United States Patent 8,067,671 (METHODS FOR GENETIC CONTROL OF PLANT PEST INFESTATION AND COMPOSITIONS THEREOF) - sequence listing, part 33

SEQ ID NO: 56716 - DNA, 1476 bp, Heterodera glycines
  Genomic contig location: Contig_ID=SeqID_5049; Location=1205..2680; Strand=-
  SCN-specific regions: Sequence locations=1-102,173-192,214-346,368 -517,546-776,857-995,1017-1349,1388-1421,1443-1476
atgaagaaaagtgtcgggatttcaaacattgctgaaaacaatccttacattatacttgtagttatgttgacagactcaacattcgaaactctaattaagaggtaaaatatcataatgaaataaattaaaaataattttaaatatatatttttttgtaatattttgtattttaccactcccaaattcccaagtccgcttctgctggtgctgacaatgcttggtctacgaagtcgaaggggcttcatatcgctcattgaaggagatttttgaagaaaagtgacatcatttttggatgtcattattaagtaatttaattttaagtttataaaacttcgatttatgtgctaaaatcaaaatatgaactgttctaaaaacttaaaaaaactgttaaaataattaaaaaaccgaaaatatgcgctataaacggaaaaaaaccataaggtgttgaaattaaaataaagtgtcaataggttgttgtttttcaaaaaactgtttttttgttgctttatttcccctgttttaatttaaaagaatttattaaaattcccttttaaattcttttttttcaattttaaatctatcaaaataaatcaaaatcgattgctaaatgcagagatttgtgtataggaaaaaccaaaaagaaagcacaaatgttcattatttgctaaataaaagaatttgttttgatctgacgtctgtttgtacatgaagcagctgtcaagtgaaccaaacaaagattttgcgaattttgttaaaaaatagaaagcacaaaaagatttaatcatatttttatttttgtgtgtaatttatttaagcatttcggttttattttattttgatttttccatttttatttatttaataatatatgtataaaaaaaagcgcgttaaaattgctataattaatcttccgaccaataaaaaaaaagttataaacagaattcacgaaaaccggaatatttcaaatatcacattaattttgacatttttcagtaaaatattttaaataattgatcaactaaacgatgatgtgcgatcaatgaagaacaaatggtttttattttttatgaagtccaattagttacggcacaaacaccaaaaaatcatagcaccgaacaacagaacagattaacaaggccattcgtgagtggaccgatattagggaggcattaatagcacaacccgtggctggtcgattcctaaaaagtagggctggtcgggaccgggaattttgacaaaaaccgggaccgggacttgccgggaccagaaaagtcgggatcgggaccgggaccaagtttttcgaccaggaccgggaccgcgagaaaagccgggaccgggaccaccgggaattttcccaatagaaaattttttgaaaaaattttgaaaatagcattataagatggaaaaaacagttttgagaagaaacttcgtcgaaaaaagaatgatccaggctatttaacgcgataaagaaataaa

SEQ ID NO: 56717 - DNA, 208 bp, Heterodera glycines
  Genomic contig location: Contig_ID=SeqID_5049; Location=6165..6372; Strand=+
  SCN-specific regions: Sequence locations=1-208
acgggcgatatcaaaattaagtttcaccattgtttcacatttcgcaccatcagcaaaacgtgacgctctgtttttaaagccgctatttgtataatcatcctggtcgacatcgtcgacataatagcaagatgcttcacagagaccctttttgacatcttctgaaaatcccaattcagtcatcatatattccctaaacgcatagtcaaat

SEQ ID NO: 56718 - DNA, 434 bp, Heterodera glycines
  Genomic contig location: Contig_ID=SeqID_5049; Location=2976..3409; Strand=-
  SCN-specific regions: Sequence locations=1-89,112-114,224-434
atgaaactatgcctattattcactttaattatttttttgatcgtcttaattaatattaattatgttgaatcagtggataaaaaattgcaacagaaaacatttgatgaaatatttggagaaaaatgggaagaaaaagaagaaaaacaacgaaatgagaagaaaaaaagagaaattattggaaaattctacaaaataagagaaaattaagcaaaaaggaagaaaatattcagccaaagaatggagtaaaattaactcaaaaatagcaaaaaaattggggacaaatcgacaatatattcaaaaatggattaaagaatttggtcttcaaaaatacaaatcaaaaactgatgaagaaaaactcacaattgtacaaaaagatgtaaaagaataacggatgatgaaaaaatgggaaaaatgcaaatttattggaaaataaa

SEQ ID NO: 56719 - DNA, 2482 bp, Heterodera glycines
  Genomic contig location: Contig_ID=SeqID_5049; Location=3863..6344; Strand=-
  SCN-specific regions: Sequence locations=1-317,339-979,1002-1058,1080- 1306,1333-1363,1413-1458,1480-1503,1525-1551,1581-1601,1641-2203,2226- 2371,2418-2482
atgactgaattgggattttcagaagatgtcaaaaagggtctctgtgaagcatcttgctattatgtcgacgatgtcgaccaggatgattatacaaatagcggctttaaaaacagagcgtcacgttttgctgatggtgcgaaatgtgaaacaatggtgaaacttaattttgatatcgcccgttgagatgatcgttctggggaaatttgattcgattttgtctattaatgctaatcgggtgctcagtagcgacggaagcatatgatgaattctcatgagattgaaatatttctatccaaacatctgacaacccgaaaatattttatcggggtttttgcttccgacaagatgcctaaatttaaggacaggcattttccgtactgctttgtggcgaatactgaccgggcgggcacgataggtgaacactgggtcgcctgttttgtaaattcgccgacagaaattgaatattttgattcattggacgattatcccaatgaatatttaagttcataccttaacttattcgaccgaatcctctttaacgatcgcattgtccaacatcaattctcagatgcttgtggtttttaatattgactatacgattcgagatgggctaaggaaagaacataaagttaaatcgaaaaatgcgaaaaagtaaatttcttccttttcattcttccgttctttctttttctaattgatttttcgaattaaaaatgctacttcgactaattttcaatgtttttccaatttctttgtcactcattttcggattttctttttttatttgccaatacattttcatttttattattttttcttccttcgttattattttcttgctaatgccaaattgcttcttccattttctaattgtgtcataaccaactccaattttcttacaaatttctttatgattttgttgccattctttggttgaatattttcttttttgcttatattcatttatcatttcaatgaatttttgtacaatttctaacttttcttcatcagtttttgatttatagcatttctttttttggagaccaaattctttaatccatttttgaatatatgttttatttgtccccaatttcttcgctatttttgaattaattttactccattcttttcttgaaaatgttcttcctttttgctttattttctcttttattttataaaattttccaattatttctctttttttgagttcatttcgttcttcttcttctttttcttgccatttttctccaaatatttcgccaaatgacttttgttgcaattttttcttttctgctccaattttgacaattaaaaataatataattaataatagtagcggaaataatttcatttttatcgtctcgaaatgattttattttatttttcttcaattaaatggcaattcattttttgaggcatttaaatgattttttttctgattaaaaaactgaataaatcattattttacttaataaaataaggaaatcctgtttaatttcaaagaaataataataataattttatcttaatgacaaaataattgccaattggtaaattaatgattaaataaaattttattactttctactggagctcattcgaaaataataaacatattttcaataaaaataaaataaattcacaatgtaaagagattttagaaaaattaaagagattttatgaaatttcattatttcagaaaattggtgtaaaacgtaaaacggccaaaaatgaaattttagcgccgaaaaatgttgaaaaagaatggaaacaaaattatgtcgaaatttgtaagaaaattggagtcggccgagacataattaagaatggaagaaacaatttggaattcgctgtaaaagaataacggaggaacaaaaaatagaaaaaatgaaaatttattggctccgttattctttttttttaattggttttgttaatttggatatttctttttaattttactttttttcgtctttttatggctttttagtgccttttttgctgttttaaaactttttttagtcgactttttggcgatttttcgtggcttaaatcaccagccctattttttttttgcaaagagatttagcccaggatgtggttttgtagatcccctttttatcataacaaaaaaattgaaatcaatcaatcgtttttggcattctgtcgaacaaaataatgccgttatgtttttctttttttggcattttatccaacaaaataatgccgcttgttgtggtaatagcattgtctgttcaatcgctcgtccatccgttttgagccgtatttgttccaatgtttgtattcgtcatcaaatgggtcaaacacactgaaaaaacgcttcggtggcagctcatgcctggtcattaagaaattaattaattatttatttaaatttttatttttaattattatttcaatggtttttagccaaggcttcaatttgaatttaatatttgtaaaaaaaagaattgtaaataaa

SEQ ID NO: 56720 - DNA, 586 bp, Heterodera glycines
  Genomic contig location: Contig_ID=SeqID_5050; Location=105..690; Strand=-
  SCN-specific regions: Sequence locations=1-16,42-55,78-108,220 -236,260-586
atgaaattattcccgctattttttaaatttattttattaatcatcaaatttgaccaatttgaagcagaaaataaaaagttggaacaaaagtcatttgatgaaatatttggagaaaaatgggaagaaaaagaagaaaaacaacgaaatgaactcaaaaaaagagaaataattggaaaattttataaaataaaagaaaaaataaagcaaaaaggaagaaaatattcagcaaaagaatgggataaaattcaaagaaaaatagcgaagaaattggggacaaatcgtttatatatttatgaatggattaaagaatttggttttcaaaaacaaataaagaaaagctataaatcaaaaactgatgaagaaaaacttgaaaatgtcgaaaaattcattgaaatgaaaaatgaatttaaacgaaaaagaaaacattcacgaaaagaatgggaccaaaattatgcggaaatttgtaagaaaattggagttaacagagaaacacttagaaaatggaagaaacaatttggcataagcaataaaagaataacggagaaagaaaaaatggaaaaaatgaaaatttattggagaataaaaa

SEQ ID NO: 56721 - DNA, 574 bp, Heterodera glycines
  Genomic contig location: Contig_ID=SeqID_5050; Location=1517..2090; Strand=+
  SCN-specific regions: Sequence locations=1-234,258-574
atgctccgtaaacccaaaaaaacttgtaaaaaatgtgagcgttgccaagaagtgcggttaatggcagaaattaaaaaagagaatgtaaaggcaggaaaatgccggggagagcatctcccaggcatgatcatagaagcccacaaaactaagcccacacaattcaaagaattgtatacggatggggatggtgtgcttgaaaaaatattggaaggtattccgagcccctacagccggaatatttttaaaaaatattgaaaggtccagcagttgtgcattgcgatgaatgtgccaatgactttgcttattataaagatttgtggaattgttcggggagtatggactgtggatggggtccgggcatctcatggattggagaagattgtttagtattgcattttataaattcttttccattgtgtacatttattcctaaaacgaaaagattacaaaatttgtttgtccattaactgcaaacggtgctctaatttcagtgaggttctaaatatatttttaaacaggaaacattactgacaacttgccctcggattcgacattgagtgcgttgtgaaaaaaa

SEQ ID NO: 56722 - DNA, 397 bp, Heterodera glycines
  Genomic contig location: Contig_ID=SeqID_25964; Location=10..406; Strand=-
  SCN-specific regions: Sequence locations=1-29,52-243,266-397
atgacactatcatccaatcatagggattcaaaacaacagcattcaagtctctgggactcaataacgaccaacattccaatcagcgggactcaacccaccaacatttcaatcactgggactcaatccaccaacattccaatcaacgggactcaatccaccagcattcaatcactgggactcaacccaccaacattccaatcgcctggactcaacccaccagtatttcaatacctgggactcaacccaccagcattccaatcactgggactcaacccaccaacatttcaatcactgggactcaatccaccaacattccaatcaacgggactcaatccaccagcattcaatcactgggactcaacccaccaaaaggcaatcgccgggactcaacccacca

SEQ ID NO: 56723 - DNA, 972 bp, Heterodera glycines
  Genomic contig location: Contig_ID=SeqID_25965; Location=143..1114; Strand=-
  SCN-specific regions: Sequence locations=1-27,50-93,115-136,178 -197,219-249,271-279,324-356,396-462,485-787,810-895,918-972
atgtttaaaattaaaacaggaagtctgtaaatttttaaacaaagtcagaaatccaatttgaattttgtagaaatctagttaaatcttaattttttcaaatattctaaaattcaaaaaattttgtatgcaattgaactaatatatacaataaaattttaaataagtattaaatttaaacttctagaagctgtaaatttcaatttgaattatgtaatactaaatcacaggtaattaaaagatatttggtaattaaatgaaaattatttaaatattgtgtgctaatttaaaaataaataaatattatatattaaaataaaataattgttgggcgaagctattataagaatacgatagtgaaataatgtaaatttaaatttattgaaatttattttttagctcaccggccattacgccttattagaagatccacatgtgtttccaagacaagagctggtaaaaaaatatatatattacagtttggtaatttgtattattaatttttagggtgagccagacactaccgtatcctactacagttacgcaccatggagtgaaaattcaaatttgaaagttcgcatcaaattgcttgatggaaagtccacccaatttagcttttatttgctgcatgacataccggaaccaaccaaaaacagtaagcctttgggtacggtagggatagtgagagttttgtaaccaaaatttcagtgggcgctaccgtaatgcaaatggatgtgaccgtaaccagtgataatgtggcgacaatgaaattcactgactttttcgtatgaatttaaaatccaacaaattttgaaatacaattccataatgacaatttttttgaggatttttagaagttaattttgcaaatttttaatggagtaattgatccggtgccaggaaaattttggaattaatttatttttcccacaaaaattctaaaaaaatctgaaatttttaagaggccacaataaa

SEQ ID NO: 56724 - DNA, 451 bp, Heterodera glycines
  Genomic contig location: Contig_ID=SeqID_25966; Location=987..1437; Strand=+
  SCN-specific regions: Sequence locations=1-19,42-210,233-286,308-451
atgagttatattttaattgaaaacgaaaaacaaaaacttttggcttttcgaatttttgttctagttcggtgcctaaatggatatcagacgcgggttctccaaccctaaaaacctctaaaccaactttaactcgaaaaaggagttataccctaaaacctgacttggcgcctgcattccatcgtcagaaataataacatttagccttctgctattttttaaaaatcattatttactcatgcaatttcaggttattatcaaaagcaacttaatgaatagacgaataattgctcagcaaaaaaggcgacagcaagaacgcaaatttgacgaaagtcttgaaagggcgcggatgagaaggggaagaaaatcgacccgcgcaaggacctgtgtccacgaagccactcatggatggatattatggaaaacaaaagattgtagcgacacattcgaaatg

SEQ ID NO: 56725 - DNA, 408 bp, Heterodera glycines
  Genomic contig location: Contig_ID=SeqID_25967; Location=1980..2387; Strand=+
  SCN-specific regions: Sequence locations=1-408
atggaaaacagtcgtcggtatatgacacgacaggagttgcgtcgtctgttagacaatggagttgcagtcgaaattgaggacaacgagataaacgtcgcacatcagcaaggattgcgcacaaattggacggattacgcggcggaaaacttcgaagcgtcgccgaattttcaaccagccgccgtttttatggaaaatcatcggcgcgaaatagcttttagctcacttcgggtcccaattcgaacttcgagtcccaataatcagaaccgggaccccgttgcaccaccggctcagaattttgttctccaaaacatgctccctcgccgtttagacaacgacactctttcatttggcggcgaggagggtggagtggaccaacacacgagaacgaactgcttggactttccgtga

SEQ ID NO: 56726 - DNA, 988 bp, Heterodera glycines
  Genomic contig location: Contig_ID=SeqID_25970; Location=261..1248; Strand=-
  SCN-specific regions: Sequence locations=1-392,414-474,496-553,647 -851,897-988
caatacaacaaaaccgggaccccattgggtacacaaaacggacgcgtcgctacccatcggacagacagccgcgccagaagcatcagcagcaacagtccaaacagagtccgatgacggacagcagtgacggggccaacccatgcgagtccgcaatgttgtcgacgacttcggcatcgatgccgtcctcgtctttctccggccccagcagctcagcttacctgattccggccggcggctcatcctctgccggtgccattacccctgcctatttttgtggtgcccgaccgtctgcctataccccggagtatgccggaggtgtcggcttgtcctctacgggtgcctataccccggattatgccggaggtggtgccggctcgtcctctgccggtgcttttacgccggcttatattggcggtgctcctgcccatgcatccgctgcctattccgctggtgcttcggcttcttccaccaaacctttgtcgatccaaattccggccttgaagctcggccctttggctgggccaaacggtgccaacttcgccggtggctatcccaactataacaacaacaccagcaacaacatgcaagctcagcagcaacaccatttatggcaacagcaacaacaccaagcgcaacagcaaaaacattttaccggcgccaatggcacaaattcgtcgcattttggcatgaggccaaatgctcaaagcattagtggcggcacttccgccggcttcatgtccagcaacaatgttggtggcacttcctctttctctacttcttcgtcgtccttccccactcccatttatggcaacacaaatgctccacaaaatgatggtggttgtgccggtggtacaacaacaaaaaagcagcaacaacaacaaccaccacaaaatcaaacaccaccaaacaatgtgccggctgaacagatggaagaggacacactgttgagacgaatgattggcattgagcagattctgatcaggatcag

SEQ ID NO: 56727 - DNA, 855 bp, Heterodera glycines
  Genomic contig location: Contig_ID=SeqID_25971; Location=703..1557; Strand=+
  SCN-specific regions: Sequence locations=1-142,196-298,328-444,574 -613,643-824,846-855
atggttatgtgcacaccttctgacatcagtgggaaaggactcttctacacaatttcgtttaaccgatcaatgataatgcacattctattgatcattattaacaatacaattgttctggttttaaaattcaaaaaaggtaaagtaaaataaatatttgaatatttcttaattaatttattgtcttaattaaatttacggtttgttcatatgttcagaaaatcagcatttctcgaaaagcattttccgctcattgctcttcctcgtctttttggaaacaattggatggctcccgtcaatttattttgcccaatttttaaaaaccgcaaaattttcaccaattacgaccacttatatcagtgctgggttcacaaccatttcaacatgcattacgtcatcggcaaatggaccgacactttattattttaggtaaaaaactttcaaattttaaagttaattaaattgcattggaaaattagtattaaataaaaaaatttaatttaattagaaaaaactaataataattaaaaattaaatttaattgaaattaataataactaaaaagtaaatttaattgtgaaattagtaataattattcgttgattattagaaattcaaaataaatttaaaattttacttttttaagtcttttatatcgcgaggaaattaatgggtttttggaaagcattggaatcaaaaagtccatcagcacgcaacaccaacaacacataaatacaatgccattaaatgttgtgacaagacataacaattggactcaccattagaagagagtcgggtcgtttcggcgccagcccaagtttttggactactttattcattgttaatctaatccaaaca

SEQ ID NO: 56728 - DNA, 660 bp, Heterodera glycines
  Genomic contig location: Contig_ID=SeqID_5051; Location=1114..1773; Strand=+
  SCN-specific regions: Sequence locations=1-660
aaacaaaaaaatcgattttttcaagtgtccgtttggggtactaaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaaa

SEQ ID NO: 56729 - DNA, 501 bp, Heterodera glycines
  Genomic contig location: Contig_ID=SeqID_5052; Location=727..1227; Strand=+
  SCN-specific regions: Sequence locations=1-125,155-291,321-455,485-501
aaattttctggaaataagcttaatagggcctagttaagctgtaaaaaaaaatttggagcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaattggggcgatttgaatgagaatagaaagagccaggttcgatgaagttttggtaagccaaaaaaaatccaaacatttaaaaatctataaaaaatttaaaaatgagaattcatgcgagat

SEQ ID NO: 56730 - DNA, 265 bp, Heterodera glycines
  Genomic contig location: Contig_ID=SeqID_25978; Location=63..327; Strand=-
  SCN-specific regions: Sequence locations=1-265
gaaaatggcccttttccgttttaatgagactaaaacaaatcgtggaagaagtttgatttcatgtcacaactttgattactgctttgaacgagatgcgcgaatcgcggagggctttgagtattggagatgcccaaggcgtcctccatattgcccaggaagagcaacagtccaaagtgcttggcaaattgatcccgacggcaaccgcttcaaaatggggcgagtgacagcaccccataatcatccacctatttttggccaacacaat

SEQ ID NO: 56731 - DNA, 1680 bp, Heterodera glycines
  Genomic contig location: Contig_ID=SeqID_25981; Location=35..1714; Strand=+
  SCN-specific regions: Sequence locations=1-200,222-310,332-939,962 -993,1029-1035,1057-1057,1237-1267,1304-1315,1471-1680
  Gene Ontology: Mol. function=SH2-domain binding; Cellular component =nucleus; Biological process=calcium ion transport
atggcaaaaccggaacactttttaagaactttcaagcatattgcatcgactccaccggaaatagtggcgaaggcgaaatacgtcagtcgtacggcgtgtgcaaacgaagcgaaggcgtgcatggacctgctgaaacaggcgcagacgtaccttcaacgagcacaggtggaggagaaagcaaattgaaacattacattatgatgataaagcctttgatattcaggaaaaggacgaagaggagcgacgacagagagaacagcaggaggaacagagacgaaggcttttggcacgacaggcggaggaggagagacgaaggcaggaggagctgaagatgaggttggagaagctgaaccaacagcgacagaaatttgtggacgagacgaaagacattctccgactgccgcaagtaaatgaggggaaacgaattattaatcccgggaaatttgcaccattttcaaccatttcaacgcattgttttcttttaataatgttcattttgcacacaaagattcgagaggaaaagaaagcacgcgtctcgacgagcagaaagaagcgcgagggcggcgaggcggaggatttcgtcaacgacagttcggacttgggcgagtacgaagatgaggagctgaggaacgccgctcggaagatgaaggtgaatgaatggtgctttaattaaggagagacggaaaataatgaaccacaattcaatcacttttttaaagactaagaaacgccccgagcaagaaatgagtggagggtcggaagaagacgacgcgacagtggagaggaggcagaagaagataaaggcggtggagaagcggaaaagggaccgcaacttggacgagcaagtgccggcacgattacggggaaaaagtgagttcgaacaagcagaaagccttcgtttacattttatttcttttcagtcaagagcaaggcctatctgtcgtcctcgtcgtcgtcgccttcccccgctcagtcgggcgcagagaaaagtggagacgaggaagagaaagaaagagacgacgaagaaatggaagtgagggcagagaaaggaggtgaggaggaagaaagagaagacgaagaaatggaagagagggcagagaaaggaggtgaggaggaagaggaagaagaagagaacgaaagagaggagagggaagaagaggagcgtgaaaagatgctagaagaaggggaagagagagaagaaaagggagagaatgagcacggagaagaggaggaagaggagcacgaacggagagatgaagaaggggaagaaaatgtgcatggagaagaggaggaagaggaacaccaaccgagggatgaagaagatggggaagagagcggaggaggaggagagggagacgaaggagaagagatggaagaggaagaagagaaggatgaagagggaagcgaaagaagagaagcgatgggcgaaggagaagaacaagatggagaagaagaggaggaggaggaagagtgattttaatttttcaggtcatcattatttatttgtgcatcccaatttttagaatttttataaattcgatttttacatttttaagtcatgtcaaacacggagcgtaagacgactaacttatttgttaggtcaattaattaccagtgaatgtgaattagtttaaacaaaaaaagtaatttggaattagaacaatgaatgcgactgaataa

SEQ ID NO: 56732 - DNA, 769 bp, Heterodera glycines
  Genomic contig location: Contig_ID=SeqID_25982; Location=169..937; Strand=-
  SCN-specific regions: Sequence locations=1-208,231-642,674-769
atggacatggacaaaatactcagtgatatgcgacaacacatatcgaatttgcaagacaaacttcacgtggcaaattctgccgttagcaaaggacaaattgtcaatgagaaaatcacactaatgaaggaggtacattttcatttttgacaacccttcaattagctccaaattgccctgttcatccatactaatcattcccagactaattaagttaatcattttataattattttcagtatcaagacaaaatcgcatcattgaactcgtgctggagagccaggaatagaacgcaattagtgcacaatttgcaacaggaaagtcgccaaatcattgcactcgaagaggaaaatcggcagcttcgatttgcactcaaagaaatggaggacggattgcatctgatcatgaacgactatcggaaaatgttttcgggttttatgagaggggaagaattggccgaagtggccaatgcccagcacaaaaaggtcaattttataaatatgtcaaaaatacaaaattttcacatgggaaatcttttctcatttatccaacatttagtaaatttgtactataacataagcgcgaaacaattctcacaacgtttgtgagccttttccgctaatagtcatttttcagcgttcgttcatttaaattttttaatttcttaaaggtatttcttgctggggtgagttacgagcaatactttggaattgcacgtgccgctgagaaatttatggcgatatcagaaaacaaagttgcagaagacgatcag

SEQ ID NO: 56733 - DNA, 396 bp, Heterodera glycines
  Genomic contig location: Contig_ID=SeqID_25982; Location=1355..1750; Strand=+
  SCN-specific regions: Sequence locations=1-30,68-96,120-163,185-396
atggtgcttctaaaatccctccttttcttcctcccattttatttgttttctttttccttggtttcttgccctcctccgccagctaaaagacagaagacggaatttcaacatgagaataaagcgaatgataacgaaaatcgggtggaagaagaagaaccggacaaagtaatcaatttatttgtatttgtttgatggattatgttaaattttagaatctatacgactttcactactcaaaatatctggaattggccgtcccaaatcccttgaaagtcagccgaaatttcagcaacgtttgagggaaatgaatgaaacacgacataaaagttcgtttttcgagggtttttttctcctttggaccattacaaaatttttatattccagcagggaaaatag

SEQ ID NO: 56734 - DNA, 115 bp, Heterodera glycines
  Genomic contig location: Contig_ID=SeqID_25983; Location=6..120; Strand=-
  SCN-specific regions: Sequence locations=1-115
atgccttcatttaatactaagaatgtaggtattgacgaagtaagaaaaagttcgcccgaagcatctgacactggtcctcgactagacttccgtatctttgcaatttttggtttgg

SEQ ID NO: 56735 - DNA, 377 bp, Heterodera glycines
  Genomic contig location: Contig_ID=SeqID_25984; Location=430..806; Strand=+
  SCN-specific regions: Sequence locations=1-41,63-326,349-377
atgaaaatggaatacgagtaagagaatttggaaatttgaatgcattttcagaattttaaaaagtgttaatatttaaattctccatttttcagttctgccatcttcggattcgccatcaaagagcaagaagaattggacaaaacaattcagtataagaaaggcacttatgcttgggaaagtgatggctcggtttggattaacggagaaggaaagggaacaaatgacgaatattactacggtgttggtgataccgtaggaattggtgttcatttaatcactggacagctctttttcacgtggaacgggcaatgtttgggttggcaaacaaataatatttaattaaaatatcggtaatatgttgctcaaaaatcatcata

SEQ ID NO: 56736 - DNA, 1605 bp, Heterodera glycines
  Genomic contig location: Contig_ID=SeqID_5053; Location=43..1647; Strand=+
  SCN-specific regions: Sequence locations=1-172,313-510,532-1198,1240 -1379,1408-1422,1444-1605
atgcgtgaacaacgggatgtcattttttatttttttcggcaccatccagcacgcatattccatcagttcgggcttcattgtctcctcattattcaatgctgtctccggcgcgctggtcaatttgatcattatttagtaagttcatcattaatgaaaattagataattatctcttttaaatattatcaaatatgtttttcaaaattgtttaaattaaaaaaaataatgtttatataaaaaaatattcagattaattcttaaatattaaataaattaaacttaaatttataatatagtaaactataataataaagatgtccctagaaaacagtgaactttttaactaaataatgattcaaatcttttgttgaaaaaatagaaattggaatgttggactaattatttcttaacgaatttttctttgaaaaagcccttcaaagtgcgagtttttcgaaatggttaaatcaattaaagtcttttttttagaaacagctttttcaaatccgacagttcttagaaatgattaaaccaattaagtacagtcttaaaagcggccaacccaacccaattcagtacaacattcctagaaacgatggacatttcttagaaaatgggtcatccatttaattagttcctgaaatacaatgccaatttgagtccttaaaaactatcattttttatcgtgaaaatttctcaatttaagccatcatccagtgctgaagaaaaaggccaagaaatggttgttgcgcattgttcagctgccaaaaccccgtgtggacgatcaaatgcttgcaacaaagcgcttgagtcaaccgcgaaacatttatggccaacatttgttgaaccgatcggagcgcgaaaatcatttcaaaatgttgcaaaaccagtggatgcaaaccagcattgatgtggccacaaattttactagtgatcagtaattattgtcgttcattggtgtggtgttttttttggttttgtttatttttacgtcagagatgtaatgatcaaaaaactttcaaaataataatttcgaggcttcaaaaattttcggaaactcagaatttccgctacatacctgatgtacagtaagaatttcattttacaaaaaacaaattttcatttgtatgtatttttgtgtacatatgattttttgcttttcgtttcaaatatttaaatttttctatggctaagattgtatcaaaaatatttttaaaaaatttcctttttaaaattaaattttcaattgaacaatttgtctaacaaattagttattcgaagagtatattttagtatttactctgaattatgaatttaaaaagcttgatttatatttgaagaaaaaaatagaatattaaaatattttcgatgaatcactcaaatttgattttatttctctttattttatgtgacaaaagaatttctctcattttcaatttcttgttgagtgaatgtgaattttgtaagtggttgtctattattgtgttcttgtgagacacatttctccgttattgtcaccaagttgaagtatatacaaacataaattcattttcccatatttaaatctttacttttcactattatgcacaattttttaatgcaacaaaaa

SEQ ID NO: 56737 - DNA, 306 bp, Heterodera glycines
  Genomic contig location: Contig_ID=SeqID_5054; Location=694..999; Strand=-
  SCN-specific regions: Sequence locations=1-106,128-306
atgattaaaaacgaggattggcactttgccaatttaagtgatgtaaaaatgatagaatggaatttgttgaaattggcattttataaaaatgatcaaggcaagaaatggaaagaaattgaagaaaaattgacagaatggaagaaggaatttttgaattcatttcaaaatgaaaggaacaattcgaaatttcaaaaaatgttacaacaattagaagaaaaattggagaaatttgaaaaagcagtgacggagaaaaagaaaagtgtctggacaaaaattgttgaaaaactttccgaaattttcgattaa

SEQ ID NO: 56738 - DNA, 395 bp, Heterodera glycines
  Genomic contig location: Contig_ID=SeqID_5054; Location=1365..1759; Strand=+
  SCN-specific regions: Sequence locations=1-143,165-168,199-238,262 -282,304-316,368-395
aattacgaattagcaattttatattcgaaaattttgcagttgataattgttgctataaccaacataaataaatatcagaaacgttacgattgtgatattaaattttgcaattgccttaatgaatatcctaattgctttcaaacaaaagtctgttctccaactcatatcttaaatattttattttttagaatatattatgctggtcagttcatatttttggagaacgttttaaagaaggataaaaataattattttattttaccgtcactagatatgcatatgtattttaaattttttattgttatgtaaacttctaatatatatatatatatatatatatatatatatatatatatttatatacataatcatatgagttggcggttttaagaaac

SEQ ID NO: 56739 - DNA, 282 bp, Heterodera glycines
  Genomic contig location: Contig_ID=SeqID_5054; Location=1248..1529; Strand=-
  SCN-specific regions: Sequence locations=1-1,23-174,224-282
atgagttggagaacagacttttgtttgaaagcaattaggatattcattaaggcaattgcaaaatttaatatcacaatcgtaacgtttctgatatttatttatgttggttatagcaacaattatcaactgcaaaattttcgaatataaaattgctaattcgtaattggtacaaccaaataaaaattaagtaaataattgtaaattaatttaataaagatttttagtctgtcactgctagactaataatatttccggctgacacttacttgcacaacaaataaa

SEQ ID NO: 56740 - DNA, 699 bp, Heterodera glycines
  Genomic contig location: Contig_ID=SeqID_5054; Location=2700..3398; Strand=+
  SCN-specific regions: Sequence locations=1-481,503-634,656-699
atgttttccacagtttccattgcaacactttttttgataaatgcttacagtttctattcaatcacggcagaagaagcgaatattggcaacattccggcaagcaatgacaaaatgccaaaggatttggcgagtgatgacaaaatgccaaaggatttggcgagtgatgacaaaatgccaagatcaggtaaagtgcaaagcgaaaggggaatggaaacgaatttgacaattggaaacaaaaagccaagcaatgacaaaataccaagatcagctcaaataccaagcgaaatgggaatggaaacgaattcgacaattaaaaacaaaacgccaagcaatgacaaaatgccaaaggatttggcgagggatggcaaagcgctgcaaagcaaagtcaaaacgaaaaagaatttgacaattggaaacaaaaagccaagcaatgacaaaatgcaaaaggatttggcgagggatggaaaaacgtcaaggtcagataaaatgtcaaacaaagacataacgcaaagcggaaataaaacggaaacgaatttgccgaatgaaaataatttgccaaataatgacaaaatgctaaatgacgatacagaattacttgacgaattcaaaggtatttttggtagaatttttttttaagtttaaatttttagcattactgaagagtgacacatataagaccaaaggagccaagtaaattta

SEQ ID NO: 56741 - DNA, 1214 bp, Heterodera glycines; identical to SEQ ID NO: 25987
  Genomic contig location: Contig_ID=SeqID_25987; Location=1..1214; Strand=+
  SCN-specific regions: Sequence locations=1-91,113-178,200-405,432 -628,655-723,745-792,944-970,992-1084,1108-1148,1170-1214
  Gene Ontology: Mol. function=heat shock protein activity; Cellular component=plasma membrane; Biological process=response to stress

SEQ ID NO: 56742 - DNA, 116 bp, Heterodera glycines
  Genomic contig location: Contig_ID=SeqID_25989; Location=51..166; Strand=-
  SCN-specific regions: Sequence locations=1-79,107-116
atgaatgaaaaaacctatggtttaattcagttgcaaatcgttcaggatttttgggtaagtaaaacttaaaattttaaggattaatatttaaaaaaaataaattttaggactcttaa

SEQ ID NO: 56743 - DNA, 259 bp, Heterodera glycines
  Genomic contig location: Contig_ID=SeqID_25989; Location=341..599; Strand=-
  SCN-specific regions: Sequence locations=1-124,152-259
atgagtactgcggacaccgtttgcatgaaatatttaggattaaccaatcgtatagtgagttcgacctacaacatgagcccatttcctgtataataaccacgtataatacaccatgtggaacaggtaaaaaaatataattaaaaataaatttggcataatattttaggatttaacccgttagatttttgtgaaattaaagaattagggagaattagcgtcaaaaattcggacaattattgtaagggaaatggaaaataaa

SEQ ID NO: 56744 - DNA, 360 bp, Heterodera glycines
  Genomic contig location: Contig_ID=SeqID_25990; Location=1..360; Strand=+
  SCN-specific regions: Sequence locations=1-334,356-360
  Gene Ontology: Mol. function=transcription cofactor activity; Cellular component=cytoplasm; Biological process=SMAD protein heteromerization
atgcgtgacgacgccacgtactttggacggccgtctgcaagtgcacggacggaagggctttccgcatgtcgtttactcaaaaatatttcgctggccggacctccacaaaaatgagctgaagcataaaagcttttgcgtttgtgcgtttgacctcaaagtggaacaggtctgacaacgagctggaggagtttattaatggatcaatttgaaacaatgaaaataactaatttattcacggttttcttaattaaggtctgtgtgaacccgtatcattatcagcgagttgtttcggttgaaggaattgagttggagtcgaacaatggaaggttggtcaagaaattgctgctacatatttcaatc

SEQ ID NO: 56745 - DNA, 1874 bp, Heterodera glycines
  Genomic contig location: Contig_ID=SeqID_25991; Location=67..1940; Strand=-
  SCN-specific regions: Sequence locations=1-5,27-186,208-1165,1187 -1273,1296-1315,1368-1383,1406-1565,1587-1874
  Gene Ontology: Cellular component=cell wall (sensu Fungi)
atgggcccaccgcacccgccaagcactcaggaagaggaccaatcatttcaacccccaggctttgaagaatttccagaggcgccatcagtggacagcgatgcggaaaagtcaccagcaacaaatgaaaatggggtggcatcgctgccaatgccaccggcaccgttaagcagcggtaaaacaccgacaaagcaaacaaacaaattggacttatcaccgcccattgcacccccaggttttgcaagtaaaccggatacggtacaaacaaatgggacgatgacagcagcaaaccgaatgacagttttaacgaacacgacagcacaaactacagcactgacacaaacaaattatccaacaaccaaaccaccgattcaaacgaatccacaaacaatttcagcaaatactcaaacaaattacccaaaaacacaaacatcggttcaaaccatttacccaacaacgcaaaaaacggtccaaacaatttacccaacaacgcaaacaccgatccaaacaatttacccaacaacgcaaaaaccggttcaaacaatttacccaacaacgcaaacatcggttcaaaccatttacccaacaacgcaaacaccgatccaaacaatttacccaacaacgcaaaaaccggtccaaacaatttacccaacaacgcaaacatcggttcaaacaaatcctccaacaatttcattgtttgtgccaacaaataatacagttgaagcattacctgcatcccttccaacggcatcccaatcacaaatattaacgcaagacataaatggaacaacatttagtagaattccaaaaccattagaaacgcgcaagtccccggaacaattaaggaaggaagtgcaaaaggaattgccaaaagatacaaaagtgccattagaattaacgccagaattcaaacagcaaaaagcagaggtgcagcaaatgttttagtatttctgctattacaaatctaccaatttttaaaaaggagcgaagaaaagatgccgaagctgcacagcttgagaatgattggaagggaaaaattgccgagttggaccgcgctcgtcaggcacttggtgaggagacacgcgccgctgcacagggccaaagcaatgacgcactgttccaaggccttcaggcagattatcaacggaagtaacgcacagcagatttaacagataaaaataatatatccatttccatccatttacaaattaagattagccgaaatgacggaggcaaaacaacgtaaagaacaagcacaacgcgacgcagccgaacaagcgcgaaagatggaaatgctgcaggcaataattattagcactttaaaaattattatcataataatattttaataaataataatttaaaaatatcaaaacaaagcaaattcttttgtgtttgtacaacagaaagaatggaagaaaaagatggacgaacttgacgctgagagacgccgccaggaagaagaagcacaagcaaacgcattggcacagtcgcaagcggaggcattgcgccaaaaagaggccgaattggaaatggctaagcgcagaattgcagatgaacaaaggcacataatttatttaaactattacattcagaaaattatggatgatttatgagaataaaattttccgctgctttacgctgtcaaatgatatttaaaaattatttaagacgggcagcttttggacaacaaaatcaggcacaaattgacgcgtggaagcgcaaattggcagaaatggaggcggaaaagcttcgaattgaggcgggagctcgccaagcggaattccaacggcaacagaaagcacaacaggaggcatggaagaagaagatggccgagatggaggaggagaagcaaatgcgagaagaagcggaaaagg

SEQ ID NO: 56746 - DNA, 580 bp, Heterodera glycines
  Genomic contig location: Contig_ID=SeqID_25993; Location=1..580; Strand=-
  SCN-specific regions: Sequence locations=1-187,220-580
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaagccaacgcagaattaaagtacaggctatagggaagc

SEQ ID NO: 56747 - DNA, 192 bp, Heterodera glycines
  Genomic contig location: Contig_ID=SeqID_25994; Location=449..640; Strand=+
  SCN-specific regions: Sequence locations=1-54,113-192
atgggcaatcattcttctatcattgatttgccttgttgttgtgattgcatttgttgtttggtaaaatatactttaaaaaatttaccaaaattttattagatgaaatttatatattcagagaatagaatgaaatttgaaaaatcaatccctaacttaggaattttatgccttattttcgatgagtttcatgca

SEQ ID NO: 56748 - DNA, 2187 bp, Heterodera glycines
  Genomic contig location: Contig_ID=SeqID_5057; Location=514..2700; Strand=-
  SCN-specific regions: Sequence locations=1-361,384-426,448-469,495 -496,518-558,580-1002,1024-1234,1326-1725,1748-1956,2013-2187
atgtacgacaccacaaccttttcacgtcaggaggcggactcacggcaggcgttcatttcgcaaaaggccaaggaaatgtgccacgattggtacgatgaggacggggcacagtaagtgccattttttgggttaaaaaaaattattggcattctgttcaggtggaatttcatccgcgacgtggagaccaacgcgtcgtgcccgtgcatggagcaccaggccaagttcgacttgggccgcttcatgccgcacccgcgctgctcgcagaccttccgcgacatcgcctgcacgtcgaccatcggtgccaaaaactgctacatgagcgtatgtttttgcattttgtcatcgctgatcagcacagcctctttttcattctttgtcagtctgatcagagatcgtgaagctaaaaaccatttctggtttttttattttatcagctgacatcactcaactttttctgcccgatcaatcaatacttttaaaaaattattttttccaattgattatccaaatgtttttctgatcagcacttgatcttagtttttttttaatcagtatgataaattttcttatctttcccccacattgatatgttctctttttttgctacgttttctgtctgatcagtcccttctttttttcccatttatattgttttgtcctaatcacccctttttctatcacctttttcagagtgatcggctgatcattgattatttattgttttccggtttcctgttttctgataaatccttttttgttcacaggcctccaacatttacggctcctattctggccagcattttgattacggtcacggctacgcctacggcgagtttggccgtgaattccgcgacgaaggcgtgcctcccggtggtgccgaaggcggcggcgctgggccattcggttacggcggttattatggacgggagaggaaccagggaaagtgggtgaagtactattagggacctaatgggcccataaatggccaatgaaaattcattgatcaaacattccaaaacatttttcatttgtccagccgttttcccacgcattatggccaagtgtgctgttatgacgaaaagggctttctgatgcagaccacttaccaggtcaatttagactcaccttcaattaattagcagaatttaatataaaagcgtaattttaaagcaaagaaaaggtgatcagagagatgggattgatctttgaaagagctcggcattcggaattgttccagaaaatgaacaaaaacatgaaaaaatattttattttaacttttgataaatttattgttttaaaataattgtaaaaaaaattttaattatcctatttttggaaaaaaagccttcgggcctttatgatcaaatgatcatgttttttaatttttttagccggttatcaaagtgattgaagaaacgccgtacaacccgggctatccgttgcgtgcctacgaattcggcacttccccttacatgggacagttcgaagttcccggactgtccgcgtttcaccacgactacatgccatactttctgtgctgcaaatttgccaagtttcgctgtcaactgttctactggcggcggccaagcagcggatgccaacagtaccaaccgccggccattggtaagcacagaaggcaaaacggtagtacatgggcaacatttaatggcatttggggggggggggggggaaatttgtgccaatttgaaatgaaattaatgcaccaatataagaaaagtgtatttgcctatttgaaatgtaagccaaaacaatagaaaatcaagcgccacggattgcactgaaatattatttgattttatatttgtaaacagtgagatatgaaagtttgtcaaggcctggatccaggcttagacttcacgaaattagttttaatttttttaaatctgttaattgtttaggaacatctaaattatctaactgacaattatattttccttaattatttaataattaacattttttaataacttgaaataaaattaaaattttatccaagaaattcagattttttatgcctaataagcctaatctgtacctgaattttgattgatttctatgtttgatctgaattaaaaaatagaaaaacccattttgtcgaaaatggctgggaacgggcccaacagatccaggaaaaacccaggcctgggccgccctgaatttaataaa

SEQ ID NO: 56749 - DNA, 604 bp, Heterodera glycines
  Genomic contig location: Contig_ID=SeqID_25997; Location=484..1087; Strand=+
  SCN-specific regions: Sequence locations=1-310,333-604
atgttattgtttctggttgctttgacgttaatttgtattgttgcttcacgatttgaagttgattatgatcaactaaccgcagaacaaaaggagcgtctcaagctgtctttaaacaaaattaatgttggttatgaccaactcactgcagagcaaaaagagaacctgatgcggtctttcaagatgattgaagagtggaacaaaacaccgggaattacttatactgtgctttttaaatattttttatgtcatgtaattagccttattcagcttgggatcaaccaattttcattgatgagcgatgcgaagattcaatctttcgttagaaggacaagggacgatattggcctcccgaaaattccgcatcgctgcggtggagactgttaccagatcaagccaaaaccgttgaaagaagaaaacgaattggcacttgtgggaaaaggtagttcaatatcaataacacttaataaaataataactgtcgtttttctttacagtggacgcggtgactttccgtcaaattgatgagagaaaaggcgagccggagagacaggcaaaatgctctccaatttcacggtttttgtcattttatggcttaatctgctga

SEQ ID NO: 56750 - DNA, 270 bp, Heterodera glycines
  Genomic contig location: Contig_ID=SeqID_25998; Location=368..637; Strand=-
  SCN-specific regions: Sequence locations=1-54,76-171,213-270
atgagcggcaccaattcctcagtcggcggcgctggcgcggcaaagcttcgcccgtccgtcgagttcctccacaccggcagctcagtaccgctgtggtcgcgcaatccgttggccaatttgttccgacgctcaaagcgcaaagaggaaaagcatcgacggattggcaccactgagcaggaggaggagggcgaggacggcgccaagcagcacaatgggaaggacggggccagcagcagcaacacgaaaagggttgacaaggcacggaaacgg

SEQ ID NO: 56751 - DNA, 250 bp, Heterodera glycines
  Genomic contig location: Contig_ID=SeqID_26001; Location=542..791; Strand=-
  SCN-specific regions: Sequence locations=1-250
cagcagctggtgttcccccgtctctctatgtgcgtcttcctcagcccgacgaccctttctatttttgcgccctcgccgttggcctcgccgcagttccgcccattacttttggcatttccgggccgcctcttcacgtttttgtgcaggccgacggcgtaactgatgcaccgaaggtggagttggaagacaaacagttgtgggaggaatttcacaaatttggcaacgaaatgatcatcacgacgagcggaag

SEQ ID NO: 56752 - DNA, 422 bp, Heterodera glycines
  misc_feature (27)..(27): n is a, c, g, or t
  misc_feature (72)..(72): n is a, c, g, or t
  Genomic contig location: Contig_ID=SeqID_26002; Location=745..1166; Strand=-
  SCN-specific regions: Sequence locations=1-422
atggacaaccaaaagcgattgtgtttncgtgcttatgttggtctaccaaatctcgaatggctcaacaatttncgagaggtggtcactgatcagccatattttcattaaatgactaattgattgatttaattgccctaaatttacgctttatttttgtttagacatttcgccatgccaccactttttcttctgtcagttacactgttcaatttactctgtcagcgtcacaaattgtgccatttgaattggtgaacgaacggaccaaagaaatgctgacattggagaaactgtcaaattatggtggtggtgaatggctgttgaagcgatgcccaattattggcgagaagaaagatgaaaattcagatgccattttgaacaatatccaatttattttttggggcggcagtaattgtatttggtga

SEQ ID NO: 56753 - DNA, 174 bp, Heterodera glycines
  Genomic contig location: Contig_ID=SeqID_26003; Location=1679..1852; Strand=+
  SCN-specific regions: Sequence locations=1-174
acgcgcgttgtgcagcaacttttttatttgaccacttcaattgacgatgctattgaagaaaatagacataaaattggtgaccaaatgtacgcatttgtcactaatttgtcgaacatttgtgaacaattgggcactgtcggaatggacaatgtaaaaatggacgaatacttaaat

SEQ ID NO: 56754 - DNA, 466 bp, Heterodera glycines
  Genomic contig location: Contig_ID=SeqID_26004; Location=363..828; Strand=-
  SCN-specific regions: Sequence locations=1-205,243-438,460-466
atgaacttctttaatctactgaccgtctttctgagcttggtcattaattgctcagctcctccgatacggtaatttcttaaatgaaagtaagttattttttttgtaaattttacaaattttcagccctttgtcatccgtcgctggcatttggaaaaagtgcaatggcaaaaatggcacaattttggtggaaaatggctgcaccaagtaaaataattgaaaaatttattatttaaacatttttaggcttcttctctgctaccaaagtgaaatggccaaaaacaaaaaaattagcaaacgttttggggtgggcaaaggaaacattggcaaactgaaatttgtggaatgtgccgaagaaattgccgaagaccaatggcacggtctgatcattacgaagcaccaagacggagtgatcagctacgaatcgaggcaaattgagagagaaaaatattttagaatatggatttaa

SEQ ID NO: 56755 - DNA, 4648 bp, Heterodera glycines
  Genomic contig location: Contig_ID=SeqID_583; Location=604..5251; Strand=-
  SCN-specific regions: Sequence locations=1-898,920-2223,2245 -2279,2301-2562,2584-2926,2950-3693,3715-4275,4302-4648
atgcaaaatcaacctcccaaacgccccacaaacttttcaattgattccattctttactcgaacaaaaagccacgccacggcttcctaatcaatcaattgttgggcgtaattcaagagggtgctggtgtttcaacaacaacaacaaacaaaactgcaaatgactacgtcaaaaaattgggctcaagtgttgaacacgttccgcgttttcaatacatcaaagtgaagaatcagttcaacattgaagatgtgcccgccaaccctgaaggactattggccggaatttttcaatactgcattgaccaatccatgcaggacagcagagagcgcgaaattgagcctacacatcttggttgtctgattagtagtccgttgttgacgagcggcgacattccaatacccattcgccaaatcaccgacaacaccgtgaacaccattctcaatcaattcaacaaagttgcacagagtaagcaacagcaaaatgttacgctttggggtgaaccgttcaaagtgatcatcacagtggttgaccgctccagccttccgatcaaaagaaacctcaaaggtggtgcacgtcggaacttggcacctgtccatcatcgtatccacgatcaatgtttgattaaggtgtgtgctccaatcaataagaaaaatcataatctatcggttaaagattcgaaatcccgatgaaaggaactattgccttttttacgctttgcaagcgacaatggtttacaaaacaaaagggtgggcccgttggaagttttacgactacctgcacagtaggcgtggacagcacggctgtatgcagtatgaaacaaccgaattaatgcggcagattggcgccccgcttggccgtgatgcatattcggcggatacttttgtaccgcgagtggttgaccactggaacaacacacagcagcaacaccattttgctgtgtttatttttggctcaacaggacagtacaaacctctgttcaaatacatcagcgctaacaacaattatgacactccaattttgctttatttcaacaacgggcactttgatggcgttcaaaaacaaggaggattgtttgggaagccctattgtttgcaatgtgaacgtccctatagcaaaccgtccgagcatctaaaatcgtgcaaagcacgctgcgcattttgctctcgcatcggaccatcatttccttgttcaccttcagctggctttttcaatgaatgtgcgggatgtaacaaaaaattccggaacaacgagtgctaccagcatcatttggcctccaattattgtgccaattcaaaacaatgcaaagactgtggtgtgatgtggaatgttcgggacagtaaccgcaacggacgtaaagtatacataatagaattcggtaaaatctaattatttcttattgattatagggacacaaatgctacgaaagttactgtcagctctgcatgtcctatcataacccggaccggggctgcttcatccagccgctgcagccaaaggagcatgacccctaccgtattgtggcgttcgacttggagaccatgcagcatcagccggtgagcgcacagcagcctgagagaagagaacaccagccaaacttcattgctgcgcgaattgcatgtcctgattgtattgataacggaaattggaagcgagcaacagccgggtgcagaatttgtgggccgtatcgcacagttaccttttgtcaacgtcgttttgttgacaccgctgtggacaagcaagtgattgatgagaacccactggcagcgtttgtcgactggctcgtctttcaactgcccaagaagcatgacacctttgcctattcccattttggcggtcgtttcgacatggtgttagtgttccgcgaaatcttccggattgggttcaaccctgagatgctgagacgggtaatcgtatcagtgacaattattaacataattgatgacgaatattcaggggaataaaatgtatgagatgaaaatccgcaaacaaaagaaaaggaacccaaacattactttccgggacagcttcaatttgatgccgtgctcactcgcggcgctcgtcccctcttatggtctcgatgtggaagagaagccatttttcccgcatttggcaaaccgcccggacaattacgggaggcagatctaccccacaccagacgattacttggccgaagggatgatgccggagaaaagacgacagtttgatgcatggtatgaacagcatcaggcagaaccattcttgttggacgaggctttggccaggtattaaataatttaactttcaaaatacaaatttttgttttgtttatacagttattgtacaaatgatgtggagatattgatggcagcactcgtcgccttccgtaaggaattttttgaaatttcgcggcgtaacgaatatgttgatggaatcgatgagcgcgaaaatcacgacggcatagacgtgttgcgggagtgcatgaccattgccggggcatgcatgcgacccttccgcaccaatcacctgcccacagaacatcttgctattgtgccggaacgtgggtacgacaacactcaaaatcagagccttcttgcacttcgcttctttcattggtacgccgaggagcacggggtccaagttcaaactgcacattcgcctggaggagagaaacgaattggaccttactcattggacgggtggattgaaacggaacggcgtgcaattgaagtcaatggtaataccatacatttatgtgtaaaagttccaattatttatttaaggttgcacatggcatggctgtaagaaatgctacccacgcgacaatatgcttctgcctaacggaaagacagccggcgaagtgagggaacgagatgccaaacggctagactatctgagaagccaattagggcgtgttgatgtgtactgggagtgcgaaattgagagaatgttggagaggagcagagagatgagacagagttttgctgaatatgttgatgacgggccattggttattcgtgacgcgtttatgggcggaaggacgggaccattgaaattgttgcacaaagcgcgcgagggtgaaaagatatcctattttgacttcacgtcactctaccctcatataaagttatatttattttgtataacaaaatgagtttattattattttagctttgtcacgagctacccaattgggcagccaaatgtgcacgtattcaacgagcaggtcgactggcacagttctaacgacaacccttacccactggctctgctgaaagtctgggttattccgcctcgacaaattgatgttccggttttgcctgtgaaagttgacaatcgcctatgctttccattgtgcatcaagtgcgccaaagaatggccaacaggaggtgttgactttgactaccactgcgaccacagtgaccaacaacgaggctgggtcagcacgtgcacatcaattgagttgaacgccgcgttggatgagggatatcgcgtcaccaaactgttccgcgtgttggagtatgagcgcagcgatgatcaactgttcagaccgtacattgctgaatttatggcacaaaaaattcaagcgagcggcttcgacaaaaacatcaaagggcagtccgacaaagaggagcaatttgttcgggaatgcgcagaaatgtttggcatatgcattgaccctaccaaaatgatcgtgaacaaaggcaaacgctcccttgcaaaattgtgtctgaataatttatgtatggttcaccttttttccgtttattctgaatcaaatttatttcagggggtagattttctctacggaactttggtctctcccaaaccctcatcaccgacgaccctgccactttggccgaatatttagacaacaaatcaatcgatgtgacatcaatcgatgaactggatactgaacacattctcatcagctacctgcacaagaaggactgggtggaagagcacgagtgctccaatattggtgagataactttataaataattaaaacttttatgatttagttatatcgctttggactacttctgccgcgcgtcttgttctgctcaaggccatgcagaaggttgtcaggtcaccgggatgtgcactattgtatacaggtaaagatggggacttccaattttgtgtgaaattctttgtttgtccacagacactgacagccttatcctggttcaccccgatgaacagtgtccgctcaaaactggtccccatcttggacagttcactgacgagtatccggagcacaacatcattgaattttgtagtggaggagccaaacaagtaaacatttttgattgacaaaaattaaattaattattaccataatatagtatggactatgcctacaacgcaaggaagcgggagcagatactgtaaaggaatatgtgctgaaggtgcggggaatgacgctcaactacgatgtcatcaacaaccaagggctcagatatgacacattcaaggaggaggtagtacgctacgcaaccaccggagactttgaaccgatcactgtcacctacccaaacttccttcgaccaaacattagggaaggaggacgggttatttccatgccaatgcaaaaatgttaccgtccatttgtaggcaaaggaattgtaggagctgaatttaaagtgatgaattttggacatactttgtaa

SEQ ID NO: 56756 - DNA, 66 bp, Heterodera glycines; identical to SEQ ID NO: 53774
  Genomic contig location: Contig_ID=SeqID_5058; Location=6944..7009; Strand=+
  SCN-specific regions: Sequence locations=1-66

SEQ ID NO: 56757 - DNA, 2054 bp, Heterodera glycines
  Genomic contig location: Contig_ID=SeqID_5058; Location=2408..4461; Strand=-
  SCN-specific regions: Sequence locations=1-191,239-317,339-833,871 -1395,1418-1423,1460-1830,1852-2054
atgcgcggcttcgaattggacggcggtgcttttttcatgtgcacggaaatttcgccacgatgctacacaattcaacaggtgaaaattgcagcaacgaaaaatggtttaatgagcggaaccgaaggattaaagaaacgcgtaattattaattggttgggacgcatcagaaaaaatgaacacgaggaaaagagaaaataatttaaaaataaatagaagatttttaaaattttgaaaaattgaaacaaaagacagactcatacgatgtatgggaatcggccactttggcgcaggccattttggcgcaagactctatatcattttgatttcacagcaaaattaaataatattggtatgattttaagtggcttgatagtgcctattaacctgcaaagtttcaaaaaatttagctgagaaacaaaaaagttatggccaaaaaacctcaaaaattgcattttcctggccattttggcgcagcgcgccatatcttttttaaaacctaatataattttttgaaattttgcaggctaataaagaacatttagacctattgattaatattagggcccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggagtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctaattaatatcaacattattttatttggtcgaattaaaaaaagttatgaatctttaaacttgtctgcgccaaaatgaccccgaccctacgatgtattgtaggtacatacatggacagggaaggacaagattggcttttgtgaaatacccccccccccccccccctctcatcagagcattttgcgaattggggaacttttgttgtctttgcaaattttaaaaattattttttaattttattttttttgaatgctgtctatgcctttaatgtgccaattcgcacttttaaaagtataattaaatccaatgagatgaaccaattagacaacacttgcataaatttacagcagtgaatgccttgccatttgttcccttttcagctcagtgacgtcgacgacgccctgaagggatttgccatgagaaggccctctcaaacggtcaatgcttcttcgaatgccatttaatggtttttgtttcagtcggcttccgcttctccgcccgcttttccttccgcgctgcgtccctttcccttcgccggtctttccacctgcgcttccaactcgcctttgccaatgcttccctggtggtttaccgctgaatgtcgccaagaacttatgggcgtgccgccgccaccgcccgatgaacgcgtgccgacgcccgacacgcgtccgccgtcgagcgtcggcgagcagccgatgagcccggaacaattgcgacaacgcatccgacgacagttggaatattacttcagcaggtccgcttcggagattgcgaaatcagtggtcgttttgaagggaaaacctggtcaacgaccgttatctgagatgccaaatggacgctga

SEQ ID NO: 56758 - DNA, 306 bp, Heterodera glycines
  Genomic contig location: Contig_ID=SeqID_5059; Location=657..962; Strand=-
  SCN-specific regions: Sequence locations=1-306
agttgactcacgaaagagccgatgagacgcagagttcatccgctggcaatggcactgagttcgggcggagtgtgccgtcctcctccgatttggtccttttggtgcgcgccccctccccttctcttcggcaacttccgtttctttcaccggtcaaaaactggggaggttttctttctccaaaacaaactgttgaaactgtgagtgcgataagtgaattctctgccgatttattcaaaacgccgtcgcccgcgcggttgggaaaacggccgattatttgtgcaaatgtgggccaactgctgaccccag

SEQ ID NO: 56759 - DNA, 897 bp, Heterodera glycines
  misc_feature (858)..(858): n is a, c, g, or t
  Genomic contig location: Contig_ID=SeqID_26007; Location=32..928; Strand=-
  SCN-specific regions: Sequence locations=1-459,482-897
atgaagggatattgctcgacagagatggaaatgtttttttttcgggagaatccaccaaatagaactttaggcgtgatgaaccaaaacgtggtggtggcggatcccaatttggagaattcggagcagctggactcgatggaaatgagacggcgccttttgaacccgaacaatgacagcgcacttggacagttgcgacaaaatgaacgtgccagccttgacgaaaacgaagaagaggaggcaaaccaaggttttatgcgaaaccgaacggattggacacaaaatttgggagagagggcaggcccaacccaacaaatttttcgaaattttgtctttggacattcccaaaatgaagatgacttcttcgatcatccaaacattagaagaacttcgactccggtcaatgaaaaccgctgtgttggggttggcccgcaaaaccttaatgaaatagggttgttagccgaacaaattgggagggtcatcgttggtcagctaaatagtgctcatcaaaatccgaacacaaacccggcactaaatttgacgcaacatggtgttgaaatccaccagcaaatacaccattcggctgtttttgcgcgtcgagccaataacataccggttcgaatgccgggtcagcaaaatccagcagcgattcaacaaaattttggtcgccctcaatctcaacaaattcaaccaccaaatttccaaccccgtcagccatatgcttggccaatgaacgaacagtgcgttcaagtgcaacaacccacaatgccgcagatgaactatcagccgcccccgacccttacacacatcaaaatcagcctaattttggcatgggaaaatttgattttgggattgtattgnagcggatccctgacctctcaggcaccgaaggatcggatg

SEQ ID NO: 56760 - DNA, 487 bp, Heterodera glycines
  Genomic contig location: Contig_ID=SeqID_26008; Location=1428..1914; Strand=+
  SCN-specific regions: Sequence locations=1-243,268-284,307-487
atgactttgaaaatagttagttctcttgagaatttgatcagattgactccggatgtccattcgattcttgtcctcgatggggacggagttccggttgtcagtgcaggcgaagaggtgcacagttcaactttggtataatgatttatttcggtgttaatttagatacgaaatcggtcccagtattcaatttcttacaattcgcttgtcgagcaggccaaaaagttgggcatgggagaacagaaattttgggtgtttcgctacgaaatgaaccaggtgagtgtcaatatttcaaatgttttaaatattttcgatgcaggtggttatgctcaggagggatgcatttgccgtattcattatggcttctgcaaatgccaatatgggaattctctgcactatgtcagcgcaacttggaccaattttggaggaatgtaaagtcatcgtaaacgaagtcataaatggacagatggccgggcaaagtccgagataa

SEQ ID NO: 56761 - DNA, 140 bp, Heterodera glycines
  Genomic contig location: Contig_ID=SeqID_26008; Location=126..265; Strand=-
  SCN-specific regions: Sequence locations=1-49,95-95,119-140
aaaaattttaaacttgatgctttattcaaagttttggctctaccagacgaagaattcgaagaatggctcagagaacttaagcttctacacaccactcgtttttgtgactgtggcaacgaaatgcgctacaaatggattaa

SEQ ID NO: 56762 - DNA, 504 bp, Heterodera glycines
  Genomic contig location: Contig_ID=SeqID_26012; Location=53..556; Strand=-
  SCN-specific regions: Sequence locations=1-10,33-412,434-504
  Gene Ontology: Mol. function=structural constituent of cuticle; Cellular component=extracellular; Biological process=cuticle biosynthesis (sensu Nematoda)
cagccaagctgtcctcctggtcctcctggcccgcctgggccccccggaacacccggcgagcccggcggcgccgggcagccgggaagcccaggacagcccggacaacaagcaccgccatgccctccgcccgtgtcgacgtgtcagaaatgcccagctgggccgtccggtcagccaggaagccaaggaccgcctgggccacccggaaacgatggacagcccgggcagcctggaacagggcggcggacaaggcccgcctggcccaccgggtcctcagggacagcctggccaacccggacaaccaggaggacctggccagcccggtcaacccggacaaccaggaatcaaaaggcgagagaatcgaactcagccaataaaaattattgaaatgttttttgtcagcacgacaattcccggcccacctggacctcccggaaacccaggagcaccgggccagcccggcagccccggacagcccgaaaacccccggaggacaaggaccgcccg

SEQ ID NO: 56763 - DNA, 1097 bp, Heterodera glycines
  Genomic contig location: Contig_ID=SeqID_26013; Location=785..1881; Strand=-
  SCN-specific regions: Sequence locations=1-200,222-639,661-727,749 -796,819-1097
tgccactttgacgcgtgttgcacaagcgcagcgccagcaacatttgagcggaaatcccaccggctcattgacggcctccgatcgcctgatgaaggagctgaaggaaatttaccgatgccaaaactacaaaaacggtcactgtttttgcatttgtactttatataatgtaaatttgccattttaaggcgttttcaccgtcgaactccaaaacgacaacctatacgagtgggacgtgaagctcaaaaaggtcgggaacactttaaaacttggatcaaacgaataagggaaaataatccaacgattatgataatgtccagagatggttccgtgtccatctcactcaatttgtttaggtggacaacgacagtctgcttgctgctgacatgcgacagttggccaaaccgccgcacaaccaagaccacctgctcttccacttcacttttgccaattcattcccgtgcgtttttggctcgtgaattatttttgaacggattcctttcaataatgcgtttttacgtttcaatttaagctttgagcctccatttgtccgtcttgtttcgccggtagttgcaaacggtgcgttaataggagcttcttgctgtcttttgtttttgagttctcctgagatattgaaatgctattttctaaagatttatttcccataattagcgatcctccatgacaagggggagaagtaaactgcacacggaatgcaatgtcgattcgattattttgtttcactgatttatttttccttttaggatttgtgcttagcggtggcgcactttgcatggaactgctgaccaaacagggctggaccagcgcgtacagcgtagagtcgctgatcactcaactcggcgcgacactcgtcaaaggcaatgcacgcatttcgtttgagcgcaacgcgcacatcaactacagcttggccagggcgcagcagtcgtttcggtcgctcgtgcaaatccacaacaaatcgggttggttgcctagtctgtctttgagtgtatcatttgcaacgggtcttatcttacgctattcccatcatttgcccccttccgattcgttaaggttggtatacgcctccaaagaacgaaggc

SEQ ID NO: 56764 - DNA, 1363 bp, Heterodera glycines
  misc_feature (1242)..(1242): n is a, c, g, or t
  Genomic contig location: Contig_ID=SeqID_26014; Location=1457..2819; Strand=+
  SCN-specific regions: Sequence locations=1-19,126-338,364-544,611 -612,668-705,732-759,824-825,984-997,1021-1177,1200-1363
atggtccgaacggaagacagatcagtcggtcgtccgtccgatcagtcgtccgttcgatccgccgccccttcgaacagtctcgaacgaaagacagatcagtcggtcatccgtccgatcggtcggtctgattcccaacgctcttagctcttttagttcccagtttggtttctgatcgcggtgaccatcatctggatcctgctctgcgcttatttgtttcttctctgagaggatacgtgagattacggttcggcttccgtttcctttgcgattttgcccttttcccaggtctttccctctatttcgtgctagtctccttcctcaccattggattcggttcgtcccttcccttccctccctttgtctaatccctttccccccagggatgtgatcccctccaagcccgatacatcattctcgtcggattatgattctgatcggattgcccctcgtttccactgttctaaccacctaaaaaagcaaatttccgcgtttggaaaaaaaagaaaaacaaaaacgaaaaaggattaccaaaaacattttaaaagggggggggggggggggggggggggaaaaaaaaaaaaaaaaaaaaaaaaaaaaataaaaaaataaatatttttttttttttttttttttttttaaaaaaaaaaaaaaaaaaaaaaaaaaaaaatattttttttttttttttgtggagaacaaaacaataataaaaaaaaaaaaaaaaaaaaaaaaaataattttttttttggggaggatttccccaaaaaaaaaaaaatttttttttagaaaaaaaattttttttttttttttttttttttttttttttagaaaaaaattttttttttccaaaaaaaaaatttttttaaaaaaaaattttttttccccccaataaaatttttttaaaaaaggggaaaattaaaaatttgttaaaaaagaaaaatggttttttaaaaaaaattttttaaaaaaaatttttttttttttttggggggttttttttaaaaagggtttttcccccgggaacccatttttttgtcccgggcccagtttaaagctttttgggcaaaaaggtgttccccaattgggggggttttttcaaattttttttttaaacaaaattttggaaaaaaaaaaattcaagggacattgtttgggtcggtaaaatttccagggcctcgggtttttttttttaaaatttttttgtttttcagggggccatgtttggattttggcaaaagtgcattngattttcactaaggcctttgccattgtggaccaattcattcgcgctcaaatggcattgccacgcggcgctggcgtgtcctttgttcgccttgaccgggacgactttcacccgctgtaccag

SEQ ID NO: 56765 - DNA, 574 bp, Heterodera glycines
  Genomic contig location: Contig_ID=SeqID_26015; Location=1357..1930; Strand=+
  SCN-specific regions: Sequence locations=1-82,104-121,143-221,243 -388,410-473,496-574
atgaaaatgttactaacatttttattattatgcgcattaattttcgaaaattcaattgatcaaattgaagctggcaaaataagccaagaaaaaagttttgctgaaatatttggccaaagatgggacgacggagcagaagaagaaaacatctgtcaaaatgatcaaataattcatggagaaacagttgatcagaaccaatatgatcaacaatttgatcatttggaagtgaaagaagaggagagtgaagaaatgtccacagattgtgatgaattgggccaattgccaatgccaacaaataatggacaaagttgtgataaattttcaaatgaaactaataaaaataaaagagaaactgtggaaaaatttcataaaattaaggagaaagttaagcaaatgggaaagaaatattcaacaaaagaatgggtgaaaattgaaagaaaaattgcaaaaaaattgggcgtcagtcaagagaaaatttacaaatggaaaaaacaattgggattgaatatcataaacagattaaggatgaacaaaaacgtaaaatattaaaacaattctcgggaggaatgcaaaa

SEQ ID NO: 56766 - DNA, 139 bp, Heterodera glycines
  Genomic contig location: Contig_ID=SeqID_5062; Location=398..536; Strand=-
  SCN-specific regions: Sequence locations=1-65,88-139
atggcagcacaatcgtcttttcctcaaagaacattgaatcaaatggagggccgatcaatttcgtcgtcagatgatgaggatgaggatctgatgaaaatgtgtggaattggagatgaacatggtcatggacgagagtttt

SEQ ID NO: 56767 - DNA, 816 bp, Heterodera glycines
  Genomic contig location: Contig_ID=SeqID_5063; Location=1346..2161; Strand=+
  SCN-specific regions: Sequence locations=1-57,82-173,195-584,613-816
  Gene Ontology: Mol. function=protein binding; Cellular component =cytoplasm; Biological process=signal transduction
cggtgtatgaatccagaagaaatatttacgaaattggagcccatcggacgaggttcattcggcgaggtgtacaagggcatcaacaaccaaactgccgaagttggatatttttttgtttcttagaatttaatgttttcctccattttggaacacataattggagagtgaaccgaatgtgttcaaaatttaatttgttcattacgtaaaattatttaggttgttgccataaaagtgttggacctggaagaagcggaagacgagctagaggacattcagcaggagataaaagtgctctcccaatgtgacagtcctttcgtgactcgctatcacggctcctatttgacggttggtccgtcacacttaaaaaattaattaagacgcagtagttcaggggtcaaagctttggattatcatggaatatttgggcggtggctctgcgttggatttgacgaaaagtggtcgcctggaggagaagcatatcgcggtgataatacgcgaaatcctgcgggggttggattatttacactcagagcgcaaaattcatcgcgatattaagggtaacatttcccccatttgccttacaattaaattttgttttcaaaataattttaatgaaaagcaaatttgtgttattgaatttgttaagctgcaaatgttcttttgtccaccaacggagacgtgaaggtagctggtaggtccccgaaacaacgaaattccttccattgaatccaattattcagactttggcgttgccggccaactcactgagacagtgcgcaaacgaatgacttttgttggcactccgttttggatggc

SEQ ID NO: 56768 - DNA, 1215 bp, Heterodera glycines
  Genomic contig location: Contig_ID=SeqID_5064; Location=134..1348; Strand=+
  SCN-specific regions: Sequence locations=1-55,77-275,300-691,713 -738,760-986,1008-1215
  Gene Ontology: Mol. function=protein kinase activity; Biological process=signal transduction
agagtttgtggaactctgcttgaacatggatccagagaatgtttgtatttacaaattttaattgtttttaattgagtcaaaatttgcaacaaaaaaatgttaagcgcccttcggcacgcgaattacttcggcacaaattcattctgacggcaaagaaaaatgaactccttcgcgacgttattgagcggagtaccgaatttcggattcggcaacagcaacaacagaatttgagcgctgattcggacgtggactccgacgttggaaatgtgctattctgttttcaaatttaaaacaaattcagggcaatgatggcactacttgttgggaatacccaactctaaaaaacacagacattttggaccatcgacaattgtcggacatcgaacgggcagtgctcgatgcagcagacaatgttgcgacaattaaggtaatcagcattaattatgggttttggacttttattttggttgccataggtttcttcttcttccgctcatcagttgcacaacaacgcatcaataattaacattgacactgtccgtttcacttcgcactcaaaagagaatgacaccgaaaatagcaatggaagtgatttcactgtgaataatgggggcacatttgtgaggcgaaaggacccagtagaacggaaagtccaaccgaatgtgaacccgtcttcaaaccgtaattttcgtgttttaatgcttctttactttacgtttttcgtcagcttcgtcctcttttacttcccatgaccattacccaccggtcgttagtgacggtgatgaaactgccgacgatggcaccggaactattcgaatcatttctccctcaaaagcggtccctccaataccacctcatcattttcatcgacaacaacaacaacaacttcagcacaaccaggtcaacaatgtgccatctacttttgttgccgatgtttcggttggcattgctccgccaccgcctccaatccgtggcgttcgctgtagctcactagagaacacactgcttcctgcactggatgagttgactcgaactcggcacggtgccgcccatttggacacaattgctgtcgcactgaaacgcgctgaacaggcaagccccgggctgtgcgatcacttagtcaccgaattgatcaccaccatggcacatccccaatgcacgaacgcggagctgcgcaaggctatcgaccgattgaccacgcgaagaaacgactga

SEQ ID NO: 56769 - DNA, 1217 bp, Heterodera glycines
  Genomic contig location: Contig_ID=SeqID_26016; Location=104..1320; Strand=-
  SCN-specific regions: Sequence locations=1-90,112-210,241-248,270 -636,658-667,706-941,982-1095,1134-1217
  Gene Ontology: Mol. function=folylpolyglutamate synthase activity; Cellular component=extracellular space; Biological process =nucleobase, nucleoside, nucleotide and nucleic acid metabolism
ctggacgacattgaccgtctgaatgttgtacacatcaccggtacaaaaggaaaaggtgttttttttgtttaaaaaatcaattaaaatccaaatttattttctttttacaggttcaaccgccgcttttctggaatccattttgcgttcccttggctacaaaactggcttttacaggtgtgggtgggtggcaggcacccaattacaaaatctaagacatgaaaattttttattttaaggaaattttggtcaattttaaatttaattttttacagttctccccatttggtccatgtccgtgaacgcattcgcatcaatggacgaccaatttcaaagcaaattttcacccagcaattttttcacatttacaacacactttttgagcacaaaaaagaggtggcaaattaataatggtgctgctgttaaaaaaaggatttggtacttttgggccccatctttatttaaattaagcaacgttaacaaaaagcgcgctgaatagtcaaaaacagcgcttcatctatttgggagtcataaaaacaacaatttgggccaaaatataatcaaatggatccgcatggcgcgcgctctttgtttgacgttttttaatttaaataaatgtggggcccccaagcggaaaagtaccaatgatttttgcaaaattagcggagttttccatttttatgtgcatttaaaaataaacaaaatttgaccatttttttatgccgctggaaactgagaaattctcgaggctccaagatcgaccagtttttgttccggaatttaaacttatttctcgagactgcggactttcaggtcgagaataaatctcgaaattcattttggtgttggcctttggggacagtccctcaagaaaaaaataataattcaaccccaatactcaaaaaatgaattttttttttggaaaaaatagcaatttttgtcccaaaaatttttaagaaactaaaaaattttttttaattttttgaaggtcaaactaatgccagcctatttcaaatttttgacactgctcgcctttcgcattttttgcgacgagcgcgtggacgttgcaattgtggaggtgggaattggcggtatgacaaaaatatttaaatttaaaaaattattaatatttatttggtttcaggtgagtacgactgcaccaacgtaattcgacgtccaattgtgtgtgccatcaacactttggacttggaccacacaaa

SEQ ID NO: 56770 - DNA, 738 bp, Heterodera glycines
  Genomic contig location: Contig_ID=SeqID_26018; Location=110..847; Strand=-
  SCN-specific regions: Sequence locations=1-64,86-274,296-738
atgccgaagaacgacctgggctttaacgaccagacaattcgttcgcgttttgtgcgcaaggtgttcttcatcgtgggcattatggtaagtgaataattgggcgactacgatagtcattgttttttttaatttaaaaccaaattgatgaacaatgatagaatttataattttttaaaatgatgcttttcaaaattttgtccgacttttagaattcagaataccgggagaagcgaggcgagcaacatctctagtccactaacttgcccgcccctacccgcctaaaataataatttttctaatttatcgcctaaaaaaaaactagttttggtacagaaaaggtctaatatttttttattgtttgttttttctgggattggttgttcagttcctttccaattccctccccattttttcagttgtccgttgtcactctgatgagcgcttttccgtttatgtgtcagccaatgatggagtttgttcaacagcatccagtatatgcgattgtggcatagtgagttttgaaaattcattcatttctcccaaatgttcgttttccaccgccacacttttcttgccaaaacaacgcgcttctttctttttcagtctcatctttatcgtcgtttatatcgtgttgatgtgctgcggccatggaatccgtcgatcgttccccattaacatcattttgcttgccattttggtacgtcgtcattttaatcgttggctttcagcataaataaa

SEQ ID NO: 56771 - DNA, 669 bp, Heterodera glycines
  Genomic contig location: Contig_ID=SeqID_26019; Location=471..1139; Strand=-
  SCN-specific regions: Sequence locations=1-669
ccaattgaagggctggacgaagccaaattcattcaattttatcggcgccgcgacgaaatttcaatcgtcaaggactgcctgatgttcggcgaccggacagtcatccccaaatcactgcagaagcaaattctcaagatgcttcatcaaggacatccgggagtcaagcgaatgaaatctttggcccgaatgcatgtctactggccaatgatggacgcagaaatcgaaacgttcgtccaaaaatgcacgtcatgcgcagctgtcgccaaaaatccaatcaagacgacactgcagtcatggccaaaatctgatggcccatggaagcgcattcacatcgattacgccggaccattccatggaaaaatgtatttaatcgtcgtcgattcattttcaaaatatccggagatttttgaaatgaattcgacaaatgcattggccacaatttccaaaatgcgctcactgatcgcgcacttcggcatcccggaaacaattgtttctgacaacggcactcaattccaaagccaccaattccaaaatttcgttaaatcgaacggaattgaacacatttttacagcgccgtacatgccacaatcaaatggtcaagccgatgccaaacaattctcgcggccgatttcatgccaaccaaatccgcgcacgtcaaattccggatga

SEQ ID NO: 56772 - DNA, 396 bp, Heterodera glycines
  Genomic contig location: Contig_ID=SeqID_26023; Location=472..867; Strand=+
  SCN-specific regions: Sequence locations=1-93,115-162,184-231,253 -369,391-396
atgatacatttgattgtacataataaaagaaacccaggacaaattgacgaaagtgatcattttgctgggaagatacaatcaaaggacataataaaagaagaccaggacaaagtgacgaaagtgatcattttgctgggaagatacaattcaaaggacataataaaagaagaccaggacaaagtgacgaaagtgatcattttgctgggaagatacaattcaaaggatataataaaagaagaccaggacaaagtgacgaaagtgatcattttgctgggaagatacaattccaaggacataataaaagaaaaccaggacaaagtgacgaaagtgatcattttgctgggaagatacaattcaaaggacataataaaagaagaccaggacaaagtgacgaaa

SEQ ID NO: 56773 - DNA, 829 bp, Heterodera glycines
  Genomic contig location: Contig_ID=SeqID_26024; Location=78..906; Strand=+
  SCN-specific regions: Sequence locations=1-332,354-575,599-829
atgtgtttgactggcgacccgatcaacgcgagcaaagcactcgaaagcggacttgtcgcggaggtgagcaaaaattctacaactagagagattaaattaattaatttttgcatctgcaggtgtttccgcctgatcagttggtgtcggaggcgatcaaattgaggcgaaaaaattgcagcaaattcaccactgatggtcggaatggcgaaacaggcggtgaaccgttcatacgaaacgacgctccaagaaggtgaggaggaggggcacagagactcatacctgtgcctgtgcaagggggggggggggtcagccaagaggtcttacgatcgactttggccctcccatgggagggtcagagcccatttccattacgatcgaccatttcttgcctgctgaagacctctttttttttgttgctcttcgggtcaaaaaaatttcatcggattgcatttccctttaagtatccaccccttaaataatcagtcctttcgctcgtgtatatgaaatttgctctttttaggccttttgttcgagcgacgacttttccacgcttcttttgcaacggcaaatattaattcatttttcaacattttttaaagccattttcagaatgaccgcaaagaaggcatggaggcatttcaggagaagcgcaaacccaactggcaaaactcatagggacagggaaaggaaagatacaaaatgagaagcggcggtcgctgttggcaaaaggactctctctgtgtgcctttcctcatagaatgtgccgtacaataattgttctttccttaaaaatcctttcaaattgtaatttctaatttatttatatcaa

SEQ ID NO: 56774 - DNA, 903 bp, Heterodera glycines
  Genomic contig location: Contig_ID=SeqID_26026; Location=621..1523; Strand=+
  SCN-specific regions: Sequence locations=1-104,126-176,198-382,404 -602,624-903
atgggtttacggacttcggattataaagcctataagtccgtactccattctttcgcagcccgtaactcttaccctttaccgtacaattttcgaatagattacggttttttaaattatttattggttgaaaaagtaaacgatttgatttattgcattttgccaaaaagtaagcaatcaattaatttaaaatgaaaccgttgttttaaatgtccccttttttttcattttcaagcgcaaatacttttccattagcgccgagtatttaaatccattttttgaatctattaattaatggggatcttgccttatgcattgatttagttttgtgtcgttccctcccccctcactgaggctgtaatttaaattactaactttagacaaactcaatcacaaacaaaattctcggcggcaataaaaaggctgacaacacttatcaccaccaacagcaaaacaaatcgtcgtcagcagcaccgtttggcggcggtctcttgggcaaaatctcttcgacaatcgcttccgctgtcaattcgacgaatcaacaggcgaatgggggaacaaattaaaaaaagaaaagaataataaatgcccaattagtaagagaaaaaagggttattaaataattttaattgataaaatgtgtcagtttcagcattatccttcaactcagccccaacaaatgtcttccggcggttacaacaatcaatcgaattatccgggaggcgcccatccgcaacagtacggcaccggaaacactggcaacgctggtggatttatgtttagggtaaaatcaataattaaatatttgatctttcatatcttttttataaatattgtataatttatggatcaattaaatgtttatttttaatagtcgaattattattgtttttggttgtcaaatga

SEQ ID NO: 56775 - DNA, 76 bp, Heterodera glycines
  Genomic contig location: Contig_ID=SeqID_26026; Location=125..200; Strand=-
  SCN-specific regions: Sequence locations=1-76
gggacccacgcgtttcggcgctcgcgtttcggcgctcgcgtttcggcgctcccgtttcggcgccagctcgtttttc

SEQ ID NO: 56776 - DNA, 426 bp, Heterodera glycines
  Genomic contig location: Contig_ID=SeqID_5065; Location=781..1206; Strand=-
  SCN-specific regions: Sequence locations=1-2,281-426
atggaggagaaaaaggagcagcaactgaagaagaggaaaaagaaaattgcagctgaacaccagcagaaacaacaacatcagcagaagcaagaacattggaaggaggagagacggaagagaaagagagtaaaatggaggagaaaaaggagcagcaactgaagaagaggaaaaagaaaattgcagctgaacaccagcagaaacaacaacatcagcagaagcaagaacattggaaggaggagagacggaagagaaagagaggaaaatggaggagaaaaaggagcagcaacggaacaagtattgctaatggatgtcggaaatcccccgccaaaatcccgaaaaataattgtcacatttttgaaaggaaaattcattcattcgatagatagcaaaccattttatatatccgatttatttatatatatttga

SEQ ID NO: 56777 - DNA, 1000 bp, Heterodera glycines
  Genomic contig location: Contig_ID=SeqID_5066; Location=338..1337; Strand=+
  SCN-specific regions: Sequence locations=1-452,474-1000
aaaagaggcaccgatttatatttgtggatttcatcatcacactctacgaatggccagccgatttgggatgtttttgttcgtgaaatttggcccattttttcgacaaacattcgctgtttgggctttaccggtggtgatcatttggaccatttgcgtcgtcgcacttcgccaacaattctcaccgatctcaaccaattgaattcaatctgttcctgtgatttgtcgcccgctgcgtttggtgatgattttgatgggccaaattcaataatttctgctggccaagcattgtccaaatggttgcactctccgagaaaagatggacaacccaagcgattgcgttgcgaagactttaaaggacaaacggacttcgattgggccaacaatttcaaggaggtgtggccataatctcgacaaatgattgatttttgtttttccaatcaaattgtttagcattttcttcgtgccaatgccatttcttccgtcagttaccaaattcgtttttatgttcatgtgccgtcaatgccaatggtgccattcgaattggtgaacgaatggacaaaggaaaagctgacattggccaaagcaaagaaaaatgaatggggcatcggttggataatgaaacgatgcaaaattggagaggccgtattcgttcagcagcagaagaaagatgaaaagtggatcaacaattgtaacaatgtgttattttggcttgatagtgacactaattgcattgggtgagctaaaaaaaggcatttaattttgttaagtaaattaaaatttcgcttaatttaggccattgtctccgccaccgaaagaagaagacgaagcaggacaaagcagcgaaaaaggggcgtcgtctgctgacaatgagtgacggacaaaagaacaaatacagtgatcagccgcagaagaaatgaattaattaagaatgatcgatcgatcgatcataattcatccgtgatcaaatgcattttatgaagaaaaacctctcaattgctaa

SEQ ID NO: 56778 - DNA, 435 bp, Heterodera glycines
  Genomic contig location: Contig_ID=SeqID_5066; Location=1364..1798; Strand=-
  SCN-specific regions: Sequence locations=1-122,227-435
atggcccttaagaaatgggccgcaaatgtccgaggcgcaaatgtcgggccgcaaaagacggaccgcaattgtcgtttttggctggtggccgcaaatgtcgtgacacgaaatcaacaacagcaaaaaggaaacagcgaagggggaggagaaggaagagaaaatgggggaaaagagagaaaaagggaggagaaaaaggagcagaaactgaagaagaggaaaaagaaaattgcagctgaacaccatcagaaacaacaacatcagcagaagcaagaacattggaaggaggagagacggaagagaaagagagaaaaagggaggagaaaaaggagcagcaacggaacaagtaatgctaatggatgtcggaaatcccccgccaaaatcccgaaaaataattgtcacatttttgaaaggaaaattcattcattcgatagatag

SEQ ID NO: 56779 - DNA, 193 bp, Heterodera glycines
  Genomic contig location: Contig_ID=SeqID_5066; Location=3112..3304; Strand=-
  SCN-specific regions: Sequence locations=1-193
ttggatgagcttcggatttgcagtcaaacagcagaacaaattggatggaacaattcgaagccgaaagggcacttatgcaattgacagtgatggaaagatttggattaatgggaaagaaacaggaataaatgtcgaatattcctacggtgcaggcgataccgtaggaattggcgtcaattctataattgcctaa

SEQ ID NO: 56780 - DNA, 922 bp, Heterodera glycines
  Genomic contig location: Contig_ID=SeqID_5067; Location=268..1189; Strand=-
  SCN-specific regions: Sequence locations=1-42,64-113,166-167,189 -235,257-268,339-584,667-899
atgaaaagctctcacaattacaaaatgatcagaagaaaattttggaaaaaatcagtgttttggagaaacagcaaaaagagcagtcaaaaggtgagggaaagaaaattaaaacgaaaataaaatttatcaatttaaatgcttatttacatttattaaaaattaattcgattttaagcaacttcaaaaattcaaaatgatcagaagaaaattgtggaaacaatcagtgcattagagcaagaaccaaagcagaggaaggtaaattaaggggtaaaaaaatatatttaaataataaaacaattttattttaaaatggattattttaaggcattttcaaatttccgacaaaattattgggatgccaattttcgtcatgagaacctccaaatcattggcaacaaaagtctcattgtccattataagagaaatttttctggtatttttataaataatttactttactaatttctcctcaaaaggttactgttcttctgcctttgcaaaacatccgattttgctggacaaaaattcgtctgacaatttttactacgaaatttcaattggaaatttgaaatggtaagagagagatttttttattttttgaatataaaatttttcagaaatattcaaattttaattattatttctttattattattattaatttttcagttggatgagcttcggatttgcagtcaaacagcagaacaaattggatggaacaattcgaagccgaaagggcacttatgcaattgacagtgatggaaagatttggattaatgggaaagaaacaggaataaatgtcgaatattcctacggtgcaggcgataccgtaggaattggcgtcaattctgttattcggcagatcactttcaccaaaaatggaaaacaattgggttggcaaataaaaatattaaatttttaa

SEQ ID NO: 56781 - DNA, 471 bp, Heterodera glycines
  Genomic contig location: Contig_ID=SeqID_5067; Location=2685..3155; Strand=+
  SCN-specific regions: Sequence locations=1-87,109-114,265-389,413-471
atgcatttgaaattgtgcctattattcttttcaatattatttttgatcatccgaactgatcagatcggatctgaaaataaaaaattggaacaaaaatcatttgatgaaatatttggagaaaaatgggaagaaaaaagaaacgaagaacagaaaagaagagaaataattggaaaattcaataagataaaagagaaaattaagcaaaaaggaagaaaatattcagcaaaagaatggagtaaaattaatggaaaaatagcaaaaaaattgggcacaaatcgcaattatatttatgaatggatcaaagaattgggattaaatcaaaagaatttttacaaatcaaaaactgacgaagaaaaactcaaaattgtagaaaaattcattgaaatgtcaaatgaatttaaggaaaaaggaagaacatattcgataaaagaatggaacaaaaattatgccgaaatttgtaagaaaatcggg

SEQ ID NO: 56782 - DNA, 275 bp, Heterodera glycines
  Genomic contig location: Contig_ID=SeqID_26028; Location=74..348; Strand=-
  SCN-specific regions: Sequence locations=1-275
atgtcctcctccaatttgatggtggccgcttcgccctacacgcgttccgcttcctccgttatccattcgcatggcgcacggttcggctcggatcagccgcaaacccaacaactgcagcaacactgcatttaccacgctgacggcagcatgtacaacaactccaccttggttgagccgggcggtgtgcacggcctgcatccgttgtccacggcgacttcctcctcaacactggtggtgaacattaacaacaataatggcactgggaatgctgccgt

SEQ ID NO: 56783 - DNA, 915 bp, Heterodera glycines
  Genomic contig location: Contig_ID=SeqID_26033; Location=30..944; Strand=+
  SCN-specific regions: Sequence locations=1-663,687-915
  Gene Ontology: Mol. function=SH2-domain binding; Cellular component =extrinsic to plasma membrane; Biological process=regulation of cell shape
atgtcaccggcagttcgcctggacttagcttctgaaatctcgacgatgcaaagattgagacaccaaaatctcgtacaactcttcggtgtcattttttccgagcatattatgatggtcatcgaactttgcgaagatggctcacttctggacagacttcggagtcaaaccaagccgcgacttttggtcacgactctgctgaattacgcccagcaaatcgccagcggaatgagttttttggagtcccgcaaatgccttcaccgggacttggccgctcgcaatgtgctcctaacccacgaagaacaagttgctcttctgtcgattcgaactacactcaaatacacccccccccctctctttaggttgtcaaaataggcgactttggactgacaagaattctcaaggacaacgaacgcctttacattatgagcgagccgaaaaaaattcctttttcttggtaagtgaacaaatttaagtggattgtttggaatagtacagcaaatgatccaccccaaaacaccctcaccataaacgctgtctaaaggcactgcccgaatttttggatttattagtagattttgcactaataaaatctttaggtctcccccagaaagtctgagatttcgtgaattttcgcataagtcgggtgggtttctttgtttgcttcttatttgttattttttctctttgctttcagatgtttgggcatttggcgtcactctttgggacttttcacttttggcgaagagccgtgggccgggcatcgtgcagctgaggttcgattacacaaaaactcattcgacattaccataattctcgtttcacatcttttccttttttaggttctccaatttctcgaaagtgaccttcggttgcgcatgcccgacttttgttcgcgagaaatttacgatattatga

SEQ ID NO: 56784 - DNA, 668 bp, Heterodera glycines
  Genomic contig location: Contig_ID=SeqID_26034; Location=361..1028; Strand=+
  SCN-specific regions: Sequence locations=1-300,322-645,667-668
atggcgattgtgccgtctctgctgatgctcgaccagaaacagtacggccttcccctccccggtcagcaaaacgagcgtaagaattcattcaaactgaaaaggggacggacccctcttctcctcactttcagtcgcaaaccctttgcaaatgccgaatgaattaactgaccaccaacgaaaagattgtggtcagaaattggctgcagaagcaactttggcaattggcagcagagggaattcggcaaatgaactcaattcacatcgccattcgaccgccatcgaatggctttccgatggacaaagccaacaaatgggaacaaagcaaagtcaaaaaaggatggagcacaaatgcgcctcattgccacaaaatgaaattgtcgctgtttcaaaatcaagtgggaacttaaattaatgcatctttttaatggattttaagaatacgacagcgcaatttccattcctcggcccaatcgcttttcgaactttcagtaaagtcaaaaattttttttgtcatccattatttttatttagtttaacacctccgtccatttctgtcggaaattttccggttggcattggcgaaaaaagtcctcaaacgatttcactatttttggagcccaaaattaccacggttgcatagatgccttctgtcatttcgacttcaacca

SEQ ID NO: 56785 - DNA, 532 bp, Heterodera glycines
  Genomic contig location: Contig_ID=SeqID_26035; Location=383..914; Strand=+
  SCN-specific regions: Sequence locations=1-261,300-350,373-442,464 -499,521-532
atgatcaagaaggaaacagaaagaaatggactatttaaaaggaaaaaatgtttaaaaaataaaggagatgtccttatggttttaaaaaagggctcgattatatgcatggtaagcaaaatttaagaggagaggaggtggaaaagtcaatgaaatatattcaatatctgcttataaagcgcgtttcgctagctcagctgacgccgttatatgtgcagtggtggaatgatggagaaaaagcgcgccaattattatatagacatcaaatttttaataataaatattaatgttattattattatgactatgtaaaaatgctgttttgtggatgatacaatttcgcaatgtcgccgcttttattatataaatatctcagtacatgcacattatgacagctaatgattgtctaaataaaaccgggatatttgaacagccaagatcgggatttggaaatgatcaccagcaggaatcaaatcccgatttgccagggtttgagatctcggattttttcaaaaaatgttttgatcatgcatga

SEQ ID NO: 56786 - DNA, 654 bp, Heterodera glycines
  Genomic contig location: Contig_ID=SeqID_26037; Location=388..1041; Strand=-
  SCN-specific regions: Sequence locations=1-198,220-223,368-654
atgccgaaatcccgcttgccaatgagcccttcctggcggagcagcagggagacaaaaaatgggcggccaaccgtgaaccgttggtggagacaatgcgcgtccacgaggtgggcacggcggaccaaaccgtggtgaccattcactttgatgacaaaactccaaatgtcgggctggaccacgacttggacgatgcgcaggtggacattatttttataacaaatgctttaattttaaaataaaatgtcaacttttaaaaatcttattttttaaagtataaaaccaaattaaattgaaaaaacaaaaaaacatttttattttaatagatcaatttaaaaacaagtgaattcaaaattaataaaaaaataaacattgtcaataaatgatactaatattttacatttgcatcatcgaaatgcattttttaccattttagttttattaaatttaaattaaggttttccgaaccccgttggaccaaccgtgtgccgaaaatttagtggttcgaatcgaatttgcgcgagatactgtcataaaggtgaaattcaaacttaattttaacgctaatttaattaattaaacaggtcacagacgcagaacgcaaagctggccaatttgagctgctttatgacagcgcaagagaccaagtcattataa

SEQ ID NO: 56787 - DNA, 2574 bp, Heterodera glycines
  Genomic contig location: Contig_ID=SeqID_5068; Location=210..2783; Strand=-
  SCN-specific regions: Sequence locations=1-76,101-348,393-926,950 -983,1005-1725,1748-1759,1784-2147,2185-2282,2333-2439,2462-2473,2563- 2574
atgttgctgatcagtgtccatgtcgagcagggcgtactccgtgttgatttcccgaaccgaagcagccctgtggaggtaattttttaataatttttaaattggcaaaaaaatcttggcaaaatgttcattttttttgtaggtaaatctgaaggaagtggaagagcgaaacattgtcctacgagcaaagtaagttgtttttggccacagcaacagaaaggtggcaaattttaaaatcggaaaacgtaagcctccataaaagtgaggcagtaattttgcctcgggggcttggtcaaatggaaggatatccttacaatagaatagcttaagtgattgttttctattagatgcaaaatttaaaaaaaaataattctattttttttgaatttttttttcttcattttatttcgaaaaaatttttcgtttattttcaaaaaagttttgcagaaaaatccaccgtctcgacccaaagactgtcgagaatcggtaccaagaaacggcaaaaccccggaaattgacccctcaagggtcacaatttgagtcttaagacatggcttgccaaaaaaaccagctggagataaagaaaaccaaagaaatttcctcgagagttcgctctcgagccgagtcccgagggaatttgcaattatttttttttttggttgatcaaatgccatgccatccatggtttttggtggcatttattcctatctaaaatggactgactttcgggccctcgctaaaggaattcaacggaatgccgagattctgctgaatccataaaaatacacaaaagtcacccgaatccgccctttaaatttctcgggtgaaattcgggactgaatttttgccgggactgaaaatgccggcactcattcggctgcatcgtttcctttcgtcttttcacacctcctctcccaactgcatgttgtctcacacaaacaaacacacaggtcttggcccgcttcccagttgagaatggtcggcttgggcccaggaaattggaacccgtcaattcggcgccgcccaaaaaatgccagggaccaaccatattggcacaccttttttcaaaaaatacaaaaaatgccattttttgactcccaaaaccggtttttagactgttttctgacctccaaacggatgggttggactgtggggatgaagtggccacggctttggacgagtttttgttggagggcaaagcggcggcgacgacgacagaggacggtagtggtggtggtacggtagggagaaagctgcgcctgatttactacggtggcgactggctgtacacggaacgcgacccgaagccggacaagagctggtggtcgaacaacccggtgccggatgtgcaggacaaggtgtggcacaacaaaattcataccaggggatgtgccaggttagccgaaatccggttttgttgtctccactcgaaatccaatccgaattttcttcggtcgttcacagacccgaaatttgtctctacccgaaacccgaaaacgcgaagtccgacttttttttctcgagactcggaaatacctaattgtacactgctgggtacagtaaatccttagctccgtggaaattcttcaaaaaaaaaaaatgccgatcgtccttggcaattttccgtaatttaggcaattcaaaaaactgaactaattaatcattcattacccctcctactagccctatttactgttcaaactgattttggcccgaaataaacaacaatttttgtgtatgtatttttgtggcatttggtcgaattttggaaaattgtttggcaaaatttgttaaattggtccaattattttctcttaaaattcttgtagtataaaagtcaaattctatgtgaaatcattttgatagcgagccccggacccgaattcgaacaaagaaatcgaattccaaattttcgaaattagcctttttggttaaaaatcgatttaatacacggaaactaactgaaagccccatcaagcctattttgaatcaatagtgcctaaatgcgaacattttggttttccactttttgttcgaattcgggtctgggattcggaattggtcgaaatggataccggattcgtggtcagtgacctcgaaaatgcagggaacttgtttttatgacattaaaatttgcactgacgcattttccgggagccccgaattttccccctgtttttgttttgcatttgcacttttcagattgcttatatggacttgaccgggtatatggcattttcatccgcctctgtcgacgacctcaatgcccatttggcctcacaggcaaaaaataaaataaaatattttaaaattaaatttaaattttcaaaatttagcaaatttcggtggatgcgcgacattttcggccaaatttggtggtcggaggattgccaccatttgacgaagaccggtggctttatgtgcgcgcgggtgaagctgaatttgtgtgctataagccatgcactcggtgaatggcaaattttaacatttaaaagaatttattaaaattatgttcgattattaattaattatctaatttataatttaaaaaaaaattatttataagaaaggaataaa

SEQ ID NO: 56788 - DNA, 317 bp, Heterodera glycines
  Genomic contig location: Contig_ID=SeqID_5069; Location=1718..2034; Strand=+
  SCN-specific regions: Sequence locations=1-27,49-154,177-225,249-317
atggaaaatttcttccgttttgtccaattggcaaacacttttggcttccaatttgatttggaccaaaaattgttgcgatggaattcgtcgacagtgccaacaatggtgcctgaagaagaagaagcggaaatggatgccaaaacggcacaatgccaacaacaccaacagcagcagcaaccgatggaaatggaaactgatgagccgactctgatcacttggactgatcagcaacagcaggagcagcagaagagacaacagcagaggcgaaaaggtgggcagacaaattaaaaaaaacgccaaaatgagtgccaatttaa

SEQ ID NO: 56789 - DNA, 331 bp, Heterodera glycines
  Genomic contig location: Contig_ID=SeqID_26038; Location=1425..1755; Strand=-
  SCN-specific regions: Sequence locations=1-129,151-265,287-331
atagaaataattaagggctcggggtgtccgggggcttcttacaccggacacacggttgaaaatattgtttcgacctttaaattcggacatgaaattgaactgaacgagtttcgaaaaaatcgtcgtgccttttatgaacccgaaatattttgcggtttaaatttcaagcggggtaaaagcatgacagcgttaattttctggacttgtaaagtcgtaattacgggaacaaaaaacaattctgaaattgatgaaatgtatcattatattcttccctatctgaaaatggctcaaaagaagttagggagacgataaaaaatttttcatttattgg

SEQ ID NO: 56790 - DNA, 62 bp, Heterodera glycines
  Genomic contig location: Contig_ID=SeqID_26039; Location=35..96; Strand=-
  SCN-specific regions: Sequence locations=1-62
atgccgggaaacaaaccgtgccgtgtggatgaaaaacacatatccaaaccactaaaacacat

SEQ ID NO: 56791 - DNA, 430 bp, Heterodera glycines
  Genomic contig location: Contig_ID=SeqID_26041; Location=256..685; Strand=+
  SCN-specific regions: Sequence locations=1-46,70-176,219-285,307-430
atggcagcggaacagcagatggaattggacttctcaactgacggcaacaacagcgagccatcactggccggtgattttgatttaaaaaatttaaaaaagttcaaaatgggacagaagaaaggcacgcgtcagacaatcattagccatcaagtgtggtgaaatccatagatttgctcataaattatcataaataagtttttaatttttaagaattaaaacggtctaaaaatatggccattttttgaaaaatcctctattagaacggccccatttcaaagcgaaaattgaaaattttagctttatttagtatttttttagcagcaattaaggcattttgacggtattttgcgatttttaagcacttaattggcaacaaaataaattattattctaaataaattctgttgcagctcgtattgtcggaagttga

SEQ ID NO: 56792 - DNA, 1114 bp, Heterodera glycines
  misc_feature (43)..(43): n is a, c, g, or t
  Genomic contig location: Contig_ID=SeqID_26043; Location=545..1658; Strand=-
  SCN-specific regions: Sequence locations=1-162,220-224,246-577,607 -655,679-1114
attcattttcattatgaaattatttcattttcagtaaatattnaggaaaaaattaacttagattgtcctccacaacttgtgccggtgcctggcgaaggcgctacaccctacagatattgctctccgtcggcaccaattaacgatggcattcaggtccgagacatattatatttataatagtattttttaatgtttaaattgtatttttaataaaataatcacatataataatacatatttgaaaaagggatgcggtataaacagacattgccaatactcaacaacactcgaacgctacatttgttgcggacttgagagcgatgtccgactaccaagtagccgggggggtttatcggtggggggcaattcggtttccgcttttaggaaaccataacttttttctttgatgacttacaagactaaaaaaagttatgacatgcggcgccaaaaagccaagtaaaatcaattttttgagcttttttggccataacttttttgtaaagcgacccaattttttttactaataaacagaaaattaagaaaaaaatgggaaatgaatgattctctttaaaattctacttaaaattttttaaatttaacagaaatctctagtgaaaggacatcttttttttctgaaacaagttgtcaccagaaattttaattttgtttttaaaaatatgctgtattcttggaaagcttaatattttcaaattacctgtaaattgtttggtacaaatgttgattatgcttggcaatgcaaatgtccgtgcctgcggcgcaaataatgcgcgaaaaattaaaaaaagctgtctcattaagtattttaaattgaatgcatagtgaattttcagatgtatgtccgcctcaaccagcaaatcttgttcccgttgaattggccggtaactaccgtacctgtaatccatacgccaggtccggcaccccacaggtcagtgattcctttcttcttatttattttcttcacattattttaacgcgtttttaaatcaagaatttttgaatttttaaggcctgcccagagaattctgcatgtctgtacacaggccaagacaatggctttatatgttgccgagtgcagctgcaaagttcgcccttt

SEQ ID NO: 56793 - DNA, 945 bp, Heterodera glycines
  Genomic contig location: Contig_ID=SeqID_26046; Location=130..1074; Strand=-
  SCN-specific regions: Sequence locations=1-238,260-884,923-945
atgtgtgagttgcgttcggccttcttcaaaccattgaatttggaaaccattgaagaggaagcggacgttctttcgcaaaattcacgcgtcaatttgaggaacggaggcaacagacgcagcggtgtctattcgaggccactcagccaaacgaatacaattacgacgtgagtaaacacacaaaaacagcaactaatgaattgatcaattgtcgtgttttccttcaaatttcctggtatcactttaatttttcatttgatttccctccaataaatgactgttttgattagcctttttcattcgtttagttatgacactcagcacgacttgttggacgtcaaaagtttgacgtatcagaacatgaacaccggaaacagagtcagcggatcgttgcgtttctcaacgcttcgaagtgccctcggcattggcataggcgtggacaaagggtcaacaattaccacgaacaaatcgtacgcctttccatcacggaaaataagaaaatggaaccgataattttaattgagcatatcataaaacagttgattgtaactttttgaacaaaggaggagaagttcggacaaatgggaaagcaattactattacaacgattacgacccgacagacccaatggacatttatctgacgaacaatccaccaaaggcaccgaaacgaacgaacgaaaagtatgaattgcagcgtaaatgggaggggaggactactctagcctaaaagtccaaaaaatagtctttgattattgtcccaggtcataattagttgcactacctatttcatttttaccaacaaaaattgaaaaatacttacattagcatattataaaatgtttactctttcaaatggtttggttttccgctttcctgcgtcaaacgttattattttgaatttaaattttgaaaaaattaaatttggcgttttgttttaaggaataaa

SEQ ID NO: 56794 - DNA, 826 bp, Heterodera glycines
  Genomic contig location: Contig_ID=SeqID_26047; Location=830..1655; Strand=-
  SCN-specific regions: Sequence locations=1-592,623-826
  Gene Ontology: Mol. function=transcription factor binding; Biological process=development
atttcgttcaaacggaaagacaaaggcggactgaatttgaccactttggtggggggggacacacacagccgtcaatttattggcatttccaattcaaaggtgccccaatcggagttggacacggacactgtgaaaaccattctcagcgaatatcgcattcacaacgcggacattacgctgaaatacgacgcgaccacggaggatttgatcgatgtgattgaggggaatcggtaaaagaagagattcgtcattgtgcatttttaatggatggatttgctcacagaatttacattccctgcatttacgtgctgaacaaaatcgaccaaattagcgtcgaagagttggacattctttacactgtgccgcattgtgtgccaatctcggcacatcacaaatggaactttgacgatttgttggaaaagatttgggcctatttgaatctgatcagagtgtgagcgagggacccccttctgactttttgatttatcagttaataatttaagttatacaaagccaaagggccaattgccggattataacgcaccgatcattttaaacgcagaaaaaaactttctcgacgatttatgtaacgtttaatttatttaaatacatattattaaatgaatttgctaattaaggtatgaaaattcacaaaagtctgtcaaaggacttcaaatggtaaatttttttttgattttgtgaaaaatcggaaggaattgttcgcttaagtgccctcgtctggggaagcagcgtaaaacacaatccgcaaagtgtgggcaaaacccatttgctgaacgacgaagacgttgtccaagtgatcaaaaag

SEQ ID NO: 56795 - DNA, 1619 bp, Heterodera glycines
  Genomic contig location: Contig_ID=SeqID_5072; Location=923..2541; Strand=+
  SCN-specific regions: Sequence locations=1-206,230-1619
atgaaacgcccaatggactcaacagcaactccgccttcttccaaaaccacacgtatttccgcggacgctttggctggacaaatcgactcactttctgctgcagtcaacgcactgcttgttcaggacgacatttcacaggccgtcaaacttcagtttggcgttctgcttactaccctccacacgtgccaacacgtcatcgatggtctgaacaacaacgcaaacaacaacagtgccgaggaacaggaacgccgccgttccttggtcataatcggtcttccggagaacccttcagcccgtccttcggagcgtgttcgagaggatcaaaaggttgtctcggggattttggacgaattgggtgttgaggcggtgccaacgacgacctaccgaatgggccgtcctgatgttcaccgtgcctcgccacgcttggtcaaagtggtgctgccggcctccgtccatcagcacattgcactcggcggttggaaaaaggagcgcactcgcctccgttctctgccaaactggggccgtttgctgattcgcccgtctctcagccgtgaacaactccaggcggaatacgaacaaagacaggccaaacgcaacggaatgaccaaccatccgccacgtgccaacaatgctagcgccatttcaaaccaactgcacgaacttggacaaaaaatgcagcaaaattttcgatgatttcaaggtttccggggtttgtgtgtaacgaaacccaatttcaaaaaaatttacaaaaattttcaacacacacaaatcccaatctttctttttttgttgattcatttgatcatttttcaattcgatctcatacaccatcatttactttttctaggacaaaagccacttctgttatttcaaaatataatcctgaacttcacagatctccaacaatttcagacaataaccaaaatttcaatagatcaattccagaacaaaaatttataggaattttatcaaatgttcgatcaattatgaacaaaattgaccccctcataaccacacttaatattgaaaaatataattttatagtattagtcgaaacatggttaacacctcaaaattttgatattttacatgcagcaattcctgaaaactatcaaatcttttcagcccttcgtgaaaacaaacgaggtggcggagtttcaatcttaatagaaaaaaaattttccgtttattcagcctttgcggaatcagtttttggatgcgaaattgttacattgaggcttaaaaatctcaaaaatttttccattatcggtgtctaccggccccctagcacttccctttctaactccaaaaaattctttaactatattgaagaaaaaattaaaggacaaacactaatattgggagattttaatctaaatagtaaaagcgttaaatggcacaataatacaccagccccttttaacaaaattggacattactttgtcgaattctttattaaaaatgaattatctttgcactgccaaacaccaacaagaggtacagagatgttagacttatgcctgacaaatgattaccgattatcacttgaaaccgaaactagggatagcttgataaattctgaccatgaatcgatctatctcaacctatctatctctcta

SEQ ID NO: 56796 - DNA, 2339 bp, Heterodera glycines; identical to SEQ ID NO: 5073
  Genomic contig location: Contig_ID=SeqID_5073; Location=1..2339; Strand=+
  SCN-specific regions: Sequence locations=1-369,391-528,550-892,914 -1418,1440-1538,1560-1671,1694-2339

SEQ ID NO: 56797 - DNA, 708 bp, Heterodera glycines
  Genomic contig location: Contig_ID=SeqID_26049; Location=476..1183; Strand=+
  SCN-specific regions: Sequence locations=1-166,188-445,543-657,684-708
atgcagtaaaaaaaagaagttttgagttcaactttctcttccactactccgacgagtacttcgaccaccaccaataaattgtcctctacgcctcccgcggaaatcaaaaataaattgcaatgtttggcatggaatatttgcaatttgttagtttatttctaatttgaaagttaaaatttatcattttcaaggagcacgaaattgaagcagtcaaaggtttcgcgacggtttttaattggtcaaaactgcgaggaaatggccaaagactggggacagattgaagaagatgaaaaaatcggagatgaatacgaccaaagtgccgacgacaatggccaagtgtttttgacggattttttcgttgggcgaattaatgcaaagatttaattgattttctaacaaaaattcaatttgatttagtttaattgaaagtagagtgccacgggaccgggaccgggccgggaattcccggtcatccgaggtcccggttcccggtcccgggttttgaaaagctcaggtcccggtcccggtagggcaaccgggaaaaacaagcactggtaagaatgggggtctgacaaaggaggggtcggcaagtgaccgtgggatttccaaatgaaatttggtgggtggattcgcaccaggttcgaatccgctatatgcaattttttttttaaatttttatttttgctttttattttggtacatatgata

SEQ ID NO: 56798 - DNA, 57 bp, Heterodera glycines
  Genomic contig location: Contig_ID=SeqID_26049; Location=953..1009; Strand=-
  SCN-specific regions: Sequence locations=49-57
tgccctaccgggaccgggacctgagcttttcaaaacccgggaccgggaaccgggacc

SEQ ID NO: 56799 - DNA, 1060 bp, Heterodera glycines
  Genomic contig location: Contig_ID=SeqID_26051; Location=257..1316; Strand=+
  SCN-specific regions: Sequence locations=1-27,49-211,233-664,686 -800,822-1060
gagtgtgatgtcagagaggaattgaagaaaaataaggagatgaaaaagttctttgaaagtgtgccggacaagggaccgatcaatccgagggatgcttatgctgggggaagaacgatgccattttgtttgtacgcaaaggctaccgaagaaattgagatatcaatgttcgacatcattagtttgtacccctttgttaattatggtaaaaatctgcttaatttttgttagtttcctttcgcttcagacaccccataccccgttggagtccctaaaattgtagtgagcaggaattttaatgtgaattggacagcacccgacgacgtaccctatgatggacttttgaaagtaaaagtgatcccaccgaaaaatcttttgtaccccctcctccccgtgcacatcgatgaaatgctcctcttccctaattgttggtcttgtgcgagaagggccaagaatgaatttgtgatgacaaaagatgtgaaaaaatgtaaccatcgtcccacgcagagagcatttttggggacattcacatcaattgagttgcggaaggctttagagctaggatatagaattgtgggattctatcgagcgtatcattttgaacagtttgacagtcaactgttcaaaggatatgtgcggatgtttttgaagataaaggtggaagcgtcggggtggccggcggaggtgaaaagtgaagatgaaaaaagagcattcatcgaaatgtacaaggcaaagtatgacatcggtttggattatgataagatttggtttaatcccggactaagaatgattgcaaaattggtgagaaattataaaaaatctttaaaaaatgttcgaatttaagggattaaacagtttgtggggaaaattttcgatgcgcaacaccctttcaagtacggaaattgtgggcagcatggaacgttggatggaattagggagagacaatacaattgagtttgggcgcccagtaaaaataagcgaagagatatcaagagtcgtgtaccggaaaaaggaggagttcatcagggagcataaagtgtcgaatattgttttgtcattgtga

SEQ ID NO: 56800 - DNA, 752 bp, Heterodera glycines
  Genomic contig location: Contig_ID=SeqID_26053; Location=213..964; Strand=+
  SCN-specific regions: Sequence locations=1-558,627-676,712-752
atgcgaaaggcaacgccgacggcggcggcgctcgccgacgacgaggacgaggagagcattgagtcgcgcgtcgccaaagtcgtcgctgtgcccccggcagtgcctgcggtggccgtggccgccccgctgtccctctcccgtctttgctgttgttggctttggcatcggcgtttgccatttgtcgccgttcccatgggcatttcctttgcatgtgccatcataatgttgtccatcagctgcagttgttgccgcggcggtgacacttcgccacaccaatcgaacgaatcgcagacgcgcacggacactttctgccggggggggggggaatttaagagttaatcattgcatttcgaactcatagaatagactcgaaatttttaaaattaattggaggtaaatgaaatttgcactggtgacaaaacgtgcaaaaaaatgagaaaattaaaaataaataaagaccgaaaaatataaaacctatgagaaaaaatgagattttgcagcacaaaaagacatttaaataagggtggattccattcccggccccgccatttccccacgaaatttaaatttctaagttttataaaaaaaaatttatgaaaatttcaaaataatttttttgaaaaaaacgtgttgttagaattcattaaattttggaaagatcgccagaaaatttcgcattattttttctttaaattttcttataaaaaaattcgaagattttttataattttagaacggaagagatatggaag

SEQ ID NO: 56801 - DNA, 88 bp, Heterodera glycines
  Genomic contig location: Contig_ID=SeqID_26054; Location=875..962; Strand=-
  SCN-specific regions: Sequence locations=1-88
atggccggacgatctgatcgaaattgtgcacgagccaatgggccatacattggacagaatgcgacgcttcagcacttccctctccaac

SEQ ID NO: 56802 - DNA, 304 bp, Heterodera glycines; identical to SEQ ID NO: 51570
  Genomic contig location: Contig_ID=SeqID_26056; Location=276..579; Strand=+
  SCN-specific regions: Sequence locations=1-304

SEQ ID NO: 56803 - DNA, 857 bp, Heterodera glycines
  Genomic contig location: Contig_ID=SeqID_26057; Location=62..918; Strand=+
  SCN-specific regions: Sequence locations=1-23,78-393,426-607,673 -705,729-791,814-857
atgacaaaattcattcaaaaaggtaaaaaaatatattttttaaattcaaaaatttgtccaaaaaaaaaaattttaaagacgatttttgagaaaaattttttcgattcgtagggggtgtatttttcgtttttattgcatttttgttaacaaattttcggcaaaacgacaaaataggcaaaaatagactctttcaaaaattttttaggctttaaaaataaagcctagaaaataggcactaataactcgaaaagtagctaaacaacagcccaaaaaaacatgtttttcgtgcgtttcaggccacggggagctcaggaaaaaataggctaaaacctaaaaattgcatccctattaataataattagagaccgacttttgaggcatatgaaaagcaactttttaatattaaaaaatttttgataaaataaggaattttctgaaattttctttgggtggcggcttgaatatacggcatggaattcatatcaaattttaaaattacccgtcgaaaaatcgcactttccgtcctttggacacacaaaaaatttctgcagtgaaattgtacgccgaaaaaactgtttacaagctaaaagatagatttaacatcttcttttataaaataatattttaaatatttcagcaataaaaatttcatattatctttttataatttaagcgcttttttttgatttattttcaattttattaccttcacaactgagcacattgtaatatttaaaggtgcaaactccgccacaaacggtacatattctgttttttgttgcttttattgtgttcaacaacattttcttcttgaaacatcgttggaatttaatggaatagaaatattaatagagaaa

SEQ ID NO: 56804 - DNA, 281 bp, Heterodera glycines
  Genomic contig location: Contig_ID=SeqID_26057; Location=1434..1714; Strand=+
  SCN-specific regions: Sequence locations=1-140,162-281
atgagtcccaaagatggcactgagttgccaaagctcactcgaaacaaacagaagagccgattaaatgctcacaaaggaagttccccaggtccccatggggatttccgaatgaaacgtggtgggtggataaagcacccatgggttcttaagaaaaatgtttttattttctgccaaataagcacgagtgccattatgacatgccagagttttttaatgaacaacaaattaataattttatttgcacctttacagtgtacaatggtgtagctgcagtgcgctag

SEQ ID NO: 56805 - DNA, 808 bp, Heterodera glycines
  Genomic contig location: Contig_ID=SeqID_5074; Location=623..1430; Strand=-
  SCN-specific regions: Sequence locations=1-47,70-104,135-565,587 -721,743-808
atggctcctcgtaagcagaatgagcagtttttggacgaaatccagagtaaattttaaaataaaacacaaatataagcattttatagaagcgaaccacgtggaagaagcacaaaacaaccaaagaaaacataaaatgggtaaaatttttcacaaattttacaaaaattttggattttttctcatttttccatgtttcagatagtgatgatgacgtcaagttggttgactcgcagtcatctcacgcagaggaacgtcctgcgctcaagaagaggggccgaaagtctcgctgggaaaaactgctggaggacgtgaacaacgcaaagaagtccaaccccgcagaggttgaagtcacagatgtcgacgaacgcaaagcagccaacgtcttcgactacccaacaattttctggaagctcgcacgcccaaaggtaatgtttgctctggtggcagccctacaatgttcttcttctgttgcagtatggggtgttcacctttatgtgcaacgaatgccgtaacgaaaacttcaagcgaggcgacaagcgcttcatcctcaacactggcagtggccaagagaagctggagtttacccaaacattctgccaagactgtgccaagttgaactttgactgcaccgacctgatcatgaaacaccaaaaaaaggatgatggaccacagaagaacggaggactgaacacctttttcaagacggaaaagtgatctttgaccattcattcattgatttttcgttaaaatgagtaactctttctttgtaattttgcccagcaatacgccgggatttgtcggcaataaa

SEQ ID NO: 56806 - DNA, 1086 bp, Heterodera glycines
  Genomic contig location: Contig_ID=SeqID_5074; Location=1656..2741; Strand=+
  SCN-specific regions: Sequence locations=1-996,1020-1086
atgcccccactgacaacagccttatccaagctgctgaactgtaaagctgagaatttggccgagtacctgaataacccagaagctgttaacaaggcgagtgcatacctgcgaggaaagaagctcaagacaacctactcgaacaagggcggcactacaaaggaggtcgagtttggcaacttctcgctaaagtctgcttcggagacgtacgccttcgagggattccttggcaagtgtcctttctgcaaacattcccacattttggaaagttcagaggtcaaagttcaccagtacttctacataaagcaccggatccgcctgctgtacccccagctgaagtgcatcgttgagtaccacagcaaaggtcattgcaagtattatccgttgggtaagctttaggctgcgatgaatgcccataatctcgcacggtttcagagttgttggccatagaggacagtgcagagataacaggcgaaaagccaacagacaccaactacttggactacctcggcttccgaagtgtttggcagccaacccccgtttattgacccgcacagagatgaagcgttcgagaccgtcgcaggagttccccgagattgattttaacgtgaacacgatgggtgtcacggtgtacagccctcgccatctgaagacccctcggtttgtgccatgggatcagccgggtcggtgtacacgctgcaagagtgggaacgtggagctggactacatcatccagccagagggagtgaccatcttctcttcacggctcaaggatgacggagagaactttctgccatttgatgagatcggtaagggtttggactattgcgaaaaagtaatcagcagcttaagtggactttggcgacaatgccaagtttcgcgtccggtcacggaacaaaatgttcaccctgccactgagacacccggaagtttaccaagctgcacaagtcgcagcggaagcgaatgaactgctggcagaagttccaccaatggctgataacaatgatgatgatgataatgttgacccaaagtgataactcagtgtgttgataagccattttgttatcattcgtgatggattacccgtga

SEQ ID NO: 56807 - DNA, 835 bp, Heterodera glycines
  Genomic contig location: Contig_ID=SeqID_5075; Location=59..893; Strand=+
  SCN-specific regions: Sequence locations=1-144,166-749,772-835
atgttgagcatccgtaatttgtccagccaaatgtttcctcgcgagcaagggtttctgatggacgcgtacaagcaggcgtgtgccgatccgtacgggtatctgttggtgacactacacgcaaacacagacaacatattacgactgaggacaaacattttcccagacgacgaagataagattgtctttgtacccaaaaatggttaagaagcaaatagtcggacagcgggtgttggacaactacgagtatctgaagtcccttgggaggacgacatctcacaagaagaggcgtcatttgttgagcagtgcaggttgtgaagagctgttgactatggtggagatttgcctaaaccttctgaacgggtccttctgtttgacacggaaacagaagcaaaagttgttgccttttgctaacaccattcgacggttggcacgcgtgagaagtgtgagcagagtgcgagaaagccgatcttacaacaacagcaaccacagcaggagggaggttcactctttgtccctttgttggcacccatactgttagaggcagcacgttatctgctgcgcaaagatggccaataagctcattcttctgccttttgagcattaccgaggattagttgcatcgagagagggtgtcggccttgcgaaaggagacgacgatgtggcagggcagacaaatttgggattcgtcaaacgacagctggagaccgtgaagaggaaacggacagcgaatgtcagcgaacgaaatgtactgtacaaccagcagctgaggagatatttgaagctgagaaaggaggcaaacgacaggccttccaactcagcaacggtgctcaactga

SEQ ID NO: 56808 - DNA, 1012 bp, Heterodera glycines
  Genomic contig location: Contig_ID=SeqID_5075; Location=1069..2080; Strand=+
  SCN-specific regions: Sequence locations=1-1012
atgaacgaaaagaaggaccacctcttgcccatcattatgtctgatccgcagagattcggcgctacggaccgtgggaaaatattaaatccaaagacggggcgggagttcatcgactcggacctggcctggtcaattgaacgcctagtggaccctcgcccggagaatgccccttcaccaagcggaaccaaagagttgatgaggaaactcgcacagaatccgctcgccagtagcctacttaatcgactattcgttgggtctggacaagtcaaacaaacgggaggatttgttccctctaaatggacgaaaaaataaacaaaatatacaccgacccggccaatcccggtgggtttgcgggtgcgagtgcactctatgcagcggtcaagaagaagcacccaaaactgaataggaccgactttgatgactttttgcagcgtaacaccacctacacgctgtttaagccaaagagggagaagtttcagcgccttcgcacagtccccggagggttcatgaccagtgagtttgtccacgttattttcacgtgatcggctcagacgttcaggcggacttggcagacttccaagccctttcgcgaaagaacagcggctatcggtacctgctgttggcggtggatgtgttgtcgcggcgtatgttcggctcacccgtaaagagtaagaggccggcggacgttaaaagggcatttgaggaggtgtttggtcaaatgccaaagcttccggaaacactgtacacggaccgtgggctggagtttgtggccaagcccatgcaggagttcttcgccgagaatggcattaagaagtatgagaccagctcaaagaagaaggctgccgtcgcagagagagccattcgtacgctgaagacccggctgtacaaatatttctctgccaaaaatacctctgcgtgggtggatgtgttgcccaaaagcaacttgttgctggcgtctcctcaccaattggagcgagcggctcgcgcttcatctcctcgtcaatcaggctga

SEQ ID NO: 56809 - DNA, 1035 bp, Heterodera glycines
  Genomic contig location: Contig_ID=SeqID_26063; Location=85..1119; Strand=+
  SCN-specific regions: Sequence locations=1-1035
atggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaacagacggaaacaatgtccgtgttcatgctcccaaccgggaaattgatgcccaaggccgagccaaagtgctgaatattgtagctactaatatgctcaagttacaataaatggcttagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgacgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagtttaataagttatatagtatttttttaata

SEQ ID NO: 56810 - DNA, 114 bp, Heterodera glycines
  Genomic contig location: Contig_ID=SeqID_26064; Location=864..977; Strand=+
  SCN-specific regions: Sequence locations=1-114
atgcgaaaagcgaaatgcgaaacgccaaaaaatgcgaataatgcgaaaggcgaaatgcgaaaagcgaaacctcggcccatccctgatgtgcacccgggaagcgaagaagaggcg

SEQ ID NO: 56811 - DNA, 920 bp, Heterodera glycines
  Genomic contig location: Contig_ID=SeqID_26066; Location=517..1436; Strand=-
  SCN-specific regions: Sequence locations=1-9,52-134,161-293,315-920
agtctttcgtttttatttattttttgcaaaattaattcttaaatattttttcagaaagggttctgaaacgcaccagattttatttacatgttagtttaggcactctgatgctttttctatcaaaaagggagatgaataaaatttttaaaaatttttaattcctttttaaacaggccaaaaagtttaggcttaactttttttttcagaaacttatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagggttctgaaacgcaccaaattttatttacatgttagtttaggcactctgatgctttttctatcaaaaagggagat

SEQ ID NO: 56812 - DNA, 400 bp, Heterodera glycines
  Genomic contig location: Contig_ID=SeqID_26067; Location=769..1168; Strand=-
  SCN-specific regions: Sequence locations=1-102,166-224,255-400
atggctaattggattaggtttgtggtaaagccctggacccctgcccctgtaacccattactacttgaagtctcgttttctaggtgttttgggtcacaagatgttatttttataagtattttaattcgtttttaatgattacaataaatatgataattaaattaaagcaatacgatcagcctggattatttatagtattaccttttcgttaagttgtatatttgcattttttcattttttaaaatatttttttttgtgcattccttaatattttttcagaagcacaaaactaactttcgaaatcaagtccgtttgttcatcacttgagttctacgacgagaataaattatattttacttaattgtcatggataaaaaagataaagcaattttgctaataaa

SEQ ID NO: 56813 - DNA, 1036 bp, Heterodera glycines
  Genomic contig location: Contig_ID=SeqID_5078; Location=573..1608; Strand=+
  SCN-specific regions: Sequence locations=1-73,95-235,277-568,613 -769,817-1036
atgtcggttatttggaggacagttcggcgaatggccaaaatttggtcagtttttaatgggaaatatgaccgttaaatttcaaatgtagggggtgtaaattgatttgaaaaatttcgtttcgaataaaattaattgcccagtgcaccaatttcattaaaaaatcaatattttgtgaaactttttgaattttttagatgtaatttttgacaatttttgaacaaattttttaatttttacataaactcaatttagggatatacttttgaaaaaatttatgtcatttctttgggtatttttcgttcttcttccatttataacctaaaggctttttttcattgtttcaaaccaaggagcgttctaggaaaaaaccatataaaatcctagccctaattcgtgacaattaacggattaaaattttaagtattggaacagcgttgatgcaattcacacaattgtcgtcgccattctgttaccgtcgctatatttgctttttgttgtcatgttttctctgaagctcactcaaatcaataaattgccaatggcggagtcaaaacatcgaaaatcggtcattaataaattattaaattaattacattaattagttactgaatttcaacatttttgtttttaggtgttcctccaagtgtttattctgtcatttgtgctcaccatcttctccattaattacactcttctcaattttgttcccgtccccgacctaatgatctccgtaaatatgtacctttgggtgcttttggatggtaaattcaatataaaaataattttaattaattttttttaaattttacaatttttggcgttcctccgtttgtttacctcgcgttgaaccgttcaattcgtggggaatgcgttcgcttctttcgacctcatgtcaatgcgccacaaacgcttaaaactcagctgataacacgacggcatcaaatgccaaaaacactccgcaattttggttaataattttgtcgatgctgacaaacaacggacaaaaacaacgacagttgaaaatgtaaagcattta

SEQ ID NO: 56814 - DNA, 721 bp, Heterodera glycines
  Genomic contig location: Contig_ID=SeqID_5078; Location=2145..2865; Strand=+
  SCN-specific regions: Sequence locations=1-345,367-381,403-541,563 -612,635-721
atgattgatcaaatcttgatcattttggctttcattgggaccatatgcgataacaagccttcgtattgcctgatcattaagcggcggattttaagcgaaaaaaataggtaaataaataagggcataaaaatttcgaaataatgcgaaaaatggtaaaataggagcgaaaatttgaaaatcagtgcgttttttcaatgaaattaaattaaaatcgatgaaaataacttattgagaaaattaattacaaaggaattgaatttcattcttttttcgaagcaaaaaaataattggggtttctacagaaaattcttttttttcagttttttgttagtttgtattattaatcattttttcatatctttgatgaacctattcaatgttaagattttaatggttaaaaaattgaatgtcaatctttgtgactagtaattttttcgaattttcaattagttatttttgtcgatggcttatagttttagtaaaaattattgataatagtggaatttttatgaatactataatatttttgacagcgaggcgcaaaagtccatttttgctgggcggcgcaaatgtcgcggcgcaaatggagcggcgcaaatatccgcggcgcaactgtctgcggcgcaaatggcgcggcgcaagtgtcgactttgctgagcggcgcaaatggtgcggcgcaaatgtctcatcacgatttttaaaacgatgaaagtaatagaaa

SEQ ID NO: 56815 - DNA, 725 bp, Heterodera glycines
  Genomic contig location: Contig_ID=SeqID_5079; Location=2947..3671; Strand=-
  SCN-specific regions: Sequence locations=1-292,314-460,482-515,678 -686,708-725
atgctaaacatatccgcttacttctattgcagttctctctgtttccaactattcatccacagaataatgatcaatttgccaagtgttcagttgaaaagttattgatctagaaatatcgcatacaggccgtatactagtcatacattcctttagtacatcaatggatactaaaagacgctgccttcccttaataatgccttagttcctttgagacatcaaataattccctcctaaacgataccagcgctgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttaatttaattttttaatttagttttatttatttttatttttatttaacatttattttcttttaattttaatcttatttttattttactttttatttgaattaatttgaattttattttactttatttattattcagttaatttaaaggagttgttcagaacctctatccaataaa

SEQ ID NO: 56816 - DNA, 512 bp, Heterodera glycines
  Genomic contig location: Contig_ID=SeqID_5079; Location=4042..4553; Strand=+
  SCN-specific regions: Sequence locations=1-512
atgcgatgtgccagtcctacccgtcaaagtgaatggtaggctctgattctctttatttatgaagtgcaccaaaaacaatcaaaaaggcaggatagacgtaaatacatatgcaaacataatgacaaacaatgagatggctgagcaatctgcatttcaatcgaaattaatgttactacggttgaagaaggttacccatttaccaattgatactgacataaaaggaaatggtgagaaggaagctgaatttgtaagagagtgcaaagagaaattagagatcttaacccaacaaagatagctgtgaaccaagaagagtaggattgttaaactatgcttgaacaatttgtgcgacatatttctttacgaaattacagcctttaacagactttacttcattaatgatgtacttgattttggagaatatttcggataatagttcaatagacgtaatggccatcgaggatttggacatggagcacattttgatcacctacgaaaataaaaaaagtgggtaa

SEQ ID NO: 56817 - DNA, 373 bp, Heterodera glycines
  Genomic contig location: Contig_ID=SeqID_26071; Location=69..441; Strand=+
  SCN-specific regions: Sequence locations=1-134,156-238,274-373
atggatatccgatcgcaagaagtagagttgagcggtaccggtaccggtactggccggtaaaatgtatgcagctataaatttacaacgaatacaaaatatattctacagataatataaaatgataagtatatagtaattttttattcgacaaaaatcaagcattcatgcttttttatattttgcaggtaaatgtatgcagctataaatttacaacgaatacaaaatatattctacagagaatataaaatgataagtatatattaattttttattcgacaaaaatcaagcattcatgtttttttatattttgcaggtaaatgtatgcagctataaatttacaacgaatacaaaatatattctacagagaatataa

SEQ ID NO: 56818 - DNA, 296 bp, Heterodera glycines
  Genomic contig location: Contig_ID=SeqID_26071; Location=769..1064; Strand=+
  SCN-specific regions: Sequence locations=1-54,76-181,203-296
atgtatgcagctataaatttacaacgaatacaaaatatattctacaaagaatataattttttattcgacaaaaatcaagcattcatgcttttttatattttgcaggtaaatgtatgcagctataaatttacaacgaatacaaaatatattctacagagaatataaatgttaagtatatattaattttttattcgacaaaaatcaagcattcatgcttttttatattttgcaggtaaatttatgcagctataaatttacaacgaatacaaaatatattctacagagaaaatataaat

SEQ ID NO: 56819 - DNA, 262 bp, Heterodera glycines
  Genomic contig location: Contig_ID=SeqID_26073; Location=366..627; Strand=+
  SCN-specific regions: Sequence locations=1-67,89-262
atggaaattgacgagcagcaccagtcgaacagtgcgggccatgttgttgcgtcgggggaatgcgtacagcaaagtgagcagcagcaggaaatgcccgatttgtcagcaatgaccgaagaggaacagttggaggtaggtaattaattcagtgataattagggtcgcgacttttagtgacgaaaaagtgccaaaaaagtggcaaaaagtccgaaatagtgacgaataatgacataattttcagccaaaaattgagcaaaaataa

SEQ ID NO: 56820 - DNA, 633 bp, Heterodera glycines
  Genomic contig location: Contig_ID=SeqID_26074; Location=745..1377; Strand=+
  SCN-specific regions: Sequence locations=1-18,40-176,198-329,351 -394,418-633
atggaaaacgctgaagtgtcacaatgtttttcaaaattcgacaataaattcctatttataattggtcatgataatcaatatcgaaaattcaaaaaaacaaatgaaagaacggatacgatttatctctattgcatgaactgtgagaactataataagcagaattctgctgggttggtttcagttatttcgtgattcttctatataattagattatagagttattggaagtgctattattagagagggccaattagatagaactcatcaaatcatgcaccatcttcagtgcaaaggtgtgccactagagcaacttactgctgaacaaattgataggaatcaaagaagagaattaattcaatgttcagcagattctaaatctatttggcgagaagtgatttgaatatttcataaaaactaatccaattggtacgataaatttaggggtctgacagggctagagagcatgatacagctgaggatatcgaaattgatgatcccactggaatttcatttaattatccaaattggcaaagcgtaagacgtgcctacaaccgacgaaaaatgaacaaataggggattgttctgatccatttaatgtgccagaaaaattttagctaactaaacgcggagcaa

SEQ ID NO: 56821 - DNA, 108 bp, Heterodera glycines
  Genomic contig location: Contig_ID=SeqID_26076; Location=1069..1176; Strand=+
  SCN-specific regions: Sequence locations=1-108
aaaattccctcaaaaataaaaggtctattgcgcaccgccctccctatcatgctcgagagcatttgtatgtgtataaaatttatcaaaaaaagagatagccatttttct

SEQ ID NO: 56822 - DNA, 288 bp, Heterodera glycines
  Genomic contig location: Contig_ID=SeqID_26078; Location=622..909; Strand=+
  SCN-specific regions: Sequence locations=1-125,150-288
attttctaagaaaaaataggagttttgggggcgcggcggtgccgataggcgccgccggggaaaaaaatggaaattttgatcatttataaacaggttttcactgaaaattagccaatttataggtaaaattttgaaaaattttatgggaatttaatccaattcttaggggtgtaaaagtcgcttttcgcgccaaaaagcgaaatgcgaaaagcgaaatgcgaaacgccaaaaaatgcgaataatgcgaaaggcgaaatgcgaaaagcgaaacctcggcccatccctgct

SEQ ID NO: 56823 - DNA, 748 bp, Heterodera glycines
  Genomic contig location: Contig_ID=SeqID_5080; Location=595..1342; Strand=-
  SCN-specific regions: Sequence locations=1-46,68-321,344-414,437 -595,617-748
atggaagaaggaattggaaattggtaagagatcaatggcatattcgattttttattatttattgtctcattttaaggtataaaaaagaaattttcaacgcaacaacaaattgaaaaagtaaaagaatttgaaaaagtgaaagaagaatttgcaaaaaatttcagtttggaaccaaattggaaaattaaagaaaaaatagcggaaaaaattggtgctagaatgaacacaatttctgcttggaaaagaaaattggactctatagctagtaacattttattacaaccaatttaagtagttatgttgaaattttaatcgaatttaatataataatgacaattaattttgattcaatttaagagaaaaggaaaatttactcggatgctgagaaaatggaatatgcgaaaagaagtgaggagatgagaaaaagaaatccaatgataaattggaaagaaattgctgaaactttgggaattccatgtgccaacttaagacgatggacgagaaattggacaccaaattgattcattagacttttaaaattctaaattctatagcaattttaagaaaaagtatcgtaaaaaagaattttttatcctattacatttagtcaactttattatgcagagaaaaacctagtgtagaatctctttgtttctttgtaatttctctcagtttggcgaactatctctttgtttttagcggataaatcgatttattataacttgttttttaccgttttggaaataaa

SEQ ID NO: 56824 - DNA, 118 bp, Heterodera glycines
  Genomic contig location: Contig_ID=SeqID_5080; Location=93..210; Strand=+
  SCN-specific regions: Sequence locations=1-118
taaacacatagagctatcgaacaacaccaaaaattcttaatttgattgacagcgaacaaagttatggttcaaaaagtcttccgacgacgtttcggccgacgacgttttggggtgcacc

SEQ ID NO: 56825 - DNA, 983 bp, Heterodera glycines
  Genomic contig location: Contig_ID=SeqID_5082; Location=3232..4214; Strand=-
  SCN-specific regions: Sequence locations=1-138,164-312,340-340,362 -441,481-686,709-762,784-983
atgggcgctaaagtgcatttatgcgtgtcatttgtgatgtgagtgtaagtaattgtaaacaacagtttttgtgttatgttgtgcagcaattttggcgtgttggtgcagcgcaaccgccgctgagactgatgagacgacaaatttattttttattttatttattggggtggggccgccgggcaaaatggcccaaaaaaggaaacatagggcgcggcgcaacaaccaaaacgacgatttggaaaaccatgagattaattggtcgaaaaaaaattgcctaatgtaggtcccaaagataacatggatttaattgcctaataaattaattttttattatattaagtggaaaattttttaaacaaatcaacagattatggcagattgaggaagagctattaaaaattttaatgtattttggttgaaataagaaaatttttttgttcaatttttaaaaatagggaaaataaggattttcaaaattttgagctcggaaaccaggatttacagtgattatttgacttatctccagtaggattcgagatcagagatttaacacacagctcaatcccaatcccagggctttaattcgcgtgaagacaattggacatgggttttggattaattctgtctcgaattttctaatttgggttcgggaattttttttttttgttttcttttccattgcttagcctcagaaacattcctcttccctgttcggtattcaagaatcaggtgcctaatgttccccctcccgcaaaaatttccggttttcctacatttccatgtaattgacggaaagcctaaaaaaacaaaaacataataattctgataggaaagagtaaaattacaggccgaaaatgctgaactgtgcacagttctctctcccatcatttggtcttaaatatgcacatggcctgagcaacacattaactccgaagaaaaaaaaagtgaaataaatgggcgaacaattaaatttcggcaataaa

SEQ ID NO: 56826 - DNA, 356 bp, Heterodera glycines
  Genomic contig location: Contig_ID=SeqID_5082; Location=4409..4764; Strand=+
  SCN-specific regions: Sequence locations=1-59,81-356
atgacggaatttggattggattcaaatgaatttcctggttatttttcggacggtttgcccttttctgttttcgaaggactgtccttaacactcgataaaatgttcttatacgccttatcggtcggtccgtcggagggaatgatcagaatttgggattgggttaaaatgaatttcttgtttttctcgggccgtaaaaaaatttctataattttgcgacgagactgtgagtttctatgaaattctcttcgaaatttcgaggtcgccttatcgatattgtaaattcgaatactgatcacttgtcgtgactcgtgagtatctcgatttagatatattatctctgtgaaccgatttattaa

SEQ ID NO: 56827 - DNA, 1093 bp, Heterodera glycines
  Genomic contig location: Contig_ID=SeqID_26079; Location=309..1401; Strand=-
  SCN-specific regions: Sequence locations=1-758,780-1093
atgaaaaatttggctcgccagtacgtttactggcaacaaatcgatgaacaaattgaagaagttgttcgttcctgtcaaatatgtgcttcggaggcaaaagcaccagtcaagacgacccttcattcatggccaaaatccgatggcccatggaagcgtgttcacatggactatgcgggaccattctttggaaagatgttcctcgtcattgtagacgcattttccaagtggcccgaaatcttcgagatgaattccaccggttcagccgccacgattggtaaattgcgctatctttgcgctcggcatggactgcccgaaaccttggtcaccgataacggcacccagttttcgtcgaaggaattcaaggaattcacccgactcaacggcataaaccatttgttttcggcaccttattgtccgatgtccaacggacaagccgaacggttcgttgacacatttaaacggacgtgtcgcaaattgaagaaggagggaatcaccgaaatgttggacacatttctggccacgtaccgtgtcacgccgactgagtctttgcctgaatgcaaaagcccagcggagttgttccttcaaaggaaactccgatcgacattggacctattgaaaccaaaaaaccgtccaatcgtcatccgcgacgaagcaatggaacgaaagttcaatcggcgccatggcgcgaggccgagatcgttcgatttagacgataaggtctacgctcggcatcgaatgtcgcaaaattggcgacccgggcatatcaccctgaaaaaaggtgtgatgtacgacgtcacttttcaggacggatcagttggacgatttcacgcgaaccaacttctggttcgacattcagacgtgaatgaggaagaccctctggacgtcttgaatgacgctttcgggcttccattggcaccagccaatcaaaatcttggtgatgttgtggcacagccagctggagaagtgattgagaatgcgccaccatctccgcgccccgatgcgccacaacagccaaacgaagtcattgaagaaggcgccgttcaaccgaatgttcagaacgaacgacccaagcgaaaccgtcgtccgcctgatc

SEQ ID NO: 56828 - DNA, 1060 bp, Heterodera glycines
  Genomic contig location: Contig_ID=SeqID_26080; Location=52..1111; Strand=+
  SCN-specific regions: Sequence locations=1-98,120-133,155-215,237 -279,302-529,554-615,645-1060
atgaaaattgcgatttcatttatccttgcggcaattgaagtgccaatgttcacggattataaaaacactaagagcattcaattgataaaaagtgggtattttttacagaaattttaattaggtaaaatgcgattttttgccaaaaaagtttgcaaaaatggaatttcatatggctttttcataaatgcgcaaaaaaaaaaacgaaatttcgcaattgtttcatacatattttttatgtttgttttcaaaaaaaaaacaaaaaaaaattgcttttctggcgttttgtattatttttaaataattgttctcgcgtcaggatcagtcagctgggtaacaaactcagcctaggacaattcagccgaggacaaactcagttgatgcgacaattcggctgatgaacaactcagctttacaagaatttacaaaacgcaactcgtacaatggcttaggctggccaagcaaggcatacgcttaagcctaagctttaggcgaggcataggcttaggcttgcttgggcctaggcttaggctttattttgtaattttttattgtatggctgagttgtccatcagccgaattgtctcatcagctgaatagcccagaagacgttcttgcattttattaaaaaaatttcttttttttaagaagaaaaaacaattctcaaagaaatgaagaagaagctaacagaaattttttatgctttgttcaaaaagttcaacatcgatgcgtacaatatgaaaattttggccaatacatttgaacaaaatgtgccaaaaacattgtccaacattggcacaatgttacgggagcaggacaaaattgatgatgaaaagcaatatgtgcgcatttattggcgaaaatgcatcattactgctcgtaaccaattggaatcgttgaaggacggcattttgtcccaaattttcaattatttggatgagtataaaacggtggaaaacattgagcaaattggtgaaacattgaagataattcgcgaaactttgctggctgacgactgagtgaagaaattttggaatttatgaaaaaatgtggatttttttta

SEQ ID NO: 56829 - DNA, 303 bp, Heterodera glycines
  Genomic contig location: Contig_ID=SeqID_26080; Location=1494..1796; Strand=-
  SCN-specific regions: Sequence locations=1-303
ggtgaatcggatgggccaaaatttgttcatccactgcaaacatgaccagcgcgagggcatgctgggcacaacatcgcgtgaggttcagcgcaactataaattgccggatgatgtggacccgaaaagcatccgctccaacatcacacgtgccggcattttgcgcataacggcacaaaagaagcgttgaattggcgcaaatttggacaaaaatgccaaaattgatcaaaaaatggagtaataacatttggaagaacataataaatccaatatattaatcattttatgacataaacacatgtaaaa

SEQ ID NO: 56830 - DNA, 399 bp, Heterodera glycines
  Genomic contig location: Contig_ID=SeqID_26082; Location=20..418; Strand=-
  SCN-specific regions: Sequence locations=1-399
atggagtggcggttggccaggcgcggcttcaccgttctgccgatgtacaaatggcaacggagtggaccatattcgttgataacggcactgaatctgctcgaccgacaccatgtaaagttttcgattctaactttatttatccaccactgttttccggatcctaaaaaattgctgaattctttgcgcgaattggccatcgagcacaattgtcccattttactttctgtcgtgctccctattcgacaattcgtcgaattcgacgataaaattgtctccgctggaagaaaacttccgggtgaattttaattttccatgtgttcgcatcacaatttttacatgctttaaaattttaatttagcttcagacattccaacgaaaggaacgaccttcgaagcccaa

SEQ ID NO: 56831 - DNA, 203 bp, Heterodera glycines
  Genomic contig location: Contig_ID=SeqID_26082; Location=1235..1437; Strand=-
  SCN-specific regions: Sequence locations=1-121,155-203
aaatgaacggcagcaaatgttgaaaggggtggcaaacggaaaacagcgactcgtccaacttccgttggaatgctgcagtgaatcggtggtccccgttgttaaattggtcgatattcctctcatttcatttcaaaatgattaacaacaaagcctataaaatgccaaaatgcaattcagattgtctatatgtgaaaataaatttg

SEQ ID NO: 56832 - DNA, 1124 bp, Heterodera glycines
  misc_feature (1009)..(1009): n is a, c, g, or t
  Genomic contig location: Contig_ID=SeqID_26083; Location=1..1124; Strand=-
  SCN-specific regions: Sequence locations=1-113,135-235,260-1124
  Gene Ontology: Mol. function=cytoskeletal anchoring activity; Cellular component=cell-cell adherens junction; Biological process =apoptosis
gcatggggacagaaaatttgagcagagaatcagccaaattctggaaagtctgcagcaggaggccgaaagtctgatccgactccaacaggggaggcaaggacgaggagaagacggggaagaggcagtgagaacaagcggagaaatggggagatggacggagagtgctttgtggacaaaatgagtggcaaatgggatagtagccaacaataaattcttttgctgtgtaaaaggtgttcgttttcaaaatctgcctcattttatttgcctactgtatgtatttaccccttctttctgttgttacggtgtgttttgttgtgtaatttgttttttcttattcgtataaatttttacgttttggtttttgcataattcaaccgatgaaagaaattgcagcgccatgggaccacgtcaaaaccgacaaagcccatcactttggacgtggaagaccagcagaaaattgccaaggttgggctggagatgaaactgttgacggccgaagtggaagcggaggcggagaaatgggacgaatacgcggagaatgacattgtgaagagagcgaaggtcggcggagagtcctccaattttagaaaaggctataccgtttttgaagcgtttgacttttctttcattttttgataggcaatgtccgcaatgagttacaacatgtatttgttcacgaagggagacggccctctgaagacgacccacgacttattcacccaagcggagtttttcgcggaacaggccaacaaaatgcacaaaactgtgatggaattcgcttttgaagtgggacaatgcttatgcatttccctccctaccaattacactttcttcccccctcgctggttaaggtccccggaagtgcagaaaagaacgaactgttgcaaattctggacaaaatcccttttcactgtcagcagcttcaagtgttggtcaaaagtccgacagtcggcaaaagtgccacttttagtaaagtagagaagaaaactcggcaccttctatctcccanaataaaatgaatgtgattcaggtggacgcggtgatctccgagatcaaaggcttaatgaacgaaattgcaaagcttgtcaccgcatgtttcgtctgtgccacaaaagtcggaaata

SEQ ID NO: 56833 - DNA, 983 bp, Heterodera glycines
  misc_feature (965)..(965): n is a, c, g, or t
  misc_feature (973)..(974): n is a, c, g, or t
  Genomic contig location: Contig_ID=SeqID_26084; Location=1160..2142; Strand=+
  SCN-specific regions: Sequence locations=1-18,40-504,527-983
atgcctccaccacgtcctaagaagagagagccacagccaaaggtcgaccctcggccatccacatcaaagaaggccgatataaaacctaaaagggagccaaagtttgagccggatccgcgaccatccacatcacggcaagccgggtacaaccccgctccacctgctcccaaaaaagagccaaagcatgagtggaaacagacaaagcgactccattctcctcctcgcaccgcaccccatcggattccgaaaagagagccagaaattgaagaaacaccacaagagcaacctccgtgcggacctattggaagaacgggttaggcaggacccaattttgtattcattgaccgctccaccaaagagaccatcacagagtacaaccaccaggacgggatcgaaaatcaaaaaagagtttcgcccgaaaaaatggaattaataaatgccactcttgacaaactgtacaacgagccatcctcccccgcgtgtttttccggcgttactgcagtgtggaaagaggagagaaaaaagataaaacaatcaagtaaaaaagaagtgcggaactatttggaaagtcatcgtagctacacgttaatgcgcccccgacgcgtgcacttccggagagcaaaaactgatgcagcaggattcatgacagatgtgcaagtggatttggccgattttcgagcgctttctcgtcaaaatcgaggccatcggtatctgctcgttgcggttgacgtcttgtcaaaacgcttgtttgttgttccgttgaaaaataagagggccgaggagatgctggaggcattcaaggaacttgttaagcaaatgccaatggttccacatcgcattctctccgacaaagggactgaattcaaaaagcaattactcaaaaaatttttcgatgagcaggaaattcagaaacatgagccagtccactcatccgtgaaggcatcagtagctgaaagagccattcngaatgtannagcacgact

SEQ ID NO: 56834 - DNA, 2668 bp, Heterodera glycines
  Genomic contig location: Contig_ID=SeqID_5083; Location=630..3297; Strand=-
  SCN-specific regions: Sequence locations=1-66,89-106,128-131,154 -451,488-608,632-880,912-1079,1101-1544,1576-1662,1684-1749,1773 -2137,2159-2255,2277-2399,2423-2668
  Gene Ontology: Mol. function=protein binding
atgtccaaagcggggattgctgggctaaaattgatgctgagcacgggagagtacgcggatgtgcactttttggtgggggatggagaagaaaaagaggcgatttttgaaaataaaaaataaaataattccatttttcaaattaaaaatctttttaagcttgtgccagctcataaacttgttttgatgcatgcttccgacgtattcgaggcaatgttccgttttgacgctaacaaagaacaagccgaaaacggtaaaaaaagattaataatttttgttaattttcaattagttgtgctcattacacgattaatttgcaattagctaattacccttctgctgtggaggtgcccgacgttgaagcagcagcctttaaagtgatgttgagcttcatttacacggatgatttgagcgaagtgaacggagagaatgcaatggcagtgctttatgccggtaaatttattttttggaaattaatttattaattaatgaattccctaattagccaaaaagtacaacatttctggccttgtcggcccatcattgcaaattcccatctccgaattacacaatgttttctttgcctatgcctatgcttgccttttcgaattggaggtgggaaggacagatttaaattcttattttgtaatatgtgtgcttagtttttgagggacttcaggctttttttgtatcattttggataatttattactttttaaaggatttttccggccaatgtttacgttacatttgccaaaatgcggctaaattgttcgaatcagatgactttttgcagattgatcaaaaaatgttgagtgggcttatcgaaagtgatcttttgttgttcagcgatgaatttcaaatttggaaagctgtaatttcgattttaaaattgaatttaaatttttttttttcatttttggcactccgttgggccgatgaaaaatgtggtcagaatggcattgaatgttcctcggaaaatcgtcgttctgtactcggtccggcactgttcaaaattcgttttccaaatattcatgaggaggagttttcaaaaggcgtcggtaaaattttttggatcgggagattaaattagcagtattaattggttttttttattagcttttatctttaatgctttaaaatgtatgctacgggggtaccgccacggaaaatttaacaaattttgaaatttttacagttccatttggtgtgctaacaatggaagaagtgtacggcatttaccaatacaattctcatccatatttgtatcttcgtgtacccgacgagctgttgtacgccttgaaattcccaagccatggacgaatttttgattggaacacagccaagggcaaccgaagggggacacttgcgttggaaattggaaaattgtcggaatttgccggggaaaaagtggggagtcgccgaataagtgatgcagtgcatataaatggagtttcatggcaaattgaagcacaaatcagacagaacagtgaaggcaaagcaaaatatttgggcttttacctttggtatgatgcttcaaaggaaggtaataaaattaaaattaaattttcattaaaagggcttctcaaatatttgcaaatttttttccttgaatggggactgcttaaaacgccgaaggattttctcgagaatattattaactttgaaaacatttgtaaatttatcaaaaataattttttacttggttttcttctaaattaataatttagctttaaattatatttaacgaattttaagaaattttggaaaattttaccatcagtttggcaactatatttttgacaatttttgcgcatataagccctaatcattaaaataataattaatttgcaatgaataggagagggtaattggcgcaacgaatattcggcaacctttcgaattgtctggcaaaagagtaaagcggccaattccacggggacactaagtgaccgtgtcattaacaacacaaagaattggttgggtttccatcttttcattacttttgcggtgagtgagtaatccattaaatagtctaattatgggtaattaaggaattgatggacccgagcaaaggattttacaacaaagaagaggacaaagtgacattggccattgatgtcactgtaaaataagcaaaacggaggacaaaatgtatttttctgttgggaagatctcgtattgaattatcattgctaaattcgataatcggaggcgaataatataatatttacctaatacatttttgatctattcgaattattttaaaaataactgatttgaagcaatttcgctaaatgttctggttttagaccccaaaatctggttttttttaagcccgatgttctgattttgaaaaattttcaatcgcatcaagaaatatcactttctagggtgtcggttttcaaaagactttttcatttccgtgattaaccgagttttacattagaaatcttttaagttgaaaatgcctcacatttttttttctgcttaaagtcgtcggttcattttgtgtcaattagcagcacacttttgtcaaaaattccaaaataggtgcgcaaataagtgttaaaaattgaaaaaatccagtgtctttatgcacaaaaattcctaaagtgactaattttttatcaatttcgcccgcacaattgcatctggtcaagaaaataaa

SEQ ID NO: 56835 - DNA, 720 bp, Heterodera glycines
  Genomic contig location: Contig_ID=SeqID_5083; Location=3428..4147; Strand=+
  SCN-specific regions: Sequence locations=1-315,337-380,403-608,630-720
atgaaaatagtatgtagataacagagaatttcttgggtttccaaaaaaaaaaccgaccaaaaaaggagacttaaactaaatattaataccaaaaaaaacaaaccaatctttttttttgttgtattttgttgaaattataaattttcaaataaaaaatgcttaaaaaagatacaaaaatgaactttcttattggggaggggacaaataaatactgcggcaaaataatgacctaaaaataggtatgataaatgaacttatttgaagtaatccatcttttttaacaaagatgaatttgattaaaatgtaccaaataggatttatgaattttacaagttttaaaatcgtttttaaatgaaaaatgcaacaacaaaattaggcgtaaattaatcaattagttaattatcaaggataattaaaaatttcacttttcggtaaatattgatcataggccccaaactcaaaaatgcttaaaaacggtcagaatcgatgtaaaaaggttcgaaatgggttggaaaaatagaattaggggtcaggatgaaaagtgccgaaaatggagtgccaaactcagctgggactcaagtgaccgcattataaaaagcagtcaaaagacatttaaataatttttctaaggtgatttttggcgctgataacgaatgtgacctttattttcaaaattccgaaccccgaacccaaattcgaacaaaaactcaaaatttataa

SEQ ID NO: 56836 - DNA, 2979 bp, Heterodera glycines
  Genomic contig location: Contig_ID=SeqID_5083; Location=4368..7346; Strand=-
  SCN-specific regions: Sequence locations=1-214,259-410,458-463,486 -715,737-1007,1084-1102,1128-1147,1169-1768,1806-2012,2044-2320,2342 -2378,2400-2579,2602-2685,2736-2979
ttgttcccaaatgtgccaattgtggtcagagatgagctgaaagaacaagtgtcagcccattggaaaaatgtgattggcacagtgaatgaagacggaagtgaagatttgacggcacaatatgaacaaatttatgcgaaattattggcacaacaaaacaaaactgaatgggcaaatatgcaacaaaaagtgaaaaaagcggacaaacacaaattggtaaaaaattaaaattaaataaatttatttcaaattaaaaatttagtgcaaaaaatcggtgagcggacaaaaactgaaaattttggtggtatcgtcgcccatttttgacacacttccgcctaaaaaggcgggcggaactgaaataatgatttatgctttgaccgagtcgctggtcaagcttggccatgacgtaagtcattaataaaaattcaaaattagatttaaaaaaaaataattattttttcgcccatttatttgggtaattaatttaaaaacaattgacttcaaatttaaggcataaaattaaaaattcgcccatttaattggctaattaatttaaaaatcaattgactcaaatttaaggcgaaattaattaattattcaccatttaattggcttaatttaatttaaaagaaaaattgacttcaattaaaggtcactttgcttgcattgtctggttcagaaacgagtgcaaaactgtttgaaattccattcaaaacgtacaaattttattaatattttttggaaaaaaactttttttcagtaacccatgggcatgcaaagacaattgggtgaagtgtcaactgccagtaatttacaatcaggtaattaaatgtgtaataaacatttatgttcggcacggcacggtcaaattattcatccaatcggattttgtaaatttccgatttgttaccgagtttttttcgagaaaattggtaattaccgatttttctggggacaataactggactaaaaaaccgtataagaaaccatttaatactggaaattttgtgaaaaattaatatgatttctattaatttatcgattttaaaatttatatttttacaaaaagaaaatcataaaaaataacccaaaaatagttactaaacaataaatttttcccaaaaaattgactccaggaaatggtcaaacgacatgcacatgaatatgacattgtgcacttccatgacccgtcaagtttcatcgaattccggcactttttgaaccacgcggtccacacacggcacatgcccgtggacgacaccgtcttctttggcctgttcagtgacgtcccgcacatttcgatcagtgaagagcaacagcggttgacaccaattggtaaagacactattaatcatttaattagtggggcgtttaattacatcattagtgggtcttatccatgtgagcgttccctaattttggcaccaaaattttgcttttaaaaattaaattaagtgcttgatttgaactgggttggctcggtgcacaacggcatcaatcttgacgacttcaaatttgtggaagtgccaaagcagcagcagccttatttggcatggatgggacgaatgattccggacaaaggcgtcgatgtggcgatcaaatttgccatcgaggctggcatgaagctgaaaattgctgcccaaattgtggacgaccatcgaaaatggtggatgaagcgcattctgccgctgatcagtgaaaagcatgctgatctgatcgaatatgtgggcgaaattgggccggaacagcgaaagtgggcggagcgaaaagcatttttaaatatttaaatttaaataatttttatttaagcgattttcttggcaatgccaccgcatttctgttcacgccaaaatgggacgaaccgtttgggctcggaatgatcgaagcaatggccacgggcacgccggtgattgccattcaacgcggggcggtcggcgaagtataaaacataattattaataatggctttaatataaattataaaaaggaaaggattgaaaatatcagaagatttcaaattaatttttaatgtattaaaaaaaatttcattagggtggcattatatagattaacaaaaatttgccaaaaaatttcttcacaaaaaaataaaataaaatgacaaattaagcgtttcattattttgtcaaaaattcatccaaattaaatattcttagtataatttaatatctctaagattctctgtgagcctataaaatttcaaaaaatttcatttgatttaaaagaaattgtgaccaaaagttttaaaatagggttttaattttttttcaaccttcgtagactaataagaggctcattagcccgcagggaaaactaagaaatttttggctgactttttaacatattttcaccaaatttggcgctttttgtgtcaaatttaaaaaatgttctgaaatttggcagattgtcatcgatgacgtcaacggtgtgacgttcgattatgaagacaaccaaatgattttcgactttatcaatgtcaagcaactggttgcccgtgtgtcgaagctagaccgtgccaaaattcgccaaattgtcgaacagcgctggtccctggagcaaatgtcgaaaaattatgtgaaagtttatcgcaaattactgcgagaaaattgtttgtgatgaggaaattgatgagtgaattttatgaaaatgattagaaattcacatcacatcatatttatttttatttattttttgcctatttattttgtttatttttaattcttagctatgttttagaaatattcgtataaatttctagaagctatacatagttgatttttttcgatatcagaactgaataaataggatatttcaataatccagctgacttcgctggatccagagctggtttatcagataatcatgaaattaacaattggatacgtcctcgcaatgtattcctccgccctccgtctcgccccactacttgctccgtcttcgcatgctcccttttgcgaaagttag

SEQ ID NO: 56837 - DNA, 962 bp, Heterodera glycines
  Genomic contig location: Contig_ID=SeqID_26091; Location=367..1328; Strand=+
  SCN-specific regions: Sequence locations=1-177,199-962
atgccttcaaaacaacataatttacgtatgaagatgaaggaggaccgacggcggacggagaaatctgtcagcccaggtcgctcacccgtcccagacgggagtgcagatgagaatggggtggtatcacacccgggcaacgtaacgcccaatattggtgctttgcaattaagcaccccggcttcttcaattggaagtagaagaagggctagaccctcaaacgccggaacggagtcaattacggcttcgcaaaaaagtgcgtcatcagttgacacacaaagcatatctcaaaatgccgaatccttgccgtgcaaaaagaaagcgaaggttgatcaagcagaccaaccaaaaaattatgaagcaattacttcaacgcctatttccacgcaaagaagctgtggaggacggccgaccaagatgaggcgcggcccaggcaggagcaaagctaatgattccatgaacgagagctcgtcaatgaatcagagttctgaagctattacaaatctgatcgttttgccaaatgtgactgaaaagataaacttcagcacagtgcaaattaagttcgccacatcgcgaaatatggcatgcaaaattcggagatgggccgatgttgggctttacgagcgtgatggcgaaacagcacaaggcccacgctctggcccaagattcattgagacctgttggaatgatctgacacagtttctaaatgatgcctttgttgtcgagtatttggcatacttggcaagtatatcacaacgaaaagtggtcgttgttgatccagttgtgtggcaaatgggcatagaccgggtcatgcaatataaaaaaatgacatttgggtatgaccctaatgttccggcagaagtcatacttttgccagtacatttccctggacactggactctaattatccatgatgtgcaatttggcactcattttgccgattctttgcctaccccatatggcag

SEQ ID NO: 56838 - DNA, 73 bp, Heterodera glycines
  Genomic contig location: Contig_ID=SeqID_26093; Location=180..252; Strand=-
  SCN-specific regions: Sequence locations=1-73
atggaatatactgagggtaaagatttcctaggctcttcgtttgccaacaccgaggccatcaaaaatactactg

SEQ ID NO: 56839 - DNA, 601 bp, Heterodera glycines
  Genomic contig location: Contig_ID=SeqID_26093; Location=840..1440; Strand=+
  SCN-specific regions: Sequence locations=1-73,105-159,181-367,389 -448,470-601
atggctgatttaaagaaaatgaaaagagatacagaggcagagaaaacgtgagtaaatagagcaaagttaggactataaaaaattataagaaaaaaattttattacttcaaaaatgaattattggagggccgagtctaaaaatggtctccaaaaacggcatttttcaagaccatcaaataacaaaatgttttaagtggttttggaaattccgaatttaattaaactaagtaaattgaccacgctgagtccgaatatggctcggggtttagatttagagcccggtttcgggttccccgggagttgcggaaatgggtttagaacagggctcgtatccgtccttggatgccaaggacgtcctttgaaatgagcatttaaaaaatggaagaaataatcaaatgaaatttgacaaatttttgaatttctaacataccgcatttgctctttttatccccccggggggattatttttcaacctcctcagaaacggggggattattagatacggggggaaaaagggagaaggggggattatttttcgacagatttattttgtgtaaaatttttgaacatgtcgccaaaaaatgtcatcgcgtcaaaaaaa

SEQ ID NO: 56840 - DNA, 441 bp, Heterodera glycines
  Genomic contig location: Contig_ID=SeqID_26094; Location=1414..1854; Strand=+
  SCN-specific regions: Sequence locations=1-19,46-107,261-441
atgaaattatttccgctactattattaattattttatttttaattgacaaaattggatcagaaaggaaaaaattgcaacaaaagtcatttggcgaaatatttggagaaaaatggcaagaaaaagaagaagaaaaacgaaatgaactcaaaaaaagagaaataattgcaaaattttataaaataaaagagaaaattaagcaaaaaggaagaaaattctcaaaaaaagaatggaataaaattaatttgaaaatagcaaaaaaattgggcacaaatcaaacatatattcaaaaatggattaaacaatttggtcttcaaaaaaataaatgctataaatcaaaaagtgatgaagaaaaaattgtaattgtgcaaaaatttattaaaatggcaaatgaatataagcaaaagagaaaatattcagcaaaagaatgggaccaaaattaa

SEQ ID NO: 56841 - DNA, 912 bp, Heterodera glycines
  Genomic contig location: Contig_ID=SeqID_26095; Location=102..1013; Strand=-
  SCN-specific regions: Sequence locations=1-186,208-247,350-912
atgtccgcaaaccgagagcagctgactgaaaatttaaaaaaaatcatcgcactccacaaactccagcaagacatgaagctcatccgcgactccatcctctcggggaactttgccgtgaacgaaatgggaaacaacaatatgatagtgtggacggtgccggtgccacgaaacgcggtaaaattttgcgaaacaacaaaaaataatgaaatcttatgtgtctttcaacttcaggggcctcaaggggtcgcgccgccgcgccctttggcaccgtcttgcccgccgccgccaccacaattgccggttttcccgccgccgccaccacaattgccgtttttaccgtcgccgccacaaatcggcatggcgccgttttgcccgcggccgccgcaaatgagcccagtacttgcgccactcgctcttccgccgctggcaccggcgccacttccgctgccatcatgctcgaccttcgcgaacccattcggtgtccgcgcaccgccaaacaaatgcgcggtgtgcggacgccgttttctggcgcctcgtcgacgtgcgacaacggaaaagctgccgagtgcaaaaaaggcgcgggttcacgggccagaggagccaatggacgaggaatagtgggtggcgtggtggggagtgaaatttgaatggtgatggtaatgcatatgtaatagttatgccattttattttgggtctcttcaattttaaaaacgaaaagtaaattttagatgatttaaaaccacattttagcaaagaaataattggattttgcctgaaattgttaatacaaattggcaccttgacttacttttttcacccaacatttatgattacttttattttgagttttttgtcttaaatcatttttttttaagtattttaattcataaaatggcatccctagtattaaa

SEQ ID NO: 56842 - DNA, 612 bp, Heterodera glycines
  Genomic contig location: Contig_ID=SeqID_26096; Location=930..1541; Strand=-
  SCN-specific regions: Sequence locations=1-177,211-327,404-470,492 -500,578-612
atgaaattgatagaaaatatatctattatttatagaagaaaattaatgaatattattcatcaatgtatttttcacagttttactacgttcgaaagcaagggtgcgtaaacagcttaagaaaaaaatatatgtaacgtgtgaattcaataataaaaggaagcaattagaaaacacgtgaataaaaaacaattaattaaataaattaattatcattatgaactaaatattgacaatgaaagccgtcgttagtggaaaaaaaagaatacaacatatatcaactttaagcatatttcaatgcaattataaaataaataaaaccgaaaaaccaaaaaaaaatacaaaaatgataaaattaaaatatattacttaaactacagattatcaaataattttttaaatttttccggttatagaatggaataattaaatttttattcaaaattagcaatgcttatattgcagataaatcaagaaaaataaaaagattggaaatttaactgattttaatatattattttaatgtttctataaatttatattatttttaattaacaaattctaaaaataataataatttcttaatgaatcattaggtaaaaaaacaaaaataaa

SEQ ID NO: 56843 - DNA, 73 bp, Heterodera glycines
  Genomic contig location: Contig_ID=SeqID_26099; Location=1611..1683; Strand=-
  SCN-specific regions: Sequence locations=1-73
cagggatgtgccgagccagacaaaatccgattccgattaaatcgccgattccgattatggccaaaaatccgat

SEQ ID NO: 56844 - DNA, 1032 bp, Heterodera glycines
  Genomic contig location: Contig_ID=SeqID_5084; Location=803..1834; Strand=-
  SCN-specific regions: Sequence locations=1-650,692-692,763-766,804 -807,844-855,878-896,928-939,962-980,1011-1032
atgcccaccaactatgactatcatagcaagcgattatggaaccgctcatggaacacaaagtgtgtggcactaccataccaaagtgcggaggtatggtgtaggcatctctgtgtcgggtaattactcccttcacagagcatttgcgccaacgcccacagcacatatgtgttccgtctacgcggattttaatccggggtgttgagtttgagcagctgcgcgttcgacactgctcagtgactcacggtcctccgggccagccagtcccggttattctctcgctgtaccaatgcagcccgtaggcagggcacattagggctaggaaccgccacccccgctgctaggaacaggcacaccttcaccctcaaggccagcgagtgaagggcccccgtccacaccagaccgactatctggctgggcttaaacatcgctgtgacacccggcgggctatgacggaaacatggtttcggtcaatcactgccgcagccctggataccagcggaataagccccgtggacagtgaacgcccgtgcccaccactctgggaagtaacccagtaccggggcaggactcctcggtttaaggatggcccccaggatatttgaaaaggcttaacaaatatcctaaaggggtttagtaccgagtaaaccaacaaaaaatggggtgagaaaggacagtacaaagtacttatgatcaatgaaaatgaataaaaaacaaggggaaaaatgaataaaaaaggaaaaaaaagagtggaaaataaaaatattttaaagagggaaaccaaaaataattaaaatttggaaaaagcggaaaattaatgaaaaataatttttaatttgaaaaaaactgaacgccaagaatttaattaatttttaaatttcaaaatacagaacggcaagaatttaaataatttttaaatttgaaaaaaaacagaatgccaagaatttaaataatttttaaatttgaaaaaacagaacgccaagaatttaaataatttttaaatttaaaaaatagaacgccaataatttaaataaa

SEQ ID NO: 56845 - DNA, 703 bp, Heterodera glycines
  Genomic contig location: Contig_ID=SeqID_5084; Location=1880..2582; Strand=+
  SCN-specific regions: Sequence locations=1-114,136-341,382-400,424-703
atgagccaattttccgacgattccctcccccctacccttgatggaccgtattcccctgtcggggatgatggaaccgaactgatggatgatgcgccgccgctggaaaacgtcatcaaacacctgccaaacaccgtacgtttttgcgaaatgtttttaaattttcttttctaattttgtgagatcgtttcaggttgtgccgtctgaagagaatgagcgcaagacccgcagggagccatcaattacccgcgaattggacgcggaattgttcaaccgagatggatttgtgtgtttatccgccgcacaggcggaagcgggacggttcaaaggtgtggttgtacaacttttttttaattttaaaatttctaactttaattaattattcgctttatgctatgaaaagtatataaaaatttttttttatttgtactttgattaattgaggtattttaaatgatgtttagcgtttcgattcattggccaatttttgctgagcctaacgttcggcgctgtttttccggaggacattctgcgcaacctctttaccatgtgcctttcctacgcagtcgagggggccgaatcgatgaaaatatctgcggaccacttcattttccttctgacgtcaaaacaccttgactacgaagtggctgtacactttaaaaaaaatcgacaacacggcaacggagaggattctgactcgttttga

SEQ ID NO: 56846 - DNA, 598 bp, Heterodera glycines
  Genomic contig location: Contig_ID=SeqID_5085; Location=833..1430; Strand=+
  SCN-specific regions: Sequence locations=1-366,391-506,547-598
atggagcccggagcgaagaagcgcagaaagaggaagaatgccgaaaacaccgacggcgaagccatggaatgcgaagaagaagaggatgccgtagatgaggacgccgagaacaactggatgctggggtatgaagaagccggggagaaacccgagtcggtgacaacgtacgcatacgcccacgccggtatatttgaaaataaaatttttgtaaacatcgatatgatcacgtgctgatttatggtgaaatgttgcgcatgggagtccgccccgaactcatccgccaaggcaaccatctcctggaaatgaaggcgcgcaaaacaggagtctacacacccaccgtgtttcgggacaggtaaaaattcgaagatttaaattatttaaagttctattcattcagttataagctgataccgatcaaattggcaaattttgtcaaaacgtttggtctggaaattgagggcgtggaaaacaagaaatattttccacacaaattcaataaggtaaggataatttattgaaaaattgataaaaaattaataaaatttaggcggaaaactacggcacagtcttggaaaccttgccaccgatggaggactaa

SEQ ID NO: 56847 - DNA, 1183 bp, Heterodera glycines
  Genomic contig location: Contig_ID=SeqID_5085; Location=2239..3421; Strand=+
  SCN-specific regions: Sequence locations=1-89,112-163,185-270,315 -343,366-392,418-528,550-630,652-735,769-821,855-869,901-906,939 -943,979-986,1013-1047,1072-1100,1139-1140
atgtacccgcgcggcttgatcgaccccgagtacaattgcgatcattttgaggactctgaaaggggtgagtttgaagcttgtaattaagcaaatattttttcttaataggcttttgacaacagtcacacacattgagctggaagccgctctccgctcgtggtacaaggtgacgcatgtgtaccgtgcctatatctggcctctggcgtgcgattggagcaatgggctgttccactcgtacctgctgaagtttctcaaaatgaaatttgaaggtaaaatttaaaaaaaattaataaaaatcattaacaaaaatttaagcaagcggatatccggcgtcttgtacggaggctggcatcagcgaggaggagtcggaacggcgcaagcaggaccacatcgacaaggccaaacaaaaggcccacgttcatctggaggctgaccggatcaagcacaatcccgggctccgctacctgtccaagttgtgcttaaactcgctgtggggccggttcgcacttcggtaaaattttggttaagaattatgaaaaaatacaaatcctacagaaaccggcttacccaaactcgaaatcgtcgagtgctatgccgaggtggccaaactgctcaccaactccaaaaattgggggcagcagcatttgttcaacttggcggaaaaagttttggatgggcttggttaaaaggggcaaaaaagagccttggggggggaggccccccccaaccaaggggaaaaaaaaaatttttaaaaaattttaaaaaaaacaaattgggaattttttcccaggggggggcattggccctttggggcccccccctctttgggggggaaaacccctttttttgggaaatacccaaaaaaaaaagggggggggggcccccccccccccccgggggaaagagccccccccccccccccccctcttccctccccctggggaaaaaatataaaaaaaaaaaaaaaaaaaaaaaaaaggggggagaaataattttttttataaatataaaagaccacgcgggccccaagatttttttttcttataacctaaccctccccgccccgcccggtggggggggggcacccacccccctccctcgggggggggggggaggggagatcgtgggggggggcgggcgccccccgcccgccccacaccccccccccaccccccccccccca

SEQ ID NO: 56848 - DNA, 58 bp, Heterodera glycines
  Genomic contig location: Contig_ID=SeqID_26101; Location=283..340; Strand=-
  SCN-specific regions: Sequence locations=1-58
aatttgcggtgtcatttgtcaaaattgtccccatattgacaatgcccaaatttaaaaa

SEQ ID NO: 56849 - DNA, 1527 bp, Heterodera glycines
  Genomic contig location: Contig_ID=SeqID_26102; Location=1..1527; Strand=+
  SCN-specific regions: Sequence locations=1-639,747-941,963-1017,1118 -1203,1247-1338,1381-1527
gtcggcgagtcaaccatcggcgagttggcgtcggcgagtcgaccatcggcgagtcggcgtcggcgagtcaaccatcggcgagtcggcgtcggcgagtcaaccatcgggcgaggtggcgtcggcgagtcgaccatcggcgagtcggcgtcggcgagtcaaccatcgggcgagttggcgtcggcgagtcgaccatcggcgagtcggcgtcggcgagtcaaccatcggcgaagttggcgtcggcgagtcgaccatcggcgagtcggcgtcggcgagtcaaccatcggcgagcgagtcgaccatcggcgagtcggcgtcggcgagttggcgtcggcgagtcgaccatcggcgagtcggcgtcggcgagtcaaccatcggcgagttggcgtcggcgagtcgaccatcggcgagtcggcgtcggcgagtcaaccatcggcgagttggcgtcggcgagtcgaccatcggcgagtcggcgtcggcgagtcaaccatcggcgagtcggcgtcggcgagtcgaccatcgccgagtcggcgtcggcgagtcgaccatcggcgagtcggcgtggcgcgttgaactgttcccctagtgcatgtatgtttgcaaaatggttaggacgctaagactcattttttgtctttatgctatttttaaaaatatttcattttatcataaaaacaaatttgaatatttatttattacaaaattttgaaataattaatattttttattgcaattaaaattaatatattcatctgattttatttaatgctcatcactaaaatttagttatttttttagatttgtagactaattttgagagttaattgttttacgtaatgatttgcatttgaatgattttgcatttttttaatcagaattttttataggaaattttttctaaatttactttatcaggatattttatttgcttctttctttgttcggctgaataaatgaatgttaggaatattgtatttgaaagttattaaatttatgcttttgtttttaattagatttctgtttttattaattaatagattttttaaaaattctctttgattaaattacggttttagttataaattaaatgttttttgaatcttttttattatttttttaagtttgagatatttaaattcttgaattttctcgacttcacgatgaaaaaattcaatttattgacgtccaactgcgatcgaaataagctatattataatatttttaatattatttttttaaaattaaatttgtagtgctataaaaacaattatttacataaaaatttttactcaaataattttcacgtaattttttctagagttcttggaaaggtgatatcagaatataattttaaaatttcttacaaaattgaaaaaaatttatgtaccagaaattctgagtcaagatttacttggacaaaaaaaaattttgttttcctaccccttagcggatttaagaaacaacctagcaccaaaatcttttcaggattggatttttgaccgattagtttctttgaaaattaaaaatgca

SEQ ID NO: 56850 - DNA, 925 bp, Heterodera glycines
  Genomic contig location: Contig_ID=SeqID_26103; Location=507..1431; Strand=+
  SCN-specific regions: Sequence locations=1-354,376-890,913-925
atgtatggtaagtatgatgacatgaatccatgatcagatcatcccttcttggtgatcgcgatatttttttaatcccgtttttcatcgaaaggagtccattgtcaaattacttgcagattttcacaatttttctcacattaatccaaatcctggtaatagtaccgatggtagttcccccttttgaaaaaaaaaatttgtgatttcaaaataattaaaacaagtttttaggggttttctgggctgctgatcacgaatcttgcgtccatttcgaccaatccctaaacccggacccaaatttgaacaaaaagtcgaaaattaaacttttcgacttttgaatttttggttcaaaaacggcttaaacacatagaaacaaactaaaagtcatcaatcctgcaattatagatcaattaaactatttttatacataaaaacgcaaagttcgaaaagtttaattttcgactttttgttcgaatttgggtccggatttagggagaccaaattcaacattcttggtatcattcgaaagcccttcagatgcactattagcctgcaaaattccaaaaaatttcgttcagtataaaaaagttcgaaaaaaatttcgttcagtataaaaaagttcgagccaaaaaaagttggaaaatttggtttgttgaactcttctgaccataacttttttgaaccttaacggaatttttccaaattttgtaggctaatagagaacacttagggctatcgaatgataccaagattattggatttggttgacaaagaaaaagttatagttcaaaaactcgccccacgcgaaaacgaccccgacccaaaaaaaaatgatggaatgaagtgaaaaatgcgtaactttaaattttaaagtagaggaagttagcggacagatcaaacaaaaagacatttttatgaacacttcata

SEQ ID NO: 56851 - DNA, 1157 bp, Heterodera glycines
  Genomic contig location: Contig_ID=SeqID_26104; Location=1009..2165; Strand=-
  SCN-specific regions: Sequence locations=1-319,373-389,411-412,437 -498,547-594,623-640,922-941,963-1157
atgaaactgttgccgactgtgctccaacctgtgctatttttggcattcgtcgccaatgttttctcatgtaggggcacaaattttaatgaccaaaattttaataccacggatttatagaccaagagccgatattaccggtttggtgctatgaaggcatccatgttggtggccaagcgaatattttgacagtgaacatttccggcagcgacaaaaaatcgctcattttcaatggcgaaatgcgaaaacacctttgtgtaatatatcaatcagatagtagacaggacgtgaaagaatgtgttgaacacgtgtgctataagggtaattaattaattaaataattgatatttttacgtttattaattagaatattttgagtagctctgatttattcagtaagtccaaatttgtcttgttcaatttcatagtattttaaacaatttaaatagataaaaggctgaatataagtttggagcgaccagcccacaaaaaaaataagccaaaaaatttatagaaaaaagtaatttaataaaaaaaaattttatttatccggtaataatcattctgaatttaaagtttgattgtcatctcaaaaagtaattattaatttttcttttaaatttatcaggtaagaatcatttggaattaaagtttatttatcaaaaagtaattaataataattattattattttttgatttattaagaatcattttggatttaaagtttatttatcaaaaagtaattaataataataatttttattttttattaagaatcattttgggtttaaagtttatttatcaaaaagtaattaataataattattattattttttaaatttattaagaatcattttggatttaaagtttatttatcaaaaagtaattaataataataattattattttttaaatttattaagaatcattttggatttaaagtttatttaagattgttattaattgtagatggtgaactgcaaatggtgttcaatctatgcgctaagcatggctatagtcaagtttgtactcctgatgatgaactgattggacttgttgtggcgagtcaatgccagggtggtcaatacaaatgctcaagacgttacattttgaagaacgaccgaaccatcccgccggcgcaacgtgtaaaacaaactg

SEQ ID NO: 56852 - DNA, 1217 bp, Heterodera glycines
  Genomic contig location: Contig_ID=SeqID_26105; Location=16..1232; Strand=-
  SCN-specific regions: Sequence locations=1-219,246-359,382-389,413 -807,829-833,860-878,914-1217
  Gene Ontology: Mol. function=transposase activity; Cellular component= nuclear chromosome
atgtcattgatttggaaatatttcaaattatctggtcgcgttgctttttgcaatatttgcgattttaaaaaggattatccaccaagagctccgacaacaccgttaatttctcatttggagcacaaacaccctgatttgcataaagagtttgcaaaaaagaaaaaggattctgctgcatttgaccaattgagcattaaaaggctgggcaacatttctagccattttttattttaaaatttagggctttttgttcatcagctccaagctgttcggtcccattaacaattgccgaagatgattttgatggcgaatcagttcagcctccaaagcacattaaatcgattatactgcactcattacaagcaaaaagttattccatttaggtttttgtttttattgataatgattttaggcccatgggaaaaagatggcgaaaaaactttaatcataaacaccaaaataatggaaatgatcgcagtggacctgcagccactttccatggttgaaaatgaaggattcagacgacttattcacgaattacaaccgaaataccatatgcctggccgcaaattttttacaacaaatttaatgccgaaaattgttgaaacattaaaggtgtttggccgttttaaattcccgaaatatataaatttttaggctcgcattaaaaaggacattaaaaaaacaaatttcatctctttgactatcgattgttggagttctaaagatgcagcgcactctcttctttcagttacctgtcacttcatttacgagggccaaccaaaattcgttgtcttggctgctaagccaattaaaggttaacaaatgtcatcatattttattaaattattaaattttaggacggcataacgctactgtcttaaaggatttattaatgaaagtttttgttgaattttcattagaaaagtcaaaaatttttgtcgttttacgggatgctgcagaggtgatggtcaaagtttgtaccgaccttggcttaaaatcaatcgattgctttgcgcacaaatgcaatttggttaaatatagtttatgcattatgtaaccttaaattatgtattcaggccatttgggacggtgttcgaaagttgaatgatgacgaatcgacaaaaagccttcttgaacggattaaaaaattagtcagaaagcttaaaaaatcgcctgtacagaaagaacaggaagggaatttacaaaaacttctg

SEQ ID NO: 56853 - DNA, 358 bp, Heterodera glycines
  Genomic contig location: Contig_ID=SeqID_26105; Location=1819..2176; Strand=+
  SCN-specific regions: Sequence locations=1-24,46-128,155-358
atgtcggaaagtccaaaaaaagtgggaaaacaaatggaaaaagcaatgtaaattttgatagaatcaattttcaattaattcattaattccgcgttcgtttagcttcatcactggcgacgattggctttcggtgttccatttggtccccccttttcagctgggccttggcattgcgttgctcagccaccgatttgaccgattggtggacgaacacttcaaaacgcggcgttgggcgttggacgaaattggaattcgtcgcacatttgaaaaggatggccaatatgagatgcaaattaccaattccaaattggatccgtcgccaattgagacaaaagtgttcgacttttacctaaagtga

SEQ ID NO: 56854 - DNA, 2199 bp, Heterodera glycines
  Genomic contig location: Contig_ID=SeqID_26107; Location=190..2388; Strand=-
  SCN-specific regions: Sequence locations=1-1878,1900-2199
  Gene Ontology: Cellular component=small nuclear ribonucleoprotein complex; Biological process=mRNA splicing
cattccagtcactgggactcaattctccagcatttcaatcactgggactcaattctccggcatttcaatcaccgggactcaatcctccagcattccagtcactgggactcaattctccggcatttcaatcaccgggactcaacccaccagcatttcaatcactgggactcaattctccagcatttcaatcaccgggactcaatcctccagcattccagtcactgggactcaattctccggcatttcaatcaccggcactcaaccctccagcatttcaatcactgggactcaatcctccggcatttcaatcaccgggactcaacccaccagcattccagtcgccgggactcaaccctccagcattccaatcacttggaatcactcaatccacctgcattccaatcactgggactcaattctccagcatttcaatcaccgggactcaatcctccagcattccagtcactgggactcaattctccagcatttcaatcactgggactcaattctccggcatttcaatcaccgggactcaatcctccagcattccagtcactgggactcaattctccggcatttcaatcaccgggactcaacccaccagcatttcaatcactgggactcaattctccagcatttcaatcaccgggactcaatcctccagcattccagtcactgggactcaattctccggcatttcaatcaccgggactcaacccaccagcattccagtcgccgggactcaaccctccatcatttcaatcaccgggactcaacccaccagcattccagtcgccgggactcaaccctccagcattccaatcacttggaatcactcaatccacctgcattccaatcaccaacaataaatctcgccgattcttctgcataccaatcgctgggactcagttctacgaccttcaatcaccgttactcaatccatcagcactcgaaacacctggactcaatctcaccaattctacataggcaaaacattttaacattctactggcctttttgtttcttgtcatttcttaaacaaccctcggcatttcaatcatcggaactctatctcaccaattctccggcattccagtcactgggaccaacccaccagcattccagtcactgggactcattctcctgcatttcaatcaccgggactcaaccctccagcatttcaatcactgggactcaatcctccggcatttcaatcactgggagtcaaatctacgagcattccgaacactgggactcaattctacagcatttcaatcactgggactcaattgtcgtgcatttcaatcaacgggactcatccctccagcatttcaatcactgggactcaattctccagcatttcgatcactgggactcaatcctccagcattccagtcactgggactcaattctcatgcatttcaatcactgggagttaaccctccagcattccagtcactgggactcaattctccggcatttcaatcactgggactcaatcctccagcattccagtcactgggactcaattctcatgcatttcaatcactgggagtcaaccctcatttcaatcactgggagtcaaatctacggcgttccgaacactggtactcaattctccagcattccagtcgccgggactcaaccctccagcatttcaatcaccgggactcaacccaccagcattccagtcgccgggactcaaccctccagcatttcaatcactgggactcaatcctccagcattccagtcactgggactcaattctccggcatttcaatcaccggcactcaaccctccagcatttcaatcactgggactcaatcctccggcatttcaatcactgggactcaatcctcggcattccgaacactgggactcaaccctctagcatttcaatcactgggactcaacccaccagcatttcaatcactgggactcaattctccagcatttcaatcaccgggactcaatcctccagcattccagtcactgggactcaattctccagcatttcaatcactgggactcaattctccggcatttcaatcaccgggactcaatcctccagcattccagtcactgggactcaattctccggcatttcaatcaccgggactcaacccaccagcatttcaatcactgggactcaattctccagcatttcaatcaccgggactcaatcctccagcattcca

SEQ ID NO: 56855 - DNA, 304 bp, Heterodera glycines
  Genomic contig location: Contig_ID=SeqID_26108; Location=569..872; Strand=+
  SCN-specific regions: Sequence locations=1-80,111-150,174-304
atgagcaaaaatacctcaacaatgttattattttctctattagcaaaccgaatatttcttgttacaagcggtgattagtgaaaattaataaaaataataattcatttaatctatttcaagcctaaaatgggaaaatattcattttctaaattaaatattaatctttcttttcagtcaatgatttgacagaagcaattggttccatgaaggagaaattgttcaccatttatcaaaaatatgacactgactttacgccaaatattccttcaattcttgaaacggaacgtcaagaattttttaacaa

SEQ ID NO: 56856 - DNA, 5763 bp, Heterodera glycines
  Genomic contig location: Contig_ID=SeqID_584; Location=380..6142; Strand=-
  SCN-specific regions: Sequence locations=1-212,234-2363,2385 -2421,2443-2696,2718-4112,4134-5763
atgcctaatcttcggtcgcctccgcttactcgtcaaagagcactcaacctcggcattcgtctaaataacaacgcaaaccagcagggggggcaacaaattgtagaaccacagcacctagcagaccgacgtttggaaaacgaggctcgccataattctgtctcttcagttgcttcatcacttttggacccaactgaaattcgccgacgcctgctcatgtctggaattggagaaaatgctgctggagttcagaacggaccgcaagatgagcaacaattcgacgcactgctgaaccagcatggtaacgacttgtttcaaaatgaaaatcggggagaaaattttgagagggacgtttttcaaccggtggtcagagaaccgccgttgcaattttcggaaaattttgaaaatggtccgaggcaatatgagttagttggggtacggcctgttgtgacttcgacgccccatgcggtgcaaccacaaaggcgaccaaactctgaacccttaaacccgggcttagttcgtccccaagcgatgtttctgaatagttttcaacaaaatatcgccgcaaatccaaacggcaatcaacggcaaagagccgaacagcgtttcattgatgaagacgaacgacaagcggctctggttagacaccgccaagcaaatttgacccattatgtgaacaacgaccgcgattttaacgcgtttcatcctatcgctggtgctcaacacgtttggcgcgcacaaattcagcatgtttcatacccaaacaacccgcaaatcggcgaggttaaccctcaacaaattccgcgacaaaatcaaggatttgtagggaatcaacaaatttttcgtcccgttgcggtacgaaatgattttcaccctgaaaattatggcgacaatttcaacttcggacatccagaacagcaaaattttggtcagcaaagaactgaacaaattcaaatcgcaaatttggaatatgttttgactttggaccgtctgccagagctaaaaggaaatgaaggagcggataaagtaaaaaattttttcaaaaaattttcaaacgcaacggaagaatggcccgagcataaaagggttaaggcattagaaacgaaagtttcaggccgtgcagaacgtgcttttaatgcagcaataagctctggaccacatcgcttcgattcaattcgacgtgcaatgcagaatcagttggaagagacggattgccgtgagatgggagcatttgatgagctgatgagcggcgtaaagcgtcgttcgaatgaaaatttggacgcattggcggatagaatccaaagcctcgtctcccgtgcctatccgggattgacacaaaatctatgcgacgattatgccattaaacatttcatcagagctctagcaaatcctgagctatctctaactttggaaatgtcgcggaaatcgggaatgtccttcgatgaattcgtggcactagcagctcgtgccgaatcgattcagcgggcgaccagagtgtcatccaatgaaaacaaatactcggataatcggaaccgaggcttttatttttcgaataatttctcaagaccgcaaagttctgagttccaaggatactcacaacaacctcgaggaaggattgtttgctacaattgcaatgagccgggtcatctttctcgggattgtaatcagcagatcaaagggcagcgagtcaacagcaacgaaaatgagcgaattcgcaatcaatttgcgacgggttcgaattctttagcgattcgtaacaacgaagagtcgccaaaaaacaaccaaagaaattttcaacccaaatcacagaattttctcaaacaaaactgcatcgttatgcaggaggaccaaccacctgatgcattttgctgtggtgtgcaactgacatcggaggtttcgaattttttggagaatgagttgcatgagaaaaatcagagtgaagagtccaaagaaaaggaccatgtaggaaaaattttggtgatcagagtggagacgaacaatgttagaacggatgcaatgttggatggaggggctcaaatttcattgattggagcagaatttctttacaaattgataaaggagcacggcctggacctgagaaaatccggtttttctcgtacgaaggcacgaattgctgacgtaaacggacaacaattgaaatgttttggaatggttacaataccaatttcaagaaaaggacgcgagaaaacgccaatttgtttccatataacaacggcgcaatttggctacaatttgctgtttggtacgaactcaatgtcgaaattgggctttcttctatacgactcggtgaacaaagaaatgattgaatttgaggaagggcagcaaaatgatgggaatgcagctcgaattattttttctacaaaaatcgaacctcgaacgaccaaattaattgaaattggagtagacaaagaatggaatggtaaagatgtgatcatcttaccttcaaacatcgaaagcggtgttaaagttgagccaacagttggaaaagttgaagatggcagagtgattgcacaaatcacaaattattcgaccctttcgcaacgcgtcaatgaaaaaacttatatcggcatgattgaaaaggtggacgagatttttgacaccgaaaattcaattttgtcagctgaaatttcatcaacaatggcttacggcaaaaacgaaagtgggaaactcggacgcgctgatcttcacatcggagaaattttggggcatcataagaccgaactgttggaacttataagccaacacaccgaaattttcgctacttctgaacaggaattaagccaaactgacttaatccgtcacaagatcgaaacgggaaatgcgcttccaattaaatcgcaaattcgcccagtcccatatgcctaccgagaaaaggtatcggcaatgattcaagactacttaggccgcggaataattcgctcatcaaattcgccatgggcttccccgattgtgatcgtgccgaaaaaagacggaacgctgagattttgtgtcgattacagaaaacttaactctgtaacagtgaaagatgcatttccgctacccaacatcgacaacacacttttagccttgggcggaaagaaggttttttcgactctggacttcatttcgggatattggcagattaaaatggatcgtaattcgattgagaagacggctttttcgacagagtttggtcttcacgaatttttggttctccctttcggcctttgcaacgcagtggcaacatttcagcggtttatgacccgactttttgcggaatgtcttaacaaattcgtctttatctacatagacgacgtcttaatcgcatctgaatcatgggacaaacacatcgaacatctgaaagaagtttttaaacggatagaaaatgccggactgaaattgaaagtaagcaaatgccattttgcttcaaacgaacttccgtttctgggccatattctctcccgtgaaggattgaaaatggacatggcaaaagtaaaacctgtcctggatctgcccattccgtccaccaaaaaacaacttcaatctcttctcggttttctcgcatattaccgcaaattcatctacgggtttggcggaattgctgctccactttattcacttttaaaaaaagacataaatttcaagatcggcgacttagaaaagaaagcgattaatacgttaaaaagcaaaatcgtcagtgatgttatgcttcattttccaaacttcgaagcagcgaaaaatgacacaacgagaaaatttattctcttaaccgacgcaagtaaaattggtattgccgcaatactttgtcaacccgacgaaaaaggcaacattcggcctatttactttgcatcacgacaatgtaaaaactatgaaagcagatactgcccaacagaattggaggctttggctgtgcgattcggtaccaagaaattcagccaatttatcaccatgatgcccacaaaaatttttacggaccatcgagcattgataccaatgttcaaaagtaaaaaggaaacgggaaacagccgtgtggacaaatggctgatggaaatgaatgcgaaattcattttggaagttgaataccatgccggaaagaaaaatgtgatcgcagatgtactctcacgctctctcgctttaaaatgtttggattcgccaagtgaagccgaaaaagtcatcatcggacaggttcgccgatctgaaaatggtcaaagacctcaagaaatcttatcgcaccaggaatgggtgaagaaaacgaaagagagcgagctcggatttctatatgatttcctgacaacaaaagtactcccaatagaaccgaaaagtcggcaaaaactggcatcttcacttcacaatttcacaattataaatgaacttctttataaatgtggaaaagacgctgaacttcgccttttcgtcccgtcttcttttcgacaaaagttgataagagaacgacattcgggtgtttgttctggacatatgagcggaaagaaaatctttcttcagttggcagagaagtatttttggccgaatatgtatttcgactgtgttaaatctgcatttcaatgccgaatttgtgcgcatacaagaaacccgaggtcaaatgagcctcctctgaaaattgtagctacggcagaaccgctcgaattggtctgcctcgacattttatcgattggtcccgcgcactcgtgcaacaaatatattttggttgctgtagaccacttctcaaaatatttggtggcaaccgccattccaaataaaagtgctgacaccatcgccaaagagttcgttaagaactttatcttaattttgggagtgccgaaaaaattacacagcgacagaggaaaagagtttcttaacgaaactctaaacgaaattgccaaagttttgaaaatggagaagagccttacgtcaggctatgatcctcaggcgaacggagtgaccgaaagggtcaaccagacgattttgagcatgttaaaacgctcaacagcttcaaattggacgtgggatgatcgccttccgttcgttgtattttcatataatacgaccccatcagaaatgacaaagatttcgccacaccatttgatgtttggaaaaccggccaacttcccgtccgatgtcagtttccctgtaaatccacagtacacagttgatgtggacgaatacatacaattgttccgagaaaacatcgcccatttggtcgttaaggcgagagaacactcagaaaaagaacggcagaagatgaaaaataactacgataaacaagcaaaagtaactgccaacaaatttgaaattggacaaagagtaatggttatctttcccggcacaaataagcgttcgccgcatcataaaataatgtggaatcattttggtcctttcaaaatcttggaaatttctgcttcagcagcgtctgttgtcccaatcgataaactgaattcaaaaccgttgaaagtacccattgagaggatggttagagtgccggacggagtcccggacataagcacgcttccgaaaggcaaaaacccgtataaaaatcagcttaatgcgcttctgtgcattgtctgtctgatttacaacgaaaaacttgaaaatgagacggattataacctgcttaaaggcaaggaccatcctcaaaatatcagcaaaaatacttctttccagggagatagaatggattctcaaaaaagtccgaaagtaaacggaaaaaatttgatgggaacggaaattaaggattttttgggaaaattcgcggaattgtggcacaattga

SEQ ID NO: 56857 - DNA, 1591 bp, Heterodera glycines
  Genomic contig location: Contig_ID=SeqID_5087; Location=377..1967; Strand=+
  SCN-specific regions: Sequence locations=1-518,542-626,648-1075,1097 -1402,1424-1552,1574-1591
atggaaaaccgcgggaaattgtgagtgaaaatattgtaatttaaacataaaaggagaaggaaattgaccaaaaataaggattgtttacccaaaggaatgtaattcattacatttaatttacttttcctgtcgtttcatctttttcaattaagttcattgtcaatctgatcaaccaatacggccgtgaacacattttgggcaaattattccaatcagttgccaaaacggttacatttgacaatgtccgttttgaacacttcgacttccatcgccattgctcctcgctgaattgggacagattgtcgttgctgcatgagagattggcacccgaagttaacaactttgggtaacatcattcatctttttacattacgttttcattattttcagctttttcttgaccaaattggagcgtaaaagtggtggtaaaaagtccgacggtctttgggaggattcgagcgcagttggggagagaaaatatcagaacggattattccgaacgaattgcatggagtgagttaaattaatcattttcctaagtaggcgttaattacttccccaatttcagttgtttggacaggacaaacgttgttcaggcacttttggccatggaatcattgcggtagttttttgggattttactataatacgccattttcatcagtcttcaactccaaagcattggcattttgcctcaaaatgtgaaaaactttgatgcctggcccggctttgtttatactttcaagaattgtaaatcgttcatatcagtggtgaattcgttttgataacgtttgttcagtgtgggccgataacggcgatgactgcagcaaacagtacgcgggcacagcggcgctgaaggcattttttggggggtgggggaatgatttgttcaaatttctttcgtcttttacagacggattacacacggatcggacgacggacattcggcggggcattgcaagacgcacacaattcacttatgcgctatttcaaaaacaattggagcgacgggtacagacaggtcaatggcattggcaaattggagataattcaccaatcaatgggtggtgtttaggacgcgatcaatctgttcctcggcaattacgtggtgaaccgatacaatttgcccgctgggttggaccattcgccagtcgctttcgatttgaatggcttcgccattgtgttctccgtgataacttttgccatgacaatcctttgtcttttggtgtccggtccgttttgcccatttttcctaatttttccccaaaattcagaaaaccctttcatcgctttgttttggctggctctttctgtgatgatgctctctttcatttggctccatggcgaagacttttccgaccgtcctcgtcttgttgtgtctggcaactgatgctaactcatcaatgtgccaattttggatgtgccgtttgaactccaaacaaagaaaagaaagttgtgaattttcccccaaactcgttttctacaatatgccgataagtacagtattcaacataatgtccggtcagttcggctttgccatataactcattaatgtatgtgtgtaaatgtgcttattattaggttgttttga

SEQ ID NO: 56858 - DNA, 87 bp, Heterodera glycines
  Genomic contig location: Contig_ID=SeqID_5088; Location=1037..1123; Strand=+
  SCN-specific regions: Sequence locations=1-87
atgttggcggctttgaatttttctgatcgaattttgggcggaattcgtcatccatcgcccgcattcattcgttgccacaatttggcc

SEQ ID NO: 56859 - DNA, 831 bp, Heterodera glycines
  Genomic contig location: Contig_ID=SeqID_26111; Location=1323..2153; Strand=+
  SCN-specific regions: Sequence locations=1-67,91-616,643-802,826-831
atggaccgagaaaacctggaagattcaaagaatgagaacaaacaactaaaggagaaaatccagaaacaagaagaggaaatggaaagaatgcgaaaggcactgaatgaagggcagagttcgtctgcgggtgcgggtacttcatcggccaaggttttgagcgattgtacgggaaggggggggggtgtttacaggggcgtcacggaaattgtatggcagttgcaattggggagggaggactatcaaaatgttgggacttggtttattttattttttgggtaatcaattgtcaattaatcggaaacaatttacaggcgtcagcgtctttctctgatcagaaaattcccgtccgtggccgtctttcgctttgtaaaagtgttaagtacgatgtaacactcggcgaaatcgaacgccgtgttacgggactcgagaagattactccgaacgagtacctccgttttctgcgcacacagaaggcaaaagggaaaggacgaaaattgcaggaagagatcgggaaggaggtttgtaaaacattcctaaacctgaaaagccaagagggacccttaggttttttgaaattttccgaacaaacttacttcggatgctaaaaacactgctgatttatttttactttattaaattttttgtccacagcgttggggaccagccattgctgctgcgatgcaattcaatctggaacgtgaaaagaatgaacaaacctgcttcactcctcttacagaaggggaggcatgcaaagcaagtttaagccatgggtgggggtggagaaactgttggatgattagccccaaaaagtttttcaaaaccaaattttga

SEQ ID NO: 56860 - DNA, 65 bp, Heterodera glycines
  Genomic contig location: Contig_ID=SeqID_26111; Location=2355..2419; Strand=+
  SCN-specific regions: Sequence locations=1-65
atgtcatttgcctcagtcgctggtcaaggcgatgggtacacacagcaggagctgttcaaatttcg

SEQ ID NO: 56861 - DNA, 418 bp, Heterodera glycines
  Genomic contig location: Contig_ID=SeqID_26112; Location=400..817; Strand=+
  SCN-specific regions: Sequence locations=1-418
atggtgatccgattcaagacatcagaaaaatttgaatgtttaacagaggaaaaatgggaaattccacctttaaagcaatacacaaaaaaagagcaaaccatcgatggtaagtcagcctcctcttcatgctcctcttggtcatcatcctcaaaatcagcggcatcggtcgccggaactgcgccaaaaattgataaattatttattgtttcagcgaacatttcggagccaacattgtgtgctgctcgggggttcgagccccgctagatgtggcataatttgttagggtgcaccccaaaatctcgccgccggaatctcgccggccgaaatctcgccgcagaaatttcaaaaaaaaaatttcaaacttagaaatttttcaaggaaaaaattcttagaaaaatttttttataagaaaatttaa

SEQ ID NO: 56862 - DNA, 213 bp, Heterodera glycines
  Genomic contig location: Contig_ID=SeqID_26112; Location=1214..1426; Strand=-
  SCN-specific regions: Sequence locations=1-147,169-213
aattttttcgttggatggaacaaatgaacatgaacatattattgacgggaaagttcaaagtgtggcgatcagtcagaatggcgacttgtacatgacgaaacagccgacccacgggacggaagagtccgccatttggaggtaattgcgtgggttttgttttcactgttctattactcttaattcagatcacacatcgatcatccaatagtctaa

SEQ ID NO: 56863 - DNA, 1344 bp, Heterodera glycines
  Genomic contig location: Contig_ID=SeqID_26113; Location=821..2164; Strand=-
  SCN-specific regions: Sequence locations=1-446,468-1344
atgttgaagcaggacaaagtgtggcaatgggcagattgtcaaaatgcttttgagaatgtgatcaagattttgaaatctgatcagttgctgacacactatgacccggcacaagagatcattgtatcggctgatgcttctgagcatggaattggagccgtgatctctcatcgcttttcggatggaagtctaaaagccatcgcacatgcatcatcgtccctgtcagcagcagaaaagaattattctcaaatcgagaaagaaggcttagcgattgtctttgccgttcaaaaattccacaagtatctcttcgggagacacttcgttctgcagacggaccacaagccgttgttgtccatttttgggaacaaaaagggaattaaggcttgcacagcgaatcgattgcagagatgggcaatcacattgctcggctatgacttcgaaattgaataccaaaatactgctgattttggtcaagcggatgttttgtcgcgtcttatcgctaagacaccagtgccggacaacggagtgatcattgcaaacattcgtgagagcaatgaaacgggagtgttgaattttgttacgaaaactcttcctctcgatcacagtgatttggctaatgccgcgaaaagtgatcaggcgatcaaaaatgtgaagaaatttgtctgctcacattggccaacaaagaacaaaatggccgcagacattgttccgttccatcgacgacgatacgctttgaccatcgaggatgaatgtctgctttatgcggacagagttgtgattccggcatcgcttcaaaaagatgtcttacaacttctgcatcgaggccatcccggaatgaagcgaatgaaaggtctcgccaggcagtacgtttactggcctgggatggacgaacaaattgagaattttgtcaaaatgtgcaacgaatgcacaatggaagcaaagatgccggtgaagactgagcttcactcgtggccgaaagctgatggaccgtggaaacgcgtacatttggactacgccggaccgtttatgggaaaaatgtttctcataattgttgacgcgtactcgaagtggcccgaggtcttcgaaatgcgttcatcgaattccgcggctacaatcgacaaattgcgatcactctgtgccagttatggccttcccgaaattttagtcacggacaacggcacacaattcgcttcaaaagaatttaaggaatttgtgaccgaaaatggcatcaaccatctgttctccgctccgtacaatcccatgtcgaacggacaagccgagcgttttgtcgatacgttcaagaggacatgtcggaagatcaagggagaagagcatcggaaatgttga

SEQ ID NO: 56864 - DNA, 1563 bp, Heterodera glycines
  Genomic contig location: Contig_ID=SeqID_26115; Location=109..1671; Strand=+
  SCN-specific regions: Sequence locations=1-1257,1279-1282,1304-1563
atgggcccaaaaaaagcgccgccggcaagacgaaaggccgagccaagtgaaggcgaagaggaagtgaagagaaagaaggcgaagagaattgtcattgaggatgaaccggaagaaggagcgaatgggacaggaagtcaattgcaacaaaatgggcatgaagaagcaatggcaccggtagtgaagggaggggacgaagaagacgaagtcgtttctgaagtaagcgaaaatgatgaattactgttttcttaatctaaaaaatcggtgaaaaaattttgttcttctcgaaatttttttgaagtttccgcggcgcgaatcgatataaatggaaacggaattttttaaatttcgatcggaatttttttccctttctctgtgcaggtcggcatctatctgttgccgttggctccgtccgatgctggtggcattgcaaagatggcaaactctgctggtgctgcttcgtcggtgtccatcaatcgacttcaattcccccagcagcatccgaatgtgctccgacgtcgcttcaatggcgcgctgtccggacgcggaaatgcacaggacggagaggaggaggaggaagaccaggaggaacagcgaaccgaccgaactggacggaaattatttgcacagtacaaggcccaggtcaaacatttgcggcttgggttcggctcggactgcgatgaggaggcgatggcatcggccgtcatgcccactttcgccggtggagggggaattgccgaactgctgacaaagtcagtcccaaagaaatgggttggggggaagcgaccgattgaccacaatgagtgcaatgtgggtgcactacgtttcccccgcccctccttcgagaattatcttttttatttccaaactgaaatatttcaaagaaaaaattcttagaaaattaaaattttcttaaaaaatttcgcggaggtgggggaacgacttgctgcggggtaatgtaccaataaaacgtcatttcaggaatcacactccgtcttcgtccgcccttttctcgccgcccccttcggcgtcggcctcttcctctgcaatcaaaggggggagcgatttgacctccgacgaaatgttcaccggggaaggcttttcccagcaaggcttgcttaattacgctgtcggattcttcaaaaaaggtgatgatgcatgtcatcatttattcttttctttctcaaatgacaatgctttgtcatttttagagagcagctcgtttcctttcccaacgaaaaaaatgaaaacaatcttttaaactttcattttcacaatatattttttctaaaatttcttccaaaaacattttattctttgcaattttcgaaaaaaaaatattaagtgaaagtttaaaaaattcgttttttttttaaaaattttcatgaggggataaatgtatttcactcgtccttttttccttgcaattttttaatttggattatcctttggcttcatgtctttgtttcaggtcgtctttttttgttaccggtggacaaaaccttcgaaatgcgaaagcccttgcgggggaccattgagcgcgagtcgacggcgcgtaccaccgca

SEQ ID NO: 56865 - DNA, 1067 bp, Heterodera glycines
  Genomic contig location: Contig_ID=SeqID_26116; Location=1..1067; Strand=-
  SCN-specific regions: Sequence locations=1-85,118-129,151-214,247 -533,624-719,769-817,844-856,1022-1067
gttgaacaacgaacagaatggaggccattttctcattcagcagcagccacgaacagaagaaaagacaaaacgccagatatttcactaattttgatttctgttttttcttgtgtgttggattggaaaccgtgtagtgctgcttcctctgcttgtgactgcccccgtcttatgtagaaatgctaattttcgaattaaaaaagcacattggacacataaatttgccaaaatattaaattcactattttttgagccacaaattccgcaatatgatttagaccaatttcaattctacaaatgatcatatgtttttaatttccttaaataaatcgttttttaaattccttacagaagccacgtgcaatgcaaaacaatgctaatcttcgttacccaattcgtttcatgcgcatgatggaaccatcgccaaatatcaatcgagcaacgagacgcttggaaatggtttccaaacaaaccactaaggcaagtcatctgattttgcaatctgagcaactcataaatgaaagtttttgcttttaggtggcggcaatttcgtcaaggcttgagtggcgcattgaccattttgaaaagctgatgaaattgatgaaaaatggccagaatctgatcagtaagtttgcttggttgttgatcaatgtgtgctttccttgtcattttaccttttgaaggcaaacagttctcctgcacttcttggttcctcagttgtttgggagctgcacgtttacccaaacggaaaacgcgaagaagacgttaatagtgcgtcgtaaaaaatatttctttccttaaagtgttccttctcccaaagatgtttcatttttcctgcgccaagtcggactgcagcggggcgaagacccagtaatgaccgaattccaaatttatgcattggacgcgagcgattgccggatcagcgtctgcagagacaccaaagacttttccaatcagcagggcaggggaaagtttcaagtgcatcgcgacaaaatgcttgcttccctccgacccgacggtaaaattgttttgttttttgctttttgccccaattcccatttgatttttgt

SEQ ID NO: 56866 - DNA, 1067 bp, Heterodera glycines
  Genomic contig location: Contig_ID=SeqID_26117; Location=294..1360; Strand=+
  SCN-specific regions: Sequence locations=1-151,173-547,574-588,610 -648,707-862,884-1016
atggcgcttaaagccgagttggaaacccagaaaaggttggcggagcacaatgagatgcaggcgatggaagagaagacggacaatgaaaaacagaagaaaaatgaaaaggaaaaatacggtaaagaaaattaacaaaaataaaaaagaaggcttttttaaattctataatttaggttttaagtttaggcaaattttaaaatttcgttacaatgtttaagattctgtttttggactcactcaacaattgcaaaatgaacagacaaaacttttcggacggatggacgaattggagaagcaatttggaaaattgctgcagaaaaaggaggaggaaaattgtaaatacggtaggggtactgtaaatttcgaaaaaaacagaaattaatcggatgagaatttggaaaaattaattaattacatttgtacttgacaataataatggcaatttccatgttaagcattggctgaacaaaagcatttggaaggaaatggtgaattgaacaaaactgacaatgagaagcagcaattggtattttcataagattggcatttaaattttttcctaaaatttgaaaatgcgactcaattttatttgaaaattatgaaaataatttattaggacttttatttacatattttgaggttctcaacaaattttatatatttacaatatttcgtataaattactgttaaaaaatatatttatttacatactttttcataattgaaaatgttaaggaattttgcgaaaagtttgccaaattggagttggaattgagcgaaaagcaaaatgaaacacgtgggttcttatttaaaaagaaacattaaaattgctcaaaatattttcatgacaatttcataatttaatttaagattttaagagaattttattgttaagtttcgctcggcagaatcgctcaattgataaatgaggagaagaaacaattggacaaaatcactgctgaatttaacaatcgtcatgaagaacaaacggtgaatgaattggcattggcaaaaacttaaataaaaataatttattttataaaatcaaaaatgatttatttaaatta

SEQ ID NO: 56867 - DNA, 955 bp, Heterodera glycines
  Genomic contig location: Contig_ID=SeqID_26117; Location=1633..2587; Strand=+
  SCN-specific regions: Sequence locations=1-20,56-180,202-283,326 -355,396-423,445-685,721-955
atgaaaaggtgaggtgatcagaagaaaacaatgcgtttcagaaagtttggcttatcaaaacaaaaatatggcatgaaagatttaattttttaaactttagcttcaaaaaattaaatttaaatgatggatttttataaaataattcaatgactcttaaaaggcaaaaaaaatttttagattttctaccctctccactcctccttgaatacaatttaaaagcataaaacttgttttgttttttgacttcgaaaacagatgttcaaacttttttaaaagttttgccttttaaaaatttagttttattctaaataattgaaaattttttgccttttcgaaaaaatgttcaaaattttggaaaacttaagtcacactttttaaattaatcatgtaacaaatgatgaaagtagttgagagatggggcttgcacctttattaaatttaattttcgcattttatagcgatgtgatcatcggattcgccccaaaacagccgaaaatgccattaaatggtacgcttttgaaccgttgcggcacttacgcatattcgagcactgccaattgtgtgcttaatgggtcttggaaaaatgctgatgtcaaattttttcctggcgatgttgtcggatgcggcgttaatttggccacccaacaaattttcttcaccaaaaatggccatcgattgggttaggaaaataaattaatggaatttttaaaatttattttagattttgcctttttaaacaaccatttgttggatgcttcttctgctgatcaattgttcccatttgttattttgtggaattctggggatcaaattgaggcaaactttgggccaaagttcaaattcgatatgaccactctttgaagaaacacatattaaatgtatttaatggatttcttgacgttttgaccaattttgttggttgcttattccatttgtcgaattataaagcttttca

SEQ ID NO: 56868 - DNA, 363 bp, Heterodera glycines
  Genomic contig location: Contig_ID=SeqID_26118; Location=129..491; Strand=-
  SCN-specific regions: Sequence locations=1-47,70-209,233-363
atgcttgccaagacatgtgcttccactccaaatatcggtaaaattttaaataaaataaaataaaataaattaccgtaacgccacccactatcactcaccattgattattaatttacttattcagttcgtacaccggtcagtgcaacaattttgagcatccaacatggggtgtcagccaaatgccattccttcggctgctgccacccatttacgagaacggcttcaacacgcctgtcggctgggacacgaacaaacgctattttgggtacggaatcgggggaggcggcaggggaattactgtaatatttttcgaccaaatgttgagatacagtgttctaagaattcggcgccaagaccaataaa

SEQ ID NO: 56869 - DNA, 1147 bp, Heterodera glycines
  Genomic contig location: Contig_ID=SeqID_26119; Location=680..1826; Strand=+
  SCN-specific regions: Sequence locations=1-197,219-465,488-509,533 -608,630-708,730-837,859-967,991-1041,1065-1147
atgagtagtatagagcgtcaaaacctcgcgggtttctcgcgggtgtttcccgcacgaacccgtgcctatgggaggggtgcagctctttgatgttgccgcccggacattttcccgcacgaacccatgcctataggaggggtgcgtgccaaccgaaacctatgtgagggtctgtttctttgaagtctgccgcctggcggtttttaattttccccgaaacctcgcgggtttcccggcctatgggaggggtgcagctctttgatgttgccgcccagacattttcccgcacaaaccaaagcctatgggaggggcgtgtgccaaatcccaaacctatgtgtcctttgaagttgccgcctaacatccatttccccaaatcctcgcgggtatttttttttccgcgccgcgcagcgccgcggaaggtcatcaatcaaccacctgtcaccaatgtgacaggtggaggaaatttgaatttttcttttgcaaatttaaaatttttttttccaatcggagattattagcgtttatcaactccatacttccgcaacacttatacagtttattttgagggggtaatgagctgaaattgtaagaattatacaagctggccaaaccaaaataataaatggaaaattattggcgcttattgactccatccttctgcgacgcctatacaatttatatttctagtatatggagctgaaattttgagaatttcaaagtgataatgaaatgtaaatagagaatctcacaatttcagctacttaatctctaaataaatactgcagcaatattgtagaaggatcgggttaatgatattctctgatttattattttcacgaccatccttgtgaaattctcaaaatttcagctaattatcatctaaatataaactctaacagcgttgcggaaatattgagttgatagcgccaataatctccgacttattattttcacgaccatctttgtgaaattttcacattttcagctcattttcctccaaatgtatctgtataaatttgcttaagtaaattgtaaatcggagattattagcgtttatcaactccatacttccgcaacacttatacagtttattttgagggggtaatgagctgaaattgtaagaattatacaagctggccaaaccaaaata

SEQ ID NO: 56870 - DNA, 236 bp, Heterodera glycines
  Genomic contig location: Contig_ID=SeqID_5091; Location=5812..6047; Strand=+
  SCN-specific regions: Sequence locations=1-211,233-236
atgccaccaagatgcaaaacctattatggcaaaccgaaaacatttggattcgttaaaaaggtgctatttttaaagtaagtacccaaaaccgtgcgggtttttgcatttcctccccgccccgacgatgaggcacaatgcaggcgccgagtaaattaattgataatgaaattgtagaagtgcaaatttaattggtaatgcagcaaataatgccgataaataaattaatgaattggaca

SEQ ID NO: 56871 - DNA, 1758 bp, Heterodera glycines
  Genomic contig location: Contig_ID=SeqID_5091; Location=740..2497; Strand=+
  SCN-specific regions: Sequence locations=1-392,414-691,715-1146,1168 -1184,1242-1261,1283-1758
  Gene Ontology: Mol. function=protein serine/threonine kinase activity; Cellular component=integral to plasma membrane; Biological process=establishment of neuroblast cell polarity
atggcttacatttcttctccaggtccgccgatgccccccaaatgcttttccccatttgaacgactcaccctcgccggccttcgactcggccaatgcgctcgcctcattcgccgccttttgggactcgctgtcctcccagtctcagctgctcattctctccactgggctcggtgccgttgtttttgtggtgcttttgatcctctgtttgttctgctgccggagggaaaagggccatcggtcggggcgaaggcggaaaagcgacgcccgggggatgacggcacagcagcagcaggaaagcgcgtcgtcgatgctttcgggcagtgttgcggcttcgcagcacaaagtgcccgtgggtgctgctggctccatgcaaaatgggcacttgccgcaaataccacagcaccatcaccacatgttggtacagagttgcaacggcgggtccaccatcacaaacaggcaaagtttgcatttggcattgtagcactatgccaatgagtaaagccgatcatttttattgcttaaggctttctcttttgcggtaaacaatcggaagattaatccaatgaaaaatcccatcaaattaatttccctttcagcgatttgaacagcgctttctaccgcaaagtacaggacgaacggatgcgtgccgcgggtgtcatgccaaatgatgagctgctgaatccgttgttgccctacgggggcggtggcggcgacactttggaccgacacattccgacggcgccctttggcccaccgcagacgatgttcgagttgaagcactcccagcagcaactgcaccatgcacagcagcagccgtaccgattctgggaaaatggggcgacctctgccgacacaatgcattcggctggcgtgggatggcatccgccgtattacgttcaacaacaaccccaaaagcaatcctacggcagtgcgagtgccaacaccgaaccaacccaagcggagccgtaccaaatcgcgagcatccaacaagaacaggtcggtgacgacgagttggagggcagcaattttacataattgggcgattaactctcgagtcatttcgttatttttttttcttgcatttagttgcgtttctcggatcagatgatcggcgaggacagcaccacttttttgacactgggagaatgggaaggggcaatgatcagtggcgccactctcaaggcatcaatcgataaatcaatcgatcaaataaataaaacctatcaactaatccaatcaattttacctaattattaaccgttttttcctccaattttgggttgccattaaatcgctgaaaccgaatgttccgcacatcgccgttgagcagttccaagaagagattaaagccatcggcatgttcgagcatcacaacgttgtccgcctgttaggcgttagctttttgcaggcccgggaaatgtgtgccgtgttcgatcacatggtccacggggatttggtggaatttttgaaagtgcgggagccccgaggagggacagagtgagtcactgcaatggtacttctgaggaaaagcttcattttagcaatgatgagcaggaaagggcgcgaaacgcggaggactttctgagaatagccactcaaatcaccgcgggaatgcaatatttggccaacaaatgtttcgtccaccgcgatttggcggcacggaattgcttggttgccgatcagcaagtgatcaaagtgtccgacttcgcgcggatgaaaccgaaatatgcgagagactattacagagtgatcccataa

SEQ ID NO: 56872 - DNA, 956 bp, Heterodera glycines
  misc_feature (78)..(78): n is a, c, g, or t
  Genomic contig location: Contig_ID=SeqID_26122; Location=628..1583; Strand=-
  SCN-specific regions: Sequence locations=1-956
actgagtctcaaggtggataataaatgaatggcatgttatcaataaaaaaacaaatcacaaaacgacagtcattattntaatcataaaataaggagaacaaatgtttttagatggtggtgttgactgatttgcatgctggtgctagtgtttatggcaagcaaatttcatcggtcgttaaacgtgtgaactctctcgatgcggatgttgtctttctcatcggcgatattgtcgatgcgccgcgcaaattgatcgaagaaagggttgaatcattgcgccatttgaaagcgcagctgggcacattttacgtaaccggcaaccacgagtattactacggcaatgcggaggaatggtttgcactgtttgaatcttatgggatccgcgttctgaagaatgagttcgtttgagcattgtcggaattattctacgcttccccttttgttaagtgttgtcaaatttaatggctattgtctgataggccttaacgacatcactagcgaggaaagtgggtgagcgccgaatgactaacattcctgatccattaatgtaaagacgtttcatctatttttagcattccaaatcacgtgatggatgtctcggtcataaactattgccctaaaaatgcgacgactatcgtattagcacataatccaagtgccgccaggaaaatttttgagttttcgcaatcaaatgaccatcctgttgatttgattttgtcaggtatcaaaaagcccgttcgttttttactttcatcaattgaaattgaggacacactcacaatgcccagtatttggttctgatgcctttcgcttacttcatcctcccttatctctatggcctctatgtgttgtcggatggcgcgactaaattatttgtttcggccggcactctcttccaaaatgcgccgatgaaaattccgtttatgtcggaaatttggtctattgaaattgaacccaga

SEQ ID NO: 56873 - DNA, 915 bp, Heterodera glycines
  Genomic contig location: Contig_ID=SeqID_26123; Location=18..932; Strand=-
  SCN-specific regions: Sequence locations=1-33,75-915
tttggtgcgtttcagaacactttctgaaaaaaatatttatgaattaattatgcaaaaaacaaataaataatgaactctcttccttaataattttcctgcaccgaaggtactcactcggccgtttggggtactcaaacaattatggggagcaaaaatccaacgcagaattaaagtacaggctatagggaagctattcccgaaggattcggtctccccataaatctgggcgcatcggttcggggggactgccccgaaaacaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagaacaggctatagggaagctattcccgaaggattcggtctccccataaatctgggcgcatcgggtcggggggactgccccgaaaac

SEQ ID NO: 56874 - DNA, 884 bp, Heterodera glycines
  Genomic contig location: Contig_ID=SeqID_26126; Location=25..908; Strand=-
  SCN-specific regions: Sequence locations=1-284,308-514,537-594,617 -811,843-884
atgccgttaagttggcaacattttttgctgattgttttctccgtcgctttgtccaaagtgcgccctttcccttgcggcgtttgtcccaaacgaattgtaagtacactaattgaccaagtagtggatttaatgcttaaattgtgtctcatttgtcagctcatcgaagcgtccgtcgcttcttcgtcgtgcggtgtctccgaagaatgcgacgatccgccgaaaaatgccgaaacaatcgcaacgacagccgcaccgttagcagaagccaaaggcaattcatcaacagaggcggggagggacgaggagaagggcaccgaacggacggcgattttggcaattgccatccgaactttttcaaatggaagcaacgaagaggtgaagccgagagagggagggcacgggctaattgtaagcactttctctgacctcagcagagatgcacttcgtccgattgccattcaaatggcatttgttttggcattccgtccgatccgttgtgcctttgtttcaagggcttctgtggccctctttgcaaatggggcaagtcatttgctaaactggctaattaaaaattggctttgttagaggcccgccatttttaacaaatttcagccttttgtcctggacacaacggatgcaatgggcacgggtggtgcttggccacttctgacagtgccaaatgcgtgtgccaaaccaatttttggggaaggcactgcgaaaagagcaaaaagggggagaagaagggcgactgaaaggaaataattggcgaaagatgaagcaaaatgatgggggattgggatcaattaagcactaataatacatattttataaatttatataatgttgacaaaatatgtataaattcaaaagggtcgacaaataaa

SEQ ID NO: 56875 - DNA, 1154 bp, Heterodera glycines
  Genomic contig location: Contig_ID=SeqID_26127; Location=411..1564; Strand=+
  SCN-specific regions: Sequence locations=1-166,188-227,251-281,303 -1154
atggacacggacaaggctcgcgtaaaattggaggaagtgaaggaccgctacggattgggcggagacattgagaaggaaaaggagaaaatgggcatttacacgcccaaacacacgcccggagtgagcacgccgcgacacaaacactgacaataaggcgtggacaccgaatttttattttttttttaaagttaacatgaattataccaaaaaaataccatttcgacaggattgcaattttcataaatttttctgtaaagttttctggaattcatcgttaaaccaaagtttttagttattttaaatttggatctccaattgatatattttgctatttgacttgttatgactttcccatttcttaacttctaatatttccatatagtacaatggaaggcgatccaacctttgtaaatgttcaaccaaatttcgtacaacagaacttaagagaattgttagattcgcatttgccaaatcaaattgcccgttttgaggagagcagcgtaaatttggagagagtggctgccttttgtgaagcgaattaccttcaggtgaatttgattatctgtgttaacttttaagtgtttggtggtcatttatgcttgtgattggctatgacaagtccgaattgttcgctacgcaagaaaattttatttagtcgccaaacaaagccgaggcattggcggagacaaaacgttgcgcgctgcaaagtttggcgagttttgcttttatggttggcgatttgtcgcgctcacttttgaacgcacttgacttggaatcgctgaatctgtcggacaaaacttcacaaattcaaaacattgcgcaggcaaaaacgggattttcgaatggaacacattaatcgttcactaaatttttagttcgtttcaattcaaaaggaaaaatcggcaagacgagaaattggcaaattaacggcaaacaaaaatttgatccgtctcaacaaaatcacttatccttcttcagaagtacttacaactgctgaattatttttcaattgttttctttttaaaggagcgtaccccgcggtatcaccgaactccgattgattttgcgattctcgacggaattggaaatggcaagcgactagtgcaatcgactaatgactatggcacaattggggcggctcgtatgcaaggaac

SEQ ID NO: 56876 - DNA, 1056 bp, Heterodera glycines
  Genomic contig location: Contig_ID=SeqID_26128; Location=83..1138; Strand=+
  SCN-specific regions: Sequence locations=1-268,290-483,507-726,748 -875,897-1005,1033-1056
atgggagcggaagaaaaaactgatcggaataggagaggaggaaaattgatcggaatggaagcggatgaaaaagtgaacggaatgagaggaggaaaagtgatcggaatggaagcggatgaaaaagtgaacggaatgagaggaggaaaagtgatcggaatgggagcggaagaaaaactgatcggaataggagaggaggaaaagtgatcggaataggagaggagaaaatgacgcgagagtgaagggcatttgcgggttgaatgatcggcgattgtgaagtgaacagagaagttcaagcgggacgaaatagcataggcaaactcaaccaccacggaagaacgcaagcaaaaaaaaccaaatgtcgataaatcaataccaccaccaccaccactgatcagtgatcactgatcagtcaggcaatttccattagcaaaaaagtcttcattctcccacagcagagcagggacctcaaaaaatttttgacttttttatgggttccatttttattctatttttactccatttgtaaatacttcctcattaacctccccacacgattagcaaagggtagttttttgtgcgttaatgatttgctaattatctaattaaccaccactcactcacatatgaaaatcaaatgacaacctttgtttctatctatttttttttgttcatccggtagaagagaattttgtcgatttttttaatcgttcctccgattttcacatttcattctcctctttctttcctatccattttctttttttttgatcagccactccaatcagtttttgatcactttgatcaatttgtatgagtcatttaatccaggctcactgacacattgcgccccattgatcaattcattcatcccattttgattggcaaaaatctgattgcttggccctttggcacaaaactggtgattaactcaggttaattacctgttggccctacacagtaatcacacattattactaaatgtactacttcttttcggcctcccggtttatttaattatatatatttttttttgttgtccccgtgttttcttatcca

SEQ ID NO: 56877 - DNA, 346 bp, Heterodera glycines
  Genomic contig location: Contig_ID=SeqID_26128; Location=86..431; Strand=-
  SCN-specific regions: Sequence locations=1-60,82-346
ttttttgcttgcgttcttccgtggtggttgagtttgcctatgctatttcgtcccgcttgaacttctctgttcacttcacaatcgccgatcattcaacccgcaaatgcccttcactctcgcgtcattttctcctctcctattccgatcacttttcctcctctcctattccgatcagtttttcttccgctcccattccgatcacttttcctcctctcattccgttcactttttcatccgcttccattccgatcacttttcctcctctcattccgttcactttttcatccgcttccattccgatcaattttcctcctctcctattccgatcagttttttcttccgctcc

SEQ ID NO: 56878 - DNA, 2185 bp, Heterodera glycines
  Genomic contig location: Contig_ID=SeqID_5093; Location=1003..3187; Strand=+
  SCN-specific regions: Sequence locations=1-112,134-647,669-676,748 -1143,1185-1389,1412-1519,1551-1569,1638-1993,2015-2185
atggaccgtggcatcacggaatatcagctggaggtgtgtggtgttgtgcttttagcatgcattaattttcaaaaacccgaaccaaaaacgcgaatttttcgtcttttcgtaaccccctccatttttgggggtcttagacctaaaaatcggcattttcagtcaccctgcacccattgcctaggcctaaaaacacaaaatgagcctaaaagcataaatttcgtcatttttttttaaatttttccctccctaggccgccattggcaaggtggtggcgtcggagaacgcgtggcaggtgtgcgacgacgccatccaactgcacggcggcatggggttcatgcgcgagtgcggcttggagcgcgtgatgcgcgatttgtaagcaaatccgggagggcgaggggggggggggtaaaaatttttttttaatttccgccatttttcgaaaaaacccgctagaattcttcccctccctatccacagacgcacccttccgtattttcgagggtgccaacgacgtgatgcggctgttcgttgcgctgaccggcatgcaccacgcgggcaaacggctacaacagttggccaaggatttgaaggcgtactccgtgtccagccttttcggggagctgaagcggcggactgtcgggtaaaaggaaattcaaaatttgaaaaaatccttaagtttttaataaaattttgttaattttagaaaattcagtaaaaaatgagattttattttttctttaaaaaattccaaaattttctgagaagtcatcgaataatcctataaaatttggaaaacactgaattcctagctcagtggtttgtgccttttgaacttaagtggaattgcttgggttcgactcccaccacgggttggcgtacatttttagcaactccgacattcggaacatcttttttttttgaaaaaaaaattaaagttttgtgagaaaaatttttatggttgatgttcagcgaagcccaggcccaagcagcggaccatgtgcacccgtcgctgaaggccagcgcggcgctgctcaaccaatgcatcggcgactttggcaaaaccgtggacgcactgatcatggcctacaaaaaggatgtgatcggtgagtgggggggggggggggaaaccgggcatttttatgaggaaaattcatttttgaaattattaaattttcaaaaaattgtgtaaaataccgaaccccgcttgaaatgcctatcgttggcacagtaccgtacctcgtttatgtttgccttcacaaacagatcgccaatacgaactgatcataatagcaaacgcggcgatcgacatctacagtatggcaggtcagtcagtacagcgcagtacaagtaccgtagtgttttttttggtccctggggcagaaacaatgcaattttcaaaatgaaacaattttttcttcgacaacaatcattggccataatatgtttttcagcggttctgtcacggtgcaacttcgccattgaacggagcggcgcggacaatacgcaacatgaccaggtcggagagagagagggggagggggggggggaagcagctaatttctacccccgaaaattttttataagaaaattatgaaaaaaatttaagaaatttttctaaaattttatttttaatttttcacagggaaggaaacgatagggtggaagggtttaaatgcaattttaaaattgcgaattaaacaatctttttttcccgctactttcagcacatcaccaatttgttctgcagacaggcgttcaagcggaccaaacacaatttgtacgtaataaaaggaaaaaattttgaaaaaatgccatttaaatgtcaattttattagattttcaatttattgcagaaaggaggccaagacgcccagcgagacggaactgtcactgatcggacgcatttcggaccaactccgtgagcagcaagcgatggcgcagaagcatccaattgaacatttatgatgagaaaacagagttttcgatgtatttaacctcctcctcctccccctggcatggaattatttttacacaaattttgcaccatttagtttttttttccttttttgagtatgatacggccggcatacactgtagttgggcatcacggaaagagaattgtattattttccagggagctatatgatactactgtatttgttcattgactataaatattttaaga

SEQ ID NO: 56879 - DNA, 897 bp, Heterodera glycines
  Genomic contig location: Contig_ID=SeqID_5094; Location=213..1109; Strand=+
  SCN-specific regions: Sequence locations=1-75,98-266,295-323,346-897
atggcaggtcagtcagtacagcgcagtacaagtaccgtagtgtttttttttggtccctggggcagaaacaatgcaattttcaaaattgaaacaattttttcttcgacaacaatcattggccataatatgtttttcagcggttctgtcacggtgcaacttcgccattgaacggagcggcgcggacaatacgcaacatgaccaggtcggagagagagagagagaagggcacagctaatttcctcccccgaaaatttttcagaaaattctaaaaaaaaaatttttttttttaattttcttctaaagaactcaatttttttaaatatttttcacagggaaggaaacgatatggtggaagggtttaaatgcaattttaaaattgcgaattaaacaatctttttttcccgctactttcagcacatcaccaatttgttctgcagacaggcgttcaagcggaccaaacacaatttgtacgtaataaaaggaaaaatttttgaaaaaatgccatttaaatgatgaaaaaatgtcgtttaaatgtcaattttattagatttttaatttattgcagaaaggaggccaaaacgcccagcgagacggaactgtcactgatcggacgcatttcggaccaactccgtgagcagcaagcgatggcgcagaagcatccaattgaacatttatgatgagaaaacagagttttcgatgtatttaacctcctcctcccccctggcatggaattatttttacacaaattttgcaccatttagtttttttttccttttttgggtatgatacggccggcatacactgtagttgggcattacggtaagagaatttgtattattttcgagggtgctatatgatgatactgtatttgttcattgtactataaatattttaaga

SEQ ID NO: 56880 - DNA, 418 bp, Heterodera glycines; identical to SEQ ID NO: 53014
  Genomic contig location: Contig_ID=SeqID_26132; Location=331..748; Strand=+
  SCN-specific regions: Sequence locations=1-2,30-32,155-206,236 -236,320-325,358-418

SEQ ID NO: 56881 - DNA, 1919 bp, Heterodera glycines
  misc_feature (1022)..(1022): n is a, c, g, or t
  misc_feature (1039)..(1039): n is a, c, g, or t
  Genomic contig location: Contig_ID=SeqID_26132; Location=1..1919; Strand=-
  SCN-specific regions: Sequence locations=1-366,397-463,508-637,668 -680,702-751,787-790,816-851,873-883,930-949,975-1232,1265-1270,1354 -1354,1384-1435,1558-1560,1588-1595,1671-1742,1810-1919
actccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctctgtctccttcgctgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaatgcatagaattattgctgcggttaaaagctcgtagttggatctgtgctagccgtccggtgcacacttttgtgtgttactggttggttggctnttctgccggtcttcccncggcgttggccttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgta

SEQ ID NO: 56882 - DNA, 755 bp, Heterodera glycines
  Genomic contig location: Contig_ID=SeqID_26133; Location=303..1057; Strand=-
  SCN-specific regions: Sequence locations=1-105,127-408,433-444,476-755
atgctcagcgatacggtagccacagttatgggagcggaacatacggtaaaagcagcaaaaataccatttttgttttatcttgctgtatttcttaaggaaaggttcataagaaaatatttacttttaacaaaaatccacgcaaaaatacatttcattaaatgtattcccagcggtttttaaattcagtgggaaatatttgagtaattctggtataattataattattgagcctgttaaatcaatcattatcttcctttaattctttcaataggaacaaattattggagcagcagttacggtaactcaagaacacagcccagctatggatacggtgggcaacagagcagatacggtacccatgaacaaaacggtggcgaaaatggacaattcgagcgacaaaacgcatggagaggaggaggaggacaatggggacagaatcagcagaattggggacagccgcagcagcagcagggagcaacagcagctgtagaaggtggccaaattgaaaagaatcgaaaaataaatggcaaaaattgaaaaaaaaacggaatttatccgaaacacaggaggatggggacgacgacagcagcagcaattcccctcccccgcgcccccaaaaacgcaaaacaattgggacaattccgacaatttcgccccttcgaccgcacaaaatcgcggaaaattgcgcgtcgaccttccgccgggtgcacccggcacaatggaggcagcggacgccgatcagtcgagcaaataaa

SEQ ID NO: 56883 - DNA, 577 bp, Heterodera glycines
  Genomic contig location: Contig_ID=SeqID_26135; Location=95..671; Strand=-
  SCN-specific regions: Sequence locations=1-152,174-526,572-577
atggctgtcaaattgatggaaaaggccgggataagcggggaggaaaaaacttttggtctacaacacctcggtctcatccagaacttttgggacaaggaatacccggaaatgtttcgcatagtggcatttgacatggtaaaaaaattacgcactttgaaaaaacatttaattttccagagaacgggaatcaaacctattttcaagggagaaggaattcgtaaaaatgaagtatgtgtgataaaagatggagaccactgggacggaatgaaatcagttacgcaattcttctgtgttcgaaacttttgtgtcagctgtgaagtgacacgcgaaaggccggagagacatcgattggaatgtaaggaaagatgcaagaagtgctgtagaatggggttcgggtttccatgtgcggatgtgtgtgctgggatttattgcgcggagtgtaatcgcaacttctacaatacggaatgttttgagtctcacaagaagactgcttgtagggagtacaaaaaatgcgaaaagtgtggagagacacccacccaaggaaaaaccacatgtggggagaaaatctgccgatttg

SEQ ID NO: 56884 - DNA, 1175 bp, Heterodera glycines; identical to SEQ ID NO: 26136
  Genomic contig location: Contig_ID=SeqID_26136; Location=1..1175; Strand=+
  SCN-specific regions: Sequence locations=1-57,79-446,507-741,763 -768,790-1010,1033-1175
  Gene Ontology: Mol. function=extracellular ligand-gated ion channel activity; Cellular component=integral to membrane; Biological process=cell surface receptor linked signal transduction

SEQ ID NO: 56885 - DNA, 820 bp, Heterodera glycines
  Genomic contig location: Contig_ID=SeqID_26137; Location=62..881; Strand=+
  SCN-specific regions: Sequence locations=1-13,35-80,102-317,345 -381,426-724,747-820
atgacgatgttcccatttgttacagaaacagaaaataatggagttgaccatctgctgtcaacgacagatcagcggcaaggttggacaataattcaaaaattcgagatttattttttaattgttttgtcaatctggcatgataatggggattatgccattgatggggagatgagataaactgctggtctctattcggggtctctttgttctgtcactttcccatactttcaccttttaaaacctaaagtttcgaaaatttgtaaccagaagagctcttcacaatagtttttggttgttaaaaatttgtaaaaattcccaaaaaattttaaattaattttttaaatgccacaaagttcaaaaagggataatttgttgcttgagatttaatttaaaataattaatgcaaaaaatttattacattaaaagctttttaattactgttttttaacagttgaacaaaacgctacagaaaaaaatatgtgcaaatttggtgccatttcgtgtgctaattgtttaaaagaaaaggcaaaaaatgagaaaattcaggtgagtattttgcagttcatcttaaaggatcatcatcaatagggatgggatttctaagtttttacttattttttctgcggctttaactcaacgagaaatacacgaaaaacacattttttgtctgaaaattttgcgttttcacgcccttattcgaccttagaaatccttatttttgatgttcgcccttaaaaatccttattttggatgttcgcccttaaaataagtttttgcccttattttggcgttttgtccaaaatttattaacaaaaatgca

SEQ ID NO: 56886 - DNA, 782 bp, Heterodera glycines
  Genomic contig location: Contig_ID=SeqID_26138; Location=237..1018; Strand=+
  SCN-specific regions: Sequence locations=1-35,57-69,91-155,177 -227,328-782
atggacaagggcgccgccggagcgctgctcttcctcaaaaaagtacaacagaaatacaattttaaacccctacatggaaacacttaaaaagttcctaacccttattcaattaagacggaaaatttttcaaagttcaaaaatctcgcgaatgcgagaaattattaaaattgaaaaactggaccgggatttgaggcaggtcgtttccccagccgattcccatcccccggaaaattaaaaaaaataagtttaaacaaatttttcaagaaaaaattcttaaaaacttttgtttgtaagaaattttaatgaaaaaaaattataataaattttcagcgattttttggatttttttttttgaaaaacagtaactcatcataaaatttcaaaaaaacgctagaaaaattttttacaattttttttttgagcattgaaatgaattggccaattttttggatttctatttgtatcctgctgcagatgcttgaccaaattgcgccgcccaccggcagcgccgacaccgataaaatggtggccgatgtgcacgcctacttcctgcgccaccacacggaccaggaggtcgctgatgtgttcgggcctgactcggactacgccggcggcggcaccgccggcacgcgcaccgatggcacggcattccttcgtcgcagcggtctccaacggttgcccgccctgctggtcaacggggtgccgttggacaacgcattggtcggtggaaaccaataaagtttagacgactcaaacaaaaaacaatttttttattgggttga

SEQ ID NO: 56887 - DNA, 362 bp, Heterodera glycines
  Genomic contig location: Contig_ID=SeqID_26138; Location=1089..1450; Strand=-
  SCN-specific regions: Sequence locations=1-81,124-362
  Gene Ontology: Mol. function=transposase activity; Biological process= DNA transposition
catcttcatgaccaaattcgtcgtcctccattttccgcatattccgcggcggcgtactccttctccatgacaacgcacgcccacatgttgcgttctcaacgcaacaaaaaattgagaaacttcgatgggcggttcttcctcatccaccatacagcccagacatcagcccgtgtgactactatctgtttcgatctatggagcacttcttgagagggaaagaatttgctgatcaaaacgaggtcgaaaatgcattggatggcttttttggatcgaaaaatgatcagttttataaaaaggggatagaaatgttgcccgaacgatgggggaggatcattgatcaaaatggtgagtgcatcattgat

SEQ ID NO: 56888 - DNA, 949 bp, Heterodera glycines
  Genomic contig location: Contig_ID=SeqID_26139; Location=310..1258; Strand=-
  SCN-specific regions: Sequence locations=1-585,621-949
atgggcggaacgccaacacttcaagcccaaccgaatgccaacactatgggcggaacgccaacaccaagcccaaacgaatgccaacactatgggcggaacgccaacacttcaagcccaaccgaatgccatgggcggaatgccaacgtattatgccgtacagcaacagcagccatatgcccaactgcagtttgtttcccagcaggcatgttagagggatggggagttactttggtgacatgactgttagtgttgttcgagagtctcgacttgagaaaagtctcgggttttttcggtctcggggtcaggtctcggtcttggatcggaaaatttttcgttctcgaacagcactaatgactgtggctcggttttctagttttttttgacaattttttatgcgatctcccagggcccatccaactacggggcccaaaatttccagcagccggcgacggtaagacttggcactccatcggcgtcagtaaagcctggcactaatcaacccatgatgcccatctcacccacacaatcagtgctggtacggattctcaaaaaacgcgaaaacatggacgaaaagtgaaaatttccattaaaaataaattattatttattttttaatttttctccagtccatgccctccgctgagttcgccagccgacgatttgaccgtgcatattgttaacagaaaggtgaagagacaattagcattaatcaaccactaatagggattcgttttaaggaaaatgcctaaaatttttgcgcacttaatacgcacagataagcacgaaaaaagccctttccgctctggtttggggtgtctacgatgacttttataatgcccaattttgcctattatgggctttttgtgcttaatgcctaaacgcctatttttgtgcctatttcgccacttttggtgcctttctcagaattttctgaaaatcctacaataaa

SEQ ID NO: 56889 - DNA, 337 bp, Heterodera glycines
  Genomic contig location: Contig_ID=SeqID_5095; Location=547..883; Strand=-
  SCN-specific regions: Sequence locations=1-337
  Gene Ontology: Mol. function=translation initiation factor activity; Cellular component=ribosome; Biological process=translational initiation
gaagaggagggcactcgccagggattctgtcacatccgaattcagcagaggacgggtcgaaaaacgatcacaacggtgcagggaatagcgccggaatacgacttgaaaaagattgttcgttacctcaaaaaggtaccacggacatagttgagtcagaaaatagttgcatcggaattctgtgactttttaggaatacaattgcaacggcacaatcgtcgagcaccccgagtatggcgaagtgattcaactgacaggggaccaaaggcagcacatcaaggactttctgtgcaaggtcgggatcgtcaaggaggacaactgcaaaatccacggattttaa

SEQ ID NO: 56890 - DNA, 2171 bp, Heterodera glycines
  Genomic contig location: Contig_ID=SeqID_5097; Location=187..2357; Strand=-
  SCN-specific regions: Sequence locations=1-180,203-671,693-731,753 -788,810-1140,1162-1345,1367-1664,1686-1929,1958-1989,2016-2171
atgatgtttatttcaagattggtggatcgtggaaaatttttaccaggaactgaacgtgaacatgcttacaaagacacagcctggaagtcaccgacaggcgatcccggctttttccatatgtctgcgccgtgtatttatgctagcgtatggaattcataaatatttattccaaaattgtatttgtttaaggttttggaaaatcttgacctggatgctggaatgtcatttttaaacattggttctggaactgggtatcttagttcgatggttggatttgttattggtattttaatatgttaaagcaaaaaaatattacaattttaggagaaaagggcattagtcacggggtggaactctatcaaaatgttaccgaatttgcaaacgataatgtcgctgtgatccaacagtccggtgaagcaagtgcctttgattggtctgtgcgtcttattgttggcttcggtttatttgggctaataaattaaaaataggtgcacgccaatttacgaaactgggaacgcctttcaaattgaagctcaaatgaaatatgacaggttttcaaatttttttgtggatttattagcgacaatttttttcaattattggaaatttaaaaatggcatttcccgtccatttaggatttactgtggtgctctcgtccccgactcccatcgctcctatttttgttcccttctaaaagttggcggcgttctcattttgccgtttggacacgtggtaaatgttgcattttcctgcttttctaatggttttattaagcttcaaagaattgtcagaaaatcggaaattgaatttcttacacgggacataagcacagtgacattctcacatttgatccccgtcaatccggataatccgctctccaatcgacccataaaactcccttttctcgaaccccactcattgcgttcgatttgccgtgatgtgtacgttaaaagggagaccaaaaagatggttaaatttaaatcatttctttcagtgtcagacgctgtgtcagggcaaatgttcagcaaacccacaaagtggaaatgcgagttttgtgtgtcgaatcagcgaaggaagagagaactcggaatgggagtgaaagagaaggccttgagctgaattgggtttctcgccgaattcaggaacacaacaacaacagacgcacttttggtcgacgtcgtcgcttacagacaattcatttctatggttacttccaacagaaaacattgcatttttaaagttttagaagaggacaatgaagacgaagagcctgcagaggagggcgatgaaccgcgcattattccaaatttccaccaaaacccaatgcggtgaattttttatgcaaaactgatttttataagttgaattttatacggattgtaacgctagaactgtcttaatcatttgtgtcacttccaattaagacattttcttgctcttgttgctcgggaccggttgaaccagcatcacgctgcgcgtgctcgtcaggaggcccatcaaataaggggtcggattcgactggtcattggtgacagagatttggaattggctgtcaatccatcgccgacaacaaatgaagacgttaattacgtaatacaaacagacaatgtccatgcccatatccagtagatatttcgaggggaggaaacaccaccaacaaattcttattgccattttctaatgtaaactaataggcacaccaaatggttttaaaatactaaaaattgccagtttccgattgaaaaatgatttgttgattttcttaactctagggattccgttttatctcggaaaacaatcttaacgccgacgacaaccaacaaatccctaacattattgcctttggacgagaaaatggtgaggcagacgatgaccaaaacgagaacaatagcgaagagggaagagagatcgaacaaacgcaaaacaccaccggagaagaggaagaagaagacaacgaaaccgacgacaatgtcggcatgagttccactgaaagtgatggccaagacaaaatgaaagccaacaacggaaaagggacttgtaaaaatgaagacgaatccaagccaagtccaacggttgaaacagaacagaataaagtgcatcagtccgcttctgaaagtgagcatttcaaggccaataccggaaaaggcatttattctgtcattaagctgtga

SEQ ID NO: 56891 - DNA, 403 bp, Heterodera glycines
  Genomic contig location: Contig_ID=SeqID_5098; Location=14..416; Strand=-
  SCN-specific regions: Sequence locations=1-172,194-403
atgggattgacagcaagtgttggacaagacaatgacgagctaattgacaatctcgtgtcaaacgactctttgaaaacagaacgcgtcgaaaagatcatgaggttaatgattttggtacttatatgttatctgtactcagattttcaaaaaattttatgtttttcgctataacttttttctttggcattcaaatccaagattgttggtatcattcgaaagcttaacatgtttcgaatctaattctatgtatcacttcgcgattagacaattaccaaaaaagttatacatgaaaattgcgaaaaggtcgaaattagtcgaaattttgaagttttttcttactaaaattttttgcaggatagaaaatcatttcgattattggaagggtaatagagcatctgagtag

SEQ ID NO: 56892 - DNA, 155 bp, Heterodera glycines; identical to SEQ ID NO: 51421
  Genomic contig location: Contig_ID=SeqID_26140; Location=891..1045; Strand=-
  SCN-specific regions: Sequence locations=1-155

SEQ ID NO: 56893 - DNA, 1005 bp, Heterodera glycines
  Genomic contig location: Contig_ID=SeqID_26143; Location=97..1101; Strand=-
  SCN-specific regions: Sequence locations=1-244,266-949,984-1005
tttgacgatgaagcatttcttgccttcgtgaaaggacctgccaattttgacaaattttgcgccggaaaaggggtcactaatgaccaaagcaaagaactgttggcacaaatttatggcactcatctaggcattttgttttacatgcgaaagaattggcattgtgccaatgttagggaagaatttgaagaatttatcgacccagaggaatgtcaactgtttcaaaattatttgtgcattgtttacgaatttttgttcaatgtttatgccgaacaagaggatataatgaaaccaattttcaagcaaccaattggatttcaaatatcaattttgatgtcattaatgtcggcattggaattaatggcaaaattttcgaaattttgtatttatgaattgaaattaattgaaagaaatgattcgacattggccgaaacaattcaacttgaaaatgagcaggaaaccttggattattataaggaaaagtttgggcaaaattcaaaaagtggtgagtcatcggcacgggcaaaatttgacaaattaatggaaaaaatgttcaaaaaattggaagaaaaagcaatggaaagagacaaattagaaaaaagttcggaaaaaaacttttggcaaatggccaagggctggccattatcattgcgatcattcaacggagcagcttcgacatcatcaacaaaagcagtagatgatgcagcacaattgtatgacagtgtgttgtacttgcctaattacggaatggccgacgcggtgagccaaaacatttcagcgggtgttgcccatttcataatgttcgggaggaattggtgtcgcgtctggtccaaggatggcattccgagtccccaaaaatttttgtaaatcgaaattccgaccccaaaatgacggaaaacggagtctgaacccggaattccgtgccatctctggtctagacaggaaaacctacaaaaaataaattagttttttaaaatttatttattgcaggtgtgtttcggtttttaa

SEQ ID NO: 56894 - DNA, 1206 bp, Heterodera glycines
  Genomic contig location: Contig_ID=SeqID_26148; Location=144..1349; Strand=-
  SCN-specific regions: Sequence locations=1-78,108-192,214-256,281 -356,383-676,700-857,888-984,1018-1206
  Gene Ontology: Mol. function=structural molecule activity; Cellular component=basal lamina; Biological process=synaptic transmission
caggctgttcggcgtgcgcatgtgaccctaacggcgtgaacatgacccaagcacgggtgaaccatatttgaaggttggtttattattattatttttaaaaattatttcattgttaacaaaacgttttgctggacgattttctagaccatctgctgtttaactaaataagaattttttttttttgcaaaatagttagaaaagtcagtcgtttaatgagtattttggccctgactttttttatacgtgttgaaaattgttttttaatttttaaattaataaagtttaacaagcgctttcaaacagtaccaagaatgaaaatcgtctaaaagatcatccttgctccgtttatttttctctaaattattaaataataattttttaagtgtaacgacattgatggacaatgccattgcaagcaaggaagagggggacgaacttgcgcggattgccaagacttttattggggtgcaaaaaatgaaaaaaaaaccattttggccaattattattttttaggtaatccactggctggggaatgcatgccatgcgagtgcgacacctatgggtcgcaaacgttgcagtgcgatcggcagacggggaactgcatgtgcaaaccgggcagtggaggcccaaagtgtaaccaatgcgcacgagggtgaacataacgccacagattaacttaaaaaatgattttgaaaatttactcacattgaacagttacactggtgtgtggcctcgttgccaagcgtgcggtgaatgctttgacaattgggacgcaattttgcaaacacttggccaagagttggaaacattgatcggccgtgccaataacattgaggacaccggtgtgaaattttgtgaaaaacccggtaaaaatttttaatttatgttactttcaggaatttcctcggaatatgatgacagtttcgttgagatggaaaataaaattggtgaagtgaaacgacgcatggaaggcataaacataacaaaagtaagcaaaaaatatatcttttttctatattggagtaatttcgtcgcgagattgtaacatttatttcctcctttaaacaggaagacatggaacaacttcgtcgacagatggaccacctgcaaaagcaaatagacacaacgcgggaaatgttggcggaaaagaatcaacgagtgacccgcgtcagcacagaagtcaatctggcggaggagggggttaag

SEQ ID NO: 56895 - DNA, 453 bp, Heterodera glycines
  Genomic contig location: Contig_ID=SeqID_26149; Location=631..1083; Strand=+
  SCN-specific regions: Sequence locations=1-104,127-453
atgcaaacggcactaattaagaaaattatgacttttcccgatcaaatagtcattcgctcaaacagctcgtagcagccgatcataccattaatatcttaaaaagcaaaaaaaaaaattattaaaaaagagagacaatcattaaattacaggcgtccagaaggcccaaagccgaagcagaagaacgcgacgactgacagcaaacacgaaccaaatccgaacatttattaagcacccaaatagcctgtgggaaaatataagaaaaatttagttaaattcaaaaattttaagaagcaatgttaaaaataagaacaaatttaaaaaaatccattggtaacttacgtaattgtcctcttcatcaaaactgagatccgttagagcgggcagagctgtcaatgatggaaccgattcagcgaattttttcagcccttaattgggatcggacccaaatagaaa

SEQ ID NO: 56896 - DNA, 632 bp, Heterodera glycines
  Genomic contig location: Contig_ID=SeqID_26149; Location=1175..1806; Strand=-
  SCN-specific regions: Sequence locations=1-632
atggtcaacaaagagcaacaagtaagtttgagataacattcacatttttggttagtcatttaattatgtgtctctgattttataaatagataaaataatcggattgaccgcccctccttttttgatttttaccgattttttcattttttgacaacttcttttacttgagatagccgactgatggatgataaggcggtaccacaaatataaactcctaaattgtggtggattcaaggaaattccaggcagacttaaaattattccaaatagctgaaaaatgccaaaaattctgccagccgagctaattttggagctgagtaatttcgcaaaatttgaccgaaaatgggctaattaccgcgtgtcattttcatttgacaaatttttgctggaaaaaatgggtgattggctaattgagatgaaaaaaatggtcatttaaataattaatttactattaatcagataaataattttcgcaggtagaattatgcaaggagtccattgatcatctatgcaacgccatcaatgggatcgaagatgaacaacaaaaaacaacagctacgtgtcgcgcattcaatggcaaggcaacaaatcaaataaattagacctttttaatcaaattcagacaaattaaa

SEQ ID NO: 56897 - DNA, 2110 bp, Heterodera glycines
  Genomic contig location: Contig_ID=SeqID_5099; Location=22..2131; Strand=+
  SCN-specific regions: Sequence locations=1-258,280-390,413-653,675 -786,808-880,902-1239,1262-1733,1755-1759,1781-1882,1904-2110
taaccattcatccgtcgaagaccgtaacattacaacaaatgaacgggccaccagtgtcacactgtaccgtcttattccaaatgccagctacgcaataagagtcgcggcccgtacaaatgccggagtgggtgccttttacattggcgaaccggttgtgatgagtaaggggccaatttcccaacaaatcacttacaattagcacaatgttttgcagcggaagaaaccctcaaccgacacattcgcctttttgaacgttctgagaatgtttggtatcgacagccgtggagtgttttggtgtgcggaattgtgctgtggtgtttgctccttcttatgatggtccttttttggtttcgctgttgtcatcaaaagggacggagcgcagcggaggccaaggaaagggaatttatcaaaatcagagatgggagtgtagcgaacagcacgaccatggtcggtggcgatgcgcgaaatgctttttgggtggcacacgagcaattcaatggtggcacggtggaaacgtccagcggaacattggccagagttggtggacagcagaaccaccagcaacatctcagctattttcaaccgactaattactctgctgatcgtgttcctggtccacataacgacgctgttaacagccagcatcacattgcactttcaaatgaaatgttcagcaacggaattcccatggttggccgaatttgtcccacggcgactcttcaaaggcataatggtggcgactgctcttctcctaactcgcctcattatcattatgcccatttgccgttttatgctgaacaaaataattcgctctcaactttccttcagcagcgacctaatcccgaactttatgatggtatgaagatggcattttcattttttacattgattatttcattacgatagatccaagtccgtacgcaacgacgactttggtttctcccactggggtaattacacaaacacttcgacccgccgtacgtcaaagcaaaggaccggcacttccgttaaaaccggcaccaaaagaaccaccaaagaattttttatgctcagcggcggtgatgcatttgacaaccaacagtaagcagcgtgtcaatggcaatttggaagttgtggaacaacagccgaacagcagcagttgtggagctttgttggaactcaacagagaatggaagagacagcagcgcatcaccgccgaggaacaaaaaaagcgagaaacaccgcagaaaaagggtggaacaacggcacagcggagagaaaatgaacacgacagagacatgggagagaatcagacatatggaacaacgggaagagggacgagaggaggagggggcagacggagtcaacgaagtagcagtgcgaacacggcacagaaacaatcttcggcattttgttcgctcaggagagtatcacacaaggagaacggcagcgaatgtcggcagaatcaacaggacagtccacagacggacatttcatatttgcaatcgtctgacggaaccaacggctctaataacaataacaataagcgaagccagcaaatgaatcgccaagtgaaatacgacgacactgcacccgaatatgatccggttatgacggactcattgagtcaaattgtgcacagagaagacattcgaaagaaaataggtccttactttacactaaaacttgcgtatttaattacaaatccgctgtcaaacgctgcaggtcgtgagaaggctaatcgaattgtacacagcaacagagtcagtttgattgaggatgaaggacaggaggagagggacccgctgatggaagatgcctttggtggtgacgaggacgaattggacgcggatggggaaatgagcgaaaacgaacacagcggaaaagagagtgaccgaagggcgaaaaggacgactgacccaatgaaaaggtgtgaagaagagtgcaatgtcgctaacgagcactattacgggttctcccccgccccgaaaaggcctaatcgacagccaatgatgggtatcaatatcagcactctgtcgggtgagagaaaataaaaatgacactttccatagggatttcaaattcagttggtgtggatcggaggacaaccgcctctccggcccatcgatga

SEQ ID NO: 56898 - DNA, 327 bp, Heterodera glycines
  Genomic contig location: Contig_ID=SeqID_5099; Location=2323..2649; Strand=+
  SCN-specific regions: Sequence locations=1-197,219-327
atttttcctttactgccgcaacatcgaattcgcttttgatgaaatcatttttcagttcgcctttgttcccatttctttcatccgttcaaattcgcttcaaatcaaccaaaattacaatttaaaattaaccattcttaatggttgagctgtccgctgtatgttttgtgtataaatccttcatctgtcatcttttgtatgtcattattcattatatatcattgcgccttttgtctaattgaacaaaattaaattaacgatcttaacaaaaaggtatttattgaattaaactttgatcattttcttaaataaagcaaatattttttgcat

SEQ ID NO: 56899 - DNA, 205 bp, Heterodera glycines
  Genomic contig location: Contig_ID=SeqID_5099; Location=6901..7105; Strand=+
  SCN-specific regions: Sequence locations=1-205
atgctccaaaacggccttaccattctgcttctgatcagtgttgtgatcggccattccttggccaaccttggcccaaccatcaaacataatcctcattttaaaaccgtacaaactgcgcatcattagcatgatgccattgcgaagaagcacgaggcgagcaattagaggaggggggaattttgagtgaaaattcatttcgaaataa

SEQ ID NO: 56900 - DNA, 565 bp, Heterodera glycines
  Genomic contig location: Contig_ID=SeqID_5099; Location=6432..6996; Strand=-
  SCN-specific regions: Sequence locations=1-115,137-449,498-565
atgaggattatgtttgatggttgggccaaggttggccaaggaatggccgatcacaacactgatcagaagcagaatggtaaggccgttttggagcattttatgagtgagtgagatgaatgggaaattgggattggaatgtttgaaaaatgccgacttaaataacccaatttaggtaagatggcatcattaaatttggcaataaaaacataagagtcacatgaatgccaaattaacgtggacaaagtgccaaaacggcacaaaaacatttccgcccctttccttaccttatggacagaagaattgtcaaaaataggtgatatcataattggaaaatatttatgtgaaaaggaaaataaaaaaataattgaacgtggcaaacaattatttcatatacaatttaattttaattctttcgaaggcaatttcctcttcacaagtgttcttgaatgtaaaataaaaaatatattttttaattcttaaattataataaataaattcagatgctaacaaatttcgttaaaaaatgacaaaatttggcacaactcagaaaaccgcgggaattaaa

SEQ ID NO: 56901 - DNA, 1228 bp, Heterodera glycines
  Genomic contig location: Contig_ID=SeqID_26151; Location=102..1329; Strand=+
  SCN-specific regions: Sequence locations=1-51,74-309,340-440,470 -1051,1073-1228
atgtcatcatcatcatctcccgaaaaaattttggctcaaccttcgtgcccaaaaaaggcaaaagtggacgagcgagctctgtggaaaattttcaaaggcaaatacatgctagcgatttatctctgcgatgatgactggcggaatctgttcgagaacaaagagaaagttcgccgaatggacaacgaccgtgtggccctaaacttcgaaatgtgcgaaaattgtgctcgtgtgaattgcaacggaacggacatattggctccgtcaaagaaacgaaaactttcaaccgatcaagcttaatgatatcatgatacctttcttttattattattattatgtgttttgccctcaaactaataaaaaataatttaattcaatttgcgcaatggtggcagggggtggggggagggaaggtagccatctgtcggcagctacatcgcatggttgttgttgttgttgttgttgtgttgttcggcaaatatccacacacactctgccctcatccttttccttccttatttttgcattttatctcccaccctcttcacggttaataaaaatgagtgcaaattccgcatcggttgaaactgaaattgcgtcactgaaacaaattattggcgcacagtccgtaaaattgatgcagatgcgtcatcattttgtgaactaccgcttcagacttgagcaacttgaggcttgggccggggaagtaaggtattcaatgttttttgtgatcacaatttttaactagggtaaagacaaaaagtttgttcgttcaccaacacgcaacaaacgattttctgtggacgacgagccagcaacatcggccgcaacttccggtaagggtagtgtaatattactgggaacagtgcgctttttcagatgggatggcaatggaaagcttgaaaaaagattttttggaggccaaaatgaaggtacttgtggaagagaaggtggccgaggcaaaagaattggcagaattttccatctctgatgcggagcgcaaaatgaaccaaagtttgaacaacgcaatgcgcgttggacgtgaaagagaccatcatcagttacgctgtgtagtggaggagcaacatatccgctgccgtctccttaccctgcaaaactaccccgtcgccacaatgacaaagctcaacatcgagttcgctacctcgcgacgtgtctcccaaacgggagacgcatcgcatgttttgtctgatagacgacccgatgtttggga

SEQ ID NO: 56902 - DNA, 1135 bp, Heterodera glycines
  misc_feature (1082)..(1082): n is a, c, g, or t
  Genomic contig location: Contig_ID=SeqID_26152; Location=648..1782; Strand=-
  SCN-specific regions: Sequence locations=1-192,216-358,380-522,544 -824,846-978,1005-1094,1117-1135
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcatnttctggaaaaaatatttatgaattaattatgcaaaaaataaacaaataatgaa

SEQ ID NO: 56903 - DNA, 572 bp, Heterodera glycines
  Genomic contig location: Contig_ID=SeqID_26153; Location=380..951; Strand=-
  SCN-specific regions: Sequence locations=1-371,394-472,527-572
atgcaagaagcagtccatcagttaaagaaggcgacaaacgctttaagcgaaaaagtaattgaccttttatgtagcttatagatattgtggaaaaccattcaaatttggcttcccaatttacggacatttgcttaaaaattctttttgtggttttcttttcgctccttctattgtttctccttttctaaattaaattttcacttttagtgcaccaattgtgcgcccgaaaagagagcgtacagaagcaattttcttttggtgaagaaatacttcgaggacacaacatcactcatcaaaagcgaagtgaaactttggcagacggtgctcgaggagaaggaagaacaattgaggtccaaggacgatgaaaggtcattgagatgaggctacaggcctggagcgggaatttttggaattattttaaaaatcgaaaaagaaaatgatagaagaaattatttatttgcttagaagtatctaaaaatatctaattaataatgataataataatgtgtttttaaatttatttaatctgattttgataacttgaaaaaacatcgggcacttgaaaaaataaa

SEQ ID NO: 56904 - DNA, 309 bp, Heterodera glycines
  Genomic contig location: Contig_ID=SeqID_26153; Location=1634..1942; Strand=+
  SCN-specific regions: Sequence locations=1-309
atgtccgtctcgtggggcactcaatactccaaactgaagacaaatcttcggctggctgcaaatcgactccgattgttgcagaagaaaaagactgagcaggcggtgaaggcgcgctgtgaaattgcggactttttaagcagtaattgaccattttagttaattgctttatttggaatggcttaaatttccctcgaaatttttatagaattcagcgctgattttcggattaattattcatccaaattttagcggacaaagaggacagagcccgaattcgcgtggagacaatcattcgcgaggattttgtgg

SEQ ID NO: 56905 - DNA, 979 bp, Heterodera glycines
  Genomic contig location: Contig_ID=SeqID_26154; Location=165..1143; Strand=-
  SCN-specific regions: Sequence locations=1-144,166-258,291-441,463 -859,881-979
gtggtcactggaggccaatatgatgttgatgtggtgttagaagatccgaatggcaaagtgttgtacaaggaggccaggaaacagttggacacccacacgtacaaagtgagtgatggcaccggtgaaatcgaatgccaaaggtttatttttcataaaattaaaaaaccataaaatgtgggtttgcctccatttttctgaattattgtcctgatttgtgtgacaaaagagtaaatttttgagattttcaaaatatgtggattgaaaaaatacacattttttgaattgtttatcaattttttttggcaacactcaaaaaaactactctgccgactcattgtcaggcaacacaaaaaattttttttgaaaaaatagaataaccatcaaaaatgatattggcattgcccaaatggtataatatggggtagggattgggaaatttgaatattttgcgccggaaaatttcctgatttttttgatcctgtataggtttttttgcctcggtttatgccaaaccctggtgtatataagtcaaattttgaggaggtcgggggacggaaatttcgaatttctccaacttttggcttgtctacgccggaggatttcctgtattttttgggatcctgaattttttttttgttgaaggtttcagattataccaaactggtatataggggccaaattttccgaaattagggaaagggggcgccggaaattcggatttcttcaacttttgggctttacccgaaaactgaccaatttctacccaaatttatttgcttccgcctttttagacagaggccaacggcacgtacaaagtttgcttctccaacgagttctccaccttctcacacaaggttgtgtacctggactggcaagtggggccggacgagcagcacaaaatgatgccaattccgcgggccggcggtgcgcaagcgacgcaaatggagcgcagcgcggagacaatcagtgaccggctcaa

SEQ ID NO: 56906 - DNA, 1217 bp, Heterodera glycines
  misc_feature (47)..(48): n is a, c, g, or t
  misc_feature (75)..(75): n is a, c, g, or t
  misc_feature (89)..(89): n is a, c, g, or t
  Genomic contig location: Contig_ID=SeqID_26155; Location=4..1220; Strand=+
  SCN-specific regions: Sequence locations=1-253,275-397,478-505,527 -542,564-768,790-914,948-1217
  Gene Ontology: Mol. function=thioredoxin peroxidase activity; Cellular component=extracellular space; Biological process=response to oxidative stress
aagttcatcgccgatttcatcggcgccctcaaatttgatcccgagcnncggccgacgtttcccacgccgttgccnctcctcggcggtgngcacaatgtgagcggcgaaagcaccggcgattgccaatcgaaaaaccttaaaaatccggcaaaaattttaaaaattcgattcggcacggacacccaaaagcagacaaatgcctgccttaacacattatcagctgtaatcgccacactgagagaaagcggacaaaatgattttttgggaattaattttaattagggaccgaattttgttacacaaaaacttcaaaatcaatcacaagaaataatcatattcataaggaatttttgtaaaagaatgaaattttaaatttttcttctctaaaatattttggataaaataaaattttttaaaattttgttttaaataaattatttattcattctgataaaatttagtaaattttttaatattcaattaccttatctttttcatttctggtaaaaaattttgtattttaaaatgttaacaataagcacattttgtgtattttctgaaattttttcgggcgattcttaggggtgtaattttcatttttgttaagaatttttccgaaaatcctgaaaaaggcgccaaaaatggcgaaataggcacaaaaataggcaaataggcattataaaagtcatcgtagacaccccaaatcgtgcttatctatgcatattaagtgcgcaaaaattttaggaatttgcctaaaaatggaagccataataataagtttaaaaattttggatttgtttatcgttagaccgcaatttttcttaattgttttcgagttttgactgttgcctatttgttaagcctgtactaccaattttcactaaaaagcattagcaatttaatgcaatttctattccttttcagtttgtgtgccccaccgaaatcattgcgttcagtgaccgcgtcgccgagttcaagcagctcggctgtgaggtgatcgcctgttcatgtgactcgcatctcgcatttggtgttttttttttgttttcaatttttttgtactcgtataatttggtccatttttcttaggcttgggtgaacacaccgcgcaatgatggcggacttggcaagatggacattccggtgctcagtgacttcagcaagaaaattgcggctgactttggcgtgttggacaaggagaccggactgtcctatcg

SEQ ID NO: 56907 - DNA, 661 bp, Heterodera glycines
  Genomic contig location: Contig_ID=SeqID_26157; Location=835..1495; Strand=+
  SCN-specific regions: Sequence locations=1-231,254-357,379-554,577-661
atggcaccgtcttcctcctctgctgccgccatgacaccactcggcgtcattttggtgtccaaggacgagtcggccgagcgcgtgctgttcatgtacccatttgagcgccgtgtgtcgccgcactccgcccacattaacagcaggggtccgcaaacagtgggaggagcagttcaatttttcttcacccattctctccccgccaacaaaattgatggtggaaagaaattcttgtaaatattcaaaaatagaaaaacgctttttttgaagaaaccaaaaagtaaatcaaaaggtatagacgaggtaatccccatcccaatttcctatttgccatttgttataaaaaaattcagaaaagtgccatgagcacaaggactcagtggtgtcaatgattggtaaagacgtgccaaagttgggcggcggcggtacgccggacgacgtgccgtgccaaccagctgcaattgacagcggtgatcagcaacaacaacgtctctgcgacggcattgcgttggacggcatttcgactgggtcggccaaaaatgtaatttcgcaattaattttttaaacttctttcagttttcccgtcaaaatgttggcccctttgctcgtcgccaaaggctccaacggaaatgggacgccttttgatatcaaagtactcttttga

SEQ ID NO: 56908 - DNA, 836 bp, Heterodera glycines
  Genomic contig location: Contig_ID=SeqID_26158; Location=41..876; Strand=+
  SCN-specific regions: Sequence locations=1-252,274-622,648-802,824-836
atgcctttaaaatttaattgtgccattttcgtaatcgacttaccaccccctctcccacatcgttcagcgaactcaccggaggacttgtggagcagggtcatcgcagcgtcgcagtcgttcaagaaagccgcgttctgtgagcaagtcgccgaggaagaagaaggctgcgcctggctcatccgcgcggaagccgtctcgtcgtcgtccacggaccgtgtcgcggcgccgtgccaccagcaagcgtcgacgcagtgccagcaagaagaagacggcgaaatcgtcgaagaaggatggagccactaccaccgccactggtgctgatgccgggacgacttcgacgacggcgacggacaacaccaacgcttcccagcaaagtgaacgtgagtttctggcgaaattcaagaattgggaggagtacgggtgctgatttcgaatctgacactttcaaaattcttaggttctgaagggagtgcaacggatgagtcatcgcgtggttctgaggcggaggcgaccaacaccggtgggacagcggcggatggaggtcgtgccacggagtagaagcaatggaagaacaccaacaatggatgatgacgaatcggatgagaagcgattttccagcagaaattaactgtattttttgtctccatcataattatatgttgagagtggccctctttctccaattgtttgtgttgtacaatattcatttcctataagcccgtgagatgcttgccacacctccgttgtatgaattccccctaatgtcagtcattctgatgttgtattgtcgatttaatcgctatgtgttgtctctcaattatgtttgctctaccata

SEQ ID NO: 56909 - DNA, 1297 bp, Heterodera glycines
  Genomic contig location: Contig_ID=SeqID_26159; Location=510..1806; Strand=+
  SCN-specific regions: Sequence locations=1-162,184-614,637-768,801 -915,957-1017,1039-1297
atgtataaaacgaaccgcgaagattggaaaccggaaatgtctgggcgatacaatcagcggctgtatgaactttttgtgaaatacgccccatggattggttggatgctttttgggcatttgcacacggacacttttcgcattataaaagtggccaattaatgctcaattaattttaattgtttccaaacttttgcccagtcccccgatggaagtgccgttcagcgaatgtttctgaatccggcggtcactccgctgttcaatctcaacaaccccgccttccgaatttacgaatataacacgaaaagcatggaaattgaggacataaaatatgtttaaacttaatgaaataatggaagcaatgcttttcgttttagaactttttttgttaacttggaagcactgaacgcaaacggagccgaaattagcgaagcgaaatttgaatattcatttcgccaaacttatggcatccaatcgccgttaaatgcaaaatcattggacaatcttgtggagcggatgaagcaaaacgaaacactgtttgaccagtacttcaactactcctccgtccaatggatgacacgaaaactgaatgaaactgaaaggtgccaaaaaaagacggatagagggagggggcggggaaatgccatggcaaaccaattatcactaattgataaaaaatgcaatggattcaggaagtcgcatctttgtgtcgttgaattcgttgactttgatcagttggagcgatgtatcaatgcaaaggtaagcgattggaatttataaaattaattaaattaaatttttaacttcatttttcacagatgtctttgccttctttctacgtccttctgcttgtgggttctctttttgtcatttccgttgcgtttttggctgcttttttctttttgccttacattcgaaagaaaatgggcaaaatttgaatttatttgtaatttaaaaaggcattcttttcgggaaccggccactttggcgcaggccattttggcgcaagactctatatcattttgatttcacagcaaaattaaataatcttggtatgattttaagtggcttgatagtgcctattaacctgcaaagtttcaaaaaatttagctgagaaacaaaaaagttatggccaaaaaacctcaaaaatgcattttcctggccattttggcgcagcgcgccatatcttttttaaaacctaatataattttttgaaattttgcaggctaataaagaacatttagacctattgattaatatcaacattattttatttggtcgaattaaaaaaaagttatga

SEQ ID NO: 56910 - DNA, 1180 bp, Heterodera glycines
  Genomic contig location: Contig_ID=SeqID_5100; Location=42..1221; Strand=+
  SCN-specific regions: Sequence locations=1-434,456-767,813-871,914 -1180
  Gene Ontology: Mol. function=protein binding; Cellular component=DNA -directed RNA polymerase II, core complex; Biological process =regulation of transcription, DNA-dependent
atgtttggaactattctgctgaagccataccttcttctggccggcttatgcctgttcatatacggcaccgaggcatggaaatgcaagcctggtaaaaagggaccgaccggtccaccaggaccgcttggaaaacctggagcacctgggaaatgcccgacgaagccaaagtacggcaaaacaacaacacccaaatacgacaccacgacttccaagtacggcactacgagaccaaaatatgacatcacgacttctaaatacggcacaacaacgccagaatatgagacaacgacatcgaaatatgggaccacaacatccaagtacgacaccacaacttccaaatatggcaccacaacatccaactacggcacaacgacaccacaatatgacactacgacttccaagtacggcaccacgacgccagaatatgacaccacgacttccaaatatggcaccataacatccaagtatggcacaacgacgcagaaatatgacaccacaacttccaagtacggcactacgacttccagatacgacaccacgacttctaactacggcacaacaacgccagaacatgacactacgacttccaattacggaactacgacttcggaatacgacaccacaacttcgaaatacgacactacaacttccaagtacggcacgaggaccccgaaatatgacaccactacatccaaatatggaacaagaccgcccaagtatacgcctagcaaaagatcggccatgtcggagtttgcggtagaatattagatgggaaaattttgaaacaaaataaggaaaaattaaaaattgtacaggatgcggtagtgatcagagctgctcgggctgagtttgccgacaaaaaatgcccagtggggcgccccggcgatgccggccccgcggggccaccgggccctccgggcaaaccgggcaaatgtccgtcaccggtggaacgctatgtcaagaaaagcgaagagaaagaagggtacaagagaaaggaggaaacggaagaaaagaaagaagcggaacgggagaagcgttatgatcatagcgttgaaagcgacgggttcgattttatctcaattctcagtttcgagtcttaggttctaatctcggtctcgatttttggggttgctcctagacgcttggactcaattctcaggggttaatcaatcgtagggga

SEQ ID NO: 56911 - DNA, 257 bp, Heterodera glycines
  Genomic contig location: Contig_ID=SeqID_5101; Location=331..587; Strand=+
  SCN-specific regions: Sequence locations=1-154,192-257
atgcctcagggaacaacagcagagccaatcagtgcgcttcaaagttatgccccgaattggatggatcaattctgctggcagttcgagcacctaatttatgcgatggtgtggaaatcgaatgcatatgaaaggagagagataaaaggagatataaaaacagatttatccagaaaaactttgttgttcattaaaaatatggatttaaatgcgaaaaattgaaatgcaaaaatatataatacagcaatttttattttcca

SEQ ID NO: 56912 - DNA, 1643 bp, Heterodera glycines
  Genomic contig location: Contig_ID=SeqID_5101; Location=821..2463; Strand=-
  SCN-specific regions: Sequence locations=1-365,387-423,462-528,561 -572,666-1247,1270-1294,1364-1496,1518-1643
atggccacttcaacggatgagggcggaagtccgagggcaaatatggaggagggattgttgtcattgccccgggactcggtgactttgtcagtgccaagcagcagactgaaaatgccaagacggtccaaaggtaagtaagtacaacttaattggcccatgagcttgatgggcatggcatattcctgcctctcgaaatgaatagtaaaaattttaaattttcgataaattatcaaattttttgtaaatttttgggccaattttttctcagtaaaatttaataaaagttggttttccccagtttttcccatatttgctgtacctttgcactctatccctcaagaattaaatgaaatgaatgtgaaaagagcgggagagagaaaatgaaaattatagatgcagagcggaagtgggaaagagaacggggagagagagagaagagagggagagagagagagagagagcgatagaaattgaaaatagagaaagcatagagacaaaagtggcagaaattggagatacaataggcataaagaattgtgaaaataaatagctaattcatagaataaggtagcgagagagagagagatagacgagagaaagaacaaggagagagaaacagagggagagagagattaatatatataaagagagaaagaaagagagagtctgagtgcaaagagatgtgtgccaatttatttgctaattgctttgtttgccgccgccactttatgccaatggccatgtaatgaaaagccattttcattattacagaggacaggttgttgtcggcattaggaccattcatttatttgttcctgccaaagtcatcccatcccattaaatcccctaatttatttaaaaaaatgttttttgttcgccaattagaaagcttggcgttccatcgcgacccgttcaatcggccggaattggtgcacaccttgcgcgggcgtgagcttgtactgtttgtgttactgtacgcaatcggtgtgattgccattgtgttcatatttggtgagtgcttttttgggtggaattttgccgaaattggcattccaaattttgtttgtagcacttttatattttggtttttgagttgcaacaaaattttttgtcctattttttattttcaatatttcaaaaaattgccaaaaaaacgaaaaatgttcccttgagaattaatctatttaaaaaattgaattatgaatttctattttaaaccaatttttcccgtctaaaagtttttagtgattttaatgaattttaagaaattatttttgtctctgtgaaaaaagggtaaaaatttaaatgaaaaatatcaatttttcatttttatgtcaattttaaaatttttaaaatttaatttcaatcaaaaacaaaaaaaatggcaaaatttttcgataacaattacaaaaaacagagtgtacaatgcccgtgttttggatcaatgatcaaagtcgcgcagagcagcgccgtcgtgccgcaattgtggtccgatcggcacagaaagtgatgctggaccgagaaatgccatcgtcaattggcccactcagaaagacatgagcaaaaagaactgaaagacaaatcagcaaatttgatcaaaacttttaatgcatgcttatagttaattagatttatttaataaa

SEQ ID NO: 56913 - DNA, 298 bp, Heterodera glycines
  Genomic contig location: Contig_ID=SeqID_5101; Location=4071..4368; Strand=+
  SCN-specific regions: Sequence locations=1-243,265-298
atgaatgtgaaatttgtgggtctgaggaaaattgtgatattttgtagagatgcgccgtgaatcacggtcacggttaccgtgaatttcacgggttttttcactcacggtcacgattcacggtaccaattcacggttattccgtgaaaaatgtacactggataaaattgaatatttacaaattacatattgttttcatagagaaatttagtcattttttgggaaatttttgctaagaaacagagcaaaattttcaaaaatttccccggcggcgtctatcggcaccgccggcccaatttaa

SEQ ID NO: 56914 - DNA, 799 bp, Heterodera glycines
  Genomic contig location: Contig_ID=SeqID_26163; Location=516..1314; Strand=+
  SCN-specific regions: Sequence locations=1-124,146-253,275-285,307 -706,731-799
atgaaggagtgtttgaagaaaaaattggcacaaattgacgaaatgccaaaattggtccgagttttttgtacatttttcactggacatattgatgccgataagttgattgatgctctgctacactcgggctggtccacagttttcaacgctcaaattggcgaaaagaaacacggaaaaagcattttggagaaatttaacctggaaaattaaaagaaaaattggattgcaaagaaagtgttgacaagtatcactcgttagttgtccttgtttttgcttcattttcagagaaatttcattaactttttaagcaatttttttggtgcttttagaccatacaatcacaaaactttgtcatcccatgtgatcaattagtgatgctcgagagcgaacattcccttttctcgaaggactcgagactaacacaaaagcacagccgactgaccaatcataaaatggaaaacccaaaaaaatgacaaacaaaacaatagatttaatttatatgaattttttttgaaggttactaaaatattgtcccagctcctcatttcttaacagggtatttttgactgaaaactcaatttctttaatggcgtaaaaaagtctcgaaagccaagacttaaaaacccgtgacttgagccgagaacaaaacatccgaatcgaattgagtccgacactctcgagaatcactactgatcatcagacttcactctttctctttctctcttttttcaaattattaatcccactatttatcatatagtgtttttttcgcctttaattgttttcaatttttcggcga

SEQ ID NO: 56915 - DNA, 604 bp, Heterodera glycines
  Genomic contig location: Contig_ID=SeqID_26164; Location=498..1101; Strand=-
  SCN-specific regions: Sequence locations=1-32,56-231,253-604
  Gene Ontology: Mol. function=protein serine/threonine kinase activity; Cellular component=nucleus; Biological process=protein modification
gctatcccccgttctgctcagagactccccaggagacatacagaaaagtgatgaattggcagcaaaccctcgcttttccgcccgaaatacctatttcaaccgaagcaaaaaatgtaaattttctgactgtcgataagcacttgttaatgctttctttctgcagacaataaaagggttctgttgcgaagttgacaagagactcggcaaccattcgggcattgaaagcatcaaacagtgccctttctttaagagggtcgactggcagaacataaggtccctcactttttggttctttatacttctttttaaaggcttttgccggcccccattcgcatcgaagtgaagggaattgcggacacttccaacttcgaccactttggggattccgatttggccttgcgtatgtgcacacattgaatgcttttagacattttttcgtatttcccttttagccggcgttaaggaagttgcctctgacaattcgacaccctccgtaaccgacaaaggcgaatttgtgcattacacattccaacgttttcaatgtttggtatggaaagcccatgtatttgacactcttctccgattcagactcagcagaaaaggt

SEQ ID NO: 56916 - DNA, 489 bp, Heterodera glycines
  misc_feature (30)..(30): n is a, c, g, or t
  misc_feature (50)..(50): n is a, c, g, or t
  Genomic contig location: Contig_ID=SeqID_26165; Location=540..1028; Strand=-
  SCN-specific regions: Sequence locations=1-177,199-230,252-329,356 -438,481-489
aaataaatcgattttttcaagtgtccgttntggggtactcaaacaattantggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 56917 - DNA, 367 bp, Heterodera glycines
  Genomic contig location: Contig_ID=SeqID_26168; Location=342..708; Strand=+
  SCN-specific regions: Sequence locations=1-93,125-327,349-367
atgggcaaagatttacagtaatattctctcgtaaatgaaaaattttattttgaatttttccatttttttaattcaaaaataacttccaatttgataaaaatatttaatgattaatatattttttgctttcatactgtacatttgcttttaattattttttttttcatttcaggcggatttcacatggtaaactcgcaattgatccgataaagacacaaaatcattgatcgcttaattatatagattttgtatacattaataatgctttttggttcgatcaatctgttatgcaatatttaaaaacaaatagtgtaatatgcgtattattgtaactttaaaaatattatttcgatttcatgctttttca

SEQ ID NO: 56918 - DNA, 1064 bp, Heterodera glycines
  Genomic contig location: Contig_ID=SeqID_5103; Location=1018..2081; Strand=-
  SCN-specific regions: Sequence locations=1-18,74-455,483-685,708 -801,823-882,904-920,942-1064
atgcgcagcggtgccccgcttctcctcctcccctcccccgccgttgtgcttttcctcctcctccgcttcttccggtgccgtgttgcagtggtggctgtcgcaaaggttgcacccgccgtgtccgttcagcgactggcactgcgcattaaagcgctcgcaaaagtcgtactcgccgttgaacacgcagtggtgataggccaaataggcatggcgactgtctgtggacgaaaagcattgccaagcgccgcagaaatcgccggccgattttgttggactgaccgacacggcacgtcgcattcagacacatggaccccgcataggaaatgcagctgatgttccgcttctcctccgtggcccgcagagttccgctcacgtcgttgatcaaatcgtacatcatcatatttaaaggattttatgccaaaaggaaatgaagatgagaagggcattttaaattcaaagagtgaaaaggaaaagccaccaaatggaaacgaagaaaaaacaatttcaaagcgtaaaaataacacaaaaaggaaaaattaaagtgaaaaaggaaaagagcaagttggaaaaagtgaaaatagcgcaaaaagaagtgaacctaatgaaattggtactgaatcgggcgaaattgatgaaaatgataaaaaaagccgaaaacatcagtataattggccaattttttattaaaactaaatgtgtttttaggtggcataaatctcaatgaagaagcgcatacgagtctaaattcgcatgatttagcgcaaaatttaaatgagaaatggcatgaaattggcacagtgccaaaagaaaaataagaaaagggcattttaaatacaaaaagtgaaaaggaaatgccgccaattggcgacggggaaaaaataatagaagaaaaagacaatgaaattgcttctgaatcaggcgaaattgatgaaaatgatcaaaagcaaaggagcgaaattggcattgtgccaaaagagaaaaatgaaaaaggcattttaaaggcgaaggaaatgcaagaaaaaacaatttcaaagagagaaaagaagccaaaaaggaaaaataaa

SEQ ID NO: 56919 - DNA, 327 bp, Heterodera glycines
  Genomic contig location: Contig_ID=SeqID_5103; Location=1785..2111; Strand=+
  SCN-specific regions: Sequence locations=1-224,280-327
atgcgacgtgccgtgtcggtcagtccaacaaaatcggccggcgatttctgcggcgcttggcaatgcttttcgtccacagacagtcgccatgcctatttggcctatcaccactgcgtgttcaacggcgagtacgacttttgcgagcgctttaatgcgcagtgccagtcgctgaacggacacggcgggtgcaacctttgcgacagccaccactgcaacacggcaccggaagaagcggaggaggaggaaaagcacaacggcgggggaggggaggaggagaagcggggcaccgctgcgcatccgcacgacgaaatgccaaccgaaaaggcg

SEQ ID NO: 56920 - DNA, 114 bp, Heterodera glycines
  Genomic contig location: Contig_ID=SeqID_5103; Location=1..114; Strand=-
  SCN-specific regions: Sequence locations=1-114
aaaattccctcaaaaataaaaggtctattgcgcaccgccctccctatcatgctcgagagcatttgtatgtgtataaaatttatcaaaaaaagagatagccatttttctgggata

SEQ ID NO: 56921 - DNA, 1821 bp, Heterodera glycines
  Genomic contig location: Contig_ID=SeqID_5104; Location=344..2164; Strand=-
  SCN-specific regions: Sequence locations=1-435,461-683,705-1381,1404 -1679,1701-1821
  Gene Ontology: Mol. function=long-chain-fatty-acid-CoA-ligase activity; Cellular component=lipid particle; Biological process =gametogenesis
atgcttcttcttctcctgcgtctcccacccgtcctggatccgaagggattcaacggcaaatttaattatttaaaaagtgcgtttttgtaatgccattttcaaatttcagtttggcttttgccaaaatcagcaaaatgctcggtggcaaccttcgctttgtgatttctggcggtgctccgctcaatccggagacgcagcggttcatgaacatttgcttctgttgccccgtcgttcagggctatgggctgacggaaacttgcggtggcgccactttggcggatggtcgttcattcaaaaaaacatagtctaagcaaaagcattttttcactttcagaacacgacctcagcaccggttcggtcggaccgccgcttcggagttgtgaaattcggcttagagaatgggaggaaggtaaaattcaattttgaaacggtcccaaaagattaatttatttattttttcgggggggggggtttgtgtcggcataattaggtccaatggcggacgtaattgaaaatttattcccaaatgcatatctttctttttcagctggttatttgcccacaaattcgcctcctcagggcgaagttctgatccacggggccaatgtcgcgttgggttacttcaaagatgaggagaagaccaaggaggacttcgtcgagttggacgggaagcgttggttcgccaccggagacattggccaattccgtaagcaattgactgccaccaaaagcattggcataatgacaaatttgttcatgtttaggcgaggatggcagtctctgcattattggttttaattagtgagtgttgttggcaatttctctctcattttcagaccggaagaaggatttgatcaaattgtcccacggcgaatacatcgctttggggcgcgtggagacggcgctgctgaccaatccgaacgtggacaacatttgcgtttatggcaacccgcaaaaggactatctgatcgcacttgtggtcccaaatcgcaaaaacttgcaagcacttgctgaaaaggtgggagtcaaaaacggaaaacaaccgtttcgcgtcatggcaatgatataattaataagccatcgcttctcccctcttcagaatgccgtcaatgagtcgagttgggaggcaatttgtgccaacaaagaaatggccaagcttctggaaaaggaactccaaaactttgtttcgggtcttttcttccggccaacctttgccttattaaacaactctttttcagggaaattgcgcagggaggaaatcccgaggaaagtcattatctgtgcggagccgtggactgccgactcgggaatgctgaccgaagcactgaagttgaagcgcaagaacatcgagagaaaattcgcggaggaaatccgacagctttatgaggggaaatgattgggttgttaattcccggaggctatttcgcttcaatttgatctcgaccatcaaatcaagcagtttcattgtgccgtaattgccatcatcatgagctttgtacccccaattatacgcaattaatttttgttcggttttcattggtcattcttctgtcagtgcgcgtttatttatttttgatattcgttagggcttttgtcgagagaaatgtccccatttgtcgctattaattaatgtgtaatgtttgaatttgtattggaattgtacaatttcgtaaaggagtaaatggtgaaactccatctaattttatgtttttggttggtttaaaaataggtaaaacagcaggtccaattctaaagtacagccaaattgcttatgtatttattgtcattaaaaaaagtatgccccataaattaaaaaataaa

SEQ ID NO: 56922 - DNA, 3409 bp, Heterodera glycines
  Genomic contig location: Contig_ID=SeqID_5104; Location=1..3409; Strand=+
  SCN-specific regions: Sequence locations=1-261,284-327,361-464,486 -761,784-1460,1482-1704,1730-2237,2259-2956,2986-3129,3151-3409
  Gene Ontology: Mol. function=guanylate cyclase activity; Cellular component=mitochondrial inner membrane; Biological process=transport
aatcccgcaatcccgcacgccttacatcggaattttaaatgcgggatttgcgggattaatccctcgtgatcccgtcccgcaaaaaattttgagttccagtcccgcagcgggatccgcaaatttgaaatttcccgtctctagtgattagtattactaattagatgctgcctttacactttgttttattaattattatgcgtcgtttctgttcagtgtttgtcgcctgcgttatgttggccgttttcggctacaaagaacttcggaagagaggcttttttgtagcggacggagaaagacagaacgaaaatttgatttagaagagagccgaaataatatttattcatttattttttaatttatggggcatactttttttaatgacaataaatacataagcaatttggctgtactttagaattggacctgctgttttacctatttttaaaccaaccaaaaacataaaattagatggagtttcaccatttactcctttacgaaattgtacaattccaatacaaattcaaacattacacattaattaatagcgacaaatggggacatttctctcgacaaaagccctaacgaatatcaaaaataaataaacgcgcactgacagaagaatgaccaatgaaaaccgaacaaaaattaattgcgtataattgggggtacaaagctcatgatgatggcaattacggcacaatgaaactgcttgatttgatggtcgagatcaaattgaagcgaaatagcctccgggaattaacaacccaatcatttcccctcataaagctgtcggatttcctccgcgaattttctctcgatgttcttgcgcttcaacttcagtgcttcggtcagcattcccgagtcggcagtccacggctccgcacagataatgactttcctcgggatttcctccctgcgcaatttccctgaaaaagagttgtttaataaggcaaaggttggccggaagaaaagacccgaaacaaagttttggagttccttttccagaagcttggccatttctttgttggcacaaattgcctcccaactcgactcattgacggcattctgaagaggggagaagcgatggcttattaattatatcattgccatgacgcgaaacggttgttttccgtttttgactcccaccttttcagcaagtgcttgcaagtttttgcgatttgggaccacaagtgcgatcagatagtccttttgcgggttgccataaacgcaaatgttgtccacgttcggattggtcagcagcgccgtctccacgcgccccaaagcgatgtattcgccgtgggacaatttgatcaaatccttcttccggtctgaaaatgagagagaaattgccaacaacactcactaattaaaaccaataatgcagagactgccatcctcgcctaaacatgaacaaatttgtcattatgccaatgcttttggtggcagtcaattgcttacggaattggccaatgtctccggtggcgaaccaacgcttcccgtccaactcgacgaagtcctccttggtcttctcctcatctttgaagtaacccaacgcgacattggccccgtggatcagaacttcgccctgaggaggcgaatttgtgggcaaataaccagctgaaaaagaaagatatgcatttgggaataaattttcaattacgtccgccattggacctaattatgccgacacaaacccccccccccgaaaaaataaataaattaatcttttgggaccgtttcaaaattgaattttaccttcctcccattctctaagccgaatttcacaactccgaagcggcggtccgaccgaaccggtgctgaggtcgtgttctgaaagtgaaaaaatgcttttgcttagactatgtttttttgaatgaacgaccatccgccaaagtggcgccaccgcaagtttccgtcagcccatagccctgaacgacggggcaacagaagcaaatgttcatgaaccgctgcgtctccggattgagcggagcaccgccagaaatcacaaagcgaaggttgccaccgagcattttgctgattttggcaaaagccaaactgaaatttgaaaatggcattacaaaaacgcactttttaaataattaaatttgccgttgaatcccttcggatccaggacgggtgggagacgcaggagaagaagaagcattgcccttttgatgttcagaaaccaaaacctgatggactacgtgttcggcatgctcgagcagtacgccagttcactggagcaggaggtggaggagcgcaccaaagagttggtggaggagaagcgcaagagcgacattctgctctatcggatgctgccgcggcaggtggcggacaaactgaagctgggcgaggcggtggagcccgagtccttccaaatggccaccattttcttctcggacgtcgtctccttcaccactttggccggcaaatgcacgccattacaggtgacaaaatcagtgatcacatcagactggggaagctgagtgatttgttcaaaacttacaggataatcactctgatcagtctggggaatctagtgatttgggcagaagaaatgtagttggtgataacgaatgggacttagtctgactattgtgatcaacatccattctgatgataatatgattcttacgtcctccccctctccgccgtttaggtggtgaatttgctgaacggactgtacaccgcctttgacggcctcatcgacacccacgactgctacaaagttggtcagtcagcggccgatcacttccatttgatcattttacaacgcatttccccgcacagaaacaatcggcgacggttatttggtgtgttccggcattccgaagcgcaacggcgaccaacacgcgaaggaaattgcggaactttcgttcgctttcctccgcacggtgtccaacttccgcgtcgaccacctcccctccgaacgcgtcaatctgcgcatcggcttccattccggtccctcccctcccctcccatttcaaatttggcattttcaggcccagcagtcgctggcgttgtcggtctgacgatgccgcgctattgcctttttggggattcggtgaacaccgccagccgaatggaatccaacggaaagggtaaaattggggggggggggggggggagaaaacaaattcatttcccatttcagccggcaaaattcacatttcatcgagttcaaatcgcttcttgaccagcgtaatcggaggatatgtgacggagccaaggggcgaagtgattataaaggtaattaggggggggggggaaaggcttttgttaattaattgcctaattaattcattagggaaaaggtgtgatggagacattttggctgttggggcgaattggcgaagtccatttgccggaggggccatccgtgccggaacggaagagcccagcggaaatg

SEQ ID NO: 56923 - DNA, 1848 bp, Heterodera glycines
  misc_feature (630)..(630): n is a, c, g, or t
  misc_feature (651)..(651): n is a, c, g, or t
  Genomic contig location: Contig_ID=SeqID_26170; Location=86..1933; Strand=-
  SCN-specific regions: Sequence locations=1-92,114-557,579-656,678 -972,994-1157,1179-1326,1348-1673,1695-1753,1775-1848
tccacccagaattgaagatgggtttttagacttattgtcaatccgagaaacatcatcaattcgaattaaatctccaaaatatttggtacagctggaattaagtaatggaaaaagagagagcttaattgtcaacagaattgatcagattacgggtaaactaaagagaattgacataaattcgggcaaaactgaatttattgatgaaaaacctgacatactaattggaatggcagaattttggaaattctttaaaagtgtcgaacagattaaagaaaatttgtttaaagtggacacaacagtcggccctattatttgcggtcaaatgaaaaataattcgggtaaattggaatcattatttgaaaatataacagccgcagtcagtgtaaagactgaggaaccaaaacaattttggaatttagaaactataggagtatgggataacccggaagagaaggatgatgagattgccttgaaaatgtttaaagaaacggttcaacgaaaaaatgggagatacgtggtaagttggccatggaaaggccctagagaagaattaccaacaaattttgctatagcataccggcgtttaatgagtatgttagaaaagatgagaataaccccaagtcagcttanagcattggatgagtcatttanagaaaatttaaaagagcaaattgttgaagaatcctcaataaaagggtttggcgaacattttctccctcatcattgtgtcttcgcaccgggaaaaaagccaaggattggttatgatggctcagcaaaaccaaggagtggtaaatgcctaaatgacatgctttttcgcggcccaatcgaaatgccacagcttccagggcttttaatgcgatcacgaataccaaaaattgctttatgggctgatattcaacgagccttttggacattggagttaaaagaggaagacagagaatttgttaaatttttatgggtaagagatataagaaaaccaattacaaaagaaaatcttctagttctacgttttaaaagagtaccatttggagtaatttcctcaccatttttactgggtgcgacggttcggtatcatttaagtcaaattgattcacaacttactaatgaaattcaaaaaaatttatttgtcgacaatgtttttgtaggctgtaaagacgaaaaagaagctatggaaaaatatgtgtcaatgaagcaaatatttgcggatgctcggatgaatttgagagaattcgtttcgaattcttattgggttaataatcagatactagaaaatgatagactcggaaaagaaaaaccaaagattatgggtgtacaatgggatgtacaaaaagatgaatttttaattaaatttgcagaaccagcgaattcaaaaatgacaaggagaagagttttaaaggatttaaactccatttttgatccttgtggatggacatcaccatgtcttttaccggcaaaattatttttccagactttatgggactcggaaagaaaatgggatgacaatttgaacgaaaatgaatgtgaaaaatggattcagatcacacaaaactggaaaaaggctaatttcacacttaaaagaagaatcgaaatgggtaaaagtgaaaataatcaattacatgtttttgtagacgcatcgaaggatgcatatgcggcatgtgtttatttcagaaatgattgtgaaaaatgtgaaattaatttattatattcaaggagccgcttaaaaccaagaaaaatgaaagtttctataccaagaatggaacttttaggggttttgattggaacaagggctatgaaattcgtggagaacgaattgggaataaaaataaaaaacaaattcttatggtgtga

SEQ ID NO: 56924 - DNA, 691 bp, Heterodera glycines
  misc_feature (106)..(106): n is a, c, g, or t
  Genomic contig location: Contig_ID=SeqID_26176; Location=333..1023; Strand=-
  SCN-specific regions: Sequence locations=1-42,68-337,370-392,574 -575,614-691
atgaaagcgagttgtctgactggtgcgtgagttacattttttaagaaaattatgagaaaaatttttgacaaattttttactcggaaaagggatcacaattcctttncaattttttcgataaaatcctaatcaaaccaaatttccttgggtgtctttctttagctcttaatttttttagaaatccttcaaaatttcactcagaaatttggctgggcaaaagaaagttaaaactaaaaagttgtgaaatttgattgacttgagtttttgagttattttggtcattttttttttaaattttgcaggtttaagaacagattaaaaattaacaaaaagaccaaatgtttttgatttatttgtttaaaaaataattaaggggtgcacatgatgaaatggaagaaggaaaagaggaagagaaaaaggaagaaggagcagatgaagagaaaaaggaagaagtagaagaggaagagaaaaagggagaaggagaagaggaagagaaaaaggaagaaggagaacaaggaagagaaaaaggaagaagaagaagaggaagagaaaaaggaagaaggagaagaggaagagaaaaaggaagaaggacaagaggaagagaaaaagaaaagtggttgattagtgacaaagagtgaggattagtttttcaaaagacaattatagaattttgcaatagaaatttattaaa

SEQ ID NO: 56925 - DNA, 356 bp, Heterodera glycines
  Genomic contig location: Contig_ID=SeqID_26177; Location=477..832; Strand=-
  SCN-specific regions: Sequence locations=1-29,71-126,212-218,241 -245,276-356
ggaatcgaaggtgttgtaagcttttttcctttttttacttttaaatttatttaaattttcaatttttttagctttttttcgaaaaattttttgtctttttttcggcaggcactgcctctgacaatgttttttatttatttagaaaaataaatttattttttttctttttaatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttcattgctttcctttcgcttacgaccatacca

SEQ ID NO: 56926 - DNA, 644 bp, Heterodera glycines
  Genomic contig location: Contig_ID=SeqID_5107; Location=523..1166; Strand=+
  SCN-specific regions: Sequence locations=1-162,184-237,260-283,305 -401,439-623
atgtccgaattgaattgcgtggtccaatttgcattgggtgggtgagcagcagacgacctttttttggtgtcatagcaactcgtacaaaatgcaacagctcatacaatttcttaggctatgcctaggcttaggcctaagctataggctagtccttaactttggcctgctctggcctaggctaggctttattttcctaatacatatttcttgattttcgtacgagttgccattgactccttttttattaattaaatttattggtaattgtttagcggtggggtgaatcaaaatcttctcccaaaaatgcgagattcgaaaattttaattttgagtttttgctcaaatccgggttcgggattcgacgtggctcaaaattaatatcagattcgggttctccgctctttaatttttattcaaaaatttatttaactaattattcttcgaattcaaattttaggccattgtctccgcccgccgaccaaaacaacgaaaaaggcgccaatttgtgaacctatggcaattgatgagaaaagaagaaaggaacgaccatttgattacctctgctggacttgatttgatgctatttactctttgaatgtgcttactttttcttttgtttaatggattttcattcaaaaattgca

SEQ ID NO: 56927 - DNA, 367 bp, Heterodera glycines
  Genomic contig location: Contig_ID=SeqID_5107; Location=1880..2246; Strand=+
  SCN-specific regions: Sequence locations=1-367
atgaacaggcggtaaggcatttttttaaaagccacaaattcctcacttatttagcctaattgtttcccatttcagttggatttgcaacgacgtttggatggacattttcccatcctttgaccgtgctcaacttggcctcaaattggcacttctttcgccacgtttcgatgcgttggtggacaaacatttcaatggcaaaagcgaattggcaatttggagaccaatcgaaattcgtcgcaaggacaaaggaccagaaccgaacctatctgtgcggatggatgacaaatctttgcccgaccgtccgttgcccagcaaaatccgttttaagagccttcagattaagtaattaaaaatcagagctatgaca

SEQ ID NO: 56928 - DNA, 804 bp, Heterodera glycines
  Genomic contig location: Contig_ID=SeqID_26180; Location=86..889; Strand=+
  SCN-specific regions: Sequence locations=1-702,724-804
atggatttacagcaaggatttatgcaaattccggttgccgaggaagacattgaaaagacggcattcatttcacacttgggcatttttgaatttataacgatgccttttggtctaacagcggccccggacacgtttcagagagtcatgaactcgttgagacgacggttaacggcggcgatgttaatttatttggacgatataataattggcagcgaaaccgaagaaaatcatttaacggatattaagaattttcttttattactaaaaaaggttggacttaaattaaaattggaaaaatgccattggggaatgtccgagatacggtaccttggctttttgctaagtgaaaaaggtgttagaattgacccaaagcaggtcgaagcggtacaaaattttaaggcaccaaaaagcctaacagaattaaagtcattgttaggagcactaacatattttcggcgctttatacacaattttgcgcatattgctcgaccattacagacattgactcaagataaatttgaagggaaaattgaagaaaattggggcccagagcaagaacatgcatttcaaactctaaaacaaatgctcacgacagtaccagggttagagtcaccaagattcgcgagagcattcacaattgagtgtgatgcttcgaaaaaggctattggagcagttctccttcaggagaatggtccggttgcttacatttcaagagcattaaatcggcacgaaacaaattacccttcaattgaaagggaggctttggcattagtttatacagttaaggaattctcgccatatatc

SEQ ID NO: 56929 - DNA, 628 bp, Heterodera glycines
  Genomic contig location: Contig_ID=SeqID_26181; Location=302..929; Strand=-
  SCN-specific regions: Sequence locations=1-25,59-210,271-312,385-628
atgcagaaattagtgaaatagtaagtaaaaaatataataattaaaataatatttaattggtagagccaaaatgaattgttggcgtattacgagagggagcggttgctgggcgaaaacgatgcgccgttggctatggatggaattatagccgagttgcggggtgaaaatttggcagaaaatgatgacctaattgcggcgggggaggaggtgattataaaaaaataattttaaaataattgaaacgatttatttttaataaatttaaattatcaaattgcaatttttgttaattttaggccgctgggcaagatgggaggaggaggaagaagaacaggaggagggggaggaagaagaagaagaggaggaggagggggaggaggaagaagcaaacgagagtgtgatggggagcagtatatggtccgggtcaattgactcggccattactggcttctccacaatgtcggcaacgcagcgaaaaaaagtgttagggcgcagccgacagtggtggcaagagcgaaaagagcgcaaaaaagcggaaaaggggagatgcgcgaaaactgcaggagcgccggaaaatgataaattgaattttgattaaaattcatttttgtgttgttgttaaaataaa

SEQ ID NO: 56930 - DNA, 1139 bp, Heterodera glycines
  Genomic contig location: Contig_ID=SeqID_26183; Location=163..1301; Strand=-
  SCN-specific regions: Sequence locations=1-510,532-1139
cttaaaacaggcccagagcattatgataagctgcacgaaatgattgaacgaaaccccgaaaagtacggagtcgataagtcgtccggcgaaattctaacaaacttcaaaaagccggtgattaggtccaactacattgactcactgatgtacttgacaggacagagagcagatgtgccgaaaggtcatcgattttttgttcaaaaaattggcagcgacccgcaaatgatgaaattttttcattcccaacggggagagggtggtagtaagcggagcaagcgcaaaaaattcgttcttgttaaagcaagcgctataaaaacggtaggactcagccgaatggagcaaccaaataacacgcaacgtaaattctttaaaccgcttctatgggcaaagctgtagtacaaaaattactggaacaagtgtattacgatcttaggtcgccggcaagttacgcaggtattcaaaaagtattgaaggaagcgaagaagcgaaatccgagcattactcttcgtgatgttgaccattttttgcataaacagcgcacctacacgttgtttaaaccgcgcaaaaaccgcttccgcagactaaaaactgtgcccagtggactacacacggactggcaatgcgatttgtgtatcatggacgcgctaaaagagcataatgatggatttcgctacatcctagtgtgcatagatgttttaagtcggaagattttcactgcagaggtagagtccaaaaaaagtgagcacatgattgcggcatttgagaagattttcaataaggcaggtgtgctgcccaataagctgtacagcgacgctgggcttgagtttcaggcaaagaaaatgattgactactggaaacaaaaggagatcatcaagcacgtgatgtacagcccacatttgcatgctggagctgtggaacgcgcaaaccgtacgctgaaggagcgactttacaagtattttagcgaaaagaacacaaagcggtgggttgatgtgctggacagcattgtgcgtaacctgaacagctccgcgaaccgaacaaccggagtaaggccaatggacgtcaactttaaaaatgccgctggtctacggaatcgcctatataaacaaggcgagtcgagtcccaaaacgccaaaatttaag

SEQ ID NO: 56931 - DNA, 1183 bp, Heterodera glycines
  Genomic contig location: Contig_ID=SeqID_26184; Location=2..1184; Strand=-
  SCN-specific regions: Sequence locations=1-282,310-338,375-475,516 -545,578-742,764-808,833-1043,1065-1132,1175-1183
atgtctgggtttgacccttttaaaaggttaggaggacaatttattcagattagatgtttttgtcaatatagcagcctattttgaataaacttagtcacaggcatttcactcacagcctattttgaaattttttttaaatttcgaattattatattgtgggtccttttctgtgggccctatgtctttgtgggccctttgtccgcgggtcctttgtctgtggctcctttgagaggacatcgcatttacgtagacatagaaaacataaaaacgaatctccaacagattaataattttttattttatttttatgcttagcttattaaaggcctcaacagcagattattattctaaaaattaattgaaaaattaaataagaccttttttgaatgaaacacaaaaaaattctcccgaactgaaaaaggatcctttgaaatgactctctcagttaattctatttcgaaaataaaaattcgtcattaaataaataattgtttttaataatagtttttttaaaagttctatccaggtgtacatttttcttttccttttttatatttttaaaatatttgtaaaaatagttgcaaaacgccaaaattttggcttatttttagtgtcaaaaaagccaaaatgtgagtttaagacgaatagtgacattattaatagaagcaaagcagattttcagactaaaatgccaatataaaaggcactaacataaataaatttataaaatggtaggcttatatttcatttgaatattgaggaaatttgggtgagatttgcttcatatctttatgcagaatttttgtagaattaattataaataattaaataacattcatttcgcagaaaaaggtagtagcttccgaacaaacattattcttgcatattgttaatggccttttggaagagcttagacaaaatttgaaacaaattaaccaaaagttaaaatggccagcggaaatgaataaaaaagactccgataagcagaaaaaagatcgattatcaatgtccgaagagaagaaaaaagatttattgtcaatgttagaaaagaagaagaacaaggagagcccatgtgaagaaattctgccgctttctggcgccaaggaaaaagatacaaagaaaaagtgagtggtaatttatttttatatttctataaaaaaaatattttaaaaaacgcaataaa

SEQ ID NO: 56932 - DNA, 390 bp, Heterodera glycines
  Genomic contig location: Contig_ID=SeqID_26185; Location=621..1010; Strand=+
  SCN-specific regions: Sequence locations=1-86,108-112,229-307,330-390
atgaatttcaatcaattatttatatttactattttattaccattgctttttctcataaattctgctaattttattcacgcaagatcagcaaaaatacaatcaaaagcaggtgaaatatttatttataaacaatataataatttaattgaagatttttttctaatttaaatttagtaaaaaaaaaatttttttccttacattattagatttaataattttgaaaattaacacaattcaggcaaaattccgaagattttatgcgattcggttgatgagtgtccgtacggaatgcgctgtaaagccggcatgtgcatgaactagaaaaagaggcgtgtaaaaatcttttgaaataatagatttatgtgtgattatagtttttaaaatataata

SEQ ID NO: 56933 - DNA, 1577 bp, Heterodera glycines
  Genomic contig location: Contig_ID=SeqID_26187; Location=291..1867; Strand=-
  SCN-specific regions: Sequence locations=1-679,701-1124,1146 -1379,1424-1480,1502-1577
atggtcgacaaattccgtgagactgtccaatttgtggacgatggcgcgccttcattcttgcgattgggagccgcaaaaatggtgaagaaagagcagcaaagacattgccacgcctgtgccaagaaagtgccggacagcgaactgttcatttgcaaagactgcaataagccaaccaaaaaggtgggcggaggatcacaagaaggaagccaaatagttccaattatttcgacctcaaattcttaccaccactttcgaaaatgaatgattggttgcatttttactcatagaattaacaccacggaaattgaattatttaaatttaaaaacagtaaaaattggtgttttaaatggtaaaaactaacaataattcagcagttcatctgtgccctctgtgttgttcgttcgcataaacaggtcaaccattgtttgtttgacaatttcatttttaaaattccattttttccaaaattttccaatttttttagcacactgtggtgacattggactgtttggccagtgagcgcgaccgcgagttggccgcactgcgcattgaagagattctgaatcatgctcaacggatggtcgacgaatcgcgaggcatgcaaaacgacattgccaagcagtttgagacgatgcgcgaggtgaatcaattagggggcaaaaaacaggaaacatttatacacaataattcataatttaaaattgaatatccgtgtggaatgtatggtttaggaaataatatcgtctgaaaacagtccatttttgcagaatctgttggccaaactgagctttttctacgccttgcaaaacgagtgcctgaacggtgaacaaattttgctgaaagagcacattgaagagaaagtatactcggccattcaaaaatgcgaacagcttaatgaggtccattaaattcagtaaacacttcgccaaaaatgactcctccttccatttcttagcattttttgcgactgcgcgagctcaaatcggagtttgaacagcatctcaaacgttggcacagcggtcgcggaagacgcttcatcgtcgatggtgtcgtcgtgcacagctttgttgcagccgatggcacatcaaacgcatcgctttcatggtcattttggcggttcatcatcatccggcatgcccggacagataacagcgcctaattcgtcgacgagaaagtgaggccgtattgggttagcaaatgcctgtttgattttccatgtaaaataacatccctggttgccagcaggtgtcatttcgcgttcctcagcagtcccactgatgctgttgttgctggtgacagagctggcaattcttctgccgaactgatggctgtcgcggacaaatggccgtcggaaacaccggcggaagcagcagcagcaagagggcaccgcccattttggtccgtcgtcgttcgcgtctccgtgtctttgtctttggcgctggtggcccctctgctggcatcagtgcgtcctcaattctttccgccgggcgcactccctccgcgggtgacgaccgcatgtactacggaggtgagccgaagcggcagcccgacttgttcagcttcttcgaccaataaa

SEQ ID NO: 56934 - DNA, 291 bp, Heterodera glycines
  Genomic contig location: Contig_ID=SeqID_26189; Location=204..494; Strand=+
  SCN-specific regions: Sequence locations=1-94,129-147,272-291
atggtcgcccgtcgtgccgaaactgtcgcaatcgtacggcgactgctcttccaattggccaagcaggcgaaccggcgacgcgtgcagcagcgcagacgactgaagcaacagcagcagccagaagatgatgacgaccaacaacagcaggatgatggcgttgctggaggcggagatgatgaacgtgttgaggaggaagaggagggggacaacgacggcggtgatcagcaggaggaggacaatgatgacgattttattgatgatgacgctgttgtttgttttcaatccgactaa

SEQ ID NO: 56935 - DNA, 1001 bp, Heterodera glycines
  Genomic contig location: Contig_ID=SeqID_5108; Location=374..1374; Strand=-
  SCN-specific regions: Sequence locations=1-333,355-444,476-632,654 -718,746-1001
atggctccatataggatagtcgcttatgatttggaatgcacggtaattgttttttagttgtaaaaataataccttatgatttagacgaatacgattctggatgaaaattcattgaaaaaggagactattcataaacccaattttattagtgcacgatttacctgttcattatgtttgggagaaattaaggagtgcgaaatttgcggtgacggcccccggcatttaaaatggtgtagtatggatagaattgacccgttaaattgttttgttaaatggattataaattttcaaaaatatgatacatatgcatatgcacattttggtggtaaggaataaaataaatttacaaggtgttaaatttttctttaggacgatatgactcacactttattttgagggaacttgcgaatttaggatataagcagccagaattgacaattgcggatttaaaaatttatgaaattaaatttaaaaagggcgaaaaatccccgaaatttttcttccgggacagttggcttttaatgcagaataaattagctcatttaccaaaaacatttggattggattgtgaatcgaaattatatttcccacaccaatttaacaaagaagaaaattacggtaaaaagatttccattaaaaaaaaaattaaaattccaattttaggcaaaatcttggctactctcccaccctttgatgattatttccctgatgaattaagtgaagaagaatatgaaaaatttaaaaaatggtactatgcaaattacaataatggatttattttaggtaagataaaaatattttaattgtgacaaaattgattttagaggaaaaattggatgaatattgttcaaatgacacggacattttaatgaaagcgcttataaaattgagaaaaatttttatagatataacaaaagataaagagacaccaaaagggattgatgttatgagattatccacaacaattgcatcttcatgcatgaattagggaccaaaataaa

SEQ ID NO: 56936 - DNA, 1125 bp, Heterodera glycines
  Genomic contig location: Contig_ID=SeqID_5108; Location=1425..2549; Strand=-
  SCN-specific regions: Sequence locations=1-125,150-421,446-478,500 -831,853-1045,1079-1125
atgaacaatgccgacactgttttgcacgaaatatttaggattaaccaatcgtatagtgagttcgacctacagcatgagcccatttcctgtataataactacatatagtacaccccgaggggcaggtaaaaaaaataattaattaaatttgacataatattttaggatttaacccattggatttttgtgaaattaaagaattagggagaattagcgtcaaaaattcggacaattattgtaagtgaaatggaaaataaatatattaatgtatcttttaggtttattttacgccttaactttaagcagattttatcaattaattaataaaaatgatgaggaggccatttcaagggaccaattcaaaaaaataatagcgaatgaacagagacaatgggaggcagttaaacaattaatgacggatgcaaaaataaatatgaaagaaaaatcatacggattagaacacttacaaattattcaggatttttgggtaaaaataaaaattcaggattaatgagaaattaatttatttaggactcgaaatttccgggaaattttcgtattgttgctttttctagggatgttgggcttcgtccaatttttaaggggaatggcccccgaaaatataatgtgtgtatttttcatgacaaaaatcattgggatggtgggtttgtatagttttttcgtaataaaaaatgttttaaggaataaaaagtataggacaattttttaacattaaacataaatattgtattagttgtgaaactacttatcaaattgaggaaaaacatagtttggagtgtgaagagaggtgtaaaaaatgctgtcgaataggtaacaataaaaaagaaatcttttaatggaaaatttaaggctttggtttcccttgccccccggaaagaaaaacatttaactgtgagaagtgtaacagggctttttttaatgagaattgctttgagcatcacaaaaataaaatatgttctttatatcaaaaatgtaaaaaatgcaaaggagaatttaggacggacacagaacataattgcggtaagttttaaaaatgaatatttataataaataaaaaactttttcgtatttttagatcagaaacattgtagaaaatgtcatttaa

SEQ ID NO: 56937 - DNA, 1002 bp, Heterodera glycines
  Genomic contig location: Contig_ID=SeqID_5109; Location=8..1009; Strand=-
  SCN-specific regions: Sequence locations=1-396,418-710,743-779,817 -973,995-1002
atgaccgcctataggatagtggcttacgacttggaatgcacggtaatttgtttttaggtctaaaaataatatatttggtttagacgaatacgattttggatgaaaaatcattaagaaaagagactattcataaaccaaattttattagtgcccgatttacttgttcaatatgtttgggagaaattaaggattgtgaaatttgtgggacgggaccacggcatttaaaatggtgtagtagggatggagtggatcctttaaactgttttgtaaaatggattacaactttggaaaaacacgaaacatatgcatatgcacactttagcggtaagatttgaaaaaacaatgaaaaaaatctaagaattttttagggcggtacgactcgcactttgttttgagggaacttgcaaatttgggatataaacaaccagaattgacattagcagatttaaaaatttatgaattaaaatttagaaagggagagaaatttccgaaaattcattttcgggacagttggctacttatgcaaaacaaactggcacatttaccaaaaacatttgggttggactgcgattctaaattatattttccccatcaatttaacaaagaagaaaattacggtaaaataagatacaaaaaacaaaaaaatgttattttttaggcaaaattttgactacactcccgccttttgaggactatttccccgatgaaatgagtgaagaagagtatgaaaaatttaaaaaatggtattattcgaattataacaatggattcttattaggtaattaataaaaattaatgtgtttaaaataaaatttagaagaaaaactggatgaatattgctcaaacgatacggatattttaatgaacgctctattaaaactgagaaaaatatttattgaaataacaaaagatgaggaaacaccaaatgggatagatgtaatgagattatcgacaacgattgcatcttcgtgcatgaagtaagttttaaaaaatgaaaataaa

SEQ ID NO: 56938 - DNA, 689 bp, Heterodera glycines
  Genomic contig location: Contig_ID=SeqID_5109; Location=1496..2184; Strand=-
  SCN-specific regions: Sequence locations=1-125,150-249,271-478,500 -547,569-689
atgaacaatgccgacactgttttgcacgaaatatttaggattaaccaatcgtatagtgagttcgacctacagcatgagcccatttcctgtataataactacatatagtacaccccgaggggcaggtaaaaaaaataattaattaaatttgacataatattttaggatttaacccattggatttttgtgaaattaaagaattagggagaattagcgtcaaaaattcggacaattattgtaagtgaaatggaaaataaatatattaatatatcttttaggtttattttacgccttaactttaagcagattttatcaattaattaataaaaatgatgaggaggccatttcaagggaccaattcaaaaaaataatagcgaatgaacagagacaatgggaggcagttaaacaattaattaatgaaaccaaaatcaatatgcgcgcaaaaaattatggattagaacacttacaaattattcaggatttttgggtaaaaataaaaattcaggattgatgagaaattaatttatttaggactcgaaatttccggggaattttcgtattgttgctttttctagggatgttgggcttcgtccgatttttaaggggaatggcccccgaaaatataatgtgtgtatttttcatgacaaaaatcattgggatggtgggtttgtatagttttttcgtaataaa

SEQ ID NO: 56939 - DNA, 634 bp, Heterodera glycines
  Genomic contig location: Contig_ID=SeqID_26191; Location=264..897; Strand=-
  SCN-specific regions: Sequence locations=1-79,106-353,375-533,555-634
tatggcacggaaagacttccgatttccaacatttttggggtcggaattccgacttccgaaatttttgatgaaaagtcggaaattttttaattttttttttaaaaactagtaagttttctacaatttcagtagttaacagcccgtgaccttcgccaccttcgccagctgacactaattagaagtgacaggtggtggaaagggggtgccaattagtcactaattgactgaccggggtgcgctaattggtatggtcagcagtgagaggggtgacaattaattagttaattggggggggggggaaccaaaccaaaacctattgaacggtttcaaattgtcttgtacttttttgacagaaaatttgcttgatttaaaaagtgacagacgaggggaggggggaaattttttgattggaaatttttgattggtcaccagtgacagatggggaaaattatgatttgtcataaagtgacagatgaggggaaattcaaattttgggagggggttcgggaattcaaagtgacatttgcggggaaaatttaaattttgctgtgagttgtattttgatagatcaccaaactgacagctgagggaaaattcattttttttagttgtagtaccactaatgacctattag

SEQ ID NO: 56940 - DNA, 1112 bp, Heterodera glycines
  Genomic contig location: Contig_ID=SeqID_26192; Location=189..1300; Strand=-
  SCN-specific regions: Sequence locations=1-222,325-461,483-824,847 -943,965-1112
atggacgactcaattctcgcaagcattaatgacgacgagaacaaccagcaacaaatgatgccgccaccacaaccactgtcatccgccgccaatgccttttccaaccacggcagtgcgtcatcatcgtcatcttcggcacatgttgacaatttgctgctgcacagcaccaacatgatgccatcgacagcatcggcaacagacaatttgtttgtggttgcggaccaacaacaacaacaacaacaacaacaacaacagcagactgaaaatgacaacaataacaacagcaacggcatcatccaatcaaagcaacaacaacaacaacaagctgaacaaactgaacgacggagtccggaagaagtggtggacgagctgatcaggatagccgaggctaggttcggtgtgaaaatttttgagacaatttttaaaaattacgcaaagttttggcgttcattggaaatcccggcaaatttgaaaaatgtggagtgtgcgtcctgaggccgaagaagcggccgaattaaaccttaaatataaaaaaggcgcgtaggaagccgcgcatgcactagcaacgaagtcctttgcgcgaagcgctcatgtcagcgcccgcccatatataccaaaagtatactgtctacaccgagcaattactatgcaaagcatactgtctacaccgagcaactactgcgccccacgctagtttatactactatagagaaacgttgcagttcgtcttaaaaaacaaaatctcccggccgaaggccgggagcgccctgaaagtagtggatgggtcttacaactttttgaggcgcatctgggaaaaataagggttttccgctccggtggccaactgagtcccggcggctgatttctcacttttgcttgcgtttgatggcccataactttttttctaaaactctgatcaaaaaatgcttgctggtaggaaactaagttgaagtgttttctaattttcaaaaaaaattccaggcctctacctatacttggaagggctgcagaaattggcaacttttcagtaccaactttgcccagttcagtccccgttgaataactcattaggctttgacctgagcgcggggtggccggcggacttattgtag

SEQ ID NO: 56941 - DNA, 480 bp, Heterodera glycines
  Genomic contig location: Contig_ID=SeqID_26193; Location=499..978; Strand=-
  SCN-specific regions: Sequence locations=1-28,444-480
  Gene Ontology: Mol. function=ATP binding; Cellular component=synaptic junction; Biological process=synaptic vesicle targeting
gggctcatccatacccaactcatccatgacccaactcatccatacccaactcatccatacccaactcatccatacccaactcatccatacccaactcatccaaacccaactcatccaaacccaactcatccatacccaactcatccatacccaactcatccatacccaactcatccatacccaactcatccatacccaactcatccatacccaactcatccatacccaactcatccatacccaactcatccatacccaactcatccatacccaactcatccaaacccaactcatccaaacccaactcatccatacccaactcatccaaacccaactcatccatacccaactcatccatacccaactcatccatacccaactcatccatacccaactcatccatacccaactcatccaaacccaactcatccaaacccaactcatccatacccaactcatccatacccaactcatccatag

SEQ ID NO: 56942 - DNA, 569 bp, Heterodera glycines
  Genomic contig location: Contig_ID=SeqID_26197; Location=270..838; Strand=+
  SCN-specific regions: Sequence locations=1-74,96-289,312-373,402-569
atgcggcggcccgtcaaagcgaacaacaacaacagccgaatggcggtaagttttgcattttcgtgtggtatgagtttggtttcaatttggggcccattctcaaataatgactttcatttgctatgagggtgtaggcaatgtggggaacggcggatatgcaatgaatatttatgctccaatgttcgccgcttgcccaatcgattccctcgctctcccccccccccccccccacttgtctctgtatgggtaagaggcaaacgctgcggcatttgtaaataccgtcactatcgattttttacacttaaatttaagacattccttttcaaaaaaagagggaaaaaacggattaggtaggtagatatatgggccactaaatttaattttaaaaaccattaaactgtatactaattttaattttttcgttgttcagcaggctctgttccggctccgcaacaacaacagaatcaggaaaatggcatggagagggccaacgttgaccaggcgctgaacgacgaggctttgggggcacaaaatggtgagtgattttccttttatgactagaaagagca

SEQ ID NO: 56943 - DNA, 693 bp, Heterodera glycines
  Genomic contig location: Contig_ID=SeqID_26198; Location=205..897; Strand=-
  SCN-specific regions: Sequence locations=1-33,55-140,164-318,340 -403,425-663,685-693
atggccgaaatatgggataaaaaggccaaaatggcgaaatatggatttattcccgaaaaccaccaaaatatggatttatatggactaaaaaccttcaccaaatcaaaaaattttaggtaatactgtgttttgtccccccctttaatttttgaaaaaatttccatataatttataaccatagtaatattcatcttaaaattggtttaaaaatctgaaataattcatgcttgcttaacttttgaggctgaacaacaaagtacttcacacctacttgatcagatcactccttcatggtgatctgtctgaacaccataaaatacactgaaaactggagtaatttttgaaaaaaattcctaggatatgacttgtacataaaaagttatacttcattgaatttttgatgattataaaaaatcattattttaccgaatttcaagggaaaatggtcaaaaaatcgatgacaactgtccgaccttgaccaactgcaaatccccaaagaaatcgactcagacaactgcattcacgagtacgctgtgtatcaataaatagagagtgccagagaaaaacaatatcttttttttctctaattttgtgtctccttttggcgtactatctaatatttctattattagcagggctgcaaaaaatatgcacgaaaaataaccaaaatatgcacataaatatgcaaataaa

SEQ ID NO: 56944 - DNA, 154 bp, Heterodera glycines
  Genomic contig location: Contig_ID=SeqID_26199; Location=64..217; Strand=+
  SCN-specific regions: Sequence locations=1-154
taggctaatagagcctgtgaagagctttcgaatgatatcaagattgtttgattcggtcaataacttcaagagttatattgactcaaagttggctcagacggagttggccagacggagttggcccgttccgcccacactatgggtcaaacccagt

SEQ ID NO: 56945 - DNA, 137 bp, Heterodera glycines
  Genomic contig location: Contig_ID=SeqID_26199; Location=426..562; Strand=+
  SCN-specific regions: Sequence locations=1-7,29-137
aatgaataaaaataaatcaaatgttaaaaattcacaggtgattaaaatatagtgtatatgtggcacagaaaatttcctactcagaactcattgcttttagtaaacccctgaattcctttgccttattaatttgcacc

SEQ ID NO: 56946 - DNA, 230 bp, Heterodera glycines
  misc_feature (205)..(205): n is a, c, g, or t
  misc_feature (227)..(227): n is a, c, g, or t
  Genomic contig location: Contig_ID=SeqID_5110; Location=782..1011; Strand=+
  SCN-specific regions: Sequence locations=1-230
atggcttataacgcatcgactgacgtggtagacagacattaaattttatttcaaaatctcccttttatttggccattgaatatttttgattaattgtttttcagtggttccaatatttcaattcaaatgggccccaatgggtgattcttctggcagcgtatggctttcgagctttgtgggcaacccttggcattatggatcattntggcattgtgtacatcaccccntaa

SEQ ID NO: 56947 - DNA, 777 bp, Heterodera glycines
  Genomic contig location: Contig_ID=SeqID_5111; Location=492..1268; Strand=-
  SCN-specific regions: Sequence locations=1-234,256-531,582-753
atgacatcacataactctcgcaatattagcgttagtgaatttgccaaacatttgagtgccaccgtaggacgcagtaccgtatttattgttgttgttttgccacggtcggctcactacggtacattgaggttgcactgctgagactgatgtgaccgcagaacccagccctttcactttgataagccatgggaaattttgttggaagcgattacggtactcattactgtgaggaaggaaaataaaaatcaatcagaagggcataaaacaattacataaaatttggaatatagtaaaaaataaaaatgcttccgtatcacctgataatgtacagtactggtgcatttgcgctgtatacggtaattgtgaagaaagaaaaagcgatggaaacggacgttttgacaaaaacatttacaacgacaaagctttggaagagcatgttgacgctgcttttgaggaacacgccgaacagattgagcgcaatgataaagatcagagacttggtcaatttgcgattgttggcattcatatcggaaattattgatttttaattttaaaaataattatttttaattcaaatttttgaaaaacacttttcgatgtcgcgttgaatttgaacaccgtaaaccagcacagggaatacagtaccatcagtgtgccgctcaatgacagcccattgattttcatcagagtgcccattccgccgtagcccatttcatttgtggtgcaggagaataagcgaaaatgggaaaatcgataatttaaaaatgaaaaattaaa

SEQ ID NO: 56948 - DNA, 1006 bp, Heterodera glycines
  Genomic contig location: Contig_ID=SeqID_5112; Location=368..1373; Strand=-
  SCN-specific regions: Sequence locations=1-101,134-188,210-242,264 -372,394-691,725-737,760-778,800-972,1002-1006
atggtcattttcgaggtatgtatttttgatggctgatttaaagaaaatgaaaagagatacagaggcagagaaaacgttagtaaatagagcaaagttaggactataaaaaattataagaaaaaaaattttattacttcaaaaatgaattattggagggccgagtctaaaaatggtctccaaaaacggcatttttcaagaccatcaaataacaaaatgttttaagtggttttggaaattccgaatttaattaaactaaataaattgaccacgctgagtccgaatggagttggagcagtacaagttcagggttaaaagataggtcagatttaaggccatattcggattctactggtctaatttgtacagaaaaccttcttttttgttatatcaggttacttttttgaccataaaaaatcgagaaaaattagtgggccaattttcaatttttgcatggtcgggaaaaaatactaaaaaattgaataagcaaataaaaaatgaaacaatggcatgaaatgaaagaagactttctgacgaacaaaataaaaaaagaattattaaaataactgcagaaattacggagttatgaatttttgaatttgtcaaaaaaaaattgtgcggaaacttatgttacaccctaagtaatagcctaaaatatttttgtgagcatttttggaatttatttgattttgggaaaatttaaaaaataataatgaatattttttaaggttattttgtgttaatgaatatttttcaattttagataaatgccctcttaattaaacaatttatatttgaaaactgtcttacgcctcaccccttaagttcgcctatgaccaaatggttcgcgactgtccgaaaacgtgcaatgtttgcccgggagtttgtgaagatttgggcaccgaatgtccagaccgacaaagggcgggttattgtgggagagcggtgagaaaaaaaagaaaatcaaattaagactaattaacaaaatatttaatttctttaaaataaa

SEQ ID NO: 56949 - DNA, 576 bp, Heterodera glycines
  Genomic contig location: Contig_ID=SeqID_5112; Location=1594..2169; Strand=-
  SCN-specific regions: Sequence locations=1-179,215-323,362-381,411-576
atggtggattggggtcgggaaaagccgaaaatgtcgggtaacggggaaataaataacgatgtagtaaaaggtgaatataaaacaaactgagacgcaataatttaagataattagacgaattacatattaattggtcaattagaaaaagtgaattgaaaaaataaaaaatcaataaagggatattttaaataattatcacatattttaatttaaacagtgttttttttgtcgacagatgccgaaatggaatttgtccgtccgatccatcgcaaatttgccgaacaatgagtgacggaaacgaatattgttgtcagttagttttgtttgataaaagagaattaaaatttaaaaatttaggcccactaccggcgggaccatcaccagcagggggaggaggaggaggaagtgccaatgattcgagtattgtttaaatgcattttgaaaacaaagacaaagaaagggccatataattttctctaaaaatttgaggttgcgcggacgtggccagagactgtgcacaacgtgctgacttatgcataattgaggtgtaattgacagtttgcataattaaataaa

SEQ ID NO: 56950 - DNA, 315 bp, Heterodera glycines
  Genomic contig location: Contig_ID=SeqID_26200; Location=93..407; Strand=+
  SCN-specific regions: Sequence locations=1-315
  Gene Ontology: Mol. function=GMP reductase activity
ttcaaagccttctacggaatgtcttcggccactgcgatgctcaaacaccacggcactgtggcggagtaccgagccagcgaaggcaaaacggtcgaaatcccttaccggtggactgttttaatttcaaatgaacactaatgttaaataacaatttgaagaggtgatgttcgagagacggtgaagtcccttttgggcggagttcgctccgcgtgcacttacatcggcgctcaaaaactgaaggaaatgcctaaaagggccactttcattcgtgtccaaatgcaggccaacgaagtgtacagcgccttcgacgcataa

SEQ ID NO: 56951 - DNA, 484 bp, Heterodera glycines
  Genomic contig location: Contig_ID=SeqID_26206; Location=1260..1743; Strand=+
  SCN-specific regions: Sequence locations=1-96,120-131,168-484
atgttgttcttgcaaattgcctttttgcttttgcttgcttcaattcaattggcaattggatcaccaattctaaaaagaagaggtgagaatttactgaaaatttttaaatttaattttttgtctcctttttgattaaaatttttaaaaacttttattgttatattaaagaacggttgttcttcataagaatattttatattcatctggattctaatgaaaaattttcagaaaaaaaacttcaaaaaaaaatcaatttttatccattattaattattttaccattaaaatttgtgccatttgagacgaaaaggatgccgcgcaatcgtcgcatacaatattgtagtgtcaaacattgataatgattctcaaattttgtcgcaacaaagcttggatgcccaacattgggccttgaccaacggacttgtcaaattacaatgttactccattaaggacaaaccctggccataatcaaattaattataca

SEQ ID NO: 56952 - DNA, 1246 bp, Heterodera glycines
  Genomic contig location: Contig_ID=SeqID_26209; Location=890..2135; Strand=-
  SCN-specific regions: Sequence locations=1-80,102-148,170-862,884-1246
atgacggctgatggtcaacaaatccataaagtcaacttcctgtccgcacgtgtgacctgctccgattgtgctgattctgttcaatgtgcaattgagcaatgtgaaatatgtatgaatgaggatggattaatggaacggagcaaatattgggcagctttctttttgttgcgatttattttatcctggacactgcttgtaaaggagcgaagctgaaggcgatgatccggttgccaactttgtagaatggataatgagggcgtggagtgaagaatttaacacatatatttgggtaataatagagcaacaggcaccaatgtatttccatttaaggcacacaacgcgtccagatttgatggccatttcgttcttcgttatctcggagagaccagaaggagaccagatgttgtaatgaatgggctaaaaatttttgaatttcgcctccaacattcgcgtgggaattcgcttcttatttggcgtgactcatgcctgctcctaccaatacggctggatggactgaaaggcacatttggccttgactgcccggacaaacccttctttccttatggcttcaatcggaggtcgggctttggttctaccaattgtagtcaatcagctatatttttaagagaaaattataccattcgattgccgcagcttcctccaagagacgattattttcctggatgcacgacacggagggagctgaattactttatacggtttttgtttaactgataaatcatcagcataacttaaatcatgtttaggacacagacagcgtaattgttaagcatcgtcgaggagttgagccactgcagactggcgaattccttggacaaatgtcggaggaatacaccggttattccatcaaaagttttgtctgtggaggtgagtgacttcgttgctatgctatcttttttaaactgaagctttactacaaggcgcaaagcaatacgcattaaaaatggttgatgagcgaactggcgaaattagatatgtgcaaaaaatacgcggcataacatttgatgtgcagaacagtcaagcactacaattcgaacattttcgtcataaagttttgaactatggtcgacaaggagaaatgccagccgtgttcagctatgacaaaattcaaccaacccgagcgagtcagattgtaacgcgtgagcagctcaagcgataccttccggtatgccaaaaaggaataatcaccgatgagcttgatgttcttccttttggttatcaatga

SEQ ID NO: 56953 - DNA, 396 bp, Heterodera glycines
  Genomic contig location: Contig_ID=SeqID_586; Location=2..397; Strand=-
  SCN-specific regions: Sequence locations=1-110,144-160,182-223,245-396
atgaaaattgatttgtttcttattatattaacattaatttattcacaaagaaacattgaatctgtaaaaaaaatccgagaaaattttgacgaaatatttggcaaaggatgggaagaaaaagcagaagaagaagaacaacaaagggacaattcagcaaataatttacaaaatggaggagaaaatggcgccgatttaaatgatcaaaaaaagaaatggacgttaaaaaatgatcagcagaaaagggaaattatccgaaaatttgacgcaattaatgaaagaatgaaaagtaaagaaaaataccaaataaaaaaccgtgtaaaaattgagaataaaattggaagaattttaggaacaaatcgaaaattaatttacaaatggaaaaacgaatgggattaa

SEQ ID NO: 56954 - DNA, 3829 bp, Heterodera glycines
  Genomic contig location: Contig_ID=SeqID_586; Location=610..4438; Strand=-
  SCN-specific regions: Sequence locations=1-931,969-1682,1740 -1764,1787-1926,1948-2038,2071-2395,2432-2568,2590-2763,2801 -3027,3081-3129,3151-3512,3534-3759,3794-3829
atggcgaaaagattgacaatgcaaagtaaatttcgatttttatataaatgccgaaaaagttggcaccataaatttggcactaaaaccatgccaaaaattaatacaaagaattgaaaaaaaaattaagtaaatcggaaattttgatattcaatttttttaattgatttatagctttaagaaatagtgcatatttgcatccttaaaagcggggcacccgaattttaacgtatcgctaacttctcttcttatttcaattgatcgtttaagcaaatctttggaattggtacttgagttgttgaaaacggaatgccaattagccaaaattgctagcaaaaattcatcctcaagttacccgaccaatggttatttggcaaaattttgtgacaaaaagacaggtcaaaatttggacacaattgaaaaactaacggaacatttaacggatttcattgaaaaagatttgccaaaaattgtggaagcaatgaaaaaaacagaaacgacggaaataatttttaccggtagagtacacggtacaatggctgagattttaccacgagcaaaacagtacccgaatgatgcatctctgcttctatatgcgcaagcgatgaaagcattgagccgaattagccaagaaattgagcctggaacaaccaaagatgcactgacgaaaacgttgaaaaagcatacggtagcttcggacgatggcgatacagtaaccttaatgccaagtgaattgacacaaatcatcatggagctttggacaaatacaattttgaaaggaattgctaatgccggccaagaaaaatacaattatctgcaggtaaattaaaagattttgggtggtaatttcatgaaaattactttgatttgaaatttataaatgtacctaataatttatcataaaatttacgcccgaataacccaaatgatactcatataaattgatttattttttcataatattatttatacatacaattaaggaactaaattgcacataattaagaatagtgaaaataccattaaacctttatttgtcagccccaactcaatggcaccggcgccgaccgttcacaagaccgtcgtcatagacgcgcacctccagtatttcatattcattccaacataattatgatgattttgctgattgtgcaaatgtctttaatcgccgtagttggcatcgatgcctctcgaagcgatgcaaattgggtcacagtgtttaccgctttttttaccatgtttttcatttggcgtgttcaaattccgggccaaccgccaccgccaagtatacatttttcactgaatttcaatttaattttgcccgtggttcaaacgtggattggtgttggcatgccatttggcggagcagcacagcgaccacctgcggcaggggatgattaccgggcacaacatttgcttgcgatgctgcaaatgttcaacgcaatgaatggtcgtgccaacacagcggcgccgtcggcaggttgggaaaagcacgaaaaatcaaatgaatagcaaatgtcgatgaaatatgaataaaatggcaatgggatattttatcatggattatttgtcagtgatactgtatttaaggaaagatactgtgatttaaatattaggtggatcaatcagaagatttatagcgtgttctgcgtaaagcctacaattacagtatcaactaattcgtcatttttttaaattttcattttttaaaatgacagaacaataaattaataaattttttagactggaatagggataggagcgcggatatcacaacaacagcaacaactccggcaacaccgacggggaacaatggaaatgatgaccgtaaacaagttgaacactatgaccctgtttcggacacatttgttggtgcggaagagacatttgtgaccactacgacagaaagtccgatcaattgggaaggagaagggacagaagacagtaatggcgacactgatgactcattactaagagagtacggtaggccaaattgagcaaacaaaacggaagccgaagatggcagaatatgagaggaacgaatgaaaagagaagaagaaagaggagcaaatttttatggcatataaccctcatttgttgccaaaagaatgtcggacaaatttacatttccatggcattaaaagttgaccaaaaaccatttatttcccattttaaatgatttttgcttttaactgattgactttttccattgtttgcctattaaccactaaaattcatggaattttatataagtttttgttgaatggaaaatcattaaaaattagtaaagagtagagattctgagctaaagacggaaaaatcaaatttcctttggaaattgataaatgtttttgcgggacctgctaatctaagctcacatgggggataaggagatttcaaaaaatttaaatttaaaaaaattattataaaaaaactattaacaaattcaaactttacaaaaaaagcgtttgatcatttttaaaattaagaatatttgtaaaaaatttgattccaaggaccataaaaaattgtaaaaatttccaattgttttattgatattgaataaagaggaaaacttcatttattcattcatgtaaataacttcatccaattattttacaaaaaaacaacagcaaccttaacctttgattaatttttcatttaaattaagctacctttgtcatttccgcaggttttcagaaatcaattaatgcaattaattatcctgaaaatttttaagttgacaagaccaaacttttttatgtctttaatttttaaactttttcaatttttttttaaatttccagtctctattcatctcaatattagggacccggttttgaggcatatgccttttttcttcaaatttcctatgacttaatttatattcacgtaccgaaaaacctaaatttttttatatttaaagataaaacgtgtttccatgagtattcggggttgctgatcacgaatatgacatccatttcgaccaatttcgaaacccggatccaaattcgaactaatttgtaagagtaaaaaatttaaattttcaaatttcacatttttaatataaaaatagtttaaatgatcttttattgaaccaatgatcattttcaacttcgtttccgagtattcaaacaaaatttgaaacaaaaatgttgaattcaaaaatttaaattttcgactttttgttcgagttctagtccggtgttccaaattggtcgaaatggatgctggattcgtgatcagcgactccgaaaagcattggaaacaatttccatggcttttgaaaattaaaaaaaaaatcctatgggctgtgaacagtacaagtacccgtttttgaagtgggaaaagaatttgcgtaaatgaaatggcagaccaaacgtggcactaaacgttttaataattgtggagcaaatggggagagaaaggatgaaaatatggggaggcccactgtcgactaaacaaaatgataatgagggatgagggagaggggaaaattggcaatcaatcaaagccaaatccaactcacttttattgggaggacccatcaaattaactgattatttcctgatgttggccctctttttaagctttgcccaaaaagtcgaaaaagtgaaacgcgtacactaattaagttttaattatggtgtaaaatagcgtaagaattcacttcgtgctcatattccaaatttaacccaatcactggagtaattttagccaacaagggtaggacaaagccaaaatctattaagcctaaatgggaaaaaattttcaaaaattattttttttattatttcctctacaattaaaatataaattttgatgaaataaa

SEQ ID NO: 56955 - DNA, 1102 bp, Heterodera glycines
  Genomic contig location: Contig_ID=SeqID_587; Location=494..1595; Strand=-
  SCN-specific regions: Sequence locations=1-78,139-297,496-511,541 -700,722-779,848-1102
  Gene Ontology: Mol. function=JUN kinase activity; Cellular component =nucleus; Biological process=JNK cascade
atgaaaagcctacggaatgccgcatatggagagaaaacaatgttggccagaagtgaacagggcagcgtgtggaaatcgtaaaattcaaataattgatttaaattaattcaaaaaaaaataattttaaatgaattataagaattgccacggaggaggatggcacaacaaggaatgtgacaataaaattgcttcgtgcgccgtttcattcacccggcacagccaaatacacattgcgcgaagtggcactgctctccacactgaatcatccgaatgtaatttatgaaagtattgaatgtctaaaatattgtaataaataaacaaatttataattatcaaaaataatttaaattttaaatgaaaattaaagtaatataaatattcttctgattaaaatagaaaataattattgcattattactccttaagaattttcagtttttttattaataaattatcatatttgaaaataaattatgcattttattaaaataatttctctcaaaggattgtgtttattaaattgtttttttaatttaatttcagttaattgctctttacgatgtccgtttgccacccaaattaaagccgttgaaaaaatttgatgatttacacttggtgacggaatattttggcaaaaatttgcgcgaaagaattgtggaaaagttgaaaaatggcacgctgtggacgcaccaagaattgtcctactgtatcattcaaattttgtgcggtgtcaattttttacacaattctggcattgtgcatcgggtaatttacttaacaattaaattattaactataaaaggttaacttatttttatatcaatttatttttttaatctaaaatttaggatttaaaaccgactaatgttgtaatgaatgagcgtggtaatgtgaaaattttggactacggtattgccagagatattgtgccagaaaatctgacaaccgaagcgggaacaccaatttaccgagcaccagaaatctacttgggcattgatagttacgacaaaaaaggtaattaatgtcccaatattatttttttgcattttattgattgctaattaatttacatttttttttattaagcagaatgcagattaaa

SEQ ID NO: 56956 - DNA, 521 bp, Heterodera glycines
  Genomic contig location: Contig_ID=SeqID_588; Location=363..883; Strand=-
  SCN-specific regions: Sequence locations=1-25,48-54,77-110,136 -157,238-327,388-521
atggtgaaaagtgttgtgagtttgttaaaaagttacaaaatttcatcgccgtcaaccacttcaaacacaactccatcaacaaattcatctgacgacagttgtgacaatgaacgacaacagcaacaacaacaatcggatgacataaagcgaggttagcataaatttaatatttaaaatccaattaaataattcattaaattaaattttaaaattatttttaaaaatataaattttttagtgaatggcgatatgaaaagcctacggaatgccgcatatggagagaaaacaatgttggccagaagtgaacagggcagcgtgtggaaatcgtaaaattcaaataattgatttaaattaattcaaaaaaaaataattttaaatgaattataagaattgccacggaggaggatggcacaacaaggaatgtgacaataaaattgcttcgtgcaccgtttcattcacccggcacagccaaatacacattgcgcgaagtggcactgctctccacactgaatcatccgaat

SEQ ID NO: 56957 - DNA, 2243 bp, Heterodera glycines
  Genomic contig location: Contig_ID=SeqID_589; Location=2818..5060; Strand=+
  SCN-specific regions: Sequence locations=1-106,153-299,322-816,854 -932,954-1188,1213-1346,1403-1414,1441-1510,1532-1537,1562-1641,1689 -1763,1815-1855,1905-1931,1995-2030,2085-2185,2226-2243
atgccgccgggcaatgaaatgttggcacccgattggcaaatggttaatgtgaatggtgccaatttttatgggaacgatacatcatcagcagttaataatgccgcacttgggggagcagtgggaagtggccaacaacagcagcaaaacccacaacattttgtggccacaaatggcattgccattgcacggactcggcccatcaaacggccgagtgttcgccgttcggtgtcggcgctgaacatcccaatgaaagtcgtggcgagtgccaacgccacgccaaacgcagcagcggggggtgccaacaacaacagcaacaattgtggccaatttggaacgccatctccggtacggcacttgcgagcggaggaaaatgagcaaatgtccaaaaacgggaattcttaaatgccaatattcttaactatgaatcactatttttgaactttccgccactaaaataggtaattacgttcattattttggcattttgtcatttagtattttttagaaattccttaataaaaacgcaagaatcaacaatatcccttagaattgaattccgtcaaaaattcaagaattgttccctaaatatttaaaaatttgaatttggaaaatgagtttgaacatgtaaaagagcatcttatcgagaagaaaaacgcagggtttgggagagaggcaagaaaagtactggtttccgtttctgctggtagcaaggggaatttttgttgctaaaacttgattttctaagactttttaattgagttcagcgatttttccgtgaatctttgttttttacgtcggttttcgaacttttagcgcaaattaaaatcaatgaaataaatattaaattttaattgccccccgagtttagcaaccatcccaacaataccttacggctggcactgccaattttggacggcccggtccaagtccaccacaacaacagcaccaacaactttcgtatggccaagtgcaacaacagcgagacggcggccaatggttgagcagcgcaacaaataatggcggcacatcgcccgaatctccgctgtcaaatcatcaagcccaacaaacgcaacaacagtcaccagcaacaggtggttatcggagtcgatcggcgtcgatgaacgtgttgaccacgccgacaatggaaagtcagcagcaattgatgttcaacacgtcaatgggttccagcactaataataacaacaacaacatctttgggcacagcatgcaaagactggtgattaacttatgcccaagggttttaatacgttttttcctgacaaatgagttcccagatacatgaaaagcgtgaaaatttgttttagcgactgatgttaagctattactttttattattttaacattataaagaattctttaaaaataatttttaaaaatattacatataaggagaaagataaaataaaattttattctaaaccccaacccattgatcagcagacttcgccggatgagagtccgttggatcatgtaaatgtgcatcaacagtatgcagtttcaacatatgcaaataatgagcaacaacagcaacaattgcttttatctccgtcaccaccaaaacgcagcgcatccttcacagatatgtgcgcttcctatcagcagatgaacattcagggtgggataaatttaaattaaatttaaaaatatatttttttatgtaatatatagcatttatatgggttctgattccagaattttttggataattttttgatgtttttaaaaagatttttaccaaaaagataaaaaatcaatttatcataataatttatttatgttaaagtaattaaaaagaaatctcgcttttatggatattaaaaatttaaaagggttcattatttaaaaaatataatctaattattttaattcaattaagaaaatatgcaaacaaatgtgcaagtgactgaaatgcaacagcaatatcagcagcaacaacaatttcaaattcaacagcagcagcagcagcaacaacaccttgaagggttttttgcgcctccttttgcatatggtaattttttaaaaatttattttagattttattaaatcaatttatataaataattggttaattttatgcattgaacttgatccggatggaccacagccaaaaatatctttggcaaatcagcagcagtcggcagcacattttgccgcatttaaaggcataaattaatttagaattttttaattttttaaaattttaaggaaatgaacttactcca

SEQ ID NO: 56958 - DNA, 61 bp, Heterodera glycines
  Genomic contig location: Contig_ID=SeqID_589; Location=6924..6984; Strand=+
  SCN-specific regions: Sequence locations=1-61
gtaaatattgatcatagtccccaaactcaaaaatgcttaaaaacggttagaatcgatgtaa

SEQ ID NO: 56959 - DNA, 887 bp, Heterodera glycines
  Genomic contig location: Contig_ID=SeqID_5113; Location=2340..3226; Strand=+
  SCN-specific regions: Sequence locations=1-172,230-329,401-464,493 -547,569-688,752-792,834-887
atgttcaatgaaggccaaagaatgattatcaacaaaattcatgaaaaaggtaaatgttgtaattattgattatatcgatattgcgtaatgttagctcaattctgatgacaagtcaataacaagatcattaatgaaaataatgtaggtaaatgtgacaatattaaattgtgtgaataaaataaaatatatttaataatatttaaatttaaataatatcaaaaaaattaatcaaaaagagggctttttgaattatgtaaaaaaacaatataaaaataaaaacaaaatggatgataaaaaacaaactctaacaaataaattatgtttaacgcaattatatattttaatttgtcatatttaattaaaaataaacaaaaatacaatggataaaaaatataaattagagaaaacaaagaaaagaaaaattaacaaaagagcagcaaattaaactaggtaagggcaatttgattaatataaaatttaattaatatttaactctcatttataaaactaaattcacctaaatttttaataatatcaaggaatacaataatgtaaaaagcatggaataataaaaaaaaggtgaaaacaatgttgttgtttttttgataaaacttaagctgaaatcttataaataattaatgctgcggcaggaaaatgactaaaatcttttaatttgaagaattgtttgaaaaattatttttattaatattataaaaatttactaaacaatataatacaaattattttttaagtaaacataactaaaggattcgatgtagaaaaaaaagaaggaaataaatagataataagaaataattaatattttattttatgaacttttcttacaattaaattaaaagaatgtatcaaaaacttttaaaatcata

SEQ ID NO: 56960 - DNA, 290 bp, Heterodera glycines
  Genomic contig location: Contig_ID=SeqID_5113; Location=945..1234; Strand=+
  SCN-specific regions: Sequence locations=1-126,151-290
attttctaagaaaaaataggagttttgggggcgcggcggtgccgataggcgccgccggggaaaaaaattggaaattttgatcatttataaacaggttttcactgaaaattagccaatttataggtaaaattttgaaaaattttatgggaatttaatccaattcttaggggtgtaaaagtcgcatttcgcgccaaaaagcgaaatgcgaaatgcgaaacgccaaaaaatgcgaataatgcgaaaggcgaaatgcgaaaagcgaaacctaggcacatccctgcttcacaccc

SEQ ID NO: 56961 - DNA, 947 bp, Heterodera glycines
  Genomic contig location: Contig_ID=SeqID_26210; Location=360..1306; Strand=-
  SCN-specific regions: Sequence locations=1-411,433-805,827-947
  Gene Ontology: Mol. function=specific transcriptional repressor activity; Cellular component=nucleus; Biological process=DNA repair
tcaatgccaattaaaaaagcgcgcttctggattttatcatcaaaacgttttatcagaggagtacaaaacgattgctgattacaagcaaaatgcacagtggccatgtctggaaatcgatcaatatgaaaagtgtggtctatttgttaacttataattttaagcaggaaattatcaatggacattttttttgtggagtttgaaaaaaaaaaagttttttaattccttttttttgtttgcttaactgacaaccccagctatataggttagcatttaaacaggataataaaaagttaaaaagatagtttgcaaccggaaattttggctgacagacagatgagtataaagttttaacaattttaataggctctcagaacttttggggcaccctgcatttttactgacataactcttaaaatatatagaaaatgtttacagaagtaaaattttagcgttttttggaatggcgtaacagaagaacaaagaatatttgaatatgcccaagaattgcctatgcaaaagggtgacaaagactggcagccatctttgggctccatcttagaactacagtttttatcgacaaataatggtggtcttggtgttccaattgagggaattacgtcgccctatttttatttacgaaaagccggctcatattttaccgcccacactgagaattctgacctttatagtgtgaatttattgtgcccttcaagtggaacagacaatgttggcataactatatggtacttttagtgggggggggggtctttttatgacaatgtattttcaggtattcgattccggcggcagattttttgaaatttaaaaatctgctctcaaccttttttgttaaagaattcacaaatgatccggaatatttgcggaataagtcaattttggtgaaccctaatatcatccgtgaaaatgggatccgatgtatccgaact

SEQ ID NO: 56962 - DNA, 453 bp, Heterodera glycines
  Genomic contig location: Contig_ID=SeqID_26210; Location=1203..1655; Strand=+
  SCN-specific regions: Sequence locations=1-105,197-453
atggccactgtgcattttgcttgtaatcagcaatcgttttgtactcctctgataaaacgttttgatgataaaatccagaagcgcgcttttttaattggcattgactttaaaaatataagaaattatttgatattaaaacaaatataagaaattatttggtaataaacaaacataaaaaaatatttgatatttttaagacaaaccgaacaagaacacggtttcggttagtaattctgcatataggaagttgaaatgattccggtatgcgaaaacgataacaccgataagtcgcgaccagacatttagcgatatgatgttatcaaaaaaaataatcaatatttgagcccaaatcatcagagctttggggggatcgttttggcgccgacaatagagtcgtaatcacacattttcgagaatctaagggaaaaaaaatacaaaaaaaaaaagcaaaca

SEQ ID NO: 56963 - DNA, 1562 bp, Heterodera glycines
  Genomic contig location: Contig_ID=SeqID_26211; Location=68..1629; Strand=-
  SCN-specific regions: Sequence locations=1-1336,1358-1562
  Gene Ontology: Mol. function=ribosome receptor activity; Cellular component=cornified envelope; Biological process=signal transduction
aagaaaaagacaaaattggcaccagaagaaatacagccgaagaaagaaaagaaaaaattgcaaccggacgaaacacagtcggtgaagcaaaaggcaattctggaagaaatacagccgaagaaggaaaagacaaaattgtcagtgggagaaacacagccgaagaaggaaaagacaattctgaaaagaatacagccatagaaggaaaagacaaaattggcactggaagaaatacaactgaagaaggaaaagacaaaattggcattaaaaacacaaccgaagaaggaaaaaacaattctggaagaaatacgatcggtgagaaatccggaataaattcaacaggcgattccggaagaaacacagccgaagaaggaaaagacaaaattggcaacggaagaaacacagccgaagaaggaaaaggcaattctggaaaaaatacgctcggtggcaaaaccggaagaaatacaatagaagatggcacaggcgaatccggaagaaatacggtcggtgtcgagtccgcaagaaatgcagccggagagggaaaagacaaaattgtcagtgggagaaacacagccgaagaaggaaaagacaattctgaaaagaatacagccgtagaaggaaaagacaaaattggcattgggaaaaacacagccgaaccgggaaaagaccaaattggcactgggaaaaacacagccgaagaaggaaaaggcaattctgtgagaaatgcaaccgaagaaggaaaagacaaaattggcattgagaaaaacacaggcgaagaaggaaaagacaaaatgggcactgggaaaaacacagccgaaccgggaaaagaccaaaatggcactgggaaaaacacaaccgaagaaggaaaaagcaattctggaagaaacacagccgaagaaggaaaaggcaattctgaaagaaacacagccgaagaaggaaaaagcaattctggaagaaacacagccggagagggaaaatacaaaattggcactggaagaaatacaactgaagaaggaaaagacaaaatcggcaccagaagaaacacaaccgaagaaagaaaagacaaaattgccactgcgaaaaacacagccgaaccgggaaaagaccaaattggcattggaaaaaacacagccgaaccgggaaaagaccaaattggcaacggaagaaacacagtcgaagaaggaaaaggcaattctggaaaaaacacgctcgatggcaaatccggaagaaatacaattgaagatggaacaggcgaatccggaagaaatacggtcggtggcgagtccggaagaaatgcagccggagagggaaaagacaaaattggcattgggaaaaacacaggcgaagaaggaaaaggcaattctgtgagaaatgcaaccgaagaaggaaaagacaaaattggcattgagaaaaacacaggcgaagaaggaaaagacaaaatgggcactgggaaaaacacagccgaaccgggaacagaccaaaatggtactgggaataacacaaccgaagaaggaaaaagcaattctgcaagaaacaacagccgaagaaggacaaggcaattctga

SEQ ID NO: 56964 - DNA, 1183 bp, Heterodera glycines
  Genomic contig location: Contig_ID=SeqID_26211; Location=426..1608; Strand=+
  SCN-specific regions: Sequence locations=1-1183
gtgttttttccagaattgccttttccttcttcgactgtgtttcttccgttgccaatttggtcttttcccggttcggctgtgttttttccaatgccaatttggtcttttcccggttcggctgtgtttttcgcagtggcaattttgtcttttctttcttcggttgtgtttcttctggtgccgattttgtcttttccttcttcagttgtatttcttccagtgccaattttgtattttccctctccggctgtgtttcttccagaattgctttttccttcttcggctgtgtttctttcagaattgccttttccttcttcggctgtgtttcttccagaattgctttttccttcttcggttgtgtttttcccagtgccattttggtcttttcccggttcggctgtgtttttcccagtgcccattttgtcttttccttcttcgcctgtgtttttctcaatgccaattttgtcttttccttcttcggttgcatttctcacagaattgccttttccttcttcggctgtgtttttcccagtgccaatttggtcttttcccggttcggctgtgtttttcccaatgccaattttgtcttttccttctacggctgtattcttttcagaattgtcttttccttcttcggctgtgtttctcccactgacaattttgtcttttccctctccggctgcatttcttgcggactcgacaccgaccgtatttcttccggattcgcctgtgccatcttctattgtatttcttccggttttgccaccgagcgtattttttccagaattgccttttccttcttcggctgtgtttcttccgttgccaattttgtcttttccttcttcggctgtgtttcttccggaatcgcctgttgaatttattccggatttctcaccgatcgtatttcttccagaattgttttttccttcttcggttgtgtttttaatgccaattttgtcttttccttcttcagttgtatttcttccagtgccaattttgtcttttccttctatggctgtattcttttcagaattgtcttttccttcttcggctgtgtttctcccactgacaattttgtcttttccttcttcggctgtatttcttccagaattgccttttgcttcaccgactgtgtttcgtccggttgcaattttttcttttctttcttcggctgtatttcttctgg

SEQ ID NO: 56965 - DNA, 1306 bp, Heterodera glycines
  misc_feature (51)..(51): n is a, c, g, or t
  Genomic contig location: Contig_ID=SeqID_26212; Location=88..1393; Strand=+
  SCN-specific regions: Sequence locations=1-43,83-268,300-401,456 -468,491-520,542-576,669-768,844-972,1016-1097,1199-1306
  Gene Ontology: Mol. function=protein serine/threonine phosphatase activity; Cellular component=nucleus; Biological process=protein amino acid dephosphorylation
atgccggacagtttgggcaaaaagtcgatcaatgtggatgaagtaaaattntaaaaattaaaaaaaaaaaaaacaatttttagtggcgccaaattttggacgtcctttggagtgacccgaagcctcagaatggatgttggccaaatgcttttcgtggcggtggcagctattttgggccggatgtgacaaagaaatttttggaaaagtgaatttattttttatttaattggtttattttcagaatgtttatttaacttaaaaatttccctattttatttttttatatttaattatatttacagaaatggcttccgtctgttaattcgatctcacgagtgcaaatatgaaggtccgtccatcataaaagcattattgtataattgtttttttaatgtttatgcattttaaaattaaaaatttaaattcaaatatctaaaaattataaaattttaattgatcaactaattcttataatttttccttcttttttcgaaaaaagctaaaattgtatttgttcaacaaaaatttcatttaaacttaaaatgcttttcatacgaatgttctaacccaataaacattttaaaaatatttttttttgaaaattagggcaatttaaaaaattaaaaaataaattttaaatatttagcaaaaattaaacaatttaaattgatcaactcattttttaattccttttttctttccaaaataagctacctaaattgtttttttccgtttccataaaaaaacatttttaattcgtcaaaaaacaaaaaattcattttgaaatttaaatgtttaaaaaaaattttcaatccaataaattaaaaaaaaaattttttttttcaggttacgaatttatgcatgaaaatcgggtgctcacaatattctcggcctccaattactatgaaactggtagcaacagaggtgcctatgtgaaatttgttggcaaagacaaagcgccacattttgtggtaaatatttttttttctaaaaatttttaaaattttaaattttagcaatacatggccagcaaagtgcacaaaaagatcaccgttcgtgaacggtaattcagaaaaatcacataccaatatgaaaacataaaatttatttataataattttatacaaaaaaaatatgtttattagaattaattttaaataaaaaatacttttattgaatttattttttaattttttaagacttagcattgtcgaacaatctgccatcaaaaaactgagtgaaaaattggtgtccttcaacacggagttgcagaaagaatttggaaaaattgattcgaccggcacag

SEQ ID NO: 56966 - DNA, 791 bp, Heterodera glycines
  Genomic contig location: Contig_ID=SeqID_26214; Location=98..888; Strand=+
  SCN-specific regions: Sequence locations=1-424,446-752,774-791
  Gene Ontology: Mol. function=ubiquitin conjugating enzyme activity; Cellular component=chromatin; Biological process=establishment and/or maintenance of chromatin architecture
atgaccttcctcaccgacattcttcatccgaacggtgggaaaagcggctggcgcaacaattcatcaaattccagcaaccccccccccccccccctttcagttgacatgagtggccaggtctgcatcagcattcttcacccgcccggcaatgatccgctcggctatgagcaggcgtccgagcgttggaatcgcaaccgtaccgtggagtccattttggtgtcggtccaactgctgctggcggagccgaacttcaacagtcctgccaatgtggatgctgccgtaagtgattgattcgtccgtcggcacatttttgattgaccatcatcataattttttgtgtccaaatttccagattttgttccgcaacgacccggcacaatacaggaaggaagtgcgacggcgcgtggagagggcatcagcatcgacaccgcgagcgaggtcgtcatcaacaccaccgccggtagcgcagccgccgggagaacagcagcagggtacgccgcaaccgccagcgacaccgccgcaagggcaagaagcgcagcagcagcaacaacaaacgggcgaatggtacctttgatgtgacgtgatgcctctgagtgatgatattattatatagttatgtatatgtattgtattgtatgcatgtgtctgtcgtccgatcatttcataaattaatggtctctctctgtgttcgtttgccctgcttttgttcgctgttgtacatattatgtgtattgtcatcatctaccaattattgtatatacatatgtgtacatatgatggtgtatcgagca

SEQ ID NO: 56967 - DNA, 1222 bp, Heterodera glycines
  Genomic contig location: Contig_ID=SeqID_26215; Location=132..1353; Strand=-
  SCN-specific regions: Sequence locations=1-377,399-534,556-867,889 -1222
atgtctgaccacgacaacctggtcaacccgcggtgggcccactcgctgatcaaaaccgccgctcgcaagctgtacacggagaggacgtggaaggaggaacactttaacgacttggtgcacacagtgctcgtccaacagcccacgctgaaggcatttctgctgaacgttctgctgaaggaccaccacgacaaacgggcgcatgaaaaatggcgcaattttgtgtcgacggaacgctgtcgaatgtcaaagtcagcgcgggcttcccggggacgcgataattggccatgcaagagcccaaaattggcaaccctttcacagcgaggggggaaagggggtcaccggcgaacgggtcagaggaaaattattgaaattccgaaccaaacccaaaaagaacccttatgtcattagaaaattggcttaaatcgcaaaattcggtttgaatttttagacaaattctcacaaaaatattcaaaattttcccgttggcgcttctcggcaccgtttggctggatgtgttccagtgcttttggtctgttttataaaataagaaattctaattttagcgctttcgacatggtcaatctatgctctaaggatgaacagactcagtttttgtctttgccgcgtcgttgcgccgtgtacgaaattgacactgcgcacgcgtttcgcgtttttgaacgccaacttgacgagtactttctgaagaagacgcaccgggttttggtcggtgttgacgccgagtggaatccgtacgtggccaggagcaggtcagtaagcggttgattgaatggtcatggacactttgtaccagcgcggaattggaaaacttccttatagaaggtcccaatgttataataccataggtgcctaattagaaaaagaaaactaatttatgcagtaattaaattcaataaaatttttgaaatattcgtcaaacaaatatttccattctcaccccgcccttatttaatgtatgttcccctccagggccagtctgctccaactggcactggtcaactccgtgtacctgttggacctggacgcgctgtacgcggacaagtccttccagcagttcatcgaccgtctcttccttgataaggcgatcatcaaactcggctatcaatttggcgacgacctcgccatgctgcgcgcccgtttgcccgcctgtgtcggcctctatcgcccgcagggcattgtgtgcattggacagttggtagatgaa

SEQ ID NO: 56968 - DNA, 910 bp, Heterodera glycines
  Genomic contig location: Contig_ID=SeqID_26216; Location=71..980; Strand=-
  SCN-specific regions: Sequence locations=1-190,214-232,254-332,356 -514,536-589,611-664,686-840,863-910
atgaatgtcatattcgtgatcactaatcagttaaaactttctgaagattgcttgttagttaatcttcttaaacagataagaaatttatcaaaaaaaaaaaaaaatcccccccccccatttttttcattttttaatttttcattaccctctttataaatagcgagggaattcccttttttgctcacatcagttcatttcatttattcattcattgttctctgcaattgttgcctattattattattattattatgtgtcttggccggaagaaagggaagcgatttggttcacctgcgtccagcaaaaaggtgaacaattttttgagcatcatttgttttttgtcctgtctaattctttctgtcccttttcagcgctttcgtccgaaatcgccaaagaagattaagtccttttttgcaaagaagaaagccgctttgtcgtcgtccaagaagcctggtgccaaaaagccgttcaagaatccgtttgccaaattcaagaagtctggtgccgccggatcggacaagaagcctgatgccaaaaagccgttcatgaatccgtttgccaaattcaagaagtctggtgccgccggatcggacaagaagcctgatgccaaaaagccgttcaagaatccgtttgccaaattcaagaagtctggtgacgctggaacggacaagaagcctgatgccaaaaagtcgctgtttgccaaattcaagaagtctggcgccgctgaatcggacaagaagcctgatgacaaaaagccgctcaagaatccggctaagatagcagacaaggtgtggcttcccgaattaccattttgtctaacaaatttatatttttgacatgtttaagcctggaccacatcagcaacctgttcatcatgatccgtctcatcagcctccgctcaagaagcctg

SEQ ID NO: 56969 - DNA, 1169 bp, Heterodera glycines
  Genomic contig location: Contig_ID=SeqID_26216; Location=1229..2397; Strand=+
  SCN-specific regions: Sequence locations=1-199,221-384,407-1169
atggaaaattttacgcgttttcttcacttcatcaattccctattcgtattcaacaattatttgttcgtctccaagtctcgtccaacgtctgcatttattgttcatcaatccttcatcggttggcatccgcgcgcatttcaaaatggacgctctcaaaaagcttgcgagccgtgcacgacaggtaaaaaaaataagcgtattctgaggaatcaatttaaaaatgccatcccacattccagaggtcggcggagatcatgctgaacgcggagaagaccgaaattggtgaggaggccatttctggattccaaaaattaaaaaataacaatttttcccaaaatttcaggcgccgagcttgaagcgctgctgaccaagacagacaagacggaggaggacatgaagaagctggtgcataccatcgaggtgtacctgcagccgaaccctggtggacacttggaatttgcaattttttggaggaaaacactaatttttttcccccaattttcagcagtccgagctctggacggtcttggggaggcgttgaaggtgtggtttttggcacattcacaattagcaacatatttttaatgcgcaccaaaatttaagggagcagcatcgatagtggtgggagccgagtcgaccgtcggaagtgagagaattttaatcggaaaatgctcaatttcattagccccactaattgttgccttttctgttgtttttcagccactttgccacagacagagtcgaaaatggcaccagcagggcaaccccaacccatccaatcgatcaccacgcaaaccttggcaagcctccggcacctccaggagaacgaactacgcaccgtccaggcgtggatttgcttcttttttttactcaatttccgacaatttttaacccaaaatccctcccttatcatttgcagaaggagcgcagcgtgttgaacaagaaacggttggatttggacgtgacaaaaagccgttggaagcgcgcctcggacgacaaaaaacccgctgtacgtcgtgtgttcttcgccgccggggctccatttttcaataattgacaaatttcactgtttttttcaggttgaggcagagttgcgcactgcccaggccgaatttgacacccaactggtgaccatcatcactgcgttggaggctcttcaaacggctatg

SEQ ID NO: 56970 - DNA, 140 bp, Heterodera glycines
  Genomic contig location: Contig_ID=SeqID_26217; Location=2272..2411; Strand=+
  SCN-specific regions: Sequence locations=1-78,101-113,135-140
atggcttccaaatgccttcctcccgaacttttgtacgaaattgtgcctttcgtccttgcgaaaatgctgccccaaattcgctctcgtcctgtcggctgcttcacaaacttttactgccacgtgtcatcaaatggcaaaag

SEQ ID NO: 56971 - DNA, 166 bp, Heterodera glycines
  Genomic contig location: Contig_ID=SeqID_26218; Location=691..856; Strand=+
  SCN-specific regions: Sequence locations=1-9,33-166
atacgcagtaagcaaagaataaaaggagaaaggaactttaaatccgacaacataacataaaatgacatatttttaatgtcaattttgcatattcacaaatttgtgtgcgtacactttcaatcacatttttatatttgcactttattaccgataaagacatcagaat

SEQ ID NO: 56972 - DNA, 101 bp, Heterodera glycines
  Genomic contig location: Contig_ID=SeqID_26219; Location=961..1061; Strand=+
  SCN-specific regions: Sequence locations=1-101
ctgctcgcatccaacagtcgacgactgtgaaaaacaaggacattcggaaattcctggacggcatttatgtgtccgagaaggtggccattgccgatgaatga

SEQ ID NO: 56973 - DNA, 1096 bp, Heterodera glycines
  Genomic contig location: Contig_ID=SeqID_5115; Location=21..1116; Strand=-
  SCN-specific regions: Sequence locations=1-294,338-377,445-627,650 -666,688-1039
atggccgaacggtgcaattcccttcgccgtggcaccggcaccggtggtgccacaatttgcgcacctccgtcctcaaacaatggcaaaaaacggctgccgtgcccaccactcactttcctcaacattcccaacttctcactggacgagctgtacgcgcgcaccttttcccgtcccgacttggaggcgttggtcgaaattcaagagtgagtaaatgaatgagggcaatttagcaattggggaggacaaaaaattgatagaaccgtaaaattgggcgtattagttcatggcaaaatcatgatttttattcaaaaaataagttgttgttttttgataaaaatcgttttcttcgagcgttgagtttttttttcaattccatcaaaaaaaaaatatttaaaaaaattaaaaattctattttctataaaaaaaaaatttttttctttatttgccatttttcacaccgtttttatagaaaagcgctgacagcgcagaagggcgaattggtacgcgttgagctgaccatgttggactcggatgaacgcgaattggttcaactgcggaagcagcacaatgttcggcaaattgtttttttattttgtattcctaaatttatattaaaaaaaaccctggaaatttttttttttttttttttggaaaaacagtaattcaccataaatatttttggaaaatcgcatgatttttttttcaattggcaatgctggagacaatccaatctccctcctccctcttttttcatttagcgaattaaaaaacagcaggaaagtcataaattttcaagccgtttctctttttttttcataccgtacaatatacaatatatgtatgtcctatccatttttcccgttttttacagaatcttcaaacagtgctgaattcaatgcgcaacgccaattggacagaacgcattggggcagagagtgcgacggcggagcgtctgcacaccgcaattgccgcaatgcgcacagcgctggcggagaagaaacggtagtttattgattgattattgtattaacaaatccggttaatttaaaaaaaaaaaatttgcgaaaaacaaataatattttaaaatttaaataaa

SEQ ID NO: 56974 - DNA, 330 bp, Heterodera glycines
  Genomic contig location: Contig_ID=SeqID_5116; Location=93..422; Strand=-
  SCN-specific regions: Sequence locations=1-194,219-330
atgatcagcaacaatatcaaggccaacaataatatgtgcaaattggacaaatgcactcaatcggatgacggaaaaatcggcgccaatttttatgccggcggaggttgcgaaagatgcgcaacattttggcctattttggaggggaaaagcagaagccgaagcagcagcaaaagtgttcatcaaaatggcacaattgaggaggagggggaggagaaaaggccaaaagtgattggcaaatttgtttttgctgaactgtttgaaaagggtggtggacgaaaatcgccaaattatggcacaatggtggcggacaacaatggccgtcatcaatcg

SEQ ID NO: 56975 - DNA, 520 bp, Heterodera glycines
  Genomic contig location: Contig_ID=SeqID_26221; Location=1077..1596; Strand=-
  SCN-specific regions: Sequence locations=1-128,171-304,330-332,362-520
atggagcaggtgagggccaatggtggcggtgaccaacgaccgctgattccggcacccggcaacggcacgcccaccaacatgttgcctcaatacgccttccacatgaccatgctggtgccgaaaatccgaaaaaaaattaaatttgaaaaaataatttttgaaaaatttttccagcaccgccaaaggttagaggccatgtacccggctggcacattctccaacacatactttcgcactgcgccaatgccaccgccgcgggcacttatggtgcgcgaccgtgccacccgtcccctttctatttgtgcccccctccccggaaatttttaaaagcgatttttttttattaattattgaaatttttctagtaaaaagtacttcaaacaattttttaaagaatttttttttatcattttttgaattttcatgggaaaattttttaaaaaacctgaaatttatttatttttccattcgaaaataagtggggaacctcccccccccccgccgacaagaaaataataaa

SEQ ID NO: 56976 - DNA, 1219 bp, Heterodera glycines
  Genomic contig location: Contig_ID=SeqID_26222; Location=23..1241; Strand=+
  SCN-specific regions: Sequence locations=1-43,65-117,214-457,491 -541,564-829,851-1020,1042-1219
atgaaaaaagcggaaaaacggataaaagagttggaaatgacaacggaagagctgaaaagggagaacaacgaattgaaaaaggaaatgagtaattacgacgaagcgaaaaaagagttagagaggacaagggaggaggtgaaagaagcgaatgagagagtgggaagggcaagggaggaaatggaggaaaagaagagggagtggggcgagagagagtcggtcgaacagctaaaaaagtgagtgaaaagaaataaatgtattacaaaaagaaatgaaattcaacagagaagagacggagaagacattggaattggacaaagagaagtaaatgttggcatattcaaatgagaaatggcaaaagtggacagacttttgaaattggaaaaaaaaagaaaaaaagccatttcattgcagttgtaagactgatcagtgatcactattaacccaaattgaaatgaaattaacaagcgaaattaaaaacaactaactaaaagccctctttttgatgctgaacgcccaagcagcaaaagtctgtgtcaccaatacatacatatgtaaaagtgtgtagaaagaagcaccgattcaacgtttctttaagaattttggaaatggaaaaaaaagtgattgaaatgaattcaaagttggaaagagagcgcgaagaatggaaagagaaagagagaaagctgacggaagagagacaggcgacagagaaggaaatggcaaaacaaagcgaacggtgccgacggaaagaattaattaccatttgaatgaatgtttcagagcattcaaattggcagaggaagtgcagaaatgtgagcagaaactgtcaaaaatggaagagaaagaaagggaatggacagaaaaagtgagagaatgccattgggagggatggaaagcgcaatttgcgactcattgtcaggtgggccgagtggaggacgaaaaagccgaattggcagcggaactgttagccgagagacgacgagtggaaaaaagcgaaacggaatttgaaatggccaaacgattgttggaggagaaggaagagagaatacgggaaaaggagagagcacaaaacgcacaacaattccccggcacagcggaagaaacgcatttcgaactgcaggagcaacagcagacgaaagtgccaatggcaaaggcacgaaaagaaagggacggaaacgatggggacgaaatttgccggatgagcgcggagttggaaaagtga

SEQ ID NO: 56977 - DNA, 434 bp, Heterodera glycines
  Genomic contig location: Contig_ID=SeqID_26224; Location=620..1053; Strand=-
  SCN-specific regions: Sequence locations=1-18,40-70,93-212,250-434
atgtatcatttcactgttagttatacagtgtgttccaaaattatacgttcaacaattgaaaacatgtaactttttatagggcaagaaaaaatctggaaaattcatgtaagtataacttttgatttttatcaaaaaaaagtccattgcaccaacgtgatcagatcactcattcgaggtgacctgaaaaccgtaaaatggcttgaaaccatcctagggggttggaaaaatttttcatgaaaggaaaatatgacagatagaagggcgcaaaatttgttacaaaagcaaaagattccatgtctctacgacttttctacatggagaaatgaaaggtcgaaaaccgagcatccaaaaagtacaggaatccaagggaaaatggcttaaaaatgtttttatctgtaaattatcagatggatgcttagaattttatgaataaa

SEQ ID NO: 56978 - DNA, 491 bp, Heterodera glycines
  Genomic contig location: Contig_ID=SeqID_26225; Location=99..589; Strand=+
  SCN-specific regions: Sequence locations=1-219,241-339,362-491
atgtacggctcgtcacgcattccccgtccggctgatttggcatccaacaattcatcccgtccggccagccgtgcatcagatatgggctccgactttggcaccaatggtggcgtcaccagcgcgacaccctcacgcattccggcaccgcgtgcccagcagcagaagggggtacgattcgcgagcggaacggggtatgttttcggattgagaaaattgcagatttatttatttttaatttttgtttattccctctaatttttgaaaattcctatctaaaattgaaatttcccattcaaaacaaatacataattaggcgtcatgcctcattaaaacgttgatacatctacttcaactaaaaattatatttttacaggggcagcagtgacgggagtggccgtaatacgccttcggtcctctaatgaatgcgtgtgcggaatgatctggcggtgtcggaatgtttcacccgctaatgaccgcatcaattaacaaaa

SEQ ID NO: 56979 - DNA, 477 bp, Heterodera glycines
  Genomic contig location: Contig_ID=SeqID_26228; Location=62..538; Strand=+
  SCN-specific regions: Sequence locations=1-215,276-281,304-436,468-477
atgagtcaaccaaatgcgcttgccaaaattgcgaagagacttatctatgagacccgcatgtgtaaagagttaaaagaaattggactgcaaccgcatcatcagcatagactcgaagaagcgcaacagaagtttgctaaaggagagtgtctgacacaatgtgaacttactctactgtttatggaacaacaagagcgcttgcggcagaagcgcttccggcagcagcagcaactgcagcagcaaccaccgcagcagcagcaaccgcagcagcagcagcaaccaccgcaaaattggattttaagtgatttgttaataattttcacaaaattgtctattttatgtgcatgacttaaggttttttgtgaatttgaatgggccccagcggcgcaggtagtcgccgccggaaaacaaattttttagagcgatttagttgtaaatcattcccaaaatttaaatttttgttggttttagtgcttaaaa

SEQ ID NO: 56980 - DNA, 2146 bp, Heterodera glycines
  Genomic contig location: Contig_ID=SeqID_5118; Location=1561..3706; Strand=+
  SCN-specific regions: Sequence locations=1-365,387-392,418-436,458 -690,712-753,782-873,897-988,1010-1101,1123-1405,1428-1481,1513 -1926,1948-2146
atgcgtcgtctattggaagccgaccagcttgcgcttggttgtctggacacatggcttatgatgaagctcagcggctgtgatgatcaaagctttgtcaccgaaccttccagtgcttcttccaccggaatgttcgacccgttcacggtgattgctcattcattttcccagtgtagttaatcattgtccatgcatttaactctaattatacattaattgattttgttctgcattaattaggccgagtggggccgtcccattttgcgtctgctcggcttccccgacccgggcgcggtgctcccgtcgctggtcgacacgacgcggctcggcgtgcacacggcgcccgagctgttcggccgcgcaattccaatttttgcatcggtaaaaaacgacggatatttttttaaattaattttattagtcctatcccacagtcaaaaacaataaaattgaattaattagtgtacaatatttttttttagctcggcgattcccaagcggccgcgttcggtgccggatgcattcgccgcgggacctgaaaatctcactgggcaccggcactctgttcgactacgtgagcgggcccgaaattcacagttcaatgcatggtcggtcgggaattggtattgaagaatgttgttgttttactcttcgaaatgggaaaaaaatttttgaggcgtcccagatttaggacaataaattttactaattgtggcgactgtcagtgtacgatccaagtgctatcgggtgaatggcattttttaattctaaataaatttttttagaaatcttcaccaatttccacaaaatacagcgataatttgccaattggcattcccccgcactttacgttgatcgattataaatgaatttcacttaaaaattaaaatattttttatctaacctctaaaaaaatttttccaggaatatatcctttggtggcatggcgtttaaatggcatttccactcatttacttgaggtggatcgaaattgcatttcctttttaattttataatttcaattttccacaattctcaaagggccgttccaatgacgtggcgtccgcagtccgttgggcccaatccgtgggattgattgcacaaaatttggaggcattgcagtccgacgacgagccggagtttgacaatgccgacggagacgaaggtggacatgacgacagtgccgtttgttttgtgcccgcttttggcggcatccaaacgcccatcggtgacgattttgcgtgtgccgcactgatggggtgagtggcaccacgtagggcaccacaatgagcgcattttttgtcaggattcgttccgataccacgcggcgtcagattgcacgtgccgtgttcgactcggtcgcctttggcgtctaccaaatttggcagtgccttgtcgaggaagtgccggaggcccgcgccggcgtgtgccgaattcggtgcgcatttgcgggagggagggacaaacgacttgggggaggggaatccaaatcggtgcagaatgaaatctctaactaaaacgccgcgggaaaaaatgccaaacattttccaattagcttacttttagcatttcccattgcttctaacgctgtctgtctgttttcgtttttttgcttccatttttcaattttctcctctcttttagcctctgcggcggtgtgtcgcgcaattcgcgcatttgcgaacacatcgccacgctcattcgtcgtccggtggagcgcgtgtgtgagccccagttttgctctgcgcgtggtgccgcactgttggccggcatcggcgccggtgcgtttcccttgaagattcagtctccatttgactaatgcgttgcgcaccctctgccatttttgacgatttcccaaaattcccatgaaatattttcgagtcggaattctcgacagtcgccaatgtgtccatctcccattttcaaggactgtggacacttgaccaagtggacagcaccgtcggcaacggtagtggcggtggcaaaagtttggtcggcgttaagcgcgtgttcgctccgcggaagggcgctgccgcttcggcacttcgccgtcgattcaaccggtggagggatgcgcagcggcggtgtcttcattattatgaacggaaatgatggaaaggacgacgaaatgccaatggaatttttatga

SEQ ID NO: 56981 - DNA, 1108 bp, Heterodera glycines
  Genomic contig location: Contig_ID=SeqID_5119; Location=163..1270; Strand=+
  SCN-specific regions: Sequence locations=1-249,272-277,299-407,429 -664,686-984,1006-1108
atgcttggatctgctccgaacaaaagagcacagatgttttttaaggattctctatcgattggtgaaaagtatttttttaaaggtctgaatgaaaaaaagtttcttcagaaattttttgaaaatttttgtccaaaatttttgcacgcctcactaaaaccatcataactattcttaaaatggacggaattgaaaaaagaagggtcgatacatgtacctgagagtgttttctttccaaccgtgtataaatgtttagggttagggtttgggaaataccctaaaaagggatctaattgacaattggttttctgcctttttcagccctgcttttcagaatccggctcagggggatacgcagggaatcagggtgggttttgagtgggatagtaaaatctggcacgttaggaaatattgtttatatatgtagagatcacctacgtgcaaattagcatggggtagaatgccggactcaagattggatcttggcatttttttaaaagcctgaatttaagctaattaaattttttgcgaaatcggtaaaaatggcacatttgggatgctgggctatatatataaagaccacctacgtgcgaatgggcatgatttataatgccaaactcaagatctgtactttgcatttaacactgaatttaaccaacttcttatacaactttcagtacaactttctacacaactttcaaaaaactttcaaccaatttctcaactttataaacaactttcagtcaactttgcatacaactttcagcacaacttttaaaatttaacaaaagcggccgagcgagtaccttaaggttatttatcctattatatgacaaatctgtgtcatgctggccccggtgttgaaagcggccccggcgctttcacagggccccttgtggccctggttcaaaagttggataatatcggaattaagggaaaactgcttaattggttatctgagtttttaaaggaaagaacttatacggtaaaaattaataacaaatattcaaaatcttatccgattaagtctggtgttccacagggatcagttttaggcccactgttgtttctaatctatataaatgatcttccgaaggttattccttcggaa

SEQ ID NO: 56982 - DNA, 1848 bp, Heterodera glycines
  Genomic contig location: Contig_ID=SeqID_26230; Location=31..1878; Strand=-
  SCN-specific regions: Sequence locations=1-893,916-925,947-1011,1054 -1125,1160-1477,1499-1848
atgattctcttcggcacgaccattacggcactcggtgccgatgaattgggtgccttcaatggacgaggcccgattgtcatccaatactttcggactcggcacaaccggaatttgatgttcccggaggctccatgtctgtgtgagaaaggagggcgaaaccatgtgagctactacccattggaactgatcgaagtacgagaaacgttcgatcgcgatcccccgtttgactttggaacccgaatgccatgggatgacaatccagaaactgtcaacatgggacccctagagggagaaaaatccccgaaacggttatccataagcagcaaggggagttccattactgtggaatatcatggcactccacagtcgggggcgggtaatccaatggaagggatctcaccggataaccactcggtgattatccaagaaattgactctgagagtccgacgggaaatccggtggaaatgcgcggagatccaccgagatcggaggaacgatcaattgtgatgaatgttccggcgaattcgaagattgaattgatcgggccgcttaaatgcaaaataattttgcttgtgctgtccgcatttattatgattcactcggtcggcgcaaaacaattgccatcggcgctgattcattcgccttcccgcggtccttcttcattgaaaatgcgagaagcgccgatgaatcagatctttctgcacggcttcggcggagatgtgcacccgggaagcgaagaagaggcggtgaatcatcggccgatgagcgctgttgatggagatgcttccttccgaatgaagggaacaaacatgagtcatccgtttttgtgcgcctatggcatgaatcagggacacaaaattgtgtcctctgccctctggcggcagctatataaggaggagggaaaggagcaaaaagtcacttgcctttccttattcctcccccttcaaccaccggaactccaaccgaccatggacatttcaaagttattggatgaaagcgaagaattcgttcagcagcaacagcaacaccatcaacaacagcaaaaacaacaagtcgtccgtttcgtaaaaattgatgaagaaagtgacgacgaagcgcttcgaatcgacatttcggagagtgagtcggaggaggaggacgacgacgatgaggaagaagcggtggcagcactcgaagcagcggtggccagtgccgcaccatcgccggttgtccaagagaccaaaaagcctcgaattcagggacctatggaggcaccgaagaccaaacgagtggcggcagctgagggaccattcgtgaagcgagcgcgcataggaggcccgctgaatgcgcagaaatcgcgctgcaacaaatgcggattgcttggccatttgtctggcgacgaggctcgctgcccaaagaccaatgccctggtcaaagcggagatggatcgaaagaaggcggcagcatttgccaaacgcgcggaagcaactatggaatgctcggcgcctccgatcattccactgccagtcaaaggtggtggacaggcacgtgcggccagagctggaggcgttgctgcctcaatggtcgccggtggacgcgcatcagctgagggcgcatttcgcgcatcgaaggaaagagcgcgccaagaattgatggccgcaatggaaaaacccaaggcggcagccatcagagtggcggaacggaaggcggcagcccgacctggtctccaagtgccaatggagacaaatgccgtgctgaatggactcagcgaaatcggtgcacgaatcgaccgcgagcgagacaatcatttgagcatggctgaggaattgcaacaacgtggaaaacgcgccgtggcagcaatggacgaa

SEQ ID NO: 56983 - DNA, 345 bp, Heterodera glycines
  Genomic contig location: Contig_ID=SeqID_26234; Location=153..497; Strand=-
  SCN-specific regions: Sequence locations=1-30,66-161,183-264,286-345
atgatcctgaaatacttcatgcacaaggtgtgaccaaagaatgaacatgaacaaaaaaccatgaaaatttgttacccggggtttttggggtgtctggatcacgaatctgacacaattttaatcaaatcctgtccctaaccctgaattcgaacaaaaagccgaaggttgaaaaattaaaattttaggaatttttgttcgagtttgggttagggataagaattggtgtgagattcgtagtcagggaccacaaaagtccctggcaatttgtctaataaattcaaaaatattcattttgtaatcgtcgtttggtaaaatccgccattttagcgattttttaaaaataaa

SEQ ID NO: 56984 - DNA, 417 bp, Heterodera glycines
  Genomic contig location: Contig_ID=SeqID_26237; Location=505..921; Strand=+
  SCN-specific regions: Sequence locations=1-25,48-274,303-417
atggtaatgaccatatttacgataatgaatatcaatgttgccctccttcgagtatataacggaataattaatcaaaaagccagtgcatataatggaaacaattgttgcagaaatacagccacccattgtgctgccatcagcacgctttgttcttcttatgttcaaccggcgattgtttttttggtgtgaaaatggatggttttttgctgaaaaaacaaaaattattcgatgaataagctttagctgttcaacattaaatccatcaagaaatggtgagaaaaataaacattttttctacaaattgttgctgtttttgggttaattcacaaaaaggcagaatttaaaaaatctgattgatcgtcattaaatttgtttaaatttcagtttatgctgcatattatgatttgtaaattttga

SEQ ID NO: 56985 - DNA, 673 bp, Heterodera glycines
  Genomic contig location: Contig_ID=SeqID_26239; Location=108..780; Strand=-
  SCN-specific regions: Sequence locations=1-220,242-392,430-549,590-673
atgggcaatggaaggagtgaagtgagtggggggggggggaagggaaacggaagttggccatttgcaaaaatcaaacgagtttcccttcattggttcggcatctcttcctttattttccgttcttttaggccgtgccaaattagtcggcaattaaaggtgattattttcattaatttggtcacacattcatatgccagtcccaaatttgccttaggtttcccacggatgcgtgtccaaaattctgtgcagatttgctgaaacaggcaatgccgcattagcaaattggtatttaaggccttataaaattaagctttcaggctcagtttctcccggggcagcttcttcgcctaatcattcgctgccggcggcgaagaaattttctataaaaaggcaataaatgaaataaacaaataaatattttaaaatatagggtgaaagacacacaaagaaaaaagcgacacccggcggaaggccatttaaagcatagcatttcagtgatattgggggaagaaggggcaaatgccgaccaaaaacagcaaaattacggtgaattatatttaattttaaaatcgaaataataaatttaaaactttttcagcaggacggtctcgccaatcctccgatgcttctccaccacgccgagtcagaacttggttcgcccctgaccagctga

SEQ ID NO: 56986 - DNA, 183 bp, Heterodera glycines
  Genomic contig location: Contig_ID=SeqID_26240; Location=778..960; Strand=+
  SCN-specific regions: Sequence locations=1-183
gtagttgcttgcctgtcgccaatgggtcagcgaattccgattggtggacgaacccaagatcggcatggaaaatggaaatgcattcaggaagccaatgcagttaaacttgtccaggaactttgaaaagcacagcaaaatatgaacaatttacacgaatgaacggcttaaaaagatgattaatta

SEQ ID NO: 56987 - DNA, 501 bp, Heterodera glycines
  Genomic contig location: Contig_ID=SeqID_5121; Location=231..731; Strand=+
  SCN-specific regions: Sequence locations=1-14,45-163,204-447,469-501
atgtctgtaaaatgaaaaaaattttgtttaaaattttaatattacataccaagacataattcattgttgagtttttaagaaataatgataatagatttttttttagaattttagacaccaaaagaataaaaactccctcccatttacacacattttgtttcacaaaaaaattaatttttcattgttttatatataaaaaaaaacagttggtgtctaacaaataaaatgctaattagaattaatcaaattagtgtcaaaataatttttaacccaaattgaagtaggaagcattaattattttgtgacgaattttaagcaattttttttttttaacttaatgtgaaccaagaaataatttcaggtattttcatgggcaccaggcgatgctgccgagaaattttttgaaaaaatattactgaattcacagtaattaatagaagagagtttcacaaaattttttgctaaaaagtttccaatttttcattttttttttacactaaa

SEQ ID NO: 56988 - DNA, 2205 bp, Heterodera glycines
  Genomic contig location: Contig_ID=SeqID_5122; Location=1262..3466; Strand=-
  SCN-specific regions: Sequence locations=1-177,200-217,269-373,435 -590,656-762,784-838,879-1259,1281-1450,1482-1510,1533-1572,1624 -1719,1741-1755,1941-2040,2065-2205
agcgacccaaacaaaaatgctgatcagcccaaatcggatggcattgatagaacagtagtattaattgatcaaatgaatgccaacaaggtatctgatcagttggaaattgatcggccgaaaagtgatcaacaaaagccatcccattgggcaaaaattaaggtaaaaattgaaattttctgaaaaatgaattttaatttatcaaatcacataatcattcatttattaaaataaaaaaattttcaaaaaatgaaaaaaaaaaaaattatttgcgttttcagacaaatttttttgcggcctatcagaatcgggttgtttttcattggtcaatattttccattattatcacagcgattgtttatcaggtaactttaacttattttaataataaatcatatttaattttaaaataattttgaaattttaatttttaaattcgttcaatattccacaatatttttttaattttcaggcacaaaattacattcaaacattgtgggcatatcgtaaagttcatgaaaaatatgtttggaatggttttgttgagagcattaacacacttttaagtaagaaaatttgttcgttcttttttaaattaataaatttatcaattgaaaaattaaataattaattatgaaaagaataaattcttaaaaaatctaaaatttatgcaaagttttaaatttgtaaattttttttctaccatttattatctacactaattacataaaaagcaattttcaaattcatcaatgttcttttttctttgccaatctttcaatatttgtttaattttgcataaaaattttcccattccttttttctgatgtttcccattttcataaattcattttttttattttatattgtaatatatttttccacaatttctcttttttcatcatcattttttatattccattttttaattgtttcttccatttataaatgctgctgatatttatgcccaaatgttttgctattattttttttacatttttctctttttcccttcaatttttcttttaatttaattgttattttatcatataattgatccctcatccgaatatctgtttatgatattcattccaaattgtcttttccatttgtaaattttactttggctggcacccaatttttgggcaatttttctttcaattttagccatttctttttctgagtattttttccccatttgcttaattttttctttgtttttaaaatttttccacaatttctcttttctttttgtcaattgcatttgaaaactgttcacaattttgtccaaaatttattggcaattgttccaattgatcacaatttgttgcactttcttgtttcacttgcaaattttcatcaaataattgatcaaattgtgtctcatgtaataattgagcattaatttcatcattttttgtctcattttgatcatccatttgtccaattattccatgttgatcagtttctttctctccattttcctccgatttttcgtcccatctttggccaaaaatttcatcaaaacttttttcatcgtttatctttccagcataaatattatcagcatttttgaaaattaataatgaaaataatattattttaattttcatatttcttaataaacccattaaaatgattagaaatacttttacgaattcatttttattcccatatttatgctgatttattgcatagctttactcagcaaatctacttattttttaaaataatgtttacattttttcgaaattctacttattaatgttttattttttataaattatactcattttgattaaatgaaattatattatatttttttaattattttgaaaggtgtcattttaagaaaattttgaattaaaaattctatttttcaaaaaaagcataaataatctaattttttttttataattttcgaatttttagggtcccgttttaattgccaactcaacaatttcacataatcgtggccatggaattgttattgagagcacattggatggacgagcatttgtcaaccaaagtcgaattgaggtagcaatttaaaaattaaaatgaaatattttggtaatttattttaggctaattatggcgacggaattttttgtcgtcaaaagcatgacggattgtcgtcaatgcaaaaccgtcttggccttgaaattggcattccgctctcaattttggacaaaaaattggcattaa

SEQ ID NO: 56989 - DNA, 753 bp, Heterodera glycines
  Genomic contig location: Contig_ID=SeqID_5122; Location=1857..2609; Strand=+
  SCN-specific regions: Sequence locations=1-3,39-78,101-129,161 -330,352-753
atgaaaattaaaataatattattttcattattaattttcaaaaatgctgataatatttatgctggaaagataaacgatgaaaaaagttttgatgaaatttttggccaaagatgggacgaaaaatcggaggaaaatggagagaaagaaactgatcaacatggaataattggacaaatggatgatcaaaatgagacaaaaaatgatgaaattaatgctcaattattacatgagacacaatttgatcaattatttgatgaaaatttgcaagtgaaacaagaaagtgcaacaaattgtgatcaattggaacaattgccaataaattttggacaaaattgtgaacagttttcaaatgcaattgacaaaaagaaaagagaaattgtggaaaaattttaaaaacaaagaaaaaattaagcaaatggggaaaaaatactcagaaaaagaaatggctaaaattgaaagaaaaattgcccaaaaattgggtgccagccaaagtaaaatttacaaatggaaaagacaatttggaatgaatatcataaacagatattcggatgagggatcaattatatgataaaataacaattaaattaaaagaaaaattgaagggaaaaagagaaaaatgtaaaaaaaataatagcaaaacatttgggcataaatatcagcagcatttataaatggaagaaacaattaaaaaatggaatataaaaaatgatgatgaaaaaagagaaattgtggaaaaatatattacaatataaa

SEQ ID NO: 56990 - DNA, 1321 bp, Heterodera glycines
  Genomic contig location: Contig_ID=SeqID_5123; Location=289..1609; Strand=-
  SCN-specific regions: Sequence locations=1-6,36-242,264-288,310 -772,813-847,877-951,1001-1026,1048-1120,1165-1216,1238-1321
atggagtttaaaatagttttattatttttattaatgctcaaaaatttaaatacaatttatgctggtggaataaaagaagaaaaaaactttgacgaaatatttggccaaagatgggacgaaaaagaggagaaaaatgaagagaaagaaactgatgaaaatggaataaatggacaaatgaatgatcaaaatggaccaacaaatattgaaaattttgtgcaaagattatttgtagaagaatctaatcaaatttttgatgaaaatttggaaatgaaagaagaggaaagtgaagaaatgtccacaaattgtgatcaattggaacaaatgacagaaaatagtggacaaatttatgatcaaattccaattttaaatgataaacaaaagagagaaattgttgaaaaattccataaaataaaagagaaaattaagcaaatgggaaagaaatattcaaagaaagaaagggtgaaaattgaaagaaaaattgcaaaaaaattgggtataaatcaaaagaaaatttacaaatggaaaagagaatttggaatgatgatccataaaaattcggaagatgaaaaacgccaaatattaaagcaatttgatcaaatatatggcaaattaaaaacgaaattaaatgaaaaattgtataaaaaaagtacaaaatgccaaaaaatattagcaaaacatttgggcacacatatcagaagtatgaataaatggaagaaacaattaaaaaatggaaaaactatgaaaaataaaaaaactgatgataaaaaaaaggaaattattgaaaaatattttaaattaaaaaatgaatttatgcaaattgggaaacattcacggaaagaatggaaagaattttatataaaaataaaacaaatatttggtttgagttataagacaattgaattatgggccaagaaatttgacatcaatcaaaatatttcaaaaggtgaaatgttttttatataaaataattttaaaattaaattatcttaaattttatatagcgaaacattttgtttttcgatgcagttttaaagcaatttctgttattttcgtacttattttcttagtttttttgtcataatccaaaaattgaaagacccaatctgacagacattacctcaaaatttcaaaaataaataaacaaattttaatttattttatttaggggaaagaaaattgtcattattatggaaaaaacagcgagtgctcagtcggatttgaaatgtctgaaaatattgccttttccgattttttttttttagaaatttaggaagcgcactcgtaccatctacctaaattatatatcttgtaaaataataaa

SEQ ID NO: 56991 - DNA, 73 bp, Heterodera glycines
  Genomic contig location: Contig_ID=SeqID_26241; Location=127..199; Strand=-
  SCN-specific regions: Sequence locations=1-73
atgccaaacattttcaaaatccttctgattgtgcttttggccgtcgtctcattccgtctctcggcttctactg

SEQ ID NO: 56992 - DNA, 690 bp, Heterodera glycines
  Genomic contig location: Contig_ID=SeqID_26243; Location=140..829; Strand=-
  SCN-specific regions: Sequence locations=1-143,167-230,252-446,472 -577,613-690
  Gene Ontology: Mol. function=voltage-gated calcium channel activity; Cellular component=voltage-gated calcium channel complex; Biological process=synaptic transmission
ctggaaagccttgtgccaaaacgaatgcgtcgatggcactccaaatgttggacaaatcgtccggcgttggtccacaaccatgcggcaccaacatgagctacgcatactttgtcacttttgtgttcctctcctcatttttggtgggaaaattttaaatttattggttgattctttctcaaaataattttttcaatgtttgaaatttcgaactaacttttttctacaatttcaatattttattttttttaaaacaattttgtgtaaaattttggtgccttaaaaaaatattattttttcaaatcccgcgggatttcctgagtttggaagctaattactaaccccaaaccttgcaaatttcgacttgttcgagttttcttcggaattggtcaccgtgattatagtgaacctctaaacccctacgagaacacttttctcgtttttctatgaccaaaaataaataaatttacaagtaaaatggtctctcctttggcttgtaaaaattttcaaaaaatcattattttcaattgcgccacacttttttttcaaacccttattttttgagatgttaaatttgttcgtggctgtgatcatggacaactttgactatctgacaagggattcgtccattcttgggcctcatcatcttgacgagttcatccgcgtgtgggccgactttgacccggccgccac

SEQ ID NO: 56993 - DNA, 1459 bp, Heterodera glycines; identical to SEQ ID NO: 26246
  Genomic contig location: Contig_ID=SeqID_26246; Location=1..1459; Strand=+
  SCN-specific regions: Sequence locations=1-102,154-318,358-466,508 -811,897-1070,1122-1163,1192-1265,1305-1459
  Gene Ontology: Mol. function=dihydropyrimidine dehydrogenase activity; Cellular component=cytosol; Biological process=uracil catabolism

SEQ ID NO: 56994 - DNA, 223 bp, Heterodera glycines
  Genomic contig location: Contig_ID=SeqID_26247; Location=321..543; Strand=-
  SCN-specific regions: Sequence locations=1-31,67-193,220-223
catcggttcagggggactgccccgaaaacccaaaaaaaaatttttttgaataaaaattatttaaatgaactgactagataatatttaaaataggttatttctcttcctttcagtatccctgcaaagtttgctgcgcttctgatcagtttctgaaaaaaagttaagcctaaactttttggcctgtttaaaaaggaattaaaaatttttaaaaattttattcatc

SEQ ID NO: 56995 - DNA, 1150 bp, Heterodera glycines
  Genomic contig location: Contig_ID=SeqID_26248; Location=621..1770; Strand=+
  SCN-specific regions: Sequence locations=1-304,326-536,559-682,704 -755,782-1026,1055-1150
atggagaaaatcgtctacttaaagctgatgcaaattgtgctcactttggcattcatttggcaactcctttcacttcaccaattctgcggcacttttgccgacccaaaggtgcttctgtttttgttgccaattcatttaacaatgatatgcttttcaggccttcatccatgacatctcagttggccgttgcaaacgctttacgctcattggaaaggactcaaaaagcggcgaatttggcgctgtgttcgaccaggacaaatggcacaaccaactgtcgatgatcagcaccaatggtcgaccaatcgaagaacagcaacaccaattcatggacgaattagccgcgaaattgccatccgctgaacgccattgcattccgataacggtccgccagcaaaacgaataataacgataaattaattttcatttgttttttcagatttcgctttttgacgggattggcaaagacatgaaccccctcaacaatggcactttgcgtcgtttttccctcctattgtgggccgcattttggtcgcttcttccccttggcattgccaccatcatagtgctacactctgtggaacaatataaaggagtgagcgcagtttgtggccacagcaaattcaacccgacaaaatcgcgtccaaaattgcttttcagtcgaaattcgatggatttttttttgaacaaattaaaattaatttttgtcgtttgcatttctgtgttcgcaaagtgtcaaagcatttaccattgtgtcgattaatttgttttgtttttaagttccccttctatttcaatgccttcgcttctatcttcttctggtgtgtctctgctgcgttctcaaccaatttgctgctttattggacgagcttctggacttgcgtcaacttccaagcggaccacacaaatgtgccgttggtcactttggtgtgtttgttttttggcatttattttgcgcatttttcaactttgaggtgctcagcatcgtcatgatgtgttcgtccgtctccgagattttcttcatatattcgctgcgccagaagaagaagaacggaagtgccgtcatcatgtgaacaataaggccagagacgaatggaaagatgctggtgccaacaaacataaccaatgcggcaatgaaacgacgatgttatga

SEQ ID NO: 56996 - DNA, 122 bp, Heterodera glycines
  misc_feature (10)..(10): n is a, c, g, or t
  misc_feature (20)..(20): n is a, c, g, or t
  misc_feature (71)..(71): n is a, c, g, or t
  Genomic contig location: Contig_ID=SeqID_26248; Location=43..164; Strand=-
  SCN-specific regions: Sequence locations=1-79,101-122
ctgcttctgntgactggtgntcgcctccccttgctcatctgtgacgacgacacttcgtgaacgaacatgancgacactgcaaatcgacagcgacgcggccgaggcgagaacgcacacgagtg

SEQ ID NO: 56997 - DNA, 777 bp, Heterodera glycines
  Genomic contig location: Contig_ID=SeqID_26250; Location=9..785; Strand=+
  SCN-specific regions: Sequence locations=1-646,668-777
atgctttcgccccgtttcgatgctcttgtggacatccatttcgatggcaaaacggaattgacactttggagaccaatcgcaattcgcaacagtgtcgcagcagtgccagaattacatgtgtttttcgacggtgccaacaaatccgtgccatttccattgcccgacgcccattcgccgccgatgccaaacaacattcgttttaaggaccttcgaattaagtaattggaaaatgaaaaacacttaataaacaaaaagcattcactctttttcagttgcattgaccattccgtgatcacatttcttcgtgccaatcaactcattttccaaaagggcaccaatttgcgtctgtcggttccttttggtccattcaacattgatgatgtccagtcaatttgggatgattttgcgcgtcaaatttggcccatttttgcaccaaccattcgacactttggctttcccgattgccatattttggacacattgcttcgtctcgtttcgccgacaattttcacggatgatcagatcaacattcattcaatcaattccggtcgtcagtttcccgaagcgattggtgatgatcattttgaggggccaacaacagcaacattagatcgatcaactacaaattatgatggatcaattgcaacttctgctgctgctggtcaagcattgtcaaaatggttgcacatttcgagaaaagatgggcagccgaagcaattgcgattccgcaattttgccaatccgccaaacatggaatggcaaaacaatttcaaagag

SEQ ID NO: 56998 - DNA, 1384 bp, Heterodera glycines
  Genomic contig location: Contig_ID=SeqID_26251; Location=86..1469; Strand=-
  SCN-specific regions: Sequence locations=1-3,25-314,337-502,524 -726,750-806,841-1384
atgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccggcataagcgagtacctcaaggcgaagagacatgattggctctataaagaaagacgtacggtaaaggggatacttgaaaataggccacagaaggtcgtgattgagaatcatgtacccggtccaaatgttgcaccatatctgggcctcaataaccaatccaaaccacaggagaccgaagaaccacggaaaataattattcctaggaaaagacttaaagagcgaactcctgatcctgaatcaaataatgatacccttgaggagttaactccggaaccccaaacaacatccacacacaaaacacccgttccaatcaaaactattatacacccgacccttttaaacggtctttttaggtacgtgaaggaaaacaaagatttatttaaaattacggcggccggaaaggtacagtcgaacatgaatttgccgattgaaaacagtaattatagggatgttttgttgtatctcgcggggaagaaagatgaaacaccgcgcggtgcaaaatttcttaaagatcggttactgaaggatccaacagtaaaagacatggttgataaatcgaaggtcatgtggggacgtggaagtaaaaaggcaataaaatctataaaaacacacggcatagcacgagagaagaaaccattcaaaccactaatatgggcaagactgtagagaaaattttatcaaaaatttattttaatttaaaatctccggcaagttttgcttggattcaaaaaattttaaatgaggccaaaaagattgactcggaaattacgaccgatgacgttaataaattcctagaaaagcagagaacatacacgattcacaagcccatcaggaaaaaattcccgagactaaagacggtaccgagcggcttccataccgattggcagtgcgatttgtgcatatttgaccagttgaaaaagcataacgacggttacaaatatctgttggtatgcatcgacgtgctgagtcgaatgatcttcagtgcaccggccaagtcaaagaagagtgaggacatgattgaggcttttgatcgggtgttcgaaaagtcgaaaattatcccgatgaaaatatatagcgacagcggactcgagtttcaggctggaaaaatgaaaaaatattttgaggaaaaatttattatcaaaaatgtgatgtatagtcctgacctcacgcccggagtcgttgaaaggggcaatcggacaataaaggagcgcttgtacagatattttacaaagatggacactctacg

SEQ ID NO: 56999 - DNA, 452 bp, Heterodera glycines
  Genomic contig location: Contig_ID=SeqID_5124; Location=1925..2376; Strand=+
  SCN-specific regions: Sequence locations=1-63,85-92,145-374,414-452
atgagaagagatgatattttcttttttaagactgttattgactacaaaattaataaagaatatcatttcttatatttctattcaagattagcatttttaattattatttttcatgtattttttatttaatataattattttatacctctatatcaggggtttgacttgtctcagaaaagacgagagcgagagttcggcgagaagcgagagttcccaaaaagacgagagttggcgagaggcgagactttttcaatttttctttagccttattttttacgttaaaaaatttcattcataagtacaatcatacaatttgatatgataaaaaatagagtgccacgggaccgggaatttttggcaaaaccgggaccgggattaaaaattaaaaaaaaaattcaaattttaatttatatcaagtgaaagtaatgcaaaattatgtggttttttattga

SEQ ID NO: 57000 - DNA, 425 bp, Heterodera glycines
  Genomic contig location: Contig_ID=SeqID_5125; Location=2180..2604; Strand=-
  SCN-specific regions: Sequence locations=1-425
atggctaacgactctcattcatcaaatgcgctttctgaaacttttgggggttccgcgcttttgaacatcaccgtggacactagaggcattgaggaaaagctcaacaacctgcaattggctattgaggattcgactggaaatttgggcgtgcaagtcagcgatctgaacgcgagagttcagagctcgcaaacgctttcttcaattgcggtaaagttgtatatattatttatgataattacatgacttatttagactgaggacatgcgtcaggacatttgtgctctccaaacgaaagtgggtacggttgagcacgatttgaagcgagctctcgcaaagctgcatattctttccaggaaaaagttgcagttctcgacaatactatgaagctggcgtccgtcaagattcaggatgttgtgaagaaatga

SEQ ID NO: 57001 - DNA, 1477 bp, Heterodera glycines
  Genomic contig location: Contig_ID=SeqID_5126; Location=166..1642; Strand=+
  SCN-specific regions: Sequence locations=1-638,660-756,785-1095,1117 -1477
atgttagcaggacagaaacaacctcgcgacagcgggtgcggtctcactcaaccaccaaaagaaaagaggatggttcttcttatgggaaagagcgcaaatgttcaaattgtgggtccgctgagcactggttgtcccaatgtcccgaaagacaggttgtaactcgtgttttcaacccaaaaaattttgtaaacggcatgttttagtagttctttctattaaggaactgcagcgggttcggtcgcattcaaccaccaaaaaaaaggacgattttccatattggaagggtgaccagcgcaaatgttcaaattgtgggtccgctgggcattggttgtcgcaatgtcccggaaaacaggtcttttttaactcatgttttcagtaaaaaaagattttatggcatattatttgttaaggaacagatgcagtcccatgggctgtatccttcagaagcactacaggatccatcaacgcgtgcttcacaaataaggcgcaaacagtttactaagggggtccgtgctccggcaaagggtgcgccgggacagccacttgcatgttaccattgcggcggaccacacctcgtcaagaattgtccaaaggtgtttttgagcttaaaactataaatcaataatgttttaagcggcaagcaaaccccaagtgttttaaatgcggggggtccggccacaaagacgttgattgtccaatggcgttgaacttgggcaatccagacttgtttccccaacgggactttaacactcgtggtattttttaaattttttttagattttttgttatgcgaattacattaagcaggatgctacaactgtgggggtccgcacaaggatgcacaatgtccggcacgcagcaactttccatcttatgccggcattgatcgagatcggaggcgcatgtatgcgttggacactcatgggggatccgctgggcagtactatcgtcgctcagaaaagggtactgaaacagttttttgtaagagtctacacctttgaatttaaagatccaaagtgcgatcactgtggagggcctcatgaatctgacaagtgtatttttggtccacgaaataaatgcgcaaagggtgggtacgttcatgggaaaacagcaaaatgcgtcgaaacgaccgatgagcatatgggtatgtttgtttctaatatacaactactattattctaataattttaggaaatggctgcaaaatatgcggcgaaatccatgatggtgattgccccgaagcaatgcagaagttgcactgtcctcattgtgggtacgatcacaaatcctatgattgtcctaaccaaccaatacgttagttttttaaaacatatgcaaaaaatatcattcaatcttttcagcactctgcggagtttgcggctctctcgcgcacaccactaaaaagtgccaagagcgctgcgctttttgcggaaggaagcacctgaccaaggattgtcctgattcacaaccaggctaa

SEQ ID NO: 57002 - DNA, 56 bp, Heterodera glycines; identical to SEQ ID NO: 52733
  Genomic contig location: Contig_ID=SeqID_26252; Location=669..724; Strand=+
  SCN-specific regions: Sequence locations=1-56

SEQ ID NO: 57003 - DNA, 1011 bp, Heterodera glycines
  Genomic contig location: Contig_ID=SeqID_26254; Location=97..1107; Strand=+
  SCN-specific regions: Sequence locations=1-328,363-397,419-465,579 -591,613-626,648-675,697-845,868-1011
ggttctgctttccaatcgtttaaatattatgaaagtcggcgaacggaaatccgtcaaattttccggattggacaagacctctgtaaaactgttgacgaatacaaaaaagaattgtttgggttggtttttaattggactttgggaaaatatctgtttgagggtccaaaaccgaaaccctcaaaactgatcggaattgaaatgtccaatttgaacagcgattgaaccgtccgacctttaataacccataaaaacggtcttaaagctcgttttttctaattaatgcccttctttatgggttttgtgtttgtgtctcaagcgatatttaccgaaatttaattttgattttaatttaaaaaatttaagagatgatcaatcacataaattttgtgtgtatactcgtaaaggagattttaacaaatttactgaaacaaaaaaagacttcactgagcagggcattgaatttggatttaaatatttaatggtaattaaatcatttaaatattaatggtaattaaatcatttaagtattaatggtaattaaatcaatttatgttttcaatatttttatttctaattaaggaatcatttaacaacatttctgtcgttttattgggagaagacaagcaatttttgaaggatttaaaaatcaatcgacatgtaaaatattgggtttactaatataataaattctaattttacagttaattgccaacgtttatttgccaaaagtaatgccgagaatgaatgacatggcttttgccataaaaacatgcgattccttgctgatcactgcacagagttcaacgtttggctggtggatcgcttatttaatgccggacaatgccaccattttttataattcaaaattcggcaaaggtcggacatttttttatgaaaatgagttgcgattttttgtgctaattacttcaatttaggcgttcctcatactcggttaaactttttggctgaatgggtaccgatacaattaatcaaaggaaagatgactcttga

SEQ ID NO: 57004 - DNA, 69 bp, Heterodera glycines
  Genomic contig location: Contig_ID=SeqID_26257; Location=715..783; Strand=+
  SCN-specific regions: Sequence locations=1-5,32-69
atggcaccacccgcggcggcagcaggagaagacgaagcgggacatgaggacaaatggggacggcacatg

SEQ ID NO: 57005 - DNA, 690 bp, Heterodera glycines
  Genomic contig location: Contig_ID=SeqID_26258; Location=671..1360; Strand=+
  SCN-specific regions: Sequence locations=1-299,321-367,399-690
atgcaattattctttttattcgccgttttcattgctgccaatgcttttgactctgcccaaagtgtcggcaaaacgtccgctgaggacgaagttcgagcggtaacggaaggggcggcaccgcagcggcaaacgccgacgcggaaatcgttgaaaatgttcggccacggcctacgccatcacacgggcatggatttgctgatgaaactcggccagcaacaggcggaggagcccaaggtggtcaaattttgaaaacattttacgtcattatttttgaagttcaatttttttcaacaaatattgaagaattttgaaacattttgtttaaataaaaaaagaagttgcaaccaaataatttgatgcatttggcatattaatttcaaaatttaaattaataatttgctctttcctcctccatttcagtcattctcctcaatggacattcttcgcctttttgatgggcttgaccaccagttttaccacgatttggagaaagtgagaatgaaatttattttcactgaaagataattgcaattcgtttctttattttaggcacaatcgctttttgaagaaaatgccaaagttgtgaaaagtcttgaaaatcgtgttgtcaaacttgagagtgcaatggcaaaggcagcggagcattgcgaacccggcaaagtccaattggtctcggctcattacgacacg

SEQ ID NO: 57006 - DNA, 451 bp, Heterodera glycines
  Genomic contig location: Contig_ID=SeqID_26260; Location=188..638; Strand=+
  SCN-specific regions: Sequence locations=1-89,112-307,358-451
atgccatttgatgagttagcagaatgcctgcctgttcagcaagagcttttcaacatccttaaaatctcactttttgttagcactaaaacgcccaaaaattcaaaaaattttcagaaaatcccatctgatcagatttgtgatcaagaaacttcatacatttgcttctttattcagcaccgatcaatcacaaattatacattttttagtggaatgagcggaatgtctgatcactcatttgattaatagtgatcatttgtcctgttttgatcaatttttgttttccaattcaattactcttttttttaaattattcccattttaaaaattctttttccctttttattaccaaattgtattacatacatatgaatgcatttatttctttactagtcaaattagtcaatctgttctgtccaccgccgcttttaatgggctgtttttggtgcttcga

SEQ ID NO: 57007 - DNA, 279 bp, Heterodera glycines
  Genomic contig location: Contig_ID=SeqID_26261; Location=1274..1552; Strand=-
  SCN-specific regions: Sequence locations=1-14,47-141,200-279
tgcccttaatactattgttgttgctgttgttgttgctgttgttgttagtgccatgcttctgcttttgttgctgctggtattgaccaacaattgcggcggacgcggtcaaatggcgccaaattcggttgaaatttgttccactatttaatataaaaataaataaaatgaaataatgatttttaataattaaaaaaaaattctacaaactttacacatgctccataaaaataataaaatccaaaaaaattcgttaaaaaattgttttttttatattcgccc

SEQ ID NO: 57008 - DNA, 1920 bp, Heterodera glycines
  Genomic contig location: Contig_ID=SeqID_5127; Location=835..2754; Strand=-
  SCN-specific regions: Sequence locations=1-291,324-461,490-679,701 -716,738-1306,1330-1625,1647-1920
atgtcagatttcttcctcgacaattccgacatggacgacaacgaactggagctgaagctgaacaatttgcaaatgttgaaaaatcggcgtgccaacaaatctctgaaaatgccacccactgacattggcactaccaaattgccggtaaacggcaaaggcattgacaaaaaaggttattgttttcttggaagcattttttaggcacgaggaacctggcattcttttgtctcaagtttgaaatccgaacccggactcgaatttttttttcttggtcatttttccagcaaatacaaaaaaaaaatttttttttttttgaatttatacttcaagctttcatttgatgccaagaatttaggtattaaccaattaagaaaaaaattatgttcaaacaaactgaagattggacgcctaaaatgcaacagagccgggtacttcagtcttttgctaccccccccccctcgaaaaaattcaaaaaattataatatttttgttttttcgagggcactcgctgatcacatgaatatacatctgctgtgtatcgatttaacaaaataactatgattttttggaagtttcaattttttcgagggtggcggatagcaaaaaacactgaagtacctatagccgttgaaaatttccgcgtcaaatttaattatttatttcttgattttctaacccaatttcagcacaattgaagcgggacattgaaacaaaaatgggcaccactgacagcgaagagaaggaaaaggagccgaaggagaacagagtgccaccaaacgaaaatggcaatggctatcgaccgctgtcagacaatgccaaggaaaaaaatggtaatattttcgtgcttttttttgggacacccattttttcgcatatatttaaacatttatcttgatttcctaacccaatttcagcccaattgaagcgcgaaatcaaagaaatattgggcataattgacagcgaagagaaggaaactgagccaaaggagacaaaattctgcgaaatgttttcatgggttcaggtatgggtcaaatgttaaaaataagacagaaatgtcagtcttaccgattaaacttaatttttagaaaatcataccgaattttcaaatctagaaaaacctaaaaaaaattcctacaattaattttttttcagaatcttttttcatttaagctgttctttggcttggctttcctgctcctttcattcgctgtgttctgctggtgtgcctcaaataaaactcaaacctcaaacactgttcgtttgctcactttttgagggagcggcgggagacatttcattacaatcgaaaatttaaaaaaaaaaattaaacacaggcctcaaaaatcccctaaatttttttaagaaccagaaatgcgattgaaatttttattgttttcaaaacgtgattactaaaactaaatttgaacaaaaaacaccgtttgtcaattttaggctaaaaattaccaatgggaaacaaacataagccagtagctaaaaaaaaattcggaggggggggggaaatacgaaggcaatttttttttgttgcttttcgggccaaaaaaattctacagcactacataattcttatgtgtattttatgtatccatttttcagccgattcattccaacagttcttccgtgccttccattgtccgtgatccaccctttttggtggtttggtttcccgtgatccatgccatcgtgttttacattgccactggctcagccatctttgcaaatatttttgtcttcgtaatgctcgttttgtgttttcgtctgttgcgtcgcatttcggccagtgtgcagcgtagagaagctgagaagatgaaagaattttatgcgaaaattgaggcagaaatagacgaggaagagctggagatggctgagtttgatgccaatttgagatgggatgagacttga

SEQ ID NO: 57009 - DNA, 892 bp, Heterodera glycines
  Genomic contig location: Contig_ID=SeqID_5127; Location=4104..4995; Strand=+
  SCN-specific regions: Sequence locations=1-30,52-142,164-243,265-892
atgagcacaccaccaaaagcagacgacaaaaagaaggaagtgggcggaattctgaaaatcggcaacacatgctgcatgggcgctgcactccaagcattggccaacgtgacggcactcagcaattttctgatcgaaaagtgggtgccaataatgccaatgtccaatgccatcaatttatgttttcacccctcttttttcagcgaaaaccgactgcccaacaacaaactcgtcatggaatatgtgcaaatgatcaaaagcattttggtgttgcgacaaccggcggcgccattcgaactgaaggtgtggtgaacagtgtgccgtggtgatggtggtgttgcgtttcatgactcgccgttttttcaggaagtcatctccagccttaccaatttgttcgctgattcgttccaacatgacagccgactgcgcgacattccgctcgacaaaattgacatttggtgcttcatgcgattgttcaaggacaaggacgaagatggacagggcgaccgcctgatttgtatcagcctggcccaggtggggagttcaagcagtaccaggaggacaaccctaaccccatttgacattttgccgctttttttagcgcttcactgatgaatcgcattacattatgggagcgtcggacgctggtcaactgcccatggatgtgccgctgatctccatcaaccattgtctcgcggatttcatcaaaccggaagacattgaaggctcacgctgtgcacagtgcagcaacgcaacgccatgtttgactgttgttgacaactccgttgacgaggcggtggagcaggaaaaggcggagaattgtccaactacatcgtcaagaaaaaataggcaggcggcgattttaagcggaattattttgaagaaaaaaaagtga

SEQ ID NO: 57010 - DNA, 1472 bp, Heterodera glycines
  Genomic contig location: Contig_ID=SeqID_5127; Location=5602..7073; Strand=+
  SCN-specific regions: Sequence locations=1-152,177-204,226-305,327 -566,588-636,659-681,704-762,787-802,825-948,970-991,1013-1030,1052 -1061,1083-1472
atgccagcttctatcttggtaagcgtgctgcctgcatgtacaaggggcgcaaaacgatcgcacgcggtggtgggccgaagacgagcgattttttggtcggttttataaaacaatattttacttcatttttatgtttctgtagcattagggtgagcagtgcatgatcagtacaaaaaatagaagtaatatgagggctcttctgttttttgatttccaaaagaaaaacatgaaaaccccaaaattaaataactttttatcagtcttttaattaaacacaaaaaagttttggactttttatggctgtatcccctattctacagaaatttcagaaatgtgtatcaacgatttcgttgttgattttttctctcctttaagttggctttgtttatgtgccttctttttgtacaaagtgcttgcgccgaggaatctttttcaatgaaagtaggagttcataaactctttgacaatgcttaaatacattttttcaggacctagcgctggagtacaagataaaatatgacttctttttcgcacctgtgacgttgattttggctgtgttaagcctagcgatggcgttttctgctggctttatggttgtcctcaaccgcatgttcagtttgcacatggatgtgcaggaaaacaaaaaccaagtgaaagaacttcgaaaagaattggacgagaatgttaaaaattttaacacattgtattctgaatttgttaatttgaaaggagaggtcaatttgctgaaaggcaaataggtagattattttataaaataatttaattgtttttcatgcataattgtgttttaaattcattaattgtgtagacagttaacaaaaatccaagtatacatccgccggtgactgggccgttttgaaatttcgacatcagtagggaatgatattttaggctctaagaactgcctaaataggtaggctctaaaaacccccaaaacaggcaaaaaccatttttaagtgtgtaaaatgtcaaatttaattttaaaatattacatatcagaaattgagataaataattttaaaatgaaaattcttcatatgaaaacaaatagctaaataattttggagatgaatttgcatttttgttaataatttggtaatagtgtacctagtctgcccccccccttttttggaaaaaaatttcaaaaattgtagtcgtgaaaacgtgtttcctgggcttttagaggtcgataatcacgaatccggcatccgtttcggccaattccgaacaccggacccaaattcgaacaaaaactcgaaatccaaattttggatttttgtctaaaaaatggtttaaatcaaaaatagaagtcacagaaatgaatgataaaaccttcaaacaaatttataaggtcatttaatcagcaatataatatctaggtaatccgtttttaatctgtgtgtgcctaatcattttttgataatttgaaaaaatatcggtcatttgaaata

SEQ ID NO: 57011 - DNA, 474 bp, Heterodera glycines
  Genomic contig location: Contig_ID=SeqID_26266; Location=311..784; Strand=-
  SCN-specific regions: Sequence locations=1-66,88-474
atggccccagggccctgtttccatcccgcatggctgtatataatggatttcacgaaatccgtaattattgatctaatttttgttaaaccacacacagatgacagtccgggctttgtattcagcggatggcaatgcgcttttcacaacgatgaaacatattgtgccgaaaagacggcgaaaaatatgagtcagaagtacaaaagtgtccattgcaaatgcgaaattggtgaacagggcaaagacatggctaatgataagccaattatgacgcttccaccgcctaagccaacatcgccgccgacgccaacaacgacggagccaccgagtgagccgctatatgtatacataattggattactccccgccggggctcccggaaaattggacattgtaaaaatggcatctaaaaaattgggcattggaaaaatagacattggaaaatagtagattaaaaaaattcataattataataaa

SEQ ID NO: 57012 - DNA, 141 bp, Heterodera glycines
  Genomic contig location: Contig_ID=SeqID_26267; Location=482..622; Strand=-
  SCN-specific regions: Sequence locations=1-33,61-141
  Gene Ontology: Mol. function=structural constituent of ribosome; Cellular component=eukaryotic 48S initiation complex; Biological process=protein biosynthesis
tttgtcatccatcgaatccaaagtcgtgaagggcagtacaaactgtgcaaggtgaagaagcaggcggtcggtgacaagcaagtgccgtacattgtcacgcacgacgcgcgcaccattcgcttcccggacccgcacgtcaag

SEQ ID NO: 57013 - DNA, 583 bp, Heterodera glycines
  Genomic contig location: Contig_ID=SeqID_26268; Location=286..868; Strand=+
  SCN-specific regions: Sequence locations=1-200,227-583
  Gene Ontology: Mol. function=transcription cofactor activity; Cellular component=cytoplasm; Biological process=SMAD protein heteromerization
atgtcccgtcgaatggacagagaaacgcgttctcgtcgagttcgtttggataatcacagcactcaaaggacaacggcatcaaaaacagtggaagttggggcagaaggctcaacgaccaaccaaagcagaataaaagctgagggcggcgagcacagtgacgatgaggtgaaaaaacaacaaacgaataattacgaaagagaaattatgttttttattaaataaaatgacaaactcggtgcatattctttaggaaagtacgcttccatgggctgggttaaccaagcaattaatttatgccttttcagactgtcgccgatgacccgggcgtggacgattatcgcactttgtgcactgtgcgcatttccttcttcaagggctttggtctcagctacccaaaacggacaattcaggtactgtttatgaattatgagctgttcgctttagccatcccactgttccccatttgttttacgcttccattaattcccaggaaacgccttgttgggttgagctgcacctgaaaagggctctccaattgctggacgaggtgatgaacactcccctgatcgaccatttgacttag

SEQ ID NO: 57014 - DNA, 1754 bp, Heterodera glycines; identical to SEQ ID NO: 26271
  Genomic contig location: Contig_ID=SeqID_26271; Location=1..1754; Strand=+
  SCN-specific regions: Sequence locations=1-100,122-225,248-570,593 -685,707-888,910-1158,1190-1570,1596-1754

SEQ ID NO: 57015 - DNA, 1528 bp, Heterodera glycines
  Genomic contig location: Contig_ID=SeqID_5128; Location=101..1628; Strand=-
  SCN-specific regions: Sequence locations=1-217,271-363,397-453,486 -622,644-669,693-843,933-963,999-1064,1087-1120,1158-1223,1253 -1342,1387-1430,1462-1528
atgccgcacctttgcattacagtaacactttttatcgtaatcactttgttaacaacggttgctttgacggatacaaaggtttatgaattaaaaaaagatttcacatttgttaacattgcttgtttaaagaaaaagctaaatgacagtgacgccaatgctgaaattgacaatgaaacaattggcgaacagcagaaaaacattgcgacaacagaacaagtaaaaattatattaataattatttttaaatatgaaattttattatttattatactggggtgatgatttaatgcgcgaaaaaacgaaaaaataattaaatggatttaaattatccaggacattaaaaaatcatcaccgaatattaattttaaaggcaaaatcaattttttaaaattcttttgtcattaaaatttgtttcaggaaaaacttatgctatttaaggcaaattccgtgaacaataataaatttataacaaaaataattaaattgcttttaatggtaacactaattattgaattctttcatctgaacgatttcataaattaattcaatttagttgattcaccaactagtccaacagcttcaacaaattcagcaaaaaattttggtcatccaaaaaaatttgccaaaacaacaaaaacaagaattatcgcaacgacgggttgaagctgtacaacaacaacaacagcaacaacctaccggcgttgtgaagctgaacacagcgcgtttgaacaacaattcaacagttgatgaacgaaaaacaaattcaagccttaaggcacaaattaaagtaaacgatttttaaacattaattttaggattaatatattaagcgaaaaaagcatcaaataaaatattcaaaataattaatagaaataaaaaatgaataattaaattatattttttgtattttttaagttaataattatttaattcacatttgtgagattaattattattcttcccttttaaaattaatattttgttaataattttttttacaaggaatttcgacatcgttttgcgcaacctcgtgaacaagtttgatgaaatactttcattgttttaatttctaaaatttatttttagtttcggaaattaatacgagcgaaggatcaggtgcaattaaaattcatttcattaaaaaaaataaaattttacattgtaaagccacagccgcaaattgctacttcaattgacaaagtctgatagtctaattaatcctctaattaatattttgtaattattttaaaaagacaaactaataggcgaattattaatttaatatccattcagacaattttgaaagaagctcccacacgggtgccaacacgtcaaccattggttaatttagttttaatattttaatatattttttacaattttttagcccgttgcaaagcatgaaacaaataaaccatcgaatcaagtaaaaattttctaaaatattccatattttcaaaaattttatcagagccaaaattttgcgaatcagccggtaaaaatcaatattgttttttgaatgaataaa

SEQ ID NO: 57016 - DNA, 602 bp, Heterodera glycines
  Genomic contig location: Contig_ID=SeqID_5128; Location=2684..3285; Strand=-
  SCN-specific regions: Sequence locations=1-128,162-346,370-413,437 -466,507-602
atgtgccctgtccgcaacatgaatggaaaaaaaataatggaaaaggttaggataaaaaatgttaaaaataagcaaaagaaaattcgactaaattcgaaattttacaataaaattgctcttttggtttgaaattattttaaataattttttgttttttatttcttgtagcattaatttttagaaagaaattcctgaaaaagtcgagagctaggctataaaataatggaagaattaataaggctggtttctttaataactgaactaaatcgtgaagaaaagcgccaaacagttacaaaagtgacaaaagccctaaaaagaagagataatgacaaataggtcgatattctttcaaatttttgcaaaccaaatcatttaattacaagcttatataattaaaacaataagtaaatttcattgaaattcatttaatttatttcatagtatagaagcaaaaaagttttttgtgatttttattcattaaataaacaataattaattaatttttagcccaaaaatctgttaagtgatcagagatcaagtatggtgtcaaacaattggcttttaaccaaattcgaataatgctattcaatttgacaaataaa

SEQ ID NO: 57017 - DNA, 289 bp, Heterodera glycines
  Genomic contig location: Contig_ID=SeqID_5128; Location=3342..3630; Strand=-
  SCN-specific regions: Sequence locations=1-46,117-126,148-238,272-289
atgaatttgaataaatctgactgcaaagcaactagagaagtaaaacattaaaataatttaaaatttagccataattagtatttaaatgttacattaaaattatttaatatataattcccatttaaatgtagcatcttcttcatgacaacagtgttcattttgaaggtgacaatgaaatttttatgacaaatcacattcaatttgcttcagcatctgcggcaccagtaaaataaaatgcaaatatattaaatgaaaattttaaaaaaatttagccacaaacaacaataaa

SEQ ID NO: 57018 - DNA, 379 bp, Heterodera glycines
  Genomic contig location: Contig_ID=SeqID_5128; Location=4347..4725; Strand=-
  SCN-specific regions: Sequence locations=1-142,165-336,360-379
atgggggataatcagagaaaatacggtaaattgagaagaaaaaaattcgtaaattattactatttgaaatttaaatgaaatatggattaacgaaatccgttgggcgtttgtccgtaatttatgcggaagaaaaggcgggacaaaaattgtttatttttaaatttatatgggaaagaacttttgttatttgcgcggctttttgctgatttttaaaaaatttgaattggggccccagaacaggaaagtacctttgcgataattagatattaagttttaataaaaattatttcagcaatttttccaaaatgcattattatagaacacaccaaaaatggaataattatgacaatttaaaaaatgaaaatgttacacaaataaa

SEQ ID NO: 57019 - DNA, 303 bp, Heterodera glycines
  Genomic contig location: Contig_ID=SeqID_5129; Location=1213..1515; Strand=-
  SCN-specific regions: Sequence locations=1-6,35-303
atggcattggttatatttttaattaatttagggtaggactccgataattcggtctgacaaaagtcggagtcggggtttttctgggttagctaaatcaggtggttgggctattttttcatggtcattaattaatgagtaggggattctaccttaaatcaattaatattttttcagacattgtcttttccgatatggaaattccccttggagtgcctccttctgctgggagtggaagaagcactaagcccggcattggccatcactttgtgatggtttttggtaaaaaaaacaatataaattaaa

SEQ ID NO: 57020 - DNA, 1300 bp, Heterodera glycines
  Genomic contig location: Contig_ID=SeqID_5130; Location=577..1876; Strand=-
  SCN-specific regions: Sequence locations=1-50,133-302,345-616,638 -771,793-853,876-1049,1086-1105,1190-1217,1239-1270
atgaagctcatccttcagctcaatgtcttgtttgcgtgcttttggagcggtaattatacaataataatgaattataattaatttttagtacatttttaaatgttcttaatattatttttttttaatattttagcaacatttctcagttgccgtaagggaattattggcaccgttgataagccctttgttgataaagagctcacaagtccttcgactgcttgccctgaaaagaaagagctaaaattttgtgcgaaagctgtctgcttccgagagggcaaaggtagaaaatatgataaacaaacacaacagcagaaatgccaatacaaataaagaaattaattaatagtcgtaaattttgaattttttgtttaaattttttcaaaaaacaaaaagcaaaaagtggcaaaaatagtgaagaaatgccattttattaattggcgaaaagtacacaatgcttatgttgtttgttctcaccaataccatatagtggcaatattttgggcgctaaaatgtttttgttcctgtctttttcatcgaaataaaaccgtcgcaaaaataattttaaacccttccatataagaaattctcaatatgcaaaaaaaaacgcacagatttaaaaaagtaattattaatcacattacataaaacaatttgttactttttttcccaagccgaacactatgtgaccgtttacacatgctccactattaccgattgcaattctgctggtcgtgaatttttggcaaagaaggagtgccaagcaaacggaagcacagaagaagcctgtgaagaggagaaaaaaaagaataaggacaattttatcagaaaatatggcaattaccggtgcgagcagtgccaatttggcaaagataatgaagacaatggcaacgcaaagttcccgccgtatcagccaaaaagtagaaaaaaaattgtttttaattaatcttttggaaaaaaaattggggaaaattgttttcttatagcattaaaatttaattttctgtttaatcattttttcaatggacaaaatcggataaatttgtaaaaccaattaaatataatttacattgtaaaaattttaatttcattgaagcaaaatttgatcattttttatgtttttttaaattttagtagatttaattataatttaggttaattaactttttaaaaatattattaatttttttttctttttacagcgcctccgccaaatcctgtgaacgcttctgttggtaaaatttttttttgccaatttcattttaatttaggataatgaactttttaaaaacaaacaaataaa

SEQ ID NO: 57021 - DNA, 747 bp, Heterodera glycines
  Genomic contig location: Contig_ID=SeqID_26272; Location=142..888; Strand=-
  SCN-specific regions: Sequence locations=1-315,337-406,428-444,466 -651,683-747
atgccaattagcaacaaaatttaccgcaatccaaacactgatttctcgtctgatcagcaactgatcgcggcccaaaagttcgcacaacaatttgttgtcaatttgtaagaaagcgttggaacggaacagaaagtccgcattttggtcaatgtaattcaaacatcgcgcagcaaattcctgtcggagggggggggggggttaaaaaataaattacaataattaaagcggttactgtaaaacattttaattaatttttgtgaattatacacctttttgttcggcaattaaagctttgaacgtttttttaaaaaggaaacccaagaaaatttaaaaaaatgcctagaattgaaaaaaaacttttttttttcgagtatgggataaagttaaccgtaaaatccttaaccttttttgtccaattcataacttttacatttataaatgttattttcagcggttttacatccctaaaaattggagccccaaaaaattcggaatttttttttaatttttgtttcaacatttgccacctcctcttcaagaatacgggttcgtacgagtgcagagaaaatgtcacgcagctcagaaacggggaattcaacacacgctttgaccaactcggggattttgtattttttggctaaattaaaatccaaatttttcaaaaaaaaaaaattttttttttgacacctgcgtaaagtaaagcaattgcgttgtcgccattacgttcgcttaggtcgtcccaataaa

SEQ ID NO: 57022 - DNA, 286 bp, Heterodera glycines
  Genomic contig location: Contig_ID=SeqID_26272; Location=76..361; Strand=+
  SCN-specific regions: Sequence locations=1-18,41-131,163-286
cttttttgcggcctgtcgagatcaccgacgtggagcccagcgcgttcaaagtgttgctgaacttcatttattgggacgacctaagcgaacgtaatggcgacaacgcaattgctttactttacgcaggtgtcaaaaaaaaaattttttttttttgaaaaatttggattttaatttagccaaaaaatacaaaatccccgagttggtcaaagcgtgtgttgaattccccgtttctgagctgcgtgacattttctctgcactcgtacgaacccgtattcttgaagaggag

SEQ ID NO: 57023 - DNA, 1286 bp, Heterodera glycines
  Genomic contig location: Contig_ID=SeqID_26276; Location=53..1338; Strand=-
  SCN-specific regions: Sequence locations=1-355,387-555,577-579,631 -658,689-848,883-1228,1252-1286
atggacagtaataagaaaaggaatgaaagtgatggaccacgaattgaaggcaaaatgggcgagaaccgttcatcaagcagtagcagcattagcagcaacttaattgatccaattaacagcaatttcaatgatccatccgctgatgatgaccagccaatgttgatcccaaatgaatgggcaattaacatgctaatgtaaatgttttgtttgtcgggtttatatgattaaaatgttgaaatttaacaaatattcccaaaaaacaaaagttttgagtgaaaattttgaaaaattaataagatgctattaatttattcagtgaccctgaaaatgtaaaacagtttaaaaaaattaatcacccctccccctttggttttttaatgtttctatataaactgataattaaatttgtggattttacagtatataagatagaaaagtgcttgaaaaaattgcttttaatgttattttatcaaatcagtttctgaattattatgttaacacagggacacttcgtcattaatgtgccattcgcaaaatttgcaacaaaatcaattcatccccaattataaacattttccgtcattatcatcatcatcatcatcattattatcactaccatcatcatcatcagaggctacaatgtttggagaggcacgtgaaaataaaattgaaaatgaaatggaaattttaaattctaattggtcaattgtgcagcaaaaaacggccgataaaaacaatgattatgaaatccaaaaagaaaaacgacagaaattggaggagttacaaatgggaaacggcgcattagacgagcagcaaatggaagcacagcaagccaaaaaacttttatgtattaaattttacaaatataatttaattttaaatggaatagagatgcatttttatgagcactttgattttctaaaaatgtgctctggaaaaagtggcacaaaatggatgtataaccaacaacttgagaccggcgggatcgggacttcccgcgagatttttgcgggaatctcgatcccgtgctttttccttgcgtgatttttttttacgggagcgggattttgatggcattcccggttcgaaataggtcaaaattagctaaattttcccgacagcgactatcgccatcgctggactacagaagccttctttttttattaggagattgaccaaaaaaccgagaaatttcattattttatgacaaaaatcggttaaccgctcaattttcttttttccctcccccttaacttccctaaaaatgtttgggaaatagcattaaa

SEQ ID NO: 57024 - DNA, 677 bp, Heterodera glycines
  Genomic contig location: Contig_ID=SeqID_26278; Location=362..1038; Strand=-
  SCN-specific regions: Sequence locations=1-30,52-126,169-642,664-677
attcacgtattcgaagtcaaatcacaggacaaggagaagcagcaagaaaggcaaagacctgacactttaatcgcgtttcacagaattgtgattacgccagaaatttgcggacacagacaatttgagtaaattaattaattcaattttaaaatatattttaatttttaagcacttggtcatattgtactaaagtcagtgtataatgtgaaaattattataatttttgtgtttttatttagctcaacttttatgggttgggaggaatcgatggggcgcaacaatttttcgggaaggggaagaccaaagaggagatcaaggacatggacgagttcgacaagcgcgggttcatgcagggtgtgttttttatgcggttgaagtttggtggaaaaaccgatcacttacttttattggacctgttctgatcagagctggacgagatttcgggttcgaaaatgtagaaaattttggggttttgcactttgatttaatgctaaggattattcggtgaatatttcccagccctgctttcgaactttagcgagtagtccatgacaatttgctcgaccattattataccagtgacctcgagaccaagaatctaggcccttttttgtgccaacgatcagactcaatgccgttgatcttttttgggctccagccccattctgacaaataaa

SEQ ID NO: 57025 - DNA, 257 bp, Heterodera glycines
  misc_feature (33)..(33): n is a, c, g, or t
  Genomic contig location: Contig_ID=SeqID_26278; Location=1181..1437; Strand=-
  SCN-specific regions: Sequence locations=1-257
gacaaaacgtcgtccagccgaaacgtcgtcgancgaatttttcgaccataacttttttctttctcaaccaaattaaacattcttggtattattcgaaagcattcgaaaaatgctattagcttgcaaattttcaaaaatttttatttatgcacaaaaaaatcagagcaaaaaaagttcgaattactgggtttttgagttccttctggccataacttttttgaaacttaacgaaaatttttgagattttgcaaattaat

SEQ ID NO: 57026 - DNA, 565 bp, Heterodera glycines
  Genomic contig location: Contig_ID=SeqID_26280; Location=211..775; Strand=-
  SCN-specific regions: Sequence locations=1-222,247-302,324-360,384 -488,510-565
atgaccccgaagttggagggtcagtcagtttactttttgtatgtaaaagtattggcatggcaattattaggtttaactgatacttttctgcatacattaaagagcacgatttttaactaacgtcaattatcacgaatatgacacccgttttgactaatttcgaagcatgaacccgaatcaaacagagttaaactttttagttttcgcgatcagcgaccccgaaaacccctttgtcctttaaaaaagtatataattaagtacatatttgaatctgaaagggtatgttaaaagaacctttaaatttaataagtaacaaattatttatttcttcagtcaagtgaaggttgaaatccgagatgaccagcaacttctgttcaaatcctgcaacggccaattcgaactttttcttcttaccgccgaagggtcgagtcattccgacggcgcctcctctgcaaacttttcaaaacttggaccgattaagcgaactgtttgtttctttcttgttcaatttatgaagctgactgtgaattaaagaacgaaataggattctgtgctaggaaataaa

SEQ ID NO: 57027 - DNA, 1201 bp, Heterodera glycines
  Genomic contig location: Contig_ID=SeqID_5131; Location=667..1867; Strand=+
  SCN-specific regions: Sequence locations=1-127,150-264,286-548,580 -1201
atgaatccaatcagcgccaaaatattgaatgcccactatgggctaaaacacccgcaaacaaagttgaacatcacccttaacgaggcaattgcacttggactttatgacccagtcacccgacaatttctcaataacaatgagcagatggattattgggattccttagcattccattcgccgaacactgtccacctctacgtcaaatttggggctataaaagtgacaccgatggacttggattatgcactgaagtgtaagtgggcgaaaaagtttctaaatacctaaataggattttcggcccaaaatgcgaatttaactaattttaaaaatggtttcgttttggccaaattttagatttaatgcgaccttaacaatacttggtacttgttaattatcttttcaaaaaaatttttgagaataaacttgttttttagttttttagcgtcggaaaacccgattctggcatctattttggttccgggtttgaatttgggccaaaatagattccagaatcggatttcccgaacctaaaatccctaaaagttttctttaaaaaataaaaaataaatttttttttttgaaaatctgtaaaaaagtacccaataattttcaatgtttcctgggtttcattaaacattccaattttttttatcacctatacaattttgtttaacaatatttcccattaagattttttggaccggtacgtcggagagttccgccttttggaataccaaatttctctgccggaggccctcaaatacggctacattgaaattcgcaagccacaaccgacatttgcattgtcgttgaccgattgcatcgaacagacttggataaacagagaaaccggactgttcattgcccgtcccgaaaaaccgcatggatttggcgaagcaatgcgtttcaatggtgacgggccatcggaaattttgaagtgcgatgtgcgcgagtgtttcgactcggaaaacaacacgcggttgaccattgccgaagcagtgcgccgaggaattttgaatctggcgaccaacacattcgttgacacaaagaatggcacacagctgacccttccacaggcacatcatcgcggattcattcataaaccgttgactctgacggaagcggtgcggatccaccttttggatgagaacgaacagtttcgagatggcaccaaccgtcacacactgcttcaggcaagggc

SEQ ID NO: 57028 - DNA, 406 bp, Heterodera glycines
  Genomic contig location: Contig_ID=SeqID_5132; Location=850..1255; Strand=-
  SCN-specific regions: Sequence locations=1-6,29-46,96-346
atgtcactattttatcaagaaaatataaggtttgcgcaaaatttggttttttaaattttacaaatttatttgagaaattttatttctttaaattagagtgccacgggaccgggacctggtagcggacaactgagtaccgaggtcccggttttgaccgggaccgggactagttccggttttttcccggttttcccagccaaaaattcccggtttttcaacccgaaaaggtcccggtcccgattaagccaaaattcccggtcccgtggcactctactttaaattaattattttcatgaaatgaaaaatgatcacttcagggagtgatgattttgattcggcagaattctatttatttctttattaaaatcattaaatataatttggatttataattaaaagtaataaa

SEQ ID NO: 57029 - DNA, 698 bp, Heterodera glycines
  Genomic contig location: Contig_ID=SeqID_5132; Location=2015..2712; Strand=+
  SCN-specific regions: Sequence locations=1-83,105-171,193-483,510-698
atgccaaatatggacataaaatatggatataaatgccaaaatatggacaaatatggaaatatagacataaatagcgaaatatggaaaaatatggaaaatatggatatagaaatccatcctagaagcttaaaaccaagccaaaacatgtttttcatgcgttccaggccttccacagtcctggaaaaaatatggagatttccatataattccgagccctattaataaatttcacccaacaaagagtcttttggcttttcactgttctccgttggcatttcagctgggctattgagaatgcttatcgtgctgatggtgataataatgatgataccatcatccgttgctgaagatgagtttccaatttatgtgatatgtaagcatttacaaagaacgctacacagttataggcgatgccagggaaaaatttttgggctttaatgaattttgtaaaggaattagctaaataatgtaaattgcatactcttttaaaatattaaatatatttttaagtatgaaatagttttcaggacccggttcgaccctatacccgtaccctggacccggtttaaaaactttggttccggacctgaacccggcttttgtggacccggcaatactcggaccaggtttttgtcaaaattcccggactgaaaatttttcaaattccgcatttggagtaaatctaaatgaaaaaatca

SEQ ID NO: 57030 - DNA, 791 bp, Heterodera glycines
  Genomic contig location: Contig_ID=SeqID_5133; Location=629..1419; Strand=+
  SCN-specific regions: Sequence locations=1-663,687-707,729-791
atggaagattatggcattaaaaggggccacaccatttatgtgtcggttgatgaatttaaaatttatgcgaaacgtaagcattacaatatacgctacccagtttgggtgagcagcacggacactgtgacaacattggaggaaaagttcaaggcggtgtatgaacatgctaatggttgtgaatgtttatcatttacgctgaaagaaggtccacgaggcagtaaagtttgggcctccgccaaaatggacgaattaggcattgaagaaggatcatatgttactttggatacccgttattgtgaggatccaccaagagttggtgaattttagggatgctcggcgagttgtcaacacaatttccaagacttgagaatagtgatcccgtaagttgattgagacagactaaaaaaagcccggagaaaattctggactcgagaaatgagaccgagaattgactctcatgagccggttgagacagagactcaaaaaaaacccggataaattttcgattcgcgaatttattcgacttgagaaacgagtctttcgagcatccctactaaatgcacgcagttcccgttgctaacaatgatcagtagggctctaatttttagatttttgcaaatttttcaagagctcccagtgacctgaaacgcacaaaaacccagttttttggcagttgttaagcctcctttcaaattattagtctctattttctaggttttatttttatagcctaaaaactaaaaaaattgaaagaaaaaacttattttgacttatttggtgtttttcccaaa

SEQ ID NO: 57031 - DNA, 98 bp, Heterodera glycines
  Genomic contig location: Contig_ID=SeqID_26283; Location=70..167; Strand=+
  SCN-specific regions: Sequence locations=1-98
tcccccattcgtacattcaaagcgaaaattagtcaaaataatgttattgaattgtttattgacgcccttccagcaccatgcccttttgataattgaaa

SEQ ID NO: 57032 - DNA, 1560 bp, Heterodera glycines
  Genomic contig location: Contig_ID=SeqID_26284; Location=81..1640; Strand=+
  SCN-specific regions: Sequence locations=1-242,264-555,577-941,977 -1560
atggtaaatggtcagccttgtacctctttcactgatgctgcaataaggcacggtcttcttgaggatgacaaaatctgggataaaacactcgctgaggcagcgttgtcacgatggcctgatcaaatgaggtggctcttcatgagcatcctcgtttatggccagcccagtaatgccgtcgaattgtggaacaagtacaaagaccaaatgtactttcctcaaggcattaccacatcggcacaacgccaagcagcagagcttgaagccctagccgacattgattggcggctgcacagctgctttaacttaagctctgtgcattttggcttgccagacccgccaaactcaattgccaaaaatacaaatgcggcaattaataagtttttctttggcgatgatgatttgaatttgcctccagggcaaccaaatcctcgtccacagccaaatacccctccgccacttaacagcgaccaacagaaggtctttgatgctgttttgttggcaatacagtcaaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaggagctgctcaatcgtttgattctcgctccgcacattgacacgtgtgatgaagtcaacgagatcatgatggcgaatgtgccaggtcaagtgcgggaatacttgtccacggataagcccctagacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttttggaagaacttggcgatgatcgcctcattggtcgtgttatcaatagcaatgctattggcggccaa

SEQ ID NO: 57033 - DNA, 1102 bp, Heterodera glycines
  Genomic contig location: Contig_ID=SeqID_26285; Location=167..1268; Strand=+
  SCN-specific regions: Sequence locations=1-219,243-290,312-752,774 -1102
aggtggagagaatagtcaatgagagaccaatcacttacacttcccaatctgaagttattcagcccctaagacctattgatctaattttacccaacattggtaacaatagattggaaataaacactagatctgttgagaactcagacaatgattatattttggaaaattcaaacactgctaatgtagtgcaaagataccagaaggcaatgaatatggctgaaaaattttggcaaaattggaaagattcctatttattgggtctaagggaacgtcatcaagggaacaaacacacaccaggaaaagcaccaaaacttggggacgtggtgatcatttctgaaccacaaactccaagaaattgttggaaattggggaaaatagaagaaattatgtcacaacgaactgcaagagtcagaatttcggaaaaatcaattattgaacgtgctattaagcacttatatcccttagaattagccgaaaatgccaataattctgactctggcattagaaagcaggaacacagttctgtgaaacaaattcattataattgggcaaaggaacctcctcaaaataaggcgcttgttaaggaaaattccccaaatcactacagatgggcaaaacaaccaccgaaaacaataaatgatataactaatgtgacatgtatttcagaaatgaacaaagacttcgatgccgtgtctcttgattgtgaagagatggaaagagatctcgaggacgaaaacaaggaggaagaatcgaaggatgagagaaagggcatttcacaaattcctgttgaggaaaggcgccccagggatggcgttggagaaaaaagggttattattaacgctcccatcgcattcgtcggggatgacgaagtggaaccaattggacggacattccaagacaacgggctccgtgccctagttctggtgcactcactaagggacattgcctggtggcatcggttaccagaggtcgtcatcattaatgatgtttgtcagatggtcgtcgtgcggacaacggaatgggccgagcacatcagaccatttttgagccttttgggaagatgggccaaaccggcggtctggattggtagtccatacatgtt

SEQ ID NO: 57034 - DNA, 434 bp, Heterodera glycines
  Genomic contig location: Contig_ID=SeqID_26285; Location=900..1333; Strand=-
  SCN-specific regions: Sequence locations=1-394,416-434
cataaacacaagtctgtgatgtcaagttctactgtctgtgccggtccagccaggcgacgcctcacaacatgtatggactaccaatccagaccgccggtttggcccatcttcccaaaaggctcaaaaatggtctgatgtgctcggcccattccgttgtccgcacgacgaccatctgacaaacatcattaatgatgacgacctctggtaaccgatgccaccaggcaatgtcccttagtgagtgcaccagaactagggcacggagcccgttgtcttggaatgtccgtccaattggttccacttcgtcatccccgacgaatgcgatgggagcgttaataataacccttttttctccaacgccatccctggggcgcctttcctcaacaggaatttgtgaaatgccctttctctcatccttcgattcttcctccttgttt

SEQ ID NO: 57035 - DNA, 1103 bp, Heterodera glycines
  Genomic contig location: Contig_ID=SeqID_26286; Location=418..1520; Strand=-
  SCN-specific regions: Sequence locations=1-29,61-303,325-514,544 -690,734-1103
gatttaatcgaaatggattaaaagtcggcaaaatttaaatattaataaatgtaataatatgtagtgattaagtatatttgtgaacttgtccaagaagacgtcgagcggaaaactggcaagagtggagctcttccaacagagctccaagttttggccacattgggatatttggcatcttcgtcgtttcaattatggtgcggagacattttgggaattcaccaagcatcagtctcgcgtgccattttccgtgtaacaagagctttatgccgaaaggccggcgatttcatatattttgatgattacgaaaatgtacagtaatttgtgtaacttttttgataattaaagagtttaggcacgtttgtgctctattcccgcttttaatgcggtggcaggaatgccgaacgttatcggtctgatcgactgtacacatatcccgattttgatgccctctgaagtgcggcatggtcgggattattacaatcgcaaaggatggcccagcataaatgcccaaggcaaaaaaagaaataaaataaaaataaaaatgaggattttagccattgtcgaccataatggacgctttttaaatataaattgcaaatggccagggagcactcatgacagctttattttgcggcactcaagtgtttggcaagattttgaaagcaggcggttgcgtggtgtcttgctgggtaataaaattatttcaattttcttctatcatcaaatattttttaggtgatagtggttatccctgtaaaaaatggcttttaaccccatttgctaatcccatcaataattcacaacaacagtataacaatgcccacagcaaaacgcgtgtgattattgaacaaacatttggcaggtggaaacgaagatttcattcgcttcaaacaccaataagaattaaattggaaaacattggcatgttcataattgccgcggccattttacataatattgcactcatgaaagggattcccgaatttgatcaagaagaatttgttgatgatcagccggaaaacgatgatcgtgtagtaataggtgaagatatcatcagtgatggttttgcagttagggcaaatattgcccaaaattacttttaa

SEQ ID NO: 57036 - DNA, 1525 bp, Heterodera glycines
  Genomic contig location: Contig_ID=SeqID_26287; Location=114..1638; Strand=+
  SCN-specific regions: Sequence locations=1-144,166-166,188-968,990 -1078,1100-1354,1376-1525
cattcaacaattaaaatggaatttttctctccatcgagccgtttttttgaaccaaatggaagaggtcgagaagaatttggcggatgtgaagaagaaggatgtgcatggcaacacgtcagttttaagataaataacaaaatcgaaataattatttccatttttaagcgcacttcacatcgcttgtatgcttggcaatgaaggtagccaatgtgtactgcgtttacagtattattcgatgtatttttattttacagaaattgcgcgcattttgttggagaagggcgccaaagtgcgggcgaggaacaatgccgaatggaacgcattggacgaagccatcgcgtatggcgacgttgaattaggtgggataatttcacttatcaaaactcaccgaaaaccggaccaccgacaaattgacgcggcatcgacccttccgacacgccatttcattccctcgaagcggcaccaacccttttccgacgcggcattgtcccaaaatggcacggaatttccccgaagcgtcaacgacctgtccctcccccgacgcggaaccgaccctcccgacgtggcatgtcccgaagcggcacgaccatttcagggttttccccatcccctcgtttaatttgagcaggaaaatgcaccaactcacactcactcacccgacgaccaaaccccacagctttaaaaattaaaaaacaaaaaatgacatttttgtttgtaatttttagcatttaataaatcatatataattttattgaattttcagttcaaacggtccacagcatatttcaagcacaaaccaaaatcgcaatgttggacaccgcgcgaaaatttaacgcaaatttgccaggaatgggcgattttagcatcgacataaaatgggtaattagcaattttaatacttaaaaaaaatccaatctcaaacctcaaattttacaggaactgaccacactgttgcgtaatatttttcctttaaatataacataatttttgacacaacctatcttcaagcactgccatctcgtttgcgccctgaagataccatcactgtacacaaaaaaggagaaaagttgcgcgtcaatttttccctcaaggaatttgacatcacaactttcaaatggtaatttcatttgctaattcgtcggggttggagcttcataatttcttttttggaggattgcaaaatgatagttttaaagattaatttgagatcccttggtattgtttaaagaaccttttgtttattaatgtttttcaattcaaaataatttctaggcaacggggcgacatgactttgctgctggacatccacaaggatgagaaagcagtattgttggacaatattgagaaggtgaattttgccaaatttctcaaaattaaccattatttctagaaatattgcgtttttcgaacggaggaagtgttgccgcagcagcttctgacggagaagaagatcaccaaataccatttgaacgccaaccaactggacttcaagagggcaaaaacactgctaaaccatgagaaaacg

SEQ ID NO: 57037 - DNA, 1816 bp, Heterodera glycines
  Genomic contig location: Contig_ID=SeqID_26291; Location=115..1930; Strand=+
  SCN-specific regions: Sequence locations=1-85,108-318,340-794,816 -925,948-1816
  Gene Ontology: Biological process=carbohydrate metabolism
atggatagcgcacagagcgggcattcgaatattcgcaacgggaggcatcgggggagtgcaccgtggaggttgttgaatgcattttgaatcttccaaaataaccattttttaagacagccaagacgtgagcgccgatctgacagaattgggccgaacgccgctgggcgttgtctgtgcgggcgttaagtccatcctggacattgaacgaacgttggaatatttggtagggagcaaaacgacagggaccgagcatcggcagcagaacaattactgatctgacattccattttcaggagacccaatcagtcaatgtggtcgttctggacaaaagtgcggtctttcccggcttttttggtcctcccactgcaattaaaggcccttatcacaccgattcattggataaagtggccgacattttgcgtacgtccattttgtggcatcattatttaattctaccaattttatcagttctgtccttccaaatgggcctcccaaatggcactcttatcgcatgtccactcactgacgatgccgttgacaagcggttagtcgacgaaagaaatgtaattgcggaagcgactaaaatggcactgaaagaggccgaagaagcaggcatcagaggcaaggaggtgacaccgtttgtgctggagagaatccgtcaacgggcgggaaaagccgcaacagaactcagtgagcgaacgcacaaataattacgagaatatgcgtcctttctcctcacttaaacagctttcagatatcgctttactcgaaaacaacgcccgaattgctgcccgcttggctttgctttgctccagcaagacattacccgccggcattgaaaagcagcccttgataacagccggccagcaaaactcgtccagtcaatgcgaaaacggtggcacagtgaaaaaacgccgtcccaaaattgtcagttttgtcatgtctgctcatttccactgctgacaatggtatcatattaaaggtgtgtgccggtgcctctgtcgttgatgtctctgtgtttcttgaccaaagttccgttccgccgcttggcccagccgccgtcggcacttatcttccggcgcggatcattcaaacaagtggtggggtggcgcggaaccatgcggacgcactgagtcggttgggatgcgacgtgacactcatttcggcattgggcacaacgacggaaagaaatagcggcggcggtgaagagtcacggaacgatacagtggatctttatggacgctttttgatggaaaaatgcgatcacattgtttgtctttataatcataaaccgttaagaattgcaaaatttgtttaggattggtcccatgtacgccactgtccgggcacagcgactgccagttcagttgggatttgttcaaagggcacaatcatttcgcaggcattcattgcggtggaaccaattatggagcgcatagatgagaaatatgtatgaattaatgacatgattggtttgtccgaacctttttagattcggtcaatggaggcacacattgccaatgccgactttttgctggtggatgccaatatgaacagcggggcattacggatagcggtcgaattggcacgcttgaacggtgtcaaaggtactcaaactgaaagccaatttagggggggggtatctacgaccaaaagaaaagtgtctcttatcgcctatagtttggttcgaaccgacaaattggaccaaggtgccgaggctgttcgaagcgcttggcaaaaatgctctgcacaaagtgagtgccatatcgccgaacctgaacgaactggaggaagtggtgcgacggttgaacgatga

SEQ ID NO: 57038 - DNA, 245 bp, Heterodera glycines
  Genomic contig location: Contig_ID=SeqID_26292; Location=194..438; Strand=+
  SCN-specific regions: Sequence locations=1-215,237-245
atggagaaggcctgcaaaatttggagagattatatcgattttagtgcgctaggttcgatgaactttttaaatataagcctaaaatttttggcctgtttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaata

SEQ ID NO: 57039 - DNA, 184 bp, Heterodera glycines
  Genomic contig location: Contig_ID=SeqID_26292; Location=861..1044; Strand=+
  SCN-specific regions: Sequence locations=1-184
atggagaaggcctgcaaaatttggagagattatatcgattttagtgcgctaggttcgatgaaactttttaaaatataagcctaaactttttggcctgtttaaaaagcaattaaaaatttttagattttttattcatctccctttttgatagtgaaagcatctgagtgccttatttaactttcaa

SEQ ID NO: 57040 - DNA, 2647 bp, Heterodera glycines
  Genomic contig location: Contig_ID=SeqID_5135; Location=376..3022; Strand=-
  SCN-specific regions: Sequence locations=1-118,140-298,320-1074,1105 -1176,1198-1198,1352-1510,1533-1673,1698-1717,1739-1782,1806 -2300,2322-2338,2360-2510,2532-2538,2560-2647
  Gene Ontology: Biological process=N-linked glycosylation
atgaaagagcagaggaaccttttgctccgtttggatgttgaatttgaaaaggccaaactccaaaaagccaccgaagcaaggggtaatttaatttgaaagtgccattctcgtcttcctttttcaggagcatcttttccatttccaattaactcgtcaagcgattttttggactgggaatacgacgacagttgggacagagaacgttacaaggacatttctccgttcgtttctccgccgcaatcgccgcccaaaatcgtagaagagacagaagacgaaatgactgactacggagagaccgaccaaaaggagggacaaaggggattcgtagaagaggagtacgaaacagcaccagccaaaattggcaacattcgtctgacattgccgaaatatgcggcgctggagaacggcacgacgaatggacaaagcgatgcgcaacattcgccaaacgacggacaaagtgaacataacgacgaggaattggagcagtcccagcggatgaacaccgagagcagggaagaagacgagaaggtaatgaacaaagcggacggaggggaaatcagtcccggttccaaaacatgaacaatttttaaggaccatgaaatcaacccagaacattttccaaaaaatagttcggcatttactctaacaattaatttaggatgtaatttgttctccatcaaacgaactgaaagtgacccaacagtcgccggatgagcttgtctctgtctccgtgcattcatttgctccctctgcaacaccccagcatttcccttttgaaacgacaacgacattaccatcggcagaattttcgtccgacccattggttccgtcgctcacctcagagattcttctcaatgagtttttacgccaaaatgttacgatgtcctcctcgtcaaattgcgacaataaaccgttggaaaatgacggcaacaattcagttgtcaatgccatgacgaagtcacttttgtgtactcatgaaaatggcgcagaaattaaattgaatgatcagcaagagagttcaaaagaggagtttcgggaaagggtcatgaaagtaagaaatttaacgaatgcaataattatttacaaattgctaaattttcaggaaaaggaacaacgagaagtaaataaggaaccagtaaaactgaaaattaaattggacaaaatgaatattaacaaggtggaggagagaaatgcccatgaaaacggaaatgaagaaaaaaaggatggacgagaaaagaaagaaagggaagaaatgatgagaaaatcggaaaagaaacgacggaaggcggagaaaaaggagaaaaagaaacaggcaaagttggaggagcggatgaagaaggaacgagaggaattaaataagtgcgaaccgcagccaagcccatcgtccgtacacctccaaaacgacgaccgaatgcctacccaatcgctgaaaatttcactgagtcgtttggcttgttggacagggacgaacaacgtaacgccggagtacagctcgaatttgggcggccatggctttcattccaacaaagaaagtgtggatttgacaaatggacactcaacaccaaaaaactgtcaaataaagccggaaaacggaggcggcgaccctttgaaattgcgcttgattctgaatagaggaggaaatagcagcgtggaggtgaaatcgacggaacacagaaagaaaagcaggaaaaggaaaagtcacgaggagaagccaaaaccaccggaagaacaggaagaggcgccaccgaaagtgccaaggctaaaaatacgatttggaactgggaacaatgaggaaaagattgaaacgaacgcacagccaaagactgaaccaagtcaatgtgagtgactcacaaaagtgtcttttccgaaggaaatgttttttagacttacccctaaaaagaggagaattttccgggaaaaccggcgagcaaattgaggaaccagaacaaattcaacagaactctctcagtccgccagaattttattgcagcaacgacaacaatcgaatccaattctctccatgttgttctggtagcgtttgtttttgttttttgtggtttatgaaactttaattacgcttatttttcagaggaatctgatgacgacgaactcagaaataggacaaacgaactcttctcaaaattgtgccaagattagttagcatctaaaacattgattcatcgcaggaaagttaataatccaaagtttttcccaaaagcatttcgataactcacttaacgggttttgcatttgttaatttacattttctgtcatttaagtagcgccgatatcccttgtccatattttcatttgtttatacctaatttaaagttcactcacattgtcgaaattgtggagttgaatttagaataatgaattaagtcttactcaagcattgttgcgcagtttaaacatattttggtttccgtccccgtgctttttttgcccaaacaagtggctgattttacagtgttaatttgtaatctcattgtcaatgtctattacagctcttctcattttcgatgatttcccatttaattgcctcaaactttttaactgtgaaatactaattatgtgtttatgcataaaatataatatgaccgtgccatttgtttaatacttaatttatgggctgttggataataaa

SEQ ID NO: 57041 - DNA, 155 bp, Heterodera glycines
  Genomic contig location: Contig_ID=SeqID_26293; Location=9..163; Strand=-
  SCN-specific regions: Sequence locations=1-155
atgattgcacgtattgccgaaaaaattcgagaccaatttccgaatgttgaccgactaattgcaaaacgaaagccgtctttgtcaaagcgccttaccgagtcaaaaaatttggaaatgtatcacagatgcaatttcaaccaaccaaatttgaagaa

SEQ ID NO: 57042 - DNA, 570 bp, Heterodera glycines
  Genomic contig location: Contig_ID=SeqID_26295; Location=278..847; Strand=+
  SCN-specific regions: Sequence locations=1-331,354-426,448-570
atccgtgaaaagcagtgcggtgacaaaaatgtttttccgctgaacaaatggctccttcttccacgcaaccacaaagagcatcttccgttttatcttttaatttataattatgaaaggaaggaacgaattatgatttgattaaaaagttaaatggcaaattgagtttttattagcgtcgtcaatttcgtgagctaattatgtctttgttcgtccccggggttaaggcgcaaaagggagctggaatgagcaagtttgaagtgtatgctcttgatcagtcggttagtttctaatcaggcaaaataagttttataaattaatttgccgaaattagtaaatattcaaatataaaaaatagcggtaagacttggactcagcccacccgaaaaaatgacatgaatttgttataaaactgcttaatattgaatattattcacaaaaatgtatgaaaaagtgacgatatatagcgaaaatttttatcaacatttgaaatttttcaaaaaaacgtcatttttgagtgaatttatcaagaaatatgctgttatacatctatttaatactgtatttttagca

SEQ ID NO: 57043 - DNA, 1276 bp, Heterodera glycines
  Genomic contig location: Contig_ID=SeqID_26297; Location=228..1503; Strand=-
  SCN-specific regions: Sequence locations=1-131,177-290,312-350,407 -463,489-582,605-913,944-1136,1199-1276
atgtacggcataaaattctcacatgcggcaccttattgcgaaattttggcaaatgtcgtctcgaataccaaaacgccatttatgattagcattgaggtgaaaggcgcaaaaaaaattgaaattttgctacgatattttttaaaattttaattattgtttattaaaatgataattatgaatcactacttttaatataacaacgtaaaattataaattaaatcccaaatcattcaattaaattttatttaaacgtaaattttaaatttgtctatgtttttaagcttcccgatggacagcagacagaaaaactggttttcgaagagccgggagccaaaaatgttattgtaagcaaaatattaattaagttttttaaaaattaattaaacaaattaaataattttttttagttaaagggcaataattgtgcaagcaaacattggcaattgaacacttttaggtggcattttaatttaattcaattttttgttacaaaattttgtctttacacagaagagatgaaaatggccagtggcaattggcgaaggaggtaaatttatcgaaaattttctcataatttcattgtttatcgagtgccattttatttaaacttcgacttttttcgttttgatttaatccctgagacattttgaaaattctgaagatattcagtagaaagccgacagatttagaacttaaatatccgccttcattttcattggatcaaaattaatctgtaaatctctcactgtgccattttcctatagatttgacaaatccacgagagataaccgcttgaatacattaaaatgagtgttattccgagaatttcttgagtcaaaattcccgaattaaccatccacatttatgccgcattcatgtcaaaattcccgaattaaccatccacatttatgccgcattcattgttttgttttctcccgtttcagagcaaggccaaattggacggcgcgggtggccaaatgacgctgaaggtggaggacgcgttgcagccgcgcgttgccggccgtcttgccgtgtcgtgctcggaaagtgccatttgcgggggcggcccattgtcgggcaatgccggcggcgatggactaatgacatggggatagaagaaaatcaaaatcttttagtataattatttttgtaattaattatttaaatttgatttcatttgtaatttttctttaaaaatgttatgttattcgtgcaggaacaaaagtcaaattatttaactcataacaatttcgctaattttactttgtttaataaa

SEQ ID NO: 57044 - DNA, 1445 bp, Heterodera glycines
  misc_feature (1355)..(1357): n is a, c, g, or t
  misc_feature (1375)..(1375): n is a, c, g, or t
  misc_feature (1380)..(1381): n is a, c, g, or t
  Genomic contig location: Contig_ID=SeqID_26298; Location=8..1452; Strand=-
  SCN-specific regions: Sequence locations=1-666,703-710,871-1193,1216 -1239,1354-1422
atgccaaacacggggatggaaaatgggctgaaaaaggggtggcaaatgttggaaaaatatggcaaatttcggagggatgccatgtgcgatcggattgatcagatcagagccacgtggcaagacgacggcactcaaacggcggaagagcaaaaatggtagggcaaaaagagggtttggggataaatggtgggcggtagactgattggaggatcgatcaatgatcaaatctgggagggactgatcggcgggttgaccccgtcaaaagggggggggggagaggggaaaatggccgatcagtagccatataaacggtggaagtgatcggtggatcggtctatggcttaagtcttttgatcacgggtctttatatatttttgattttgtcaaattaatggccaaaaatggtgacaaaacggcgatcacttcctatttgttttaatataaataaagtcaaaatgccaaaaaaccttttcaggcttctaaaatttgacgaagaaattgagaaactgcatttacatcgccttcaccaattgatcagttgggaagtgccaaattcaaagccgaaactagcggaattattccatatgaaacgtctggagggggagaacgtatttgcatacagattgagaatgattggattggccagcttagaagaagcagatcaaatgagaagacaggtgagagaaacagagacagagaaaaatatacgtgagagagagaggggagagagaaagagatagtatgagagagtgagaaaggggaggggaggagagagagagcgagagaaagatagagaacgctagaagaagagaaagaatgagacagagagaaatatagagagtgagagagagatagagagcgagagagagatagtatgataatgactcgagctctagggtactcgaaaagtatcaaaggaggattgagactgggtttccgagactctacacggtacgaaaaatcttttcacgcgtcaaaagccgacccgaaacccgagactctcgaatagcaataaaatttaatttgacttttatcacattcaaattaggcttattaatcgtctattttgcctcctttcttttttctgttcagattcatcagagactgccagaattggttggaggagaaaagcaaagggttaacgaattaatggaaacgttgtcaattcgtttgagtggaaatggtaagcatcaaattaagttttgctcaaataaagcgaactctttttaacgcaaaaacaatttttattttttatttactttatattttcattaaacaaaacttattttattttaatttaaaaaattatgattttcaatatttttttagtaattaaaaagaaaatttattattgnnntgtttactctcatattanaattnncattatttgtccatttgttttttattttcccatttttacgcaattttaattttaatttaataaa

SEQ ID NO: 57045 - DNA, 1136 bp, Heterodera glycines
  Genomic contig location: Contig_ID=SeqID_26300; Location=119..1254; Strand=-
  SCN-specific regions: Sequence locations=1-192,216-823,845-976,1003 -1085,1128-1136
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcacattctgggaaaactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 57046 - DNA, 1759 bp, Heterodera glycines
  Genomic contig location: Contig_ID=SeqID_26301; Location=74..1832; Strand=+
  SCN-specific regions: Sequence locations=1-195,217-695,717-829,970 -1427,1449-1452,1526-1759
  Gene Ontology: Mol. function=protein binding; Cellular component =integral to plasma membrane; Biological process=signal transduction
atggcttttcctttttcagtcacttctcgcgcaccaaaagcaggcgaacagcaggggcgcgagtacaagtttgagcgcaaggaggacattctgcaacgcattcgtgatcgccaaatgatcgaatggggcgaatataatggtaaaaaaaattatgaaattgcttattttaatatcattcgacatccctaaatgttctctattagcccctaaaatttcgttaaatttaaaaaaaagttatggaccaataatgttcgaaaacaaggttttcgagtttttctggcaaataacttttttgaaacgcaataaaaatttttgaaattttgcagactcatagagaattcttcatgttatcgaatggatatgaagaattaaaaaaatttggttattcttgaacaaacttatgaataatttttcaacacaattttttccatttgatgatttttttcggtaacgtactaaccccaaaaaattgaaaaaaaattttctttcaggtgctttgtatgggacaacagcagagtccgtccgtgaggtggtccgatcgggacgcgtttgtgtgttggactgtagcgcgcgagcattagaaactctttacaattcagagtaagggcacagtcttcatcatttaatcacaaataccaggctcatgtcatattcgtaagaagtgtttcagagaaaatgccatagaattcatggaatttaaaaaataacaattttttcactccaattctcctaataagatttttttaagaatttaagactgattaaaaggctcaaccttcaatttatcaaaaaagaattttgttaaatttgacttaagaaaaattatcactaaaaatttaaaaaaaaaattttaaatttccaatttaaaaattaaaaaaaaaacacaaacacaaaaaataaataaattttaaattagacacttataaaaactgattaaattaaaaattatgaaaattatcaaatttaaaactgtcatgaataggatctgttttttctttatcaatactttatcaacaataataatcagatttatgccatttgttgtgcttgtggcggcaccgccctttgaagaattggtgcagctgagtcggctgcatgggaagccgcgcgaggaggacgaactgcgccgaatctgtgatcagtctgatcagttgttccacagtgattatgccaaatgctttgatctggtgctggtcaaccggaaccgggacatttcattgcggaggtacggtaaattgggcgaaatgataaaaaaaaaatagaagaaaatggtagctacggtaattaggcataacaatacaaaagaaaccaagtttgaatgatggtaagggcagcaatttaaaaaaattgagatatgatacctaattcaattacaataaacaacacaataggagctacggtaattaggcctaccaagacaacaatgcaactttgagagatggtgaaggcaccaataaaaataaataaaattgttgaatcatagtttaattatgtcattttttattgaaaaatatttatatttattggacacaatttcaattgacatttctgtaaatctagttttgtgaaaagttacagcattatggatatggtaaaataaaattaatcaattcgaacatacagtatctgctgtccttcgttcgctattaatcgtatccatcaaaggttgttggacgcgttggaagcactgaaaaccgaaccacaatgggtgccgttggaatggcttcagggtagtgccaatgtgaagtcgaaaagctag

SEQ ID NO: 57047 - DNA, 438 bp, Heterodera glycines
  Genomic contig location: Contig_ID=SeqID_26302; Location=561..998; Strand=+
  SCN-specific regions: Sequence locations=1-1,24-160,190-325,355-438
aaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaattgggcctagttaagctgtaaaaaaaatttggggcgatttgaaagaga

SEQ ID NO: 57048 - DNA, 1372 bp, Heterodera glycines
  Genomic contig location: Contig_ID=SeqID_5136; Location=1..1372; Strand=-
  SCN-specific regions: Sequence locations=1-10,40-215,246-548,605 -614,912-925,1061-1064,1086-1086,1256-1372
  Gene Ontology: Biological process=reproduction
aaaatttgagttaaaaaaactaatttttttaataaatttcttagctacattttgcctgggaaaaatcggctgacggttcatctgaaaaacaaatggctgatccgacaacgaaaacgatggagtcaggtgagtaaaaatgagaaaaaaaaattcaaagccacgcgaaaattggtaaaatttaggggaaaaaaaaatttaaaaattctaagtccaagaaataagcaaaaatatttttctcttattttattcccttttaattctctttcggaaaattcgaattatttctgaaaattatacaaaaaaattcaaagcccctcgaaaatttcaactggttagaaaatttgaaaaattcttttaaaccgaacccacaagaaaaattttcagaaaatttttggctattttttttggaaatttttacaggtgatgtatttgtactatttgctcggctatcggcttgccatgcgagtgcatgagaatcgaaggcgagagctgttgtccgagaacacgttcatcttgacgcttgacggtgacgtggactttcaggcaacaaataaataattttttattatttatgtaatattttattataatttaattaattattcaaatcctcgttttaaaatttctaaaattaaattaaattattttatttttttgatttatttgattttacattttaactatacgaaaaatttattatttatataataattcattttgttttaaaagaattttatctaattatattatctaattttggtttttatttaaatggttaagtaaaatatcatttattatttaaatattaaattatttctttaaatcatttaaaataatatagatttaaaaaaggctttatcttttatttaataaaattaaaaattatttaaatatttttgaatttttattttcatctgacgaaaacaaatttaaatttaattgtaatttttagcttattcaaattttactttttaaatcactatgaaaaattgattattataaatgaatgctttttttttaattcctaattatttttaattaagtttgtttttatttaattggggaaattaattaccaataattaccatttattattttttattagatatatttctttaaaatatatatatatatatatatatatatatatatatatatatatatatataataaatggattttaaaaatgttttattttttatttaataaaattttaacatttatttaaatgggtttttatttaaattttttatttgacaaaaagtaatttaattacactttaatcggaatataaaattaattaatcaaggcatttttcattaaattttaagttagccaattttacaatacatacctttttaatttcgtcttt

SEQ ID NO: 57049 - DNA, 1229 bp, Heterodera glycines
  Genomic contig location: Contig_ID=SeqID_5138; Location=61..1289; Strand=-
  SCN-specific regions: Sequence locations=1-70,92-269,308-483,525 -996,1032-1116,1150-1229
  Gene Ontology: Biological process=reproduction
atggcactgatgacggggagagcagtgtgcgcacctatgagtccaccgccatctctgactatctggtggagcgcggtggtgggcccgccggtggtggcatggcgtcgcgtaaagtgccgtcattgtgcagcagccaactgaccgccggcagcgggaggcccgactgcggggggctgatacggtagcgctgagtttgcgatgcaactttttatatttatgaattttatgaaaaaatgaagaaaattgactaagaaacctaggaatttttctggaaaaatcttaggaatttaagaaattttttaaaattttccagtgattattgtgaaaatttttttaaaaaacttagtaattcatatataaattttgaaaaacccttttctttctcgagtttttcttttaatgcaatttctaagattttttcttgaaaatttctatccctcaagagcgagacaaaatctcgggactcaaaaaattgcgctttacaatttatgaattttcaaaatttaaatatatatattttttttgccagggagcagccgagcgccgctgatgccatttgcaaaatttatgtgtgcgcaacaatgtggcatgaaagtgcactggagatgacgtgcatgctgaagtccattctgcgtcttgacgaagtgaatgaatattatttgctgatggggatcatatccgtgggaactctatatatcccatccatgaatatgcatatgcattgcctgtccaaagatacaagctataggaatacaaaattgggtccgatgatataaacggaaatcaaaacctataaactataaattatgtgtatacccaggcgatatactcgggaatattcgtatatgtttctatgcatatatttatatcacggaatgtaatattggatggcttaaatttggttatatatatagtatagatgactattcttttatggtgctgtgacgaagtgacaaaagtctgaatgtgggcgaagtgacaaaagtctgatgtttgtaataattaaatttaattattattttaattaaattggctaaataattaatcataacttagcttaaacctagtcaaattaatgaaatttagtatttagcgacagctcaaagtaccctctactatttatgtaattttttaaaaattttgcataaatttacaaaaagtgtaaccaaaaaagtacgaaaaattttgacttaacaattttaaccctaactttattgaagttcaataaa

SEQ ID NO: 57050 - DNA, 1272 bp, Heterodera glycines
  Genomic contig location: Contig_ID=SeqID_5139; Location=64..1335; Strand=-
  SCN-specific regions: Sequence locations=1-74,97-117,221-436,467 -581,607-609,906-1272
  Gene Ontology: Biological process=reproduction
atggccaagcagcggcacattggcccacacaaaaaggcatatcgccgggtggaaaagcgtgcaccaaaaatgcaggagcaggcaggagaggaggagatcatttcggcatacaatgtgaaaattattttcaaaaaatttttagaaaattatcgaaattttaatttaaagcaaaaaatttaaattttgaaatttgggtatatatttttttgtttattaatttcaaatctctaaaaattttccaccagatttacgatgatcgcgtggagttgaatcagttcaccacggcgtacgacgcgctgtggcttgcactgttccaagttgcgtgcgcactgctatgccatttcagcgccaagtttgcatgcaaagtaagtaatcaagtaagccattctcacgaaggcataacggcacagttggtttttgagaatttttagctaagtattattatttttttttgaaaaaatattttggcacaggttgtgatgcaacgcgttggcatggcgtttccgatgatgctcagcggcccgctcagcgtgtttcttctcgcgcatgcgtgcgaaaggtcagcaaattagaacgttgtgtatttaattaaatatttattattttgcgaatttatattttaaaaataaatattttttgaaaatgttatttcttattaaaatatttataacaatttaaaatataaaaatttattatgttataaatttcataattttaaaaataatttaaaaattttaatttttattaaaataatatttaataatttaaaatataaaaattattaatttgcaaattttataattaaaaaaacataatttaataattttaatttattattaataattttttaatcatttaaatttttaataatttaaaatttttattattaaataaaaaaataataagaatttcagtcatacacaaaacgcgtgctatatgaacgattggctaagtaaggagctgttctggaaatgcccggaccagtaagtgccattaaaagcgccaaattaaattgttggcattttccccataaaatttagggctttccattggcaattttggacagaccctgcgatgctgctttggctcagctggtggttggcacaatgctggtcagtttatatatgagaaaaatgtgcaaatttttttttatagattaatgtaaggaatttttgaaaattttcgattttttagaaattttagtgaaaattttaagttttgccagcgtttatggccactgccagattcaaactccctttgtttttaaataaa

SEQ ID NO: 57051 - DNA, 819 bp, Heterodera glycines
  Genomic contig location: Contig_ID=SeqID_26303; Location=8..826; Strand=-
  SCN-specific regions: Sequence locations=1-108,130-819
atggctgagaagcttaaacgagctaaagttcgactcgagttttctgagaaaatgttctatgaaagagcactcaccgaatggagagacaaaatattaaaggacagtggtaataaaaatcacgcttttgttcttcggaaagcattatgcaatctcaaattgtttccgctcgacgtcaatggcttttcagacctaagaaaaatccgaggtgaatacataattttattaattgcaattaatgtcaatgagatgttaaaaatccaggaattggcgttgacattgcgacccgattgtcttcggcttggaaattcacatgcgctactcacttttgcacagaatcccctacaattggccaaataaagtctctgaaaagtggcgaggcttttgtgttagtcgagcaatcgtcaactgaaaacggtggacgagttcccttagtggcgggcgctaaacagcgaaaggcaattccaagtcaaattggccaacagcaaaagagtcaaacgaacggaaaacaaaaaggacaccattttgaaagtgcgttgaactttatgacatctttccaagcagtacagagttttttttctttcagcggctcccttagtacggtcaaattcgcaagaatgcgtagtcatgcataagtcggagtcattggaagtgatggactttgatcatttgctgaatgtttctgtttcacaaccagccatttcttcttttgcttttgaggtgtccactcaattgcaaccaattcaaaccaatttaattcccttttccatgtttagaattgtcggccaaaaagagcaatgtctcctccgcccacttcaagca

SEQ ID NO: 57052 - DNA, 1378 bp, Heterodera glycines
  Genomic contig location: Contig_ID=SeqID_26304; Location=126..1503; Strand=-
  SCN-specific regions: Sequence locations=1-292,314-320,355-564,587 -717,741-1378
gaattggtcggtgatacgcaccagcaacacatggtccgaactgtgactgctgtcacatcgctacacattctgttgtttgcagggcctgtccgaatggacctcaaatgcgtgaaatattttgaacttggtaaatttttttgtttttcttttttgatttttgaattgatttccttatttagtggatccaaacggttctctccggcaacaaaggaaattgtttcgcgataaaattcttcgaaagcaccggaaagaacaacgaaatttggagagagaacttcgacgaagacatcgcaaacaattggagcaaagaaacttaatggagcagaatttggaagagcaaaacaaaaagaaacagcttggaaaaagacaacggggggaggagagtgaaaagtgtcggcagacggacgggagggcacagaacgccacagacacaaaaagcgattggaatgacagcggacactcattggagaagagagaacagtggcagacgtcgacagacagtaggcagagaaagaaacgggaagagaacgaggagattggcggtaattattccctaaatgactctttccttttcaaattatatttttatagagtccagtgccacgagcagcagtgatgactcattcgactcttttcctgcggccaattccgccatggcaacaccgtcttcactgagctcaaggtaaagtcgcaaatgaccagtaatgagggacgatttaattatttgaaaatataggaaatttagtgcactcagcagtttggaaccggaactggcagaacaattgcccgaatacatgcgcagttttacaaaatcggagcccgaagaaccatacgaactgcttgaactcgacaattggtttgggttccgtggatctttcagcgatttacaggtctttacacctaacagtaaaaaaaatagtattcttgaatcaatgaatttaccactattagccatttctaattttcaataagaattgttgtgttcgtagatgacggtgaagttgcgctttcgtctcatggattatttgacgcgcgttctctcccattcggtcaacttcgaactatcgcccgaggacagggtatgacaaattatggccaagattagcaaaaaaaaaaaaatcaaaaaaatatcattccagcgtcttctcgactgtttgaacgaaactcttacagcggcgcatcgatcacaaaagtttgccaaagtcaacgatttgtgaagacaaagtgcgaatgacagaggaagttgccttaaaatcaggtgcaaaatgattttggatttaattactcgtaatacgtaatctgattttttaggtcgccatcaatgatggcttcatccgagatgatgaccgcttttaaaagagaatgtcattgcttgtct

SEQ ID NO: 57053 - DNA, 337 bp, Heterodera glycines
  Genomic contig location: Contig_ID=SeqID_26305; Location=276..612; Strand=+
  SCN-specific regions: Sequence locations=1-337
atgttttttttaaacatttttggttagaagtttctgaaaatttaatgaaatattcctaaaattttcatatttatagcgcaagtcgagagctatcgtgggatacaacgattattttttatgttgtatttaagaaaagttattactgatttttctcaaaaattctgtaaatttggcaaggtttttacgaggtcggatttacaaatatgtatgaaaaacgcattattcttctcaggcggaacttatgtataccttccgaaaatttttttttgcaccattcacagattttcttaacaaatctgaatgcgcgatataaccagcagagaccagaaatagacca

SEQ ID NO: 57054 - DNA, 697 bp, Heterodera glycines
  Genomic contig location: Contig_ID=SeqID_26307; Location=956..1652; Strand=+
  SCN-specific regions: Sequence locations=1-411,433-465,562-697
  Gene Ontology: Mol. function=peroxidase activity; Cellular component =integral to membrane; Biological process=thyroid hormone generation
gacggctataactttctgattggcccctacaccggctaccgtcctgacaccaatccgtccgtgtccaacgcgttcgccaccgccgcgttccgctttgggcatacgctgatcagcccacagctggagcgactggataaagcactccggccaacgcccgaggggcccctcccattgcacgaggcgttctttgcacccgagcgtctgcttgccgaagggggcgttgacccgttgctccggggcctgttcggcacaccgctgaagatgccaatgagtgatcaggtgatagatagaccacagaccgcatgagcaatgcctgttgaataaaatgcgattttaggcttttgaatcgcgtttttaaatatccttattttaaagccaaattcgtatttatggcagtgatttgcttattgggaagttttcagtggaagctctttgatagtaccacttttttaagagaaagatatcaataatttaatttttcaattaaggttttttaaacatttatttatactgtatttttaataaattcttttttttttgcaaatttttatttttaaaattgtattagccgaatgcatattaattttcagctattgaataaagaactgactgagaagctgtttcaccgtgcccacaatgtgtccctggacttagctgccctgaatatccaacggggccgtgaccatggcattccagg

SEQ ID NO: 57055 - DNA, 975 bp, Heterodera glycines
  Genomic contig location: Contig_ID=SeqID_26309; Location=295..1269; Strand=+
  SCN-specific regions: Sequence locations=1-681,705-754,777-975
  Gene Ontology: Mol. function=valine-tRNA ligase activity; Cellular component=intracellular; Biological process=translational elongation
atggtccgcgatgcccacgggcgaaaaatgagcaaatcgctgggcaatgtcatcgacccattagacgtgatccacggcattacgcttgagcaactgaacaagaagttggaggacggcaatttggacccgaagtaaaaaaagaaagaaaaatcgcaatagtgtctttgctcatcctccgcagggagttggaaacggcaaagcttggccaagcaagcgactacccccagggcatcccggagtgtggcacggacgcactgcgattcgcgttgatggcctacaccacgtaacaatggcactttgccataattgaaaaatgcattcgtttagccagggccgtgacattaatttggacgttctccgcgtgcagggctaccgcttcttctgcaacaaactttggcagggcacgcgcttcgttctcagtcggcttgggcccgactttattcccagcgatacgtttgaggtaaaaacggacaaagtgttggaaaaacaaatgccaacttttcccaatattctaattaatgccaattcttaaaataagtccaatttctgggttcaccaaagaagttggtctaattgtaagataactgatttttgtgttattttttggcaataaaacatgtctaaatggaataaaagacaaaaaagccgattagggcatccactcgttgattatttattttattgcaaaatgtttttgtttgttttaagccttccactttggcacttaatttggccgaccggtggcttctctcccgactgtcccattgtgtttctgaatgcgatgtcggcttccgcacttacaacttccggcagctgacttccgccattcaccacttttggatccacgaattctgcgacatttatttggagtcggtgaagagtattattgtcgttaacaatgccaacaaaaagggggcggacgcaattgcggaagagcgaagcaaaaacggcaccgatgaagtgacaacgcaaaag

SEQ ID NO: 57056 - DNA, 363 bp, Heterodera glycines
  Genomic contig location: Contig_ID=SeqID_26311; Location=705..1067; Strand=+
  SCN-specific regions: Sequence locations=1-363
atgattcacgtgttaattcacggtcatgtgcgtttaatttacagtcattattcagtgtcaatttacgggttaaatcacgtgtcaattcacggtcatgatttacgtgttaatttacggtcatgtaagtttaacttacagtcattattcacgtgtcaatttaggggttaattcacgtgacaattcacagtcatgatttacgtgttaattcaaaatcatgatttatgtgttaatttacggtaatgattcacatgttaattcccgggcatgtacgtttaatttacagtcattattcacgtgtcaatttacggcttaaagcacgtgtcaattcacggtcatgatttacttgtaaattcacgatcatga

SEQ ID NO: 57057 - DNA, 287 bp, Heterodera glycines
  Genomic contig location: Contig_ID=SeqID_26312; Location=673..959; Strand=-
  SCN-specific regions: Sequence locations=1-107,166-265
atgtttaaaaatctgattatttatgcatttcgcaatcacaactcttcaaaaagcacaaaaattcaagagaaggtttaatgattttttagataaaagataaaagctggttaaataaactaaaatatttatttgggtaatttttaaaaataagtaaaattatttattcttcagatgaaaatagaacataaacaacgacttcatccacccgaggaactgtgaaagaatgcgtatgggcgtcttcagcacgcgcgcgtaaattgtcattttaaaccaaaaagtaaaataaa

SEQ ID NO: 57058 - DNA, 387 bp, Heterodera glycines
  Genomic contig location: Contig_ID=SeqID_591; Location=207..593; Strand=+
  SCN-specific regions: Sequence locations=1-38,61-99,121-138,182 -248,276-324,356-387
tcggcacgacggtcaatcacatcactttgctcggcggtaaattgctgtggttcagttttatagatccagatgtaagtggtgaaagtgataagaatataattgtttttcatttctttttatgttctattttctaggctgtattttaaatttttaaaaaaagtatattttaaaattttattttcacctattttggcgttttgcacaaatttccttaacaaaaaagcaattcacccataataatggttcgaattttgaaaaatttattttttgtaaaattccttataattttgattcctttttctaacagcaaaaaaataagttaggttaaaatttaaattgaaattatttattttttccatgaaattggtgaatggactaaaaatgata

SEQ ID NO: 57059 - DNA, 771 bp, Heterodera glycines
  Genomic contig location: Contig_ID=SeqID_591; Location=888..1658; Strand=+
  SCN-specific regions: Sequence locations=1-771
atgaaagtaaaatatactctgggcaccgtaatcgacgaacatcatcccaatatggtgacacaaaattcggctaatcagcgcgccaatcataaagcggctgatgatcatgaaccactggacaaacagattcaactcaaattcaagatcacgatggattcgagaaacggaaagattggcgtagaatttcgactgaacggtcaacacattacaaaagacataaatggcactgtgcttacgtgctgtccagcagaattggtgccgtttgaagacatccaatacattacggtaattgagtacacattactgtaatgcaatacaggatggtaaatttattgcatacatcaagtaatcaaatacatatttgtaatccatcatattacggtaatcgaatacttttctataatccaatacaatatggtaatcaaatgcatactgtaacccagcaccttacggtattcgagctataaacataacaaacgaataccacattgcttttgatgatattgatgaatggagcccttttcccctctttttatttggcgctaaatcctaaccgattttgggtgatttttggggtccataaaaattcgcttttacatcccttttattataattgttttaggcgaaaagttttgacatggaattgtcccctgacacggatgtgcagatatattgtataccaccagagaaatgcattttaaagacttaatttatatggatggatggatatcaatcacactgtatttagataattggcatatgaattttcaa

SEQ ID NO: 57060 - DNA, 1955 bp, Heterodera glycines
  Genomic contig location: Contig_ID=SeqID_592; Location=58..2012; Strand=+
  SCN-specific regions: Sequence locations=1-219,278-284,307-862,886 -1012,1034-1191,1228-1553,1575-1955
atgcgctactattctctctacaaacgtgggatcattaccgaagacagatggaggtggattaaagaccgacagactactgttctccaacaaaaagtactacttttactccgagaggcagggatcccgacaactgaaccggaatacgacgcggaaatttacatccatcaagtgcaaggattgtggagcacaaaatatcccggtgattatttttaaaaaggcatttataaaaatttatttattttcaaatgaaaaatagatttatatttttacaaattttcaggcgaatataaaatttttattttcaatgattaccaaactcgtccaatcacaaaatcagacgtcaccgattaccaattccctattctgctctaccaccatgacaaacattttgacggcattaagacaatatcaaaattttggaacaaacgttactactgcctctcctgtgaatcagcattcagcaataaatcacaacactcaatgaactgcacatcactctgccacggttgccgggaggtgggcgtcgactatccatgcgaatcccaacaaggatacttcaaaaaatgcaaacattgtaacaataatttctacaacaacgactgctatgaacgacacctccacaaggatttgtgctcgaaatttcagcgctgcgaagattgtggagttatttacaacatcaaatatcacggaacaacaggtcaccaatgcggagaaaggttttgtcgtctatgtaagcagtttcatgtaaaagaggaagatggcgagaacccctgcaaaagctgcttcatacaaccgctgaaactacacaaaataaaaccataccgcattattgcatacgactttgaggcgacacaggacaagaaagtgggcaatcgtttcgaacacgaggttaactttgcagcggctaccatcatctgcaccgactgcatcaacaatggggaatggaaaaattcactgcttggaaaaaagtgtcaaatttgcggtccaaaccgcacaatcacattctcgccatttgactacacgaatacaaaagttgaccaaaaaatcatcactcaaaacccactgcgtgattttgttggatggctactcttcgatcacaacaaaaagttctcaacagttgcctttgcacactttgggggccgctacgacatgacgatgatcatcaaggaggttttagcgcaaggtataaacttaattttaaatttaaattaattctttttaaataaaggtattcacaaccctgaaatcatcaagcaaggaaatcgtctctacgagttaaaaatcaaggacaatgaacattgcccactcacaactctccacgacagctataatttaatgcccatcaaattatcagccctcataaaatcctttggtctcaaaattcaagttagttttatttttatcaattcttgttttaattattttacaaatttactttttaggacaaacaacattttccccacatgtttaataaagaggccaactacgacaacgtcctaccgcaccttccacctcgtgatgactactgccctaaacaaatgaaaaaacccgacctacaaaattttaacaactggtacaataacaactatgaacaaaaattcgacctcaaagaaaaactccccgaatactgctgcaatgacgtccatatcctcacccacgccctcatcgaactgcgccgggaattcaaacaactaacgcaacggaacggaaaacacggaggaatcgacattctttggcaagccatgaccatagccagcgcctgcgtcaaaaactatgcactcaaccatttgaaaccaaactcgcttgccatcgtccccgaaaagggctacactcctcaacaaaatcaaagtgcattggccatcaaatatctcgactggtactctcacaccaacaacgtcaacattcaaactgctcactcccggtacggcgaatatgtgttcaagcgcgaagggcag

SEQ ID NO: 57061 - DNA, 2363 bp, Heterodera glycines
  Genomic contig location: Contig_ID=SeqID_593; Location=773..3135; Strand=+
  SCN-specific regions: Sequence locations=1-233,255-671,693-1564,1586 -1909,1931-2247,2269-2363
gacagctataatttaatgcccatcaaattatcaggcctcataaaatcctttggtctcaaaattcaagttagttttatttttatcaattcttgttttaattattttacaaatttactttttaggacaaacaacattttccccacatgtttaataaagaggccaactacgacaacgtcctaccgcaccttccacctcgtgatgactactgccctaaacaaatgaaaaaacccgacctacaaaattttaacaactggtacaataacaactatgaacaaaaattcgacctcaaagaaaaactccccgaatactgctgcaatgacgtcaaaattctcacccacgccctcgtcgaattacgccgagaattcaaacaactaacacaacggaacggaaaacacggaggaatcgacattttgtggcaagcaatgaccatagccagcgcctgcgtcaaaaactatgcactcaaccatttgaaaccgaactcgcttgccatcgtccccgaaaagggctacactcctcaacagaatcaaagcgctctggctatcaaatacctcgactggtactcccacatcaacaacgtcaacatccaaacggctcactcacgatacggcgaatatgtgttcaagcgcgaagggcaggtatatcaagtggacggctacatcaaaggcacaaatgggaggagggataaaataattgaagtaaatggttgtctgtggcacggctgcgaggagtgttttgatgagatggacgaataaacgaggatgccgaatggaaagacgctaggacaattaagagagagggaagtgaggaaacacgatatattgagccgttacgtcgacttggaggtggtatgggagcacgaaataaatgaacaactaaagaaggacaagcagatgagggaatattttgaaaactggaaggaccgctcaccaataaaaatcagagacgcttttcacggaggacgcactggaccgatgaagttactccacacagcaaagtcaggccagaaaatcagctacaaggacttcaccagcctctatccgtggaccaatttttcgaccgactatccccttggccaccctaaaatcatcagttttccagtaaatgagcagacggtcaactggcgctctccatccgacaacccctacaaaggacttctcaaagtgttgcttctacctccaaacaacaacataaacgtcactgttatgccaatcaaatttgatgagcgccttctcttccctctctgtgagaagtgcgccaaacacatcaccgcaaaatatcccaatggtctcaaggacgacaactactcctgcccgcatttcaaccccaacgaccgagcctttgtatcaacctgcacccatcttgaactaaacgccgctttggaggccggttacaccgcccgcaaagtcttccacgtcctccaatacgaccagtggagtaacaatgtcttcaagtcctacgtgagtgaaatgatggccctaaaaatccacgccactggcttcccgtcatggtgcgagagcgaagagcagaagagtgaatacattgaggagtgctgggggaaatttgcaattaaacttgacaaagaaaagatgaaagctgaaccggggaagcggtacatcgccaagctctgcctcaactcactctggggccgcttctccatgcggaaccttctctcaaaagcaataattgacaacgacgaaagccttattcatcagtataccgaagacaaaaagattgagctaatcgacttggaaatgatggatgaggacaacgatgtattcatgctcacttacaaaccaaaggaggagtttgtcgacgaaaataagtactccaatgtagtcatctccctcttcacaacatcaatggcgcgtctctacctctacgaagctctgaaaaaagtggccgacactcccggatgtgaaattctctactttgacacggacagcatcatctacgttcatcccgaggacaacgacccactcccaacaggaaagggacacctcggtgagctgacggacgaaaatccagaccacgacattttggaattcatcagtgctggctgcaaaaactacggactgaaacttcaacggaaagacaatggtgaaatttgcttcgacttgaaaataagggggttcactctcgacgaacagactgtacaaaaaatacactacgacacagtaaaagagcaaattttacgttatggttccgatgaccccgctgaccccataattgttacatatccccattttattcgtcctaatcttatccaaggcaaagtgtttactcattccctcacaaagcattatcaacccatattcacaaaaggtattattaatgattcattccaagtcctcgaatttggttat

SEQ ID NO: 57062 - DNA, 2232 bp, Heterodera glycines
  Genomic contig location: Contig_ID=SeqID_5140; Location=519..2750; Strand=-
  SCN-specific regions: Sequence locations=1-171,344-871,910-1084,1141 -1236,1259-1330,1352-1385,1407-1557,1597-1667,1692-1851,1873 -1976,2003-2054,2097-2121,2144-2232
  Gene Ontology: Mol. function=endopeptidase inhibitor activity; Biological process=pregnancy
atggtccattggacgacgaaggtgtcaaacggtgccaaagatggcactggtggagcagctaaaaatggtggcggtgcggcccgggacaccaaccagtacttcttccaaccccagccggccgacgttgagatgagcgcgtacgtttgagtcccctcggggacgacttttttaagagagagagcgagggagggagagagagatatagatagagggagaggaagagagggagagagacagagagagagagggagagacagagagagagagacagagagagagggagagagacagagagagagagggacagacagagagagagagagacagagagagagggagagagtctctcgtactcaatttatcggctttcaaattttcatttaaaaaatgccaaaaaagaaaatgtcatttttttacagttatgccctgctcacttacatgctgctggacaacaaagagcacgcgctgcccattgtccgttggctgaccgcgcagcgcaattccctgggcggcttttcatccacacaggtggaaatttgttcaaaattcaaatttggcgctaaaatgcaataaaaaggatccggtaattgatcagaagagtctgaatacaaatagcaccactagatcatagaaaagatcaaaatctcgaaaccggcttgatcaagcatgtgcttaatcgttggattttataccatgacgtggtttaaaaaagaagcattgatcaaaccaaaatcagtgaccaatctttttttttgactgatcaagcctaattccgtatgattttgggtcagataaccgctttttttgtgatcccaaatcaaatccattgattggactaaccagtgatcaatcttgatcaatcagtttcttgttttatgattttatgattttttgttcaaaaaaaaaccccttcttccccccccccccaggacacagtgatggcactccaatccctgggggcatatgccgaaaaagcctactcgccctccttcaacttgagcatcaaagtgcagaatggacagcaggacacacatttgttcaccatcaacgcacagaacgcacttgtcctgcagagttacgaggtgtggtggttgatggtggtggttttaaatggtgcccaaatcttaaaaatatcactgattttgtctatgattagccaacaatcatagatttaatcctttggtaaatgctaattactaattagtaattacttttaaaaaactaagtgctaacttacttttattaaactggaattttccagggttttaaattcaactctttggatttatttacccattgggttttggctaaaaaatcaatgattgattttaaatttgccatttaatatttctatgagtctcaaaacagttctttagagcatctaacagattttataaatatttatggcttgtacaaaaaccatacacaattttttttctttaattttccgcatttttttaccgccgattttgaagctcataggacaaaagtagtgaattttttttatttcgataatttgtttttttcataaataattcttctctgattcatcgagttttttgactgtattttgtctaagaattttctaaaatttcgcgcttgaaattgcggctgtttttggcattttacaatctcggtgcttaattgccctgtttttggcgttttgcaattttttttaaattaattattttccattttttagttgccaaatttggacgcgcccgtcgagctggaggcggtcggcacatcgatggcatttgtgcaggtccaatactcctaccatcgccaaacccttcgggaggacgtgccattttattgtgccaaagaagtgcgcgaggtgcgcaacggcaaccggctgcagttggagctgtgctgcaagtgcgtaaaacagaaaaacatttttggcactgccaaatttgaattttgatcaaaaaaggatcagatcagtaaatgaatttgattaaaaaaatgatcagaaaattttgaattctgatcaaataaatagtcaaaaaaatttggaaatttttttttttggaatttcaacttttttcatcttttaattttgaatttaattattaattaattattattattaacaataagaagaattaaatcactaggaattttattttatttattttttgccattttttcagttacacgcgtgccggtgcccgctcaaacatggccgttgcggaggtggacgcgctcagtggataccgctttgacgag

SEQ ID NO: 57063 - DNA, 2990 bp, Heterodera glycines
  Genomic contig location: Contig_ID=SeqID_5142; Location=342..3331; Strand=-
  SCN-specific regions: Sequence locations=1-91,113-1118,1140-1322,1344- 1830,1870-2739,2761-2990
  Gene Ontology: Mol. function=endopeptidase inhibitor activity; Cellular component=extracellular space; Biological process=pregnancy
agtccaagtcaaacgctccactgatggtgtcacgctttaccgcgccggtgccacaactgttgccagcaccgcgccagcgcaaatactttccggaggcgtggatatgggccgacctgctggacccagctggtccaaggtgatgagtgcctaatttgcgtatttgtgcagaggcatactgtaatactactagacgatggttaggtaattaccgtattttatgcagtacataccgcactatttggacaatgatttgcgcgtatttgtgcgggaatactgtaataactggacattgttggccatattcgcgccggttttttgtaatatttgggcagaaatatgccgtttttgcgcagtgcatactgttctatttgggatatcattctaccatttttgtagcgggttatgtttttacagtatcccttgtaccattatccttttgtcggcatgctttacgtgtacgatggttttttttgatcactttgttctgtgcacttgtccatcacttccctcgtttcatatctaacactttttgatcattgctgctgcccaatgctaatgggaccggccaattagcaactaattgctcataatcacctccactaatttctgatcgttgctcgttgatcactctatcactgatcagtcaataaatgtaaaaataaagttggaggagttgcaactgcgtacatgctggcggaagataatcccggcatttcgtactttggcggcccgcccatcgctggtgccagtttgcgctcattgaaaatggaccgaccgaagtcggcaccggcgcgagtgcgatcggaattcccggaaacttggatttggacagatttggacactgctgctggtgatgggaaaaggttgcacgggttacggtgttggtatagaattttggatacggtagaaaacggactttggcatttctccaaaaactagataatttgtttatgcattgaaagggttaagcaattggaaacgggttggatccctttttttggttgatgccgaaaaggccccaactgtagctacagtaatgggggcatacggtaggaacagtattctcgtgtgtattctcgctatcttatgcggctactgtgtgtgtgtctgataatgcgtttgcattttttgtgctttttgcgtgtcatcatctatcacctatcatatccaccgtcgctttgatcatcctttgtcagaaactaatcaatattattgacattaattgacactaattaggtcactcaccaattgattgggtgatgatctcgcacctttttatttacgtcaaaccttaacaattattttgatcctcttgctaattgatcagcagcaggtgttttctttctttttttttagcctcactgatcacacacacacataaattgatcttttttctgatcattttagacccatttcagaaaaaaaaatttatgcatagcgaatttcggaccgttttcataatcagcagcacttttctcgtttctgctgatcatgcatcattattcatttgcttgttgatcaccaatctgatcgatcaatcaatcaagaccacaataggcatcatgaccgatcctaattatggaacacttggtgaactccatagtggcatttttgggctggcgtcggcatcggcaccgacaaaagtgcgatcggaattcccggaaacatggatttgggccggtttggacactgctgctgatgatgatggcaaaaggttgcgcagactacggtgttgttgttgttggcggagttttgaatactgtaaaaagcggtgcaaaaattgcaaaactaaaacatggacaaattgcccaattgtcatggacattccgtcaaaatggcatctttggaaaatgccaatgttttttaacagattaaaggacattgaatggtgaaaaaaaaacgcaaattatattgtattttttgtgaaagtgtgattgatgcttctgagttgctgcgcaataaagggttgaaaagtcaaaatttcatttaaattttttttcctgggacattttttaatttaaccttggaattttgggggaaaatttaaaaaaaaattaagcgtaattacctataacaaatttcagcgacagcggtgaggtggtgtacgatgcgaaggcgcccgacacgatcacttcatgggtggcatccgcatttgccatcaacgacaaagccggacttggggtaaaaaatttttcaaaaaaatctgtctaccgtatcccgtttcctaccatattccctgtgggaagggaacacacatgcgcaactctgcgcttttttcacattatacgcttactctcgcggtatactgtacaacctataccatatggcgtgtggtttaagccatttcgattccatacgatgttaatgtacgtgccgtacaaatttggcacattaagccttccaaatctttctttaccgtacatccctcattggtgtaccgttgtgtactgcacaatattctatccactaccgtatccacccacccgttcctcttcagttggcaccgtcgaccgtcaagctgaaggtgttcaggccgttctttgtccgtcttgagctgccttatgcggtgaaacgtggtgaaaagatggcattgcaagtgctcgtgttcaactacttggagaatgagcaggaagtaggcaaaatgaattaggaaaaaacaaaagtgatcggaaatagatcaaagcgacaaccaaatgatcagaaaatttctgcccttctctgatcaatgccatatttaacaaatttctctctaaaaaatttttataaaatcagcagggggttgtattttttgaaaatttgttctaaaatttctatagaattccccaataattggtgagaaatttcgggcataaggagggttaatcctcaacttttgtgctgtattactaccgtaattaccgtaccaaacttgtattacaggtcactgtaacattgaagcaccagcccggctttgattttctgcaaaaggacggctccagcattaagaaagg

SEQ ID NO: 57064 - DNA, 114 bp, Heterodera glycines
  Genomic contig location: Contig_ID=SeqID_5143; Location=1229..1342; Strand=+
  SCN-specific regions: Sequence locations=1-31,55-114
tgaagcggcatcggcgggcccggcatgccgggctgctccttcagcttgcgctcctcgccgccggcaaaatcggtccgcatgtgcatgtacatgggacggaagcgccagtgccct

SEQ ID NO: 57065 - DNA, 787 bp, Heterodera glycines
  Genomic contig location: Contig_ID=SeqID_26313; Location=1000..1786; Strand=+
  SCN-specific regions: Sequence locations=1-787
atgcattttgataacgatggtgatgtaattgaagatgattacggagaaaatattgatgaatatgattcgcagcagaatttgggtacacaatcaaaccctcaattaattggtgaaataatgtccactaaaatggcaaatcaaccgccaatgtttatctccggctgggaagaggatgagcaaggcattgagcaaaaagttgtgttgtttcttaattgatctcgctctctgagaatctttttaaaggatatgagtgacccgattgagcagtttctttccgcggcggaggagggcaatttgcatttgatggaacttttgttgagtgaaaggcctgatcttttgatggttattgcattttttaatatctgtatattttaaaggtctagtttgttttaaggcacgtgatcgcgataattacacagcattgcatcgggctgcttacagtgacaaatccgaaacgtgcaaatggttgctaagcaaagtttagtctatctcgccctctccatattattttgtttgtccaatttccttttcaggtgctgacccggaagcaaagacaagcgaaggttggacgccattgcattccgctgcaaattggggaaatttcgaagtaatcgccacacttctgagttggggtgttgacgtgaaccgtcggactgagataagtttatcattcctactttactttatttcaaattcgataatttttgttgattattttaaggcaaaattgtgcctctccatttggcaattaattcgatggcggatgacccgcacaagcagtacatga

SEQ ID NO: 57066 - DNA, 1081 bp, Heterodera glycines
  Genomic contig location: Contig_ID=SeqID_26314; Location=1..1081; Strand=+
  SCN-specific regions: Sequence locations=1-84,120-249,277-525,547 -675,764-823,847-1081
  Gene Ontology: Mol. function=N-acetyltransferase activity; Cellular component=nucleus
atgtaagtgtcgaatgacaccataataatttgcttctcaagggttcacaagacctccccgtaaccaaaatttcaaggcaataggataataagataaaattttcaaaaaaaaaaaattttccctggcgcgccaatcggcattcgccgccctcctcccttatttttcttgaaaaatttttaatttttcaatttcatactgtatttttccttttaattagccctccaaatcttttttttattgaaattgcaaattcaattttaatttgccaattcaaggacggcgatctccaccaattgctgctccatgacgagcaaatttcgccccgtgccaatttgcccccgttgctcgtccgtctcgcggactaccgacgccatgctgaccaattggactatgtgggcgtttcgtttggcctcacgttggcgctgctcaaattttggaaacggcttggctttgtgcccgtttatttgcgccaaaatacgaacgatttgacgggcgaacacagctgcgtgatggtgccgcaaagttgcagggggaggaggaggtgaacatggcgaagatgacggaaacggcaggatggacggggaacggagtgagtcagtgttcatacacagacagaaatttggttgggcacccaaattcaaggagtcggctttccccaacgggcatttatcccacaaaaaataaattttttatttttacaactttctaagaaatttttttttgaaattaaattggtaataattttaaaaatattgaaaattttcgttggaaattttacatgggaataaaattcaaattttaaaagtttctgattttttttctaaaattttttaagaaatcatttttagaaaagataatgcaatttgtattttgagaaatatcctttcgtaaaattccattttgcttccctcctccaaataaattccaatagggcatcatcatggcatgccggtgaatgctgccgcttctggcgccactttgaactcggacggcacttggctgtccgccttctttgtggagttccgtcgccgcttcgtctcgttgcttggcacttcgttcagcgcgttcagcccccacttac

SEQ ID NO: 57067 - DNA, 349 bp, Heterodera glycines
  misc_feature (13)..(13): n is a, c, g, or t
  misc_feature (37)..(37): n is a, c, g, or t
  misc_feature (40)..(40): n is a, c, g, or t
  misc_feature (45)..(45): n is a, c, g, or t
  misc_feature (47)..(47): n is a, c, g, or t
  misc_feature (58)..(58): n is a, c, g, or t
  misc_feature (61)..(61): n is a, c, g, or t
  misc_feature (66)..(66): n is a, c, g, or t
  misc_feature (77)..(77): n is a, c, g, or t
  misc_feature (87)..(87): n is a, c, g, or t
  misc_feature (120)..(120): n is a, c, g, or t
  misc_feature (141)..(141): n is a, c, g, or t
  misc_feature (170)..(170): n is a, c, g, or t
  misc_feature (177)..(177): n is a, c, g, or t
  misc_feature (187)..(187): n is a, c, g, or t
  misc_feature (218)..(218): n is a, c, g, or t
  misc_feature (228)..(228): n is a, c, g, or t
  misc_feature (238)..(238): n is a, c, g, or t
  misc_feature (298)..(298): n is a, c, g, or t
  misc_feature (308)..(308): n is a, c, g, or t
  misc_feature (321)..(321): n is a, c, g, or t
  misc_feature (330)..(330): n is a, c, g, or t
  misc_feature (339)..(339): n is a, c, g, or t
  misc_feature (341)..(341): n is a, c, g, or t
  Genomic contig location: Contig_ID=SeqID_26316; Location=1765..2113; Strand=-
  SCN-specific regions: Sequence locations=1-73,135-349
atgattgttgtanatattgtaatgattgttgtaattnttntaatnantgttgtaattnttntaatnagtgttgtatnttttttaatnaattttgtaaatattttattaattttgtatgtnttataataatttttgtaggtnttgataaaatttatatgtattgtaattanttttgtnattgttaatnaaatttgtaagtgttataataaattttgtanatgttttatnagttttgtanttattgatgaaatttgtagatattataatgaattttgtagattttgataaaatttgtagntgttataatnagttttgtatgtnttttataanttttgtagntnttaataaa

SEQ ID NO: 57068 - DNA, 1256 bp, Heterodera glycines
  Genomic contig location: Contig_ID=SeqID_26317; Location=9..1264; Strand=-
  SCN-specific regions: Sequence locations=1-25,47-410,444-745,767 -880,907-1001,1023-1256
atggccaacgcaatgtacgcggcacgggcgcgcgcggccaaggcggaaaagcgtcaagcgcagctgcgcaaggcggccagagcaagggcaggaaacgtaagtttagattaaaaaaaatttaaaaccgaaaataattttccccaattttttttcccacagaccgccaaatcgagacgagccgagcgctgttcactttgctggggccgactgagccgaatcacgcgtaccacgatgggctgccaccatccgctgcaccttggactccatgtgcgaatctttatgcgacgtgaagcggagcgcatgcgttggaccaggcgctgatggaggaggagaggtgggttttgttgaggtgtgggacggggggcagcagggaggacgagtgtaatttttggttctgtttcagtttgctgtgttgtgggggagggagaaaattgaaaaattcagaatttattggactcaatttatttttaattatcatttttttgaattttcaggcccggaaacgagaagtcgtcacaatcgcatggcaaacggcggaaggatggaaagaacggacgacggatcacacaatgaatgattggccgagtgtatttattgatgtatttgtgatggatattcattcatttgttgtctcatataaccatgtcagaacacacgcattgtttgtatcacttaccattatatttgtactgaattgaatgcataaaaattctgtttgctattgctgtttctccatttgtgccaaatttgaatttcaaaaatagaatttttcttttttcgactaaaagtgaaaattctgattttcgggtctaaaacgcacagaaatggaatggaaaatcatcaaactaaaattttgaggcacaaatttgaaaaaaaaaattgaattttctttttgttttaatttgtgcaaggtgtgctgagtattgaatttatcagaataacattttgtccatttttagggggtccgtgccagattttgggttcgttttagggcttttgctaagtttaaaaaattagaatttgtcatgcaattgccgattatcccatggtgagtgttctttgcttacccgcgcctcccatggcatttcacgagtgtacccataaaatccgaaaccgttgaataccctatcaaatgtagtaggccccaaaacattttatttttcagtctcaaaaatgctatttggacgcttaaaatgccacccccgcccccgtccccgggggcgagaaatttctcacccccgcctccgcgactctga

SEQ ID NO: 57069 - DNA, 53 bp, Heterodera glycines
  Genomic contig location: Contig_ID=SeqID_26317; Location=1019..1071; Strand=+
  SCN-specific regions: Sequence locations=1-53
atggtggcagcccatcgtggtacgcgtgattcggctcagtcggccccagcaaa

SEQ ID NO: 57070 - DNA, 1191 bp, Heterodera glycines
  Genomic contig location: Contig_ID=SeqID_26321; Location=14..1204; Strand=-
  SCN-specific regions: Sequence locations=1-77,99-448,470-742,764 -949,971-1191
atgaatcattttggcttaggcatttctgctggactaacaatgcttatgcggctgatgatgcgctcatccgttgctgatgatgaatttgaaattagctcagtgattgagatcagtgattttgtctggtcatgtgggcccaccgtaatggtgaagggagaggatactgtggccgatttgaagaagaagttcgcagaagagattaaaattgatcccaacagacaagagctgagaaataaaattgagcccaaaagacaaatgctgagactcggcggtcgctttggttcaacgcttgaagacagtaaaactttgaaagtttatggcattgaaaaagaccaagtcattagcataacatttgatgaatatgaaatttttgtgcattttaacgagaaaaattacccaatttgggtcagaaaaagcgactacgtagaagatttggagaagaaggccatgcaaatgctgaaaagggagttggacattaacatagatgatataaaattaaagagtcgtcaatctcctggaagttatgacatgttttttgaacaatggtatacaatggaacaatatgaaattaaagaaggcgcagttatttacgtttgttatgaatatcattacaagacattagttgagtttgacattttcattgaatataaccagaaaaagtacccagttcgtgtaaaacgtgcggacactgtgcgcgatttgaagatgaaaatcggaaatatccaagagattggtattttgcccaaccaacaacaaatgctgagactcggcggtcgctttggtccaacgcttgaagacagtaaaactttgaaagattatggcattgaaaaagaccaagtcattatcataacatttgatgaatatgaaatttttgtgcattttaacgagaaaaattacccaatttgggtcagaaaaagcgactacgtagaagatttggagaagaaggccatgcaaatgctgaaaagggagttggacattaacatagatgatataaaattaaagagtcgtcaatctcctggaagttatgacatgttttttgaacaatggtatacaatggaacaatatgaaattaaagaaggcgcagttatttacgtttgttatgaatatcattacaagacattagttgagtttgacattttcattgaatataaccagaaaaagtacccagttcgtgtaaaacgtgcggacact

SEQ ID NO: 57071 - DNA, 1035 bp, Heterodera glycines
  Genomic contig location: Contig_ID=SeqID_5144; Location=191..1225; Strand=-
  SCN-specific regions: Sequence locations=1-84,130-250,273-314,360 -459,486-589,622-735,785-994,1017-1035
atgggatttaaattcattgtcggcaccaccaccattttcctgctaattcagtcggttggcctaatcactgctgatcggcaaaagcagcaaaaacaacaacaacaacaacaacaacaaaagcagcagcaaaatcgaattgtgctaagcccaaacagagtgccacattggaaagtggagaacaatattaatagaggttaaaacaaaatttgtgattaattaatttaattaaagtagcctgccaactattaagaaaaataattaatttaattaaagtagcctaattactttcattcattttatattaataaagatggattattagtttaatattttgaaattaatttaatttatcttttaatgcgtatttattgtttgtttttgtttgttttaaggaccattttatggacaaccagaacaagtccatttgtcttatgccagtgacccatcaaaggtaaaatgtttatttttattttattataaaaatagcatttttccacttttgtgatttgttttgctaacagttttcaatgaatacccttgaaaaatgcacccaagattatttgttcattaaaaagtcgaatacattctttaataatgtaacatttaaaacttttaatttatcacaagctaaacattttttcctaggaaataattttatgtccttgaaatttgttatttgataatcatagctatggatattttttccaagatttttcattaattaagaagattttaaattaactaattaattaattaatttcttaaactaattaattaattaatttacaacagttgtgggtcacttggctgacctttgacgacacattggactcgctggtcgtatggggcgaccagtacagtcagctaacgcgcaaaacgccggctacagtagactattttgtggacggtggcaccgagaaaacgaaacgatacacccatcgggcactaattgaagggctgaagccgggacaacgctattgtcagtggaaatctctcattttatttttggcatttttaatcaacattaaaatttga

SEQ ID NO: 57072 - DNA, 1816 bp, Heterodera glycines
  Genomic contig location: Contig_ID=SeqID_5145; Location=1708..3523; Strand=+
  SCN-specific regions: Sequence locations=1-143,265-419,472-611,673 -1031,1063-1158,1253-1431,1469-1816
atgactaggacagtggatcatgcatctacagtgattattttttgtcgtgcatttttcagtgctaatatgtaagcgcattaaactatgagatttgaaatgttttttaaatcccgaaaatttactccaccaacaggcgagaaatcaaaaaaattttagttataaaataatattttaatgtaatcttttattaatgcaaaattgttattaatttactaatttcttaatccaataattgcttattttaaaaaaaaattaacaaaaaatggaaattgtcaccaattaacatatttttatgcccatttgcaaccgtttaaatttgctctatgtaaatagtgcgggagaccacaccacggccatttcaaaaatcaattcgttccccttttcaaaattgttggcccctgagcgctctttagacttgtgccaacaaaaaattttttccatttttggcacaaaatttgctgccaaaatttgcaaaaaaaaagtcactcaatttgcttgtgatttatttaatggtttggttttttggcatccattaaaatatattaaggttcatcccgggtccattgggagcaaaaattaaattttcttagaattcttggccgatttgtaagaaaattttgcaaacattttgcaaaaatttataatttttaatcatttttaatattttatattgctattaatggaatatttataggaaaattttcggttccctcccaccaatatcttttttttttgatttgcatttaaatggacacacatgctttttccaatacttgtttcttgaaaaatggaaacagaaaagtacaaatcaatttttcctattaaattttgcaaattttttaccgtaaaaatttaaatcctttttttgaaatatttatttaggcttttaaatatttaatttgttattttgaaaggctcactatgcatttttgcccatttctcatgcctttagtcaaattattcacaaaactttgcccaaaagcttagatcaaatttccatggccaataagctgctctgggaaatttcaaacaaaaaaatatttttaaacattatttaaaattgctgttgtttattctttttctgagatttatttgtgagagaagaataaaaggaaaattttaaaatgtaaaaaatatagaaaaggaaattttttgctcaattatatgtaaattaattattttattttatttttgctaaattatatgctttttaaaataaataaaaatgtttaaaaattttaataaaatattagaacatttgcaacatttatgttattttctggggaaatttgatatgcacatatgttgtgagctaatctgttcatttttttaacttttttaaaactttgctctcgatctttcaattgttactaaagaaatattgaaaatttaacaatttgaaaaaaatttaaatattgtagaaccaccgagaaaatttattaaaatttttaaattaattcaaaaaaaagttttactatcttaatttctgagcggagcagggcatgttcagttacaaaagtccaaagttataaagctccaaacttgtcaaatgcacgtcagacgcgaccaccgtgccaaatccgttaatcgcacgatttaaatctcgtttataaaaactactaatcctaactgagataattccttagaacgtctttatttaatgctttaaatttaatttttgcagcattttttgaggcttttaatgcttcaattattaagcatcggaaagacgttccctatctttaaaatttatttccaaagctcttccattcacttgttatgaacattgataaagctaatgacatcatttgtggta

SEQ ID NO: 57073 - DNA, 1116 bp, Heterodera glycines
  Genomic contig location: Contig_ID=SeqID_5145; Location=3748..4863; Strand=+
  SCN-specific regions: Sequence locations=1-351,381-393,415-500,534 -573,600-619,641-677,701-1116
atgggccacaattttaccatggtggagttgggctggctgtgtaccgcgctggtgtcactgatgcgcaacagttcgcctcccctggtacacactgatcagaatgcgcaacaaatgctcaaactgatcagtgatacaaaatgctcaaatagcaacagtacaacaacaacaattaacggattgtctaccgtaccaactacagtaggaacaacagctacagtacagctgaatgctgcactgcttgaaaaacttataaggccaggcgctgctgatcagcaggtcagcagtaccgattgaaactgggattccaaccataattttttgggatttggaatgaatttgggatttaaaatttgcataaatctttaaaaattaaaaattaagtcccaacaaaataaaatttttgctgacaaccaacgattgcttgactggcttatgacatttgtgtacatgcttatttcaatgtttggcataattggcaatatttttggtatgttgtcgagaaaaaaaaaattaatttgattaatattaattaagtggtaattgttgtacgaactgtgccaggaatggtatgtgttttaatttatttcaataaaatgggtttaaaaatctgaattctttgaaatatttttaataattttagagataacaacctactaaatataatgagacaattagagttttttaatttaaaaattttcgtttgtctaaacatatttaaaaatgccatgtttccgaaacgggaaagcattatccagggtagttttaggcgctaatgaaggatatggagtatgaaaaaaaatcatgctttttcgaaaaaaagccaaaaaaaaaatttgtctatttttaaaaatcaaaaccatcggcatatcggcttaatttagtggagtgtggcataacgaaaaagttaccaatataaaagataaatcttttcaaattaatcaaagatcactccaaccaactgttatttgatgtcattggcaatttccgattgcatttttctgctttctgctgcaccggttgagctcagctttttgcacgttgattggtacgcgtttggctccattggctgcaaagtgctctcatttctcccatttttgggcataaattcgagtaaaa

SEQ ID NO: 57074 - DNA, 144 bp, Heterodera glycines
  Genomic contig location: Contig_ID=SeqID_26324; Location=1161..1304; Strand=-
  SCN-specific regions: Sequence locations=1-144
gaacgggctggatgccgtcgtcgcctgctgatcatcaatgtactcattgaagaccacggggagtacaaatgcacagccaaagacgacgaaacaatggcccaactcattgtgcaccccaaattcgtcaaaaaagcggagcgctag

SEQ ID NO: 57075 - DNA, 378 bp, Heterodera glycines
  Genomic contig location: Contig_ID=SeqID_26325; Location=1277..1654; Strand=+
  SCN-specific regions: Sequence locations=1-111,219-236,258-378
atgaatttgttcgtgaacggcaaaaagacgacggagcatgtgtatggacggcaggaatgggaaaacggcaccgtgtacacttatgccagcctggcattcagaccggggtaaaaaagaaaaaatggaattattaaaaataaaaataaggcaggaataaaaaagaaaattggaattaaaaattaaacaagataagggtaaaaaagaataaattaaaaatatcagggtaaaagcgtatgaaaattaattttcagaaaaattcaccataaaaaagtgatttcctgcgaagcgcagcacccggaaacgaacacaaacttacgcgactcgatcactttggatgttttctgtgagtttggcctaattgttatgatgatcggataa

SEQ ID NO: 57076 - DNA, 80 bp, Heterodera glycines; identical to SEQ ID NO: 51817
  Genomic contig location: Contig_ID=SeqID_26327; Location=391..470; Strand=-
  SCN-specific regions: Sequence locations=69-80

SEQ ID NO: 57077 - DNA, 409 bp, Heterodera glycines
  Genomic contig location: Contig_ID=SeqID_26329; Location=940..1348; Strand=+
  SCN-specific regions: Sequence locations=1-303,325-409
gacgaatgatggaaaccgtgccaaaatgcagcaaaagcgccagtcaaagcaaatttgcaaacttggccaaagcaacgcatccatggcagagagttcacattgattttgctggtcctttcttcggaaaagattacttgatcattatagacgcctattcaaaatactcagaagtttttgagatggcaaccaaatcgacggcagccacaaacaacaaacttcggtatttgtttagtcgtcacggattacctgaaattttggtatccgacaatggaactcaatttaccagcaatgaattttcaaaattcatttccaacaatggcatttctcacctcttctctgcgccatataacccaatgtcaaatggccaagcggaaagatttgtagacacgtttaagaggtcattccgaag

SEQ ID NO: 57078 - DNA, 1296 bp, Heterodera glycines
  Genomic contig location: Contig_ID=SeqID_26330; Location=35..1330; Strand=-
  SCN-specific regions: Sequence locations=1-19,46-189,211-983,1005 -1136,1163-1296
aacgatataaccaaaatataaggaaaaattttttaaccccccttgtctccatcttcctttttgatactaaagcatcagcgtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttataaattttattcatctccctttttgatagaaaaagcatcagagtgcctaaactaacatgtaaataacatttggtgcgtttcagaaccctttctgaaaaaatattctagaattaattttgcaaaaaataaataaaaacgaaagact

SEQ ID NO: 57079 - DNA, 924 bp, Heterodera glycines
  Genomic contig location: Contig_ID=SeqID_26331; Location=143..1066; Strand=-
  SCN-specific regions: Sequence locations=1-11,34-554,577-784,806-924
atgggagcaaaatggacagtgcgagagtttcggaaagcggtgggagtgcaagtcaagtgcatgagggccgccgaatccgcgttggcagcaatgaaaggacccgaacgacgacatgagcagcgatcggagcccgaacgaggcggacggaacgcccgaacaggacaaggattccagcgggcatttatgatcagagatcagcccccggagaaacgaacgtcgaacgaagcacacaccaggaccgaagtcgcgatgccacccactcgaccagcgaatccgaatcgtgtgccgctcgggagttactcccgaccgatgggagcgcattcccaagcacaggagggacagggaggacaaccccgacaagggtgctcgttgtgtggacaaacgggacaccaaccaagccggtgttgcaaatatgggtcagcacaagccaaaaggaggagactgatcgagcaacgccgttgtctcaaatgcctgggatccgatcacaccgcgcagcagtgtacacgaaaaacagcctgccggacgtgcgaacaaatggatcaccactggctgatatgctggaagggggagagaaggaacgaaccccctagccactcgagaacggaagatgcacaacaaaatcggacgatgatcattcgggaaattgaagcgaagcacgtgcgcactccccctcccaccgagtccagcaaggacgggatgggggctaaaggggaggacccacctttgctcgacggagagcagagagcattcaccaccgtgggccagcaactcccggcctatttaatggtgtgcccggtggtggtggcatcggaggatggcatgacagaatgcaataccaatcttcttctcgacccagccagccatggcgattatggggatgcggctctgatcaagcagctgggcaccgagaagggtcgggagtga

SEQ ID NO: 57080 - DNA, 1248 bp, Heterodera glycines
  Genomic contig location: Contig_ID=SeqID_5146; Location=10..1257; Strand=+
  SCN-specific regions: Sequence locations=1-230,252-556,578-752,778 -1085,1109-1248
atggccgggctgcgcatgacgcgcgctcgcctgcgccaattggaacgcattgcgcgccgccgcattcccaccgcgcggctgcgaccgattgtggggccgaaaacatttttggacatcaattacggggacgacgaagaggaggaaagcacttcagcaaaactgccggggcagcaggacgatgagggagacatggactacaccccggcaaacgacccgaccgcaccaacggaacgaagacgacggaggaggagacggaaaacgaagacggagggggagaagggacaaacggtgagcaacagatggggaaagtcatgggcaagagggacggtgagaaaggcaaagtgcggggacggttttcagcgatgtttttgaaaattagtaattattcataagaaagatttctaatttttttttcttgaaattttctttaaaaaaacaaaacaaaatgcccttaaaattccaaaataatgataaaatttaattgctaaaacaggctgacaaagtttcttattcgcagatttacaataattgttttctcactttatgtttttttagcaaacaaattccgaccgttcggcttctgagtgtgatgatgctgaagacgcgtcatcgtctatgcgctcctccgacacggactttgtctgctcggacatggacgaacaacagcagccggagcagggaacatcacaatcagcaacagttgagactgaacaagtaggagatgaacaacatcagaagcaacaacgatgcacacatgacgaggaagaggaggagggacaaagtgtcgaatatctgacaaaagtgggcaattaatgatcaattaatcaatttaagcaaaggatatcgaaaatgaatgtcttttgtcatattaacagaaaacaattttcatgcaggtggacaatccgatctatccaatcttcatcaaatcgttggccaccgacacggaaattgacccggaagttcgtcagcaactatacgatgacggtacagtttgctgttgtttgttgatcaaggcgagactgaattcatggctatgaaagggggggggggggggcttccccttcggagtttgaattaaaaaatggggatttttaaaataatataccatcttatttagaagacaatgaccccgagtacgtcttcccggactttgacgatttgtgtgatgagcaggaggacgaatacgaattccgacgggaccgagccaccgaaattccgcgtaattttttatgacaggaatttaattta

SEQ ID NO: 57081 - DNA, 4097 bp, Heterodera glycines
  Genomic contig location: Contig_ID=SeqID_5147; Location=136..4232; Strand=+
  SCN-specific regions: Sequence locations=1-1069,1091-1274,1296 -1404,1426-1541,1563-2922,2951-3207,3230-3504,3526-3811,3833 -3849,3873-3947,3969-4056,4078-4097
cacgttcagcttctctgccaagccattgtgggcacgtctcaatatgccaacttggtggaaccacacaacaaatctatgttgatgctggtcagtgagtcatgattattaatttttaattgaaaactactaaaatagtgaaaattgtttaaaaaatcgtttcagagcgaattggacggattgtctcgcgagcgtggcgccaaatcggcgtttaacgtgccgacgctggaggcggccatttacagtgcgcacgacatcaaagcgtgccgcgaagtgaatttggcattggcatcaacagcggcagcagaaacgaatggcgatgagctccaacccaaaaacactgtcgaagtcagtcggattgaaatcaaattgttttttggactaatttatttagggtctcattattttttaatccgtcggtaatttctcgtaattaatagaaatgtaattgccataatgtcaccgcgtatactcacacttttttctaccgaaacagctgctccaactcaaggatgagcagcggcctagcaatgagaccatgtgggtgttgtcgcgcagcggtgccgtccgttaccccgacctgttgtgcccgtaccggttcagcagtgccgaagactgtgataaattgcagtcctcaaaaatgggtccaacgcagcgatttttgcattcggaacaggcagaaattactaaattttctgggccgccgaaattttttttcaaaattttcaagaaaaatctctgtgtttcagttactgctcgccatcggtctctaccaattgggtggtgtccagtcacatcggaatggcaaaatgcgcaaccgttaccaacatattcagcagtactttctgcccacaaaacgagtcgaccaaattcgcaatcacattgtcagcaacacaaattagcgattagatctaatgacaatggctaattaattcaaacggcgctttgttttgtgtggcattggcccatttttaattccaaaaaaaaaaaaaaatcaattttacctattttaatattgcagaaaaatgtgcattcgtccccgtcaccgaccatttaccaccagttgatcatgcaggcagaaaagggccattttccggtcacttatcggcccgatttgggcgaaaaagcccagcgaaaaacgccaattgaatggccaacgaatgtgcagccctattggcttaaagtgtgtggggatgcattaagtcacttccgattttttaatcttttaatgcaatttaaattaaatttttccattttttccccattttagtggctttccaacctgctgggcaaatgccaaacccagatgattatggtcgacgatggtgacaacactgacaatgatgcgggtcaacaattgcatggcgttttcgaggcattgaatggcactgatcagccttcttctcctcctgcccctcctcctgctgctttcgcttctgctgatcatctccatcaaccggcatcatctgacacgtctaattccgaagcccaaactgctcaaaatgtcaaagttgagaatgcaaatcgccaacgacacgtaaaggcgggaaaaaagccgaggatattggctactgctcgaaaacgctgcgttcccacagcaacgggagcggcaccatcaacaacttcaacaatggaacagagaaaggatgaccaacagcagttggacacgacgacaaccgtcccgtacaacaacaacgaagcggccaccgaactgcttggagacgttttcattccaggggagcaacaacagccagattttgtggacgtggaggaggaggaccatgtggtgggtgtggagacccggtggcggaaacgtatacgaacagcctcgtcaacaacaacggaagacggggcaagtcgcttgagtggtgttgccgctgctacagatgttgctgaaaagggaggaacaacgccgccgacacaaacagttacagcagcagcaacgatggtaaacaacaacgccagcagcaggaggaattgtagcagtgcagcaaacggcgccggtggcgcagaagccgccacattgtcgacgatggcgcagatgacagcgaaaagcgccggcgttgaaaatattaatggcactaattgtgccgaaagtggtgtcatgcctgccgcaacagctacgtcgcaattggtgcgtttatctatcatttattaaattggaattgtacctgaaccaattcggaagatttatggcaccattctttttcagcaaaagaagtcacggcgacatgaacgggccgagcgcggaatggccgcgctgggcgacgcgcattcgcttgagcaaaccgaacgggcgctggccgccgcaatttacgaggacttcggcaagcgaatgttcatgcatcaggcaaatttgctcacttttttcttgccacttcctcctcgtaaatccacagacgttttgccctctggcaatattcgcaaaatgccattgtcgccatttcaggacaaattgcgtgccgtccagcgcgtgttggccactgctccaccgccgcgttatgatccatcactgtctgctgcttgctcaaccgcacaatctttcgcctctctatggcaactgatgggcctcacccatccccaactgttccatttgttcgccgccattgcgcccgaggcgcagctgccgcacgcactgcgcgtcgacccgcactggcaggcgtgcaaacgcgcgctgcgcatgctgaagaccatccatgtgcgtttttgcttgtagtttggtcggttggcagcccaattcgggaattctcgaacttttcttctcgtcttggtgccaattcctgacacaatttcgattctcgatcagacttctagggccattcaaattgccaatttttcagacttatttggctgcgagtcgaacccttgcccagatgaagcatatgctcaaattcctcaaagagagtgagttaatttctgtttatgtataaaaaaataaacataataatttaatggaactttgtggggtcaaatttatagatttttttgcatttttttgttattttaatttctttcttaatacaaagttttcatctttgctattgctcttccactgtttcttttgttagtttccgtggacatcacttctgagcaacagtttttcgaggctcttcagcgccaatttggggttagggacgagccgttgtggcggctgttgcgacgcgaatggatgggcggaaaatttgttgaaaagtgggtttattgggttagcacaaaaccaatgtttaattttgagttcagaaaactcgtttcaaaactatttaacattagagcaaattggaatcaaagcaattctcaaacaaaaaataattttcagcgtcgaggattgggagtacgaatttgtggacatggacaagcagtaccagcagcaacaacaacacacgagcgaatgcgcaacagtttccactgatggaattggcaacggggacaagcagcaattccagttcgaacatgtccgacttccctaccgacgcgacccgtccgaacgcagtcgccttcgcgtccgacacggccgcgtcacggcggaactgaacggacggttgtgcaacgtgtcaattggtgccaatttcataaggggggggggcactgatttcaattacatttgccattgtttaagcctgtgcttcgtcatcttctggtctctcctcctccgactctttgtcggttgttgaacctcagcagagcaattgtccaacaacaacagcacgtgccagtgtggacaaatccaatgaactgcaaaagaatcgctgctgttggacccgaaaaatggacatggaattaatgttggcctacaagaatgcgggtggcgatcagtaagttttttaattcattctttacggggcaaaaaatgttaaaatgatggaatatttactggactatggactgtatacaaacttttgggtgttttagcaagaaatgtgtgaacgccttcctacaccaacgttccacacaatccaaaattggtgaatcggtcgtagcagaagacgctgaaaaacggttggaccaacttttgaacgtggccaacacattgaggaggaggaggagggagacagaagaaagggacgggaaatgatctcatcattttacccattttattgcaa

SEQ ID NO: 57082 - DNA, 524 bp, Heterodera glycines
  Genomic contig location: Contig_ID=SeqID_5147; Location=5955..6478; Strand=+
  SCN-specific regions: Sequence locations=1-75,97-255,277-332,354-524
atgacatgccaaaccggaattcgtggtatgtttatttaaaaaaagaaattgtgaaagtttgacaaattttagccgatgaaaaactgttggactttttcgagcagtgcaaacagtgcaaagtgcgctttggcaaaattgtcattaacaacggttcgtctcatttttcaacattttttagtggaaattccgcccattttccctcctttagagcgtctctgtgtgaatcacaatttgaagccctcaaaagattggcgcaaagattggaaaaaatggtgagcaatttttttcgaatttttctaatatttttttttcagtttgcccgactgtgtagatgcctatgagccttgctttttgcttttccgtttcgactcgagccacgattggattctgatcaggcaatcaaaacggatgactctgaccatttttgaatggtttgtctttctttcagtttttccgacgacaaagcgtccacacgcgacaaaatgatgttggccgccaccaaagcgacgtttaaagtgccacaa

SEQ ID NO: 57083 - DNA, 729 bp, Heterodera glycines
  Genomic contig location: Contig_ID=SeqID_26335; Location=182..910; Strand=-
  SCN-specific regions: Sequence locations=1-429,451-629,652-729
atggagtacacagaccttgcggtctgtgataaaaggcttatggaaggaaacgggcaaggaaaaagcgaaacaaataaaaatataaatcaaaatattgcttcgacaagccaaagtgctaatgaaaaggaaataaaaagaattgcagaaataaatcattgtagagaaatgattagaaaaacaatggcagctttggcaataaaatctgataatgaaaaaatacatgaactgagagaaactgaaaaaagtgatgaaaagaatccaacagaactgattaataatattgactgtccttctagttctggaataggtttgagatgtactgatgctcttgcctgggtaatgattaaaccagaaagcgatgaatatcaaataaaacaaaaaaaggataaaaatagagatgatcagctaaggatgattatttttcagagaatgggtaagtgtgctttggctgtacggctggataaggaggacaaatggccatattttgcattggtttatccaaatgaaaaactaaatcagtatccatgcttaggcagtataacttcagtaccaaaagtggaaaagtttgaatattttagttcttcgaattctgagttatactcacaaaacccaaaagaggaaagtgggactatttataatattataaaaattgaaaggaatgagataaaagcaattgatgttgattttaatgtatatgatgatgagagttatgatagcataaaccagtga

SEQ ID NO: 57084 - DNA, 360 bp, Heterodera glycines
  Genomic contig location: Contig_ID=SeqID_26339; Location=1098..1457; Strand=+
  SCN-specific regions: Sequence locations=1-360
atggaccgacggtaagaaaggatttaaaaaattgcaagttttcatttacccaattttcttatgtttcagttggatttgtggcgacgtgtggatggacattctcccatcttttgaccatgctcaactcggactcaaaatggcattgctttccgaccgtttcgatgttttggtggacaaacatttcgatggaaaaagcgaattgacaatttggagacgtatcaaaataagcgaaactgtctgtggcgatcgatggcaaatttgtgggatttccattgccggaccattcgctgccaaacaaaatccgttttcgtttccttcagattcagtaaatcaaaaactatacagaaaccaattaatatg

SEQ ID NO: 57085 - DNA, 606 bp, Heterodera glycines
  Genomic contig location: Contig_ID=SeqID_26340; Location=204..809; Strand=-
  SCN-specific regions: Sequence locations=1-606
atgacggagaccgagctgcgcaaccgacttctgaacgtgagcatcggacgcaacattcgcaacgacaatggcactcaaaacggagacgcaccaaatttggggcaacaaaacggaaacgaatcggtggaaattggacaaaatttggagcacggcggcgacgcacaaatggaatttggacagcaaatgcgtggaggtttgcgtgacttcgaaatttttgaaaattttggtcatgaaagagggggactgcaaaactttggagttgagagagtcagcccgaaccgacaccagcattttggagaaaaccgaatgcaaaatcgacatattagcagcgaaattaggggtcaaacaaatgtccgcgcttcgaataaccgcgaatttgtggagcagcgtccattgttgaaccgaccgccgttagcgcctcaacacagcgtcatccaccgccaatacattcagcatgttgaatcgcttccaccgtctttcccttatgcgaacgaacgcattccaccggctccgagctacgcgcagcctgtttttgaacagcagcgtcatcagccccgacaaaatgcacctaaccccagccaaaatttggatgttttgcacgtctag

SEQ ID NO: 57086 - DNA, 291 bp, Heterodera glycines
  Genomic contig location: Contig_ID=SeqID_26342; Location=1777..2067; Strand=+
  SCN-specific regions: Sequence locations=1-291
  Gene Ontology: Mol. function=glutathione reductase (NADPH) activity; Cellular component=mitochondrion; Biological process=response to oxidative stress
atgaagaagtttgactatctcgtcattggcggcggttccggtggcatcgcatcggcacgccgtgccgcggaattcaaagtgaaagtcggactcatcgagtcggagcgccttggtggcacatgcgtaagtgaaatcatatcaatttcaatcactttctcattaattttgtaggtcaaccttggatgtgttcccaagaaagtgatgtacaacaccgccatacatgccgagtttctgcgggaccatgctgactacggcatcgactcaatgaacgtaaaattcaattggaggtag

SEQ ID NO: 57087 - DNA, 65 bp, Heterodera glycines
  Genomic contig location: Contig_ID=SeqID_26344; Location=819..883; Strand=+
  SCN-specific regions: Sequence locations=1-65
atgatcaccgagaacgggggacaggcacgcaaagcaaccgctgaggaggaggccaaggtcaagca

SEQ ID NO: 57088 - DNA, 242 bp, Heterodera glycines
  Genomic contig location: Contig_ID=SeqID_26345; Location=73..314; Strand=-
  SCN-specific regions: Sequence locations=1-242
atgagccgtaacgaacttgtcggttttctcctgcgacagatcaaattccatcccatcttcgccaataatttcttctcttcctccgattctggcctaatccattgggatgccagtgctttggcccaaggagcgaagtgagttcagccgaccgaaggcaccaccccatttggcataatcttccgtttgcagtttaaatccgccaacaaacggaagagaaatgactggccacgaatctgctgcgg

SEQ ID NO: 57089 - DNA, 2165 bp, Heterodera glycines; identical to SEQ ID NO: 26347
  Genomic contig location: Contig_ID=SeqID_26347; Location=1..2165; Strand=+
  SCN-specific regions: Sequence locations=1-16,47-172,194-1298,1320 -1650,1672-1947,1969-2062,2107-2165
  Gene Ontology: Mol. function=ATP binding; Cellular component=nucleus; Biological process=signal transduction

SEQ ID NO: 57090 - DNA, 764 bp, Heterodera glycines
  Genomic contig location: Contig_ID=SeqID_26350; Location=22..785; Strand=-
  SCN-specific regions: Sequence locations=1-345,368-621,643-764
  Gene Ontology: Mol. function=structural constituent of cuticle; Cellular component=extracellular; Biological process=reproduction
atgcatgcggcgactcgccaccgcgtggcgcgtaatgctgacgcgtgctgcggctgtggcgaatccccgcgtggtccgcccggtcagtgagcctgtcatggcattttctggacagtaactaatgccctccctcgtcttaggccctcccggcccagatggaaatcccggcggcgacggacagcccggcggacctggacagcctggcgcgccggcacaggctccgccgcgtccgaaaccgagcggcacagggtaagcatgccattgagaagcggtggttcatccattcacaaaatgcctaaatatgacagatgtcaaacatgtgctccggccgagaacggacatcccggcccccagggcccacccggccaacctggcgcagcgggagagcccggggcacccggctatcccggcaaaaagggcccacgcggtccgcccggtccagcgggtccggacggaaagcccggcgacgccggagcacccggacagccaggcgcaccaggagaactcaagtaggagaggaggggaggtatatttagttaattaatgcatatttaggcccggacccgtcaaggtgggaccgcccggcccgcctggctatcccggcaaacccggcggacctggccaacctggccaacctggagagcccggacaccctggcggacaaggtccacccggcgatgccggacagcccggcgagccaggcaaccccggcggtgcgggcgagcccggacaacccggagagaagggagagcacggacactgcg

SEQ ID NO: 57091 - DNA, 889 bp, Heterodera glycines
  misc_feature (690)..(690): n is a, c, g, or t
  misc_feature (842)..(842): n is a, c, g, or t
  Genomic contig location: Contig_ID=SeqID_26352; Location=189..1077; Strand=-
  SCN-specific regions: Sequence locations=1-258,280-518,550-589,633 -698,720-889
atgccaatcttgctcgggcgtgccattgcacctcagtgggccctgcgtaaagcatcggagaaggaaaaatggccaaaacagtctaaaggtgcgaaataacaaccgggccaataaccggctgattctgagttcacaaaaaatgggaaattttgagcaatttataagacttaaaaaatatataatactgcccaaatcctacccaatcagcgtccaaaacattctccttcaacactgcttcgtgttgcgcaattcgaacctcaaacaaaaacaattaaaaaataaattgcccccaaaacatgccttcaatggcacgtcatcgtcctttgtccaaccgccgagggggtgcaacaaaagtacgggattgcgatagcctcgccttaatttgtgaactgaatcatacgttaaaagggggaggggttctggtagattacgaacgagtctggagggggggggggatatggaacaggacaaatgacaaaacacagtcgccgaaacacagccgagacataacagccgggaaaaaattttaaaaaaaattttcaaaaaaatcgctggaagttttttatttttttcccttgaattttctaagaataattttttaagattttttcatgaaaattttttaattttttccaggatgtgttatgtctctgctgtgtttctgcggctgtgttttggggtgaaccgggngggggggatcatcacctaattttatgaaggggataagtcatgtaaatcgccgacaatagcgcactttttccaaaacttttggagacaagggagatctggcgatgccgataggcgccgtcggtgaattagaaagtttgggtgtaatttgttanaggattttcaccaaaaactgctagattttcgcttttgagctaataaa

SEQ ID NO: 57092 - DNA, 1674 bp, Heterodera glycines
  misc_feature (74)..(74): n is a, c, g, or t
  misc_feature (155)..(155): n is a, c, g, or t
  misc_feature (160)..(160): n is a, c, g, or t
  misc_feature (236)..(236): n is a, c, g, or t
  misc_feature (388)..(388): n is a, c, g, or t
  Genomic contig location: Contig_ID=SeqID_26352; Location=1..1674; Strand=+
  SCN-specific regions: Sequence locations=1-47,71-358,380-445,489 -528,560-798,820-1110,1132-1250,1272-1674
agaaatgagaaagttatgggggctcaaaaacccgtaaagtcttatgccagttttgttatttttattaattcccncaactttgcatttggatctgctctatccaatggtatatcttttaagacgttctccgacttacagctgggaatgttaaatcncaatnccatgcgcactttgattccccttttccctttattagctcaaaagcgaaaatctagcagtttttggtgaaaatcctntaacaaattacacccaaactttctaattcaccgacggcgcctatcggcatcgccagatctcccttgtctccaaaagttttggaaaaagtgcgctattgtcggcgatttacatgacttatccccttcataaaattaggtgatgatcccccccncccggttcaccccaaaacacagccgcagaaacacagcagagacataacacatcctggaaaaaattaaaaaattttcatgaaaaaatcttaaaaaattattcttagaaaattcaagggaaaaaaataaaaaacttccagcgatttttttgaaaattttttttaaaattttttcccggctgttatgtctcggctgtgtttcggcgactgtgttttgtcatttgtcctgttccatatccccccccccctccagactcgttcgtaatctaccagaacccctcccccttttaacgtatgattcagttcacaaattaaggcgaggctatcgcaatcccgtacttttgttgcaccccctcggcggttggacaaaggacgatgacgtgccattgaaggcatgttttgggggcaatttattttttaattgtttttgtttgaggttcgaattgcgcaacacgaagcagtgttgaaggagaatgttttggacgctgattgggtaggatttgggcagtattatatattttttaagtcttataaattgctcaaaatttcccattttttgtgaactcagaatcagccggttattggcccggttgttatttcgcacctttagactgttttggccatttttccttctccgatgctttacgcagggcccactgaggtgcaatggcacgcccgagcaagattggcatgtggcgtgaacgcttacattgtcggacgcgatccggcaggcatacaaaatccacgtactggcgattatttgtacgaaccaagccatggcgcaaaagttagtcaaggaaagattgtggcgccaccggcaccgctggatccctccccttccccatagttttaaataaacacccgcaaaaaagtggcctaaaaaggaaaaggcgtctttcccccgtaaatttaggcttctacccctcccccttttttaccactattaacttatgtgtcgaccaacatcgtcaatttttattgcattactattccttaaaggttctctcaatgactaccggtttggtcggcctggagataatcccatttcgtgtcgcagcttacgattcttttgcgggagccatggcattttacgacccaaaccggcacgataatttcatgtttatcagtggaactatgatgagaaagttagcgagggaaggacgacagccaccggagggatttatgcccccaaaggcgtgggaagtatgacgaagaaacttttggtgtttcataacgaattatttgctaaacaggtactttcgaattactatcgtactcaaaatggaaat

SEQ ID NO: 57093 - DNA, 73 bp, Heterodera glycines
  Genomic contig location: Contig_ID=SeqID_26353; Location=870..942; Strand=+
  SCN-specific regions: Sequence locations=1-73
gatgatcgactattgccgcaaaaacggtgccacagttgacatgccatcggaagcggagcttttcctacactga

SEQ ID NO: 57094 - DNA, 2125 bp, Heterodera glycines
  Genomic contig location: Contig_ID=SeqID_5151; Location=33..2157; Strand=-
  SCN-specific regions: Sequence locations=1-264,286-290,312-815,837 -1320,1342-1713,1735-2125
atggaaagtgaaatcaacatttcacctaacaacggatcggactttgatcccgttcatttcacgcccgaagaaaatgagaaatgggcaaatttacttggtcgaatgcgagcatttgaactggcagtttgtcgccaatttcgaacaatcgagaacgcattttcacaaatctcgagtcaaattcagattcaggacaccgctgaccgagtaagagaattggaaagttcgataaaggaactcgagaactttacagaaatggacacatttgagaccaaagaaaagtttattgaagtggaggaagaaattggaaaggtaagtaatcatatggaacgttatgagacgttcacaaaggttcgatttgggaaaattgttgaaaaaatgaaggatgaggttcggaaaattaccgaaaatttggatgttctaaaaggccgagtacaactgttggaatttgaacaagataatccagagggatttggggaatggtttgatgacggacaatcccaagaacataatcgattgcctgatgacaaaggggcaacggaaggggaagacaacatcccaattggggacggaagttgcgaaattatggttgcagatccatttttagggggaattacccccctcgagggttatgatggaaacccaagtgtatcattctcacggtgggttgcacgtttcgaggatatgctaacactatacccacagtattctgaagtgcaaaaattgagtagattgagaattttgctcagtggacaagcccgagccgagtttgactcaattgaaccctcacctgtctctctttctgatgctctaaaccatttaaaaagaaaatttgaaaacgaaaatactcggtcaattgccaggcaggcaatggcaagttgcagacaagcaccgggcgaacgtgtttatgagtttgcaaaccgattaaatgaggcagtcagaactgctctatcaggagaaaatgaagagacaataagaagaagacttcttgaggaatttcttgaaaaattaacccccgaattacaatttgaggtcaaggcggggaggccaacgagctattcaaacgcttatgaaattgctcaacattttgagcttcttctcgccactaagcggactaaccaagtgtcggtggcggattcagtcgctgaattgtcgcataaagttgaagcattggccatccgccaacattctgtacctaaaagaggaatagaacggcgcgtctgttactattgtcggcgtccaggccatgttgtaaaggattgtagagacaagaaaagggacgaagaaaggagaggacatggtggtcaaagggaccgaccgttctatggggaaagaaaatggaattatgagagaaatgaaagagaacaccggcataggcatttttcaccccacgacaggccgaactatggaggaaatgagggggaacaccgacaacggcacttctcaccccacaacaggccgagccacggcagaaataatcatcggtcaccaatttcttatgaaggaagggaatatgaaaatgaacgaactcagtcgccggggaggcgagttcgatttggtggccaaagaataggagccgcaaggattgctagcccaatttttctagcattaatggttattctctcattgtttggtgcaaattttgcgacaaattcggtggagagcccaatgatttgccatcccgattctcccgcaactttatggtcaatcccaattgacccgatttgtccaagttggacaccaacggaattgcctgtggcaatgaaattgaacgtatacagagtaaatacggtaaagtacaaaacaaaggcaactgcatgtaaatgcatcaagacaaaaatatccagaaggattggattttttgggggaaaatacgaggaattatcaacagaaaacgttgaaatgcctacggcaatgtgccgaaaaatgaaggattttgatgaatcatctgcggggaaaatggttcaaattaatgggacattgagggccacacaaaattcgttagagcccgggtggagaacctggccaatcggccttttctggagaacagttgaaatcgtaaattgctatttgtacgaaaccgtcgtttttgcacgtcacggcaattcgggaccaagcactcggggag

SEQ ID NO: 57095 - DNA, 578 bp, Heterodera glycines
  Genomic contig location: Contig_ID=SeqID_5152; Location=21..598; Strand=+
  SCN-specific regions: Sequence locations=1-282,304-353,375-578
atgaagtactcgttcaatgtccgcgaaattcaatccctcctcaacgggttcatgtgcattttcaagccccgtgatgtgtccatttcggccattgaaaagttgctgatgcgccgcatttgtgagcaggcgaactgcttggacccgtgccgtcctttgcccaccattgaaatgccaattgttgaagcccacccgaagagtggtgcattggttgtggttggaagaaaaaaacaaattgactacaggtcggtaaaattcgatttatatttgtcctgtttttttcggaaatttaaaaaaaaattttttcgtaaacatccaactaatttgatggttgttttccattttttgaatattctcacaaaattcaaaaatttcagcaaacatccgttgatggtaggccagatgttcaggcccgaagacatgcgcattgaagcgctcaattatttggagccttcctgctcgggcgtatgcggtaaattcaatggatattttctttttttattatgacaaattgtttggtctacattttaaaattttttcggaatggaattttagacatttctatggagaatttattgaaa

SEQ ID NO: 57096 - DNA, 317 bp, Heterodera glycines
  Genomic contig location: Contig_ID=SeqID_26354; Location=364..680; Strand=+
  SCN-specific regions: Sequence locations=1-317
atgtctccaaatgaatgttctgaccgtccctttcaacaacccgacaatgtacaacagccgcatcgacaaccagatgaagacgccgagttgcgcgcacaaattgaagacgcggaagaggatttgctcttgaattggtggcgtgaagatccgacaattgtaagcttgtttttcaatttagcatttttaatttcttcacgtttcagattcgttttctttttggacatggacgagcccctgccatagaagccgcgcttcttcaacgcgccgaacgtgaggcagaaattttgcgcgaatatgccgagaatcaacaacaatga

SEQ ID NO: 57097 - DNA, 636 bp, Heterodera glycines
  Genomic contig location: Contig_ID=SeqID_26356; Location=228..863; Strand=+
  SCN-specific regions: Sequence locations=1-368,390-636
atgtccaatgatgcagaaaaagagttcacaccggcaggcaacccgaaggcaccagcgcttcacatggcacttgactggatccaccgatcgtggcaggaaatttccaaagccgtgatcatcaaatcattcgagggtcagtttaaaaataaaaatgcctacgaaagacgccgaaacttttaagtctgcgggttgactacgccattggacggaacaggagacgaaaaaattgcttgcttcaagccggaaggagcaattggaccgattgggatcaaatttttgcgcgactttagagcaaatgagacgatgaaagatggacgaaatgatcacgaagaagccggcctatctgatgatgatgatgtagagttggatgcagtcggagatgttgatgaatttttcgtttgttaagttttttttatttactgttgatttggttttgttttttgaaaaaaattggtgccaaacaatttcttaaaattctatttatatcccatgggggataaatagagactgggggattatttttcgaactcctcagaaagggggggataattggagactgcgaaattaatagagactgggctataattagagcaaatacggtatgcatgaaaaatacataaaacccaaaatatgcaa

SEQ ID NO: 57098 - DNA, 1033 bp, Heterodera glycines
  Genomic contig location: Contig_ID=SeqID_26360; Location=152..1184; Strand=-
  SCN-specific regions: Sequence locations=1-87,117-157,191-443,483 -520,542-643,713-841,863-982,1013-1033
atgaaaagctatggccaatatgccaaatcactgctcaattcgcttaatggccatgaactgacattggtcagcgtatttttgaccgcaacattcattaacacaattacaattaattgcatggaaacaatttaccccaaagaagtaaatagttattgtctaattaatattttttgaataaattaaaatatttgggcgagtaattattctatttttaggccatttctcgaggcattgatcgaggccatattggcctagtgatcggcatataccaattaagcagatttttcatggcaccaattatcggaaattatgtaaatgatataattttttaaaggcacatacatacaataaattccatttttagattgtaaaaattggaacaaaatttacattttacaccgcactttttcttgtgtccgggtcagcaatttgttttgggtgtgttattttttttaattatttattaatttttatttaaatttgtgtttaggtttctcacctttttgcacagcaatttgactttctttttgtgttctttggtcatccgttttttccaagctgttggtcggacattttttgtgctgagtattttcacactttcagctgaactttttcctgaacacgtgtcgttgataggcgtaagaaaattaaatatttaataataaaaatttcactccttaaaatattaatttaaaataataaatttttaaatgctttttaatttgttttagagtattttggaaacatttgaaggcgttggccaaatctcagggccaatttttggcgcctcattgtatgaaattggcggatttatgctgcctaattttgtgatgggcacagcgatggcactgatggcatttgcttttgtcgctttggcaccgtttccaacggcactcgtttatgaagacgaattgcacaaaaaaacgatgcaaaacattgaagagggcaaaatggaggaacagcagaaaagggtgaaacaaacttttaattaataactttttttaattttaaagagaaaatttacgaaaataaa

SEQ ID NO: 57099 - DNA, 525 bp, Heterodera glycines
  Genomic contig location: Contig_ID=SeqID_26364; Location=1082..1606; Strand=-
  SCN-specific regions: Sequence locations=1-458,481-525
atggacatggtgttcgagccgttcagtgtggttctcaaaaagcgcgactgtcaggagattgttgatctgattcagatgctcccgaaaagtggtgctgagatacgcggagcaatgggacggagtgagtgcagcaaaaaaaaatggcaatttaaaagaattaattaattttgatcattcgcactcatcaattattaaattagtaatgtgggtcgctccatcctttggagcagaacaaaaggtcacggacgatttaaatttaaaaattaagttcatatgcttttatttaattggaattgattttaaatatgctatttttcattaagctgacttgtctttgctgaaccatttggtcaaaatcgccgggaattatgcgctggacgacatgatgttggcctacaaaaaagtacactttcatttcatgggttcaccgacttcttcacaagaaacttggctaccctaaaattttgtgtttgtttaattggctttatgatcaaattgaattttcgattatttaattctattaaa

SEQ ID NO: 57100 - DNA, 843 bp, Heterodera glycines
  Genomic contig location: Contig_ID=SeqID_5154; Location=57..899; Strand=-
  SCN-specific regions: Sequence locations=1-9,31-434,467-685,707-843
atgacgaaagcggcagcagcaacgacatgggattcaagcagtataacaaagccaacgggaacgacgataacatcaacaacaagtgcaattgtttcgatgttattggcaccgccaaaagctcaactggtgatgaacacttctccatcacgtacatccaccatggcagcagacaaagggcatggcatgtctacagtcaatgaacaaattgattggaaaactgggccgaaagccacactgatcagtgtgccgttgagcgtcgatcaaagatgccgccgcactgatcaaatgccatcattggctgcggatgccgcagcggtgcagcgagagagtgcgtacggtgtgcgagagagtgccattgggggtgcttgcgatgatcacgatcagccgccaatgctgctccgtgccgaagaagcgaagcgagagaatgtgagcacgtttgaggaagaggaggaggaggaagagaatggcaccaccagtgatcaaaagacggatgacaacactgatcagcagccacctcaactggtgctgatgattgcagcagagaaggcagcagaatgtgaggacgacgaatgggcgtcagacagttgtggtatgacgtcaagcttatcatcaacagcggcaccatcaaaggcggcatcatcaaaagtggcagcatcggcattagctgatcagaacaataatcataatgatgatgatgctgtgatcactggtgacgaacggcacgagccgcgatcgcctccgcctaccaaggcgagcaaacgtcggcagtcggtgtacagcgacgaacctagcagcagcaaggacggcacgcacgtcaccggtggcgaacggcaccagccaacg

SEQ ID NO: 57101 - DNA, 560 bp, Heterodera glycines
  Genomic contig location: Contig_ID=SeqID_5155; Location=20..579; Strand=-
  SCN-specific regions: Sequence locations=1-83,113-194,216-316,339 -384,406-560
atggcccccactgctgccaacaaacagcggctgccaatgccgatgccaaccgatttcagtgaactgatgggaccaaaaaaagtgccacagcaacaacaacagcagcagaaacaattggtaaggcaaggacggcattgatctcagcatcctcatattttgttttggatagctttagacaatggactaatcactggtttaattatacaagaaaaagggtggggaaggcctaccgaatttttgggaagggtccggggacatgttaatcgacggttttcttttttgcctttcaaaccgcttttttgcggcgcgctttttcaaaaaataataataatacagtgaagcccggcggagccgataggtgccgtaggggaaattttttttgaaattttaaagaattttattagaaatttgttcaaaataatcctgaaacttttgatcactctcttttttgtggtctcgagaattcggctcaactcccgattctctagttcaagttcgagttcgtcctctcttatcatcaattctcggcacaaaatttgattttttttcaaaaaaataaa

SEQ ID NO: 57102 - DNA, 814 bp, Heterodera glycines
  Genomic contig location: Contig_ID=SeqID_5156; Location=1586..2399; Strand=-
  SCN-specific regions: Sequence locations=1-60,90-104,127-220,242 -274,319-341,363-408,448-479,502-698,720-814
atggtcgagctgtacatgaaggagctgctgatgcaacagaaactccaacgcgaatacatgcttcaacaacaacagcagcaacaacaaactgtgagaatggcacgaaaatattaaaaatttatttttgttcgacccctaaaagcgaaaattttcggaaaaatttaggagcatttcagaaaattaaatacccatttgtgcttttcgacaattaaaactcctttctctggtggaggaaatttccaaatgtgtgccatctttttccccccccccctccaaataattataaaaaaattcttatttcaataaacttatttaatagcccccccctaattagtgcctccttataataaaaataattttaaccttttttataatgactcctttcccgttctctaaaaacaatttgtcaaaaattaattaaacaattaatttatttttattaattatgcccctttcccatgccattttcaatcactttcatattttccggacttttggaaaaatttagcgaaattttttgaaaaaatttggtgagggaggtcttggataggttacttaccaatgccattttgttcagcaattccatgccccgctgcttcctctggcgccctcgcccttcccactgttccatgcccttcagcatcaaccggcagtgcttccgccggcttctgccgctaccgccaccacatcgtctccatttccaacaatggcaccgctccaatttggcaccgccccgggtactgccggaccattcgccgccgcgccgttctgtgccgccaaaccgatggcatcgttttcgtcggtgccggatcag

SEQ ID NO: 57103 - DNA, 328 bp, Heterodera glycines
  Genomic contig location: Contig_ID=SeqID_26365; Location=486..813; Strand=-
  SCN-specific regions: Sequence locations=1-76,98-328
atggaagtcgaagaaacgaaagcgacaaaattggagcaaatgtttgccaatgtatggcaaaattggagtcattttgtgctattaatgggtttggaaggaaatgcaaaatgttttgatcgggcaaatacatttgtcagaagtcggcctttggaagcaaaggcagagtttcggccgatcaattcgatggactttcattccgacgtcggccgaatggtctgatcatcatggccttcgtcccgttgctccttgctaaccccgatcactttagctgtacaccatcgccattctgctgatggtccgtccctccgccgttcgttcgtccgattga

SEQ ID NO: 57104 - DNA, 331 bp, Heterodera glycines
  Genomic contig location: Contig_ID=SeqID_26369; Location=148..478; Strand=-
  SCN-specific regions: Sequence locations=1-39,71-135,178-225,329-331
atgtttcctcatcttcagcaccaacttggactaacagttcaacaacaacagcagcagcagcaacaacaacgaactgtcggcggaacaaagcgacgccattgcgaagaggggggaaattcggtgggatcaaagaagaaattaataaaatattttaaaattattaaatttaatttaattgcaggaaaatattgacatcaaatcagtttcaaaacggtttcatccaatggaggcaaaggaaaatgagaacaatggaaaagaaagtagtaaagaggaggaagaggaggaggatggggccgaggaaagtgtggcggaagaggaggaagaagagtga

SEQ ID NO: 57105 - DNA, 330 bp, Heterodera glycines
  Genomic contig location: Contig_ID=SeqID_26369; Location=742..1071; Strand=+
  SCN-specific regions: Sequence locations=1-2,45-77,101-272,294-330
atggaaaatgggaaagggaaggcacaaacaaacaaaaagaccgaattagggatgtaagttgtgtgggctaaaaatgccaaatatgggcttaaaatatacactaaaaacttcaccaaaccatacgcataaatgttaattttcagctttgcaaaaaaatatgtaagctctaatcggtcggcactttctcgtcctttattcgactcgatgttcgagaagtagcggagggagggcattcatttgatttgacaatttgacaaatattctatcattcgaaagctgttcatgaagcaaaactaattgttgctaccaatttcaccaaaaaaagagaaa

SEQ ID NO: 57106 - DNA, 781 bp, Heterodera glycines
  misc_feature (644)..(644): n is a, c, g, or t
  misc_feature (760)..(760): n is a, c, g, or t
  Genomic contig location: Contig_ID=SeqID_26370; Location=917..1697; Strand=+
  SCN-specific regions: Sequence locations=1-30,52-261,283-504,528-781
atggccaaagcaatcccggatcagaaagcgaatactgtatcagaaatttttgttgaaattgtggtccatcaacattcaactcctgagattgttgtgactgatcagggaagacagttcacttcgggaattttaatgatttggcaaaaatatatggttttgagcatgtcactacaacaccatatcatcagcagtctaatggaatagctgaaggggctatgcgaatcatggctaatattatttctcaaatagtcaatgaaaaagggaataattgggatgaaattctgccgcacgctattttttcatacaatgtttcaatacatgcagctacaaaattttcgccattttttatcattaatttacgacagccaaaattgccaactgatcggttacttaaactcccatcccccgatgagcttgtgtccgatatttcggtctatacaagaattcagactgaaaaagcagctaaagcgtgggaaattgtgcgaaatgaaattttaaaagcgcaggaaaggaacaaagaagagaatgatcgcataaagaaagcgaatgaaagagaatttgaaattggtgatttagtgttgtttaaaaaagaagttttgggccataaatttgatcagcgttggctgggaccaatgcgttgttgntgggggttgaaaaagaaaagaaaaatgttgttttacagtcaattgatggaagcgctaaattaagaaaagtacatcaagaaaaagtgaaacattttaatggaccagcaattcttccntctaggcagtcagacgaacca

SEQ ID NO: 57107 - DNA, 660 bp, Heterodera glycines
  Genomic contig location: Contig_ID=SeqID_26372; Location=1..660; Strand=+
  SCN-specific regions: Sequence locations=1-43,65-660
aaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 57108 - DNA, 270 bp, Heterodera glycines
  Genomic contig location: Contig_ID=SeqID_26372; Location=497..766; Strand=-
  SCN-specific regions: Sequence locations=1-270
tcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttt

SEQ ID NO: 57109 - DNA, 104 bp, Heterodera glycines
  Genomic contig location: Contig_ID=SeqID_26373; Location=191..294; Strand=+
  SCN-specific regions: Sequence locations=1-104
atgaccaaccattcattggcattcattagccgccgcctgggacaatggcacaaacgaaacggagtggattttaacgcgaaatgcattcggagaatgctcttaga

SEQ ID NO: 57110 - DNA, 457 bp, Heterodera glycines
  Genomic contig location: Contig_ID=SeqID_5160; Location=120..576; Strand=-
  SCN-specific regions: Sequence locations=1-165,187-457
atggatccgtccgctccagcgaagaagcgtggccgaccaccgaaggcgggcggcgtagcgaaaacaattgccaagaaaccaccagcgaccacaaaagcggcgcccaagtcgccgtccaagtcaccagccaaatcgcctccgagttcaccaccgcagccggtttaatttttgggatttcaaattttaatgccggaccatcaattacgcatgtccaccaccaaaacatgttttcatccaaaatttgtttaggcaaagggctcgcccgccgcaaagaacgccgtcaagccggcagcagcgactggacgcggccgtggccgcccaaagggcaccggcacatcggcagcagcgaagaagaaggcggccgcaccggcgggcggaggcacgggcaagcgcggacgcccaccgaagaagacagcgcagaaggccaaggagagcgatacggacgagcacgacgagg

SEQ ID NO: 57111 - DNA, 1197 bp, Heterodera glycines
  Genomic contig location: Contig_ID=SeqID_5161; Location=145..1341; Strand=+
  SCN-specific regions: Sequence locations=1-29,51-157,179-256,278 -480,532-558,591-689,750-1016,1039-1096,1118-1197
atgccagaaaaatctgtcaaaatttcgaaaactcttaagtatgtttcttcattctataattttaccttaaaaaggcgaaaagcattgattgctaatactaacaagcaccgaaataatacacactcagttactaacttataattagtccgtattttagagtgataagaaccacaagattagctgaaaaatttcagaatgcaatttctgtgctaattaatataaagacctacctgttaatagcgggtaattgcatgagaaaatatattttaaattatttcgataaatacgaattacagaaggaaatttttttacagtttcagcttttgcattccaatcagggctggctgtgattgaatttccaatcacggaaatccgtgagccgtgatcacggggcttttaaaaaaatccgtgacccgtgaaccgtgatcacggcaccccaaaatccccgtgatttccgtgatccgtgagccgtgatccgtgattataaaaaaaatttttctaatgattttttatttaaatttatttaaaaaacggaatttaatcgcgggaaaaattcccaaaaaatgttttaaagaaacaaaacatataaaccgctttttttgcggcgaccatttccaaacaatgactaagtttacgatttttggcaattttttgaagaaaattagagctttttgtagaaatctccaaggaaaaatttttatttttaactaatttattaagaaaatttttcaaatttttcttaaatttaaccaaaaatctatttatgtagagaaaaaaaaatttcctctaatttgtaagctaacttttgatgctgaaaaaaatcttttggaccaacatgctcagtccttcatgacgatctgaacaccccaaaagatactgaaagtcgggaaaattttagaaaaaattcttagagggttgggaaaattttctgaaaattttgattaggcctgtcgttttaaatttaagcgacggagagaaaaaatagggttttagcagtttatatgccaaaaatggtaatttttctgccattttggggtcaaaatttcaaaaatacggtaaaatgggggtccgtctgccggtggtgccgacaggcgccgccgggaaaaattttgaaattttgagtgaatttgttgacagattttgtccaaaatatgtccaatcattggttaatttattggtctaaggacgttttaaaaa

SEQ ID NO: 57112 - DNA, 1368 bp, Heterodera glycines
  Genomic contig location: Contig_ID=SeqID_5161; Location=2414..3781; Strand=+
  SCN-specific regions: Sequence locations=1-208,231-368,391-603,626 -830,852-1313,1336-1368
  Gene Ontology: Mol. function=lipid transporter activity; Cellular component=mitochondrial inner membrane; Biological process=transport
atgagtgacacaaatgtggtgaccaatttcatcgctggcggcgtcggcggctcatgcgccgtcatcaccggccatccgttcgacacggtcaaagtgcgactgcagacaatgccaaagccggcgcccggacagccgccactgttcaccggtgcgctcgactgtgtgcgccaaaccgtggcacgggagggattttttgtgaggttttttcaaaattaaaaaaaaaaaaatttgattttcgtccgcttcgagcgtaaatggacagtgattcggagtgggattttctctaaaacccacccaacccctaaatcatcgactgtttaatttgaaatacgtagatagacgcaatttggtcggaaaagcccacttttcaaagagtcacgagatttctataacctgaaaagttgcataaattcgggtgtggtgagaattttctgaaaaatcatggaaaagcaatgttttaatgggttttgggtccgaaatcacgaattttacacccattttccgcagtttctattaccaaacgccaattcatggacctatatcatataaagaatttccttttttttttggcatttcattaacgggattgacacatctaatttgccaaaaatttatccaaatttcaaaatcatgtcccttttctcaggcactttacaaaggcatggccgccccgctcgtcggcgtttcaccactctttgccgttttctttggcggcactgcactgggcaaatggctgctgcagaacgagccgggccagcagttggacttcaagcagaatttcacggccggtgccattgccggcgtgttcaccaccgctgtgatggtgccaggttgatcacttttttaagggctttttacttcttccgcttaaaagttaccgtatttgctaaaataaagccctgcggaccttaattttccaaccccccggcactaattttaggggatggcactattttccaattgatgccaattcatcatttttaggcgagcgaatcaaatgcattctccaagtgcagtccatggacggcagtgccggcacaacgcccaaatacaccgggccggtggatgtggtgcgcaagctgtacagagagggtggcattcgcagcatttaccggggcacggccgccacactgctcaggggttggtggattggggtacacggagtaaaattcacacccaaaatgggtcgattcaattttttaagtttttttttttctgggacgggcattgatttagggtccgtaaattttcgccaattttcaactcatttgcagacattccggccagcggcgcctacattgctgtgtacgaattgctcaaagacaaattttcgggcggagaacgaaacgagctgacgcccatggcaac

SEQ ID NO: 57113 - DNA, 870 bp, Heterodera glycines
  Genomic contig location: Contig_ID=SeqID_5161; Location=4853..5722; Strand=+
  SCN-specific regions: Sequence locations=1-112,134-870
gaacaaatttgacggcggagcccaatcgattcagtgcgatcaatcaaaaataactaaaacgtggcgaatttatttgacctcggcattttaaattaacaaatttttatgaaatttcattttttcaaaatctaaattggccaatttgaaaaaagtgtgcggaaattgtcagactgaaccgaccgcggccgcttcatgtggcattttatttctagggcttcgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaattttaaaaaacttattttcacctattttggcattttgcccaaaatttgttaacaaaaatgaaataaaaaggaaaaacagacccctaagaatcgaccgaaaatttttttcaaaaaatatacccctaagaatcgactcgaaaattttcaaaaatatacctttatttctgtgtctttttggcattttgtttgcgtattttgtaatttaattttcccccctctctcaacagaaggcatccgtgatgtgttccgcgaaatgttgcgcgaggaggggcaccgtgcgctgttccgcggcttcgtgcccgtcatgttgtgcgcattccacgccaacgcggcctgcttctccgggcttgagctggcgctgtgggcatttcgccaagcgggcatttgaaaaaaccatttttgctttaattcaaattcagtgctaatttaatcttattgtatttactgtattatgtcgaaaaattaaaaatcttttgctcataaatctcttatgtttca

SEQ ID NO: 57114 - DNA, 182 bp, Heterodera glycines
  Genomic contig location: Contig_ID=SeqID_26378; Location=1085..1266; Strand=+
  SCN-specific regions: Sequence locations=1-106,133-182
atggagaaggcctgcaaaatttggagagattatatcgattttagtgcgctaggttcgatgaaacttttaaaatataagcctaaactttttggcttatttaaaaagcaattaaaaatttttaaaaattttattcatatcccttttgatagaaaaagcatcagagagccttgattaacttttaa

SEQ ID NO: 57115 - DNA, 65 bp, Heterodera glycines
  Genomic contig location: Contig_ID=SeqID_26384; Location=1068..1132; Strand=-
  SCN-specific regions: Sequence locations=1-20,56-65
taacttgttatgagatgtacaaaaataatttcataattttaaatataattttatagaattaggtt

SEQ ID NO: 57116 - DNA, 1782 bp, Heterodera glycines
  Genomic contig location: Contig_ID=SeqID_5162; Location=493..2274; Strand=-
  SCN-specific regions: Sequence locations=1-88,122-195,218-244,268 -453,475-502,525-804,828-1059,1089-1195,1217-1232,1254-1782
atgaaattatgggtgcagaagcattcgacaagtgaggatgccaatgaaaataaagacaaaaaattgatttcttatggacaaaaatagcaaaaaaataaataaataaataaataaaataaatttttaaagaattttatgacttggaaaataagtgtctttttagttttaagcattcaattgggctatgacgttactcaaaaaccatcaaaataaaaaatttttttgatataactttgctcaaaagtaaattaaattttaattattaatgttattcgatagcccaaagtgttttctattatcctacaaaatttcaaaaattttgagaaagtttaaagaaagttatgaccaaaaatgttcaagaaaacttgctttagtttcgaaacttcatgaatttttttgaaatttagcaggataatagaaaacacttagggctatcgaataatatctagattctaaaatttgattcattttgggcgaagttatgaataattttctgccaacattttttattttgatggtttttgagtaacgacccggcaccattccattctaccaaaatgcatttagtgttctgtttggaaaataaggattgagtcctgtgccttctgttttcccgttttggattttctaaaaacatttcgtcgttggccgcttaacagagtggtgccaaagtgacagagaccttagggatgtgcgagagtctcggttctcgtctcgggaaatttctcgggtttttcgcttctcggtctcggtctagggtttttcgtctaggaaaaaacccctaaaacttcaaaatttgacccaaaaattaccattttctgtgaaaatctcttaaaaagggtcaaaattccaatgtttcctaccgcagtgcccatcgcggtggggtcaactccgtccagggacggaaggagaggaacagacgccggaagggaaggcaaacggctggggaggacgaacagcagctggaaataaatggcatgacatatgccattagtatggaatgatgaaaacaatttatggcacttttttagttttttgggctccgctgaaaaaaacaaagaggaacctttcatttttaaaatttcacacataactattatgcttactgtttaaaattcaccggctcaactgctggagtacaaacggcgatattaccgaacctttgaagggctctcgaatgggaatttttgagggtttaaaacttaaaatttgacagtttttatccatattttggtccatatttggccatttttgagctttttcgtccatgtgtttggcattttagtccatattttagtaaatttttggggtttttttagtccatatgatttataatcctaattatcattttcagatcactttttgtatgatcaagcgaagacgaactttaagctcgaagatgaagtcaccaaattgctcaatttgttgatgattgacgcgtcatttgatctcgaggcgcgcaaaaagtgcctggagacagcatttcaggtccaattccgcaactttgcagcgatagcgattagccaggagatggatcttaaacagatccagaaatatgtgtgtgctccgttgagtgaggtaatggcttttcgtcaaatggatgggatcagagactattccagtgggtggtgcgccggagggatatacatgcatcgctccctcccgtccaaggcgccaattccgtcccaggcatgtttaaaaaacatcataacttttttctcagttggccaaatttataaatttggcaacattcgaaagctttatatgtttagaagctattga

SEQ ID NO: 57117 - DNA, 340 bp, Heterodera glycines
  Genomic contig location: Contig_ID=SeqID_5163; Location=2674..3013; Strand=+
  SCN-specific regions: Sequence locations=1-80,159-237,259-340
atgtcaccgatatggccaaatttgtcgccaaaaatggcacaagcattaataaagttagaaaattgaatttgttcattttctattaaaataaataatacatttctttaattattttaaaacaattaaaatattttagaaaatattttttctattttttactttccaccgtccgcgattaagataattttttagcaggaatatcgcaattttcgggggaattcttaaaatttttttttcaggtttttgtgtcttttatttttcttaatgttaatctggacggtatgcttgattaaaaaaaattcagttttacaaatctatttgaatacaaaaaacacatata

SEQ ID NO: 57118 - DNA, 102 bp, Heterodera glycines
  Genomic contig location: Contig_ID=SeqID_5163; Location=912..1013; Strand=-
  SCN-specific regions: Sequence locations=1-102
taaactaaaagatttttcctcaacacaccggaagctcagtgcgtacaattgtgctcaggaggccaaccattacaattcaggaagatggacgcattcttattg

SEQ ID NO: 57119 - DNA, 73 bp, Heterodera glycines
  Genomic contig location: Contig_ID=SeqID_26386; Location=330..402; Strand=-
  SCN-specific regions: Sequence locations=1-73
atgcccaacagatacaacaaacacatggaaacgaatctaatgggtaaagtaattatggttatggagtcagaaa

SEQ ID NO: 57120 - DNA, 965 bp, Heterodera glycines
  Genomic contig location: Contig_ID=SeqID_26387; Location=105..1069; Strand=+
  SCN-specific regions: Sequence locations=1-895
atgatcagaagaggtacaacagtgattagaagaggtacaacagtgatgagaagagtgattagaagaggtacaacagtgattaaaagaggtacaacagtgattagaagaggtacgacagtgattagtagaggtacaaaagtgataagaagaggtacaaaagtgattagaagaggtacaaaagtgataagaagaggtacaaaagtgattagaagaggtacaacatggtatagtgcaacagtgattaaaaagaggtacaactgtgattaaaagagatacaccagtgattagtagaggtacaaaagtgattaaaagaggtaaaacgtgattaaaagaagtacaacagtgattaaaagacgtcaaaagtgattaaaaaggtacaaaagtgaattaaaaaaggtacaacagtgattagaacaggttcaacagtgattagaagtggtacaaaaggattagaagaggttcaacagtgatcagaagaggtacaacagtgattagaagaggtacaacagtgattagaagaggtacaaaagtgattaaaagaggtaaattgattaaaagaagtacaacagtgattaaaagacgtcaaaagtgattaaaagaggtacaaaagtgaattaaaaaaggttcaacagtgattagaagtggtacaaaaggattagaagaggttcaacagtaaatagaagaggtacaacagagattaagaaaggtaaaacagtgattagtagaggtacaaagtgatcagaagaggtacaacagtgataaaagaggtacaacagcgattagaagagtgattagaagaagtacaacagtgattagaagaggtacaacagtgattagaagaggtacaaaagtgataagaagaggtacaaaagtgattagaagaggtacatcatggtttaaaattaaataaataatgaaaagtttttataaaaatcgattgcattttaatttaaaatttttttata

SEQ ID NO: 57121 - DNA, 403 bp, Heterodera glycines
  Genomic contig location: Contig_ID=SeqID_26388; Location=47..449; Strand=+
  SCN-specific regions: Sequence locations=1-49,71-174,196-299,321-403
atgtgggttggagttcatttgagtgtgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatgtgagtgttgagcagaaaaagagatagacgttttttcaaaattttcagagccaaactcgcccagaaagaaaatccagaaaaattagggtcgtcgctactattccgaaaatgtggttggaattcatttgagtgttga

SEQ ID NO: 57122 - DNA, 836 bp, Heterodera glycines
  Genomic contig location: Contig_ID=SeqID_26389; Location=229..1064; Strand=+
  SCN-specific regions: Sequence locations=1-836
attgagaaacggcgtgaggcggtcagaaaacgaatttgcccgtgctttttgagactcaaatcggcgattgacgaccaatacaacgaaaagaaaaaggttgtcaagcgagagcaaaataactatgaaaataatacgacaaaaaatcatagactgatgaaaccataactttgatgttgtcatatgacaaaactgatagtgtatttttcgctcattatcagcacctttgacaactcatgagtgaaataaaaaatcgtttaaatcgggcattttatattatctctaccattaccccacaaaaataaataaaacgtaaaaaattaacacccccgcctttcacagaaattggacaccgtccgttctctccgtttacgcgcgttggagcgcggtcgggaggccgaattgagtgcagcgcggctgaatttgcatgagttagagacgacggtggtgcggcaccaatgcgaaaaaatggtggaaggtaaaatggagcaactcaaagcggagacggaagcggtggaaggtgtgcaattttatgatttgggacaacacttaccgaaacaccgaacccatgaataatgccttatttcttcgaactaactcgaaacccccttaaatgtcgttttgattaattcgcttttaatttcgaattccctccagttttaccggtgaattgttggttcaaagactacgtactctcaccgcattcttgaatttttacaatttaataaccgtaaaagccttttcagaaatttctacaagaacttttcaactcgaatttgacaaaatgcaatgatgagtacaaatctcaatcgatgaacaaatatttggtggaatgcgaa

SEQ ID NO: 57123 - DNA, 1079 bp, Heterodera glycines
  Genomic contig location: Contig_ID=SeqID_26392; Location=198..1276; Strand=+
  SCN-specific regions: Sequence locations=1-183,248-359,394-397,423 -687,709-1079
atggcttttagtggtattgcggcaactttattgaaaaatggacgaactgttcacaactgttttaaattaccattagatttgaatagcaattctttgtcatctattgaacttaggtaattctaaggaagcgaatgaaattcgccaaacagatgtttttatttttgacgaagcacctatggcaccaaaatatataattgaaatactaaataaaaaacttaaagaaattcataataatgattatatttttgggggtaaaattatgatattaagtggtgattttcgccaatgattacctattaaaaataaggcaaccaaagccgaaatactagatttattaatacaaaaaagtgaattatggaataattttcaaatttttcatttaactcaaaatatgcgttctgaccctttaaaaataggaaatggtaataacggtgatacgtttttacatcttcccgaaagttgcgatgtcggaaataatgatttaattgacgaaatttttggagaaataataaaaagaaaggtttttttgaaattgtgtaattactgtattttagctccatataacagagaaattaactgttacaacgaaaaagttttgtcaaaatttccaggagaaaattatatatttaaaagtattgatgatgcagagagtaaaggcgctcctattcttcctgaaatactcaataaactcgaaacaagtagtctcccgaatcatgaacttaaactaaaaataaattgtgtaacaaaattaattagaaatttaaatgttagtgcgggtttatgcaatggaacacgtcttcaaatacttgatattgggaaaaatgtattaagagtaatgattttaacaggtgatagaacgggtgagatcgattttattccaagaataagtttaatagaagataaaaaatttccttatgtacttaaaagacatcaatttccattaaggttagcattttgcatgaccattaatggagcccaaggacaaacttttgaaaaaattggtattgatttatcaagagaggttttttcacatgggcaattatatgtagcataatcaagaacacgaaattgggaaagaa

SEQ ID NO: 57124 - DNA, 7556 bp, Heterodera glycines
  misc_feature (7511)..(7511): n is a, c, g, or t
  Genomic contig location: Contig_ID=SeqID_5164; Location=1..7556; Strand=-
  SCN-specific regions: Sequence locations=1-55,77-300,324-510,533 -1442,1464-1813,1846-2235,2259-2264,2289-2630,2652-3977,3999 -4093,4116-4793,4815-4837,4859-4885,4909-5551,5573-5726,5773 -5877,5899-5981,6003-7556
  Gene Ontology: Mol. function=structural constituent of muscle; Cellular component=sarcomere; Biological process=cell proliferation
gcccgcgtattcaatgtaccctacggtgacctgccctccgacacttgcactactacccccaccaccacgccaacccaagggacgcacaccgatgaggataaacaggacttgaagagaaaggcgaaggtagctcttgacttagtggaagctgggttaatggccgatgccatgcaggatggcgcgcgttggaacaaggccaaaacggcaatcaatgtactcggaaatctccttttagcggaatctctggacaaaaaaggtgaccaatagccctgtggaggaagaaaaggtgcaggaagagcccaaagaaaaagaggaaaacaaggaggacattggagacattgacaaaacacttgatgagttcttcaacagtattaaagcatccacctcaaacttgtaattcattttgtccctaaaaatgcttaacacccaatcattcaccaataaagatatttgcttcaaactgccgtttggtctaatcatttcgggtccctcttcatcggggaaaactgaatttttattaaaatttattgctgaatcggaccaattgataatccctaaacccatctccatgctctattgttttggtgaaatgaattcggcggtgccggctctccaaaaggcgggagtcgatgtgtatgcgggagttccatccgaggaattggtcaagcgtttccctaagcctcttttgctcattctcgacgacctgatgctatccattgatgagaagtatttgtccgatttgttcaccaaaaagtcacaccatcaccaatttgcggtggtgttcgtcactcaaaatttgtttgagcggaagatcaaggtggcccgcatgtccgctcagtatctggtactgatgcgggcaccgaattcccagttgtccattcgcaacattggcgttcaactctttccacgacaacttgattttttccttgatgcttaccgcaaagcgactgcccgtccctatggctatttgttgatcgatatgcatgcttcatcggacccatcgttacggcttcgaacaaacatatttaaagatgaacaggaggaagatgaaggaacaattgtgttcatccccaaaaatggagcaacataaacaacaacaacaacaagtaaatattggagagctgataaaaaacaattgcgattggctctgtgccttggccaggacgaaatccgctaaaaaatgtaagaaactgatagggaaagcaaactccgaacagctgctcgcactggtggaaatttgtctgaaccttgtcgcttcacgcttccgactctcaactcgtcagaaaaagcgactgatgccccatgtggatactgtacgccgaatgagcagagcgagaagtgagcggggcgcccggcgtgtgcttgtccagaaaggcgcaggatttggaggattgtttgctgccgtattaacccccgttctaattgaattggcaaagtctatcatgaacaaaaatgcataaatacccatcgacattgttattttgtatgcttccatcattcattcattggcgataaatggcgaataaatttttactcgttcctcaagaaatttatcgtggtctcacctccgtgtatgacacgggcgacctcaatctggatgctgttcgacacgatttgaaccgagccaggggtgagcgaacaaatccctcaacaaaaaatgtccactacaaccaacagctaaggcgctatttgaaaatgaggagggatcttgcggacagaccagccaaagttgagctcaccaaaggaatcagtgtactgatgaggagaggtggtgaagatgaagatggtgaggttgtggacactccacgccgaccccctgctccaccaccaccacctccaccgccagggagacgtcctccgcgtggaccccctcctccaccgactgggagacgccctccctctggaccaactactcctcgtccctccccacccggaagtcctccgccccgtcctgaacgcccccaaagaccaagtagagcttctcggagaggtggtcgtctggagaaatggcggaaaagtcgatacaatatacagcaacggcagccggtggtgcgggaccttcttgcagaagcagctgctgcgccattgcccgaaagtgacgatgatgatgatgagtacatgttggagagtggattcgcgttgccagcgccgtcacaatattatggcgatttgcctgtgctgcccgacaacgcgaacgaaattgaggagatggacactgctcagcacaggagtgccaccagaagaaaattacaaaaggatgaggcaaatgataatgatgatgatgatttacgacgcaaaagatttttggtttatcaccgttcacctccacggctcccatccccgcctcgtttgaaaacaaaaattgaaccaagaccacctccaccgcgtcctaccgccaagagagaaaaacaacaggtaaagctgaattggaagaaaacccaacaccctactccagcgcctcgggcgaaaagagagccagaacttaagctggacccgcggccatccacgtctaggcaagccgggtacttccctcccccgacaaccaaaatagaaccaaaacatgcaccaacaaagaggcccgtaccataccgtatcccggaaagagagccaaaaatcagagaaaaaccattacagcaacaacaacctcctcatcctactgctgtcgtcgaagaaataccctatgttcctccgcctaggagggggaccaaacgcccccaccccgtaaatgatgagaatggtgaggtgcacataagaaaacgggtgaggcaaccgagaagggtaagagtacagtattcgccagagccaggcccttcaacatcagcacaagcttatgaacaacaacggcaacaacgtgaactgtttgccattccgtcaaatcagctgaccatgactcagcggattgaacggctatacatcaaatgcaaccattatgcggatcgtatgggcgttcggggaaatacaattaataccgcaaacggcaagccgttggcgcatagcaatttgcgaatggccatcaagtatataatagaccggagagcgggccgccccaccattaaaccaccaggagcgaacctattggaagagcggcttaggaaggacccaattttgtattcatggacggccccaccaaagagaccgtcacagagcaaaaccacccggacggaacgggcaatcaagaaggaatttcgcccgaaaaaatggagctgatcaacaccactcttgacaaaatgtacaatgatccatcatccccagcggcattcgcaggtgttacagcgctgtggaaagaggcgcgaaagaagattaaacatttacggaaaaaggacgtacagcattatttggatggtcaccgcacctacactctgatgcgccctcgcagggtgcgctttccaagggccaaaactgttgcagcgggattcatgacagatgtccaagtggatttggcggattttcaatctctttcgcgccacaatcggggtcaccgctacctacttgttgcggttgatgtcctctccaaacgcctgtttgttgtaccgctgaaaaataagcgagccgaggagatgctggaggcattcaagcaactcatcgaccaaatgcccatggtgccccaccgtattttctccgacaaaggcaccgagttcaaaaatcgattgatgaaggaattcttcgaggagcgggagattgagaagcatgagcctgtccattcatccgtaaaagcgtcggttgcagaacgagccattcgtaatgtgaagcagcgactgtaccggtatttcgcggagaaggagacgctgaactgggtggatgcagtacagaaaattgtggatggaattaatagttcacactctcgtgttcacggtatgcgacctattgatgttgatttttcaaatgctcagaaggtgtggaaacgaatgtaccgtcccctatcatttttcaaaaaaacgccccgcttccgtaaagatgaatttgtgcgaatgagcagagagaagggacaatttgagaagggatatttaccaaattatggagacgaaattctcgagattgatgaggtgttgaaagcggtgcgcccaattcgatacaaattgcgggatgaacatggtgagaaattcaagggcagcttctatgagcaggagttggcgcgcgtaagaaaggacgcggatacaagctaccgtatcgagaaggtgtacaggaagaggaaaagaacggacgggaccacagagatgcttgtgaaatttattggctatcccaatcgggagtgggttcatgagtcccaacttgtataaaagcgttcacatttttcaacatttatgcagataaacaatcatgtcgaacagtttctttgtgtttttacctagtaatgtgagtgattaccctgacaatcagccgaataaattccgtgttcggcttccaaaacctttacattttaacggctcgtgggtgtgcggactgcacagtatcagttacccctactcatggtcaaccattggcacattggatgagcaatggattgacattcacttcaccgaccgcagagcgaccgatgaggacagacagcgagtgatcagagtgccggtgcctaaggcatcgcatagtcgggttgagcagttgagagaatttttgtctgtcactttgagtaatcatagcggtgcaaaactacaacctctccctcgtgaggtggaagagaatcggaatcgtacaacaacaaagcctctcggctcgccaccgcctttgaaaagacagaaaagagatacggtgtttgacgtgagtagaaaacagattgcccctcctccattgcataatgaaaatgatgacgatgaagaaattattgaggagtcaccacctcatcatgaagaagatgatgaagggccgattgaagagtcaccacctcatcatgaagaagaagatgatgaagggccgattgaggagtctccgccgcattacaatgaagagcaaaatgatacagtaacagctcctgtcacaccaaaagtgccggtaccagcacctgtcacaagccctgcgaaaccaacgacagtaaaaacaccagctactccatctgtaacaacaccagcgcctcccacaactgcaaagccgccagtaaccgtcccttctccaaccacaaaaccaataacaccgacccctcctcctaccacaaccacacctactccaaccacaaagtcaacaaccagccctccacctaccacaaccgtccctccagcaatcacaaagccatcaaccggccctccacctaccacaaccgtccctccaccaatcacaaagccatcaaccggccctccatcaacagaaaagccaataacaacggtgcctgcaccgccaaagacaacaacaacaagtacgccagcaataagtgcagttcctagcccatctgttaagccgacgattccggtaccgccggcgcaactaaaaagctcggcactgtctccaaaatcaaaaaccccaatttctactgttaagccgccacttccagcgtcggtttccgctaaagtgggcactaggcctcaaacgccgccgtctcctaaggcggaatctccaccacattatgatgaagaagaagataaggacaaattaactgtaaagacagcaacgcctgtaaaaccttctgccaaaccgataattacggcgcctccagcgcaactaaaaagtccgacagcatctcaactcaaacctcaacagccttctaagcctcaagctccgccgtcaggctctccaccccgttttgaagaaacagaacatcaacagccaccaccaccaccaacatcagcagctcaaatagacccatcgcgtttgattcacacgctcgacccaccaaaaatattttttagaactcctccagctaatcaaaaccctctgacatatgtgcccaattcagtgtttattctgtatgaaaccaatatggaacgtttcaagctggtgttcaatgaggagatcatcagccatttgtccttctcaccacagctcgggtatgtgcttggctttgaaaaccctcagcatgtggtgtcaaatgaagttgccaaatacgggtttgatctacgaggtggcatatcaagttttgcagtctactcaaaaggactaactgaaaatatgataattggcaattcattgagctccttgctccgggttgtgtctatcagcggtgctatccccggggagtataatgagaagatttacgactcgccaatatttgcgcgagtgttgccacgtgagatcaacgagattgagattgaactgcgcacaatggacaaaggtcgtctcgtgccattcgcctatgggacaacgatggccgtgttgatatttaagaaagtgataaatttttgatttcattcattttatgttttatttgtcatacgttaataaaaatggttcatattgtgtttgacccaagcattgcgcagtacgacgagtatgtgcagtacggtagcggattagaaaaggacgattttgactacttcagggggtcaagcccctttcagagggggtacggtattcaacgaggggcgggcgttggagatgtgtttcgtggactgtggcgctttttcctacccattcttcgccgcgttggcaccacggtagggtcggaggcgctaagcactgggcaacgcgtgctggagcgagtcgggaatgagggggtgccatttaaagaggcgcttgtcagtgagggaaagcgaggaattgataccgtacttgacaaaggaggactaccaaaacagtttggaagcggaaaacggagtataaaaagaaagagaacatatgtacatggtcatcagacactaattggtcgacctattgtaaaacaggcaaaaaagcgtattcgatcggacgcctttggactttactaaataaatgacatttcacaaaatcgacaacgactcagtgaactcaatcaccaatgcattggactttttccgtataccccctacaaatgtgagcgtctcatcttcaaaggtattcgagcttctgcccagcaatccgcttaccgacacaccctaccacttcaaacttcactccagtcaaaattacattgacctctccaaatgctatttgctcaccgagtttcgaatccgtaaggaaaacgttaatggtcaactcgttaacctaggcattgatgacataaatattgcgccaattcaaatgatcggacaaaccttcatccgtaacatcaaaatgagcatcaatgggcgcgaaatttttaatgcaaacgccctgatggcctacaaatcatatttctcacatgaactctcctattcaacgaccgcaaaagactcccatctgaatgcagctgggtacttccgggacacgggcgatacattggagatgggaggcggatgcacagcgcgacgcgatttatttgcgggtagcaacgtagctcaattcattgcaaaaattgacaccgacctgttcaatcagccgttgtatctgatcaatttttgtgaattggacattgaaattttgcccaacgacaacgactttgtgctaatttcaccagtcgtaggtgcacccanaataacattttgaggtcatgggtttgaaaatgtatgtgaagaaag

SEQ ID NO: 57125 - DNA, 390 bp, Heterodera glycines
  Genomic contig location: Contig_ID=SeqID_5165; Location=334..723; Strand=-
  SCN-specific regions: Sequence locations=1-13,37-390
atggagcggcataaacaacaacaacaacaacaacaagtaaatattggagagctgataaaagacaattgcgattggctctgtgccttggccaggacgaaatccgctaaaaaatgtaagaaactgatagggaaagcaaactccgaacagctgcttgcattggtggaaatttgtctgaaccttgtcgcttcacgcttccgactctcaactcgtcagaaaaagcgactgatgccccatgtggatactgtacgccgaatgagcagagcgagaagtgagcggggcgcccggcgtgtgcttgtccagaaaggcgcaggatttggaggattgtttgctgccgtattaacccccgttctaattgaattggcaaagtctgttatgaccaagaatgcataa

SEQ ID NO: 57126 - DNA, 954 bp, Heterodera glycines
  Genomic contig location: Contig_ID=SeqID_26395; Location=874..1827; Strand=+
  SCN-specific regions: Sequence locations=1-32,62-67,106-114,143 -143,173-215,266-281,320-423,456-470,529-565,591-613,724-954
atgcgcgccattctcttcctggccatggtttgcttggtgatggctgttattcttgagacaggtggccaaaattaattaaaaatttaaaaatattttattattttagccaactcaaaggcagtgaaaaaagacaataagaaaggtataaataaattgaaaataaatattaattggaatatgcttttaaaggagcaattacaacgccagcaaaaggaaaagcggcgccgaaaggagcagcgaaaggaggtaaagcagaaaagagagagggactaattaatacaaattaactaattaatcaaataattaattaaggaattaaaaaagacgcaaaatcaaagggaaaaggaaaaaaggacgccaaaggcaaaaagggtaaggattttaatataaagcgaaatttaaacagttaatttttgaattttagacaaaaaagctaagccagccaaaggaaaaggtgcccctaaaaatggtaattattattaattttaaatgctaattaaaatgattgaataaatttagataaaaaatccccagcggcaaaagccaatgacaaaaagagcccaagtaaataattaattatatttaatattgtgccaaaattgccaatttgaagccaaaccaatggcagcagtgaaagccgtgccaaaggcggcggagaatgctcagaagggaccgtcgagtgcggaagtggtggcggaggaaaacaacttggacactgaggcggtcgacgacttgggggcggaagagtcggactttgaccaattggcagaggacgaactgctcgaggacgacgccatggacggcgaggcggacgaatgggaaggcatgggggaggagacggagatggacagccaaatggcactctgatggccaactaattggacaaattacaaacggaacaaaacgggacaatgacacaaaatattatttatcatttttggcatatcattgaaa

SEQ ID NO: 57127 - DNA, 56 bp, Heterodera glycines; identical to SEQ ID NO: 52733
  Genomic contig location: Contig_ID=SeqID_26396; Location=29..84; Strand=+
  SCN-specific regions: Sequence locations=1-56

SEQ ID NO: 57128 - DNA, 995 bp, Heterodera glycines
  Genomic contig location: Contig_ID=SeqID_26397; Location=417..1411; Strand=+
  SCN-specific regions: Sequence locations=1-258,304-320,342-405,444 -475,497-598,636-874,897-995
  Gene Ontology: Biological process=regulation of protein activity, epigenetic
ctgatgaccgatcgcaaagcacgcccgggcccggcacatccaaaattgcggaaggcgtcaaaaaccgaagttcaaaacgtagtcgacgacgtgtcggcggtgggccccatggcggtgccggtgaagacgatgaggactacccatacaagccggacgaacttgccttcaacaaaacgtcatactttaaagtcagtgccggacggacacgattttttgaatccgagaaaaattgcatctcttaactccgaagttttttggaaattattttttaaattttttgtatcacttatttttttattttttgcaatttaaaattccctaacccgaattcgaacaaaaattagatctttttttttccaaaatatgcgtttttaaattcatttacatttttgatcgatttaacgcattaaaaaaaattttttttggtttatataatattatttcccgtcaggttgaaaagctgttggcacaatttggttggggccgttgggctgtgctgaaagcattttctgatttgactgaacatgaactggaacacatcaccaggcaattttcaatttccttttaccccaattgttgatcattgatcagggggtggggattttggtaaatttaaaaaatcacagatttcatgtcttgacattttttctggagaattccacctgtagatcactgatcagagtgccgttgccattctcctaaaattgattcaacaaattattgggtagttatgcccattgattttgacaggacactgttgttgcattgtgttcgcgaatttcgtggcgatgagaagatccgtgaatacgtgtgggcactgatcactccgtcgcatcgcacacaaaaaaaatcggcaacaacaaaaattgatccggatcaaaagcagcagcaggatgaaaaaaagacagcagcggcaactggggactcaaacagccgctaccaccagggatgggccgctttgcctgaatacaatgtatgtcgtctaatgctcatct

SEQ ID NO: 57129 - DNA, 351 bp, Heterodera glycines
  Genomic contig location: Contig_ID=SeqID_26398; Location=1269..1619; Strand=+
  SCN-specific regions: Sequence locations=1-70,92-351
atgcctaaagcagccaaatcaaacgctgtgttaaatcgtcactggatttcaaagttcccggaaggaacttattcaactgatggaaaaattaatccgggactttacaaattgattgatatcgccaaaattttgattggaggtcgggcgaaaattgacaaagactgatattaaatatgattttttttttttgagtaaatacatttggtttttccaatttttagcacatatttttgcattttttaacacatatttaggcctttttttttggtttttagcacatattttattacatatttcaggatttttagcacataaaaatcccagccctaattattatatataatcacagca

SEQ ID NO: 57130 - DNA, 405 bp, Heterodera glycines
  Genomic contig location: Contig_ID=SeqID_26398; Location=1790..2194; Strand=-
  SCN-specific regions: Sequence locations=1-405
atgaaaaacacacgaaaaacagtgaaaagtcgtcgacgccggcgggtgttgtccatgagaacaacgaatttggtgtgtcagtcaaccaattatggcattaatcgagcttaaaataaaggcatcgagatcgtcgaacaacagttgccagaggaacgacagaatcttttgcccgcaaattcggccaccgttggcatcggctcggactctgtccgtttggcctacgaactgccggaagcattgccatcgcaaagtgccggcgaaagtgacggggaaaggaccaatggaccgccgaattgcaacacgaaaacgacggaggaacagcaacaacagaccgatgcggtgcttctgaatacgaatgtgaccgccgaactgacagaattaatggccaaattgaaggcattgtaa

SEQ ID NO: 57131 - DNA, 1459 bp, Heterodera glycines
  Genomic contig location: Contig_ID=SeqID_26399; Location=265..1723; Strand=+
  SCN-specific regions: Sequence locations=1-345,367-1411,1433-1459
  Gene Ontology: Mol. function=potassium:chloride symporter activity; Cellular component=mitochondrion; Biological process=embryogenesis and morphogenesis
atggcctccaattaccaagggtttggttttacaccattatacgaaaaggaagaacccgcctcgttctatgtagacaaaaagaaaatcgaagaacgggttagtctctctaagccattcgcacacatttcattcattgtcgtcatttctgatccaggctaagctcggcgtcatgctcggcgtgtaccttccgaccatccagcacattcttggcgtcaccatgttcatccgtttggcgtggatcgtcggtgtcgctggcgtatcgcacacttttctgatgctcttcatttgctgcctttgtgtaactttgcgttctttcaattcactttttcacgtgtccttcagacgtttctcacctgtattagtgtgtcagcggtggcgaccaatggcgtcgtggaaggcggaggagcatattttatgatatcacgcaatttgggacctgaatttggaagtgcggttggcattctgttctatctggccaacactgttgcaacttccatgtatttggttggaggaattgaaattcttctggtgattcttccggtcaacccattgacttttcatccgtaaattttcagttgtacctttgtcccgggatgacaattggcggtaaaaatgcgcacacggacactggtgagttacatcagcacacggccaaggggccaaaggaagtggcgacagaaatcagcctgggggagggcgacgcaaattccccccttgaaaagtcgcttattttagtaacacaaatacttaccctcgacaggtttcttggggatgatgtccaacaacatgcgtctgtatgctacttttctgctcattgttcagttcaccatcgttgcaatgggtgttcgttttgtccaacttcttgcacctgtaacttcttcgttttctttcccctaactttgtccccctaatttccctaaggtttcgctcgtctgtgtcattctctccgttttggcttgttacgctggtgccgttgaaaaaacgatttccggaagcggacaacagtatcttttgaggaagctgtacacttcaaatcattgcattcagagtttgcatgatcggtgaccatttgcttcaaactgatgcagttttgaaaggcgtgttcaaaaatcagtccattcccgagggagtgtccgtctgcgattattgcaactcgacttaccttttagacctgtgatatattttttcttttttaaaattttcgacaacctttaagggttatcaaattttctgctaaggacaacaacagtcaccttctgaatgcctcctgtgtcaatggatttcccggttttgccactgacactttttggggtcagtgatggtaaaattttttaattcccatgcatttccctcaattgttacaggcaatttcaatcctaattaccccgactttcatgaatacgccgtaggaaagaaagctgacgtttccaaggaagtcttccaggatgtcaagacgtaa

SEQ ID NO: 57132 - DNA, 304 bp, Heterodera glycines; identical to SEQ ID NO: 51570
  Genomic contig location: Contig_ID=SeqID_26401; Location=673..976; Strand=+
  SCN-specific regions: Sequence locations=1-304

SEQ ID NO: 57133 - DNA, 105 bp, Heterodera glycines
  Genomic contig location: Contig_ID=SeqID_26401; Location=1180..1284; Strand=+
  SCN-specific regions: Sequence locations=1-105
aaaattcccctcaaaataaaaggtctattgcgcaccgccctccctatcatgctcgagagcatttgtatgtgtataaaatttatcaaaaaaagagatagcattttt

SEQ ID NO: 57134 - DNA, 805 bp, Heterodera glycines
  Genomic contig location: Contig_ID=SeqID_26402; Location=244..1048; Strand=+
  SCN-specific regions: Sequence locations=1-467,501-600,648-658,688 -704,726-805
atggagagggcgtgtgctcaactcgagtctcttggcaaagtgttggacaatgccacgccctcttcggttggtacaaatttctttgccgatcactcttatcaattcctatcgatatctgttccattttcattcccactccatgatttttccctttaggtcaccctctcccatcgtttgtgccttctcttcgcctccaatccaacgcccttttggacggtgctcaaatggcatgccgatgtgctcctttcgctcggctgtgtctctgatgcccttcgcattttcgaacggctccaactttgggaggaaactgtccaatgctttgtgagtcttcgtcagtcggaaaaggccgaggcattggtgcggcgtttgttggaacagcgggaggaaccgttgtacctttgtttgttgggcgatgtgacgggcgacgcggagtgttaccaaaaggcgattcgggtgagacgcgaaaagcccttttttggtgcatttgatttttacattttacaaaaaaaggggggtccggacgatccgtcagtggacaatccgtcagtggataatccgtcagtggacaattcgtcagcaaattttttatgagcaatgatcaaaaattttaaaaatgattgttaaatttaataaatataatttttatagatcttaacatttctagttactttatagtttaattaattgacaatttcgagaaattatcatttaattcttttaaaatggttatttcatatttttataaaataacacaaattattaattcacatttttagcgacttaaattaatttcacatgattttaa

SEQ ID NO: 57135 - DNA, 466 bp, Heterodera glycines
  Genomic contig location: Contig_ID=SeqID_26403; Location=992..1457; Strand=-
  SCN-specific regions: Sequence locations=1-153,175-244,270-445
atgggagctcaggaaaatacaggtaaaaacctaaaatggtatgtatccctaatcattatatgcaaatttccacaacaaaaaccataaaattgacacaaaataataaaaaaaaatctcagaaaagataaggatttttatttaaatctcagctaatttttagagttgtaaataaatcagagatcgtatttgtccttatttctaagaattctccttatttcagccaaaaaaaaattttttcaatgtaatcactgaaataaatataaagtcaaattttatcttaattttatctccgaatattcgagacattcctccaacagattgccaatttcacacgacagcgaaaagaattggcagtgcattaattgcaacaaatgaaatttgtagtaattgggaatttagttaatttttctaattatacacgggaaagagagactccatctgctgactgaaccaaagaaaaaataaa

SEQ ID NO: 57136 - DNA, 1315 bp, Heterodera glycines
  Genomic contig location: Contig_ID=SeqID_26404; Location=208..1522; Strand=+
  SCN-specific regions: Sequence locations=1-1079,1102-1315
  Gene Ontology: Cellular component=nucleus; Biological process =neurogenesis
atggccatcaacagagaggccacccgtttcggcaccgaggcgatgatggcacaacgaccccagcagcaaatgatggcacgtgtcacccttcagaacattgccaaaaatgcgggccacattgacatcaccggcaagctgatcggaatagaggccaaaacggtcggattggtggccacaccgacgccggcgccaggtgagtgggcattgtatcacgacccatgggtttggaattgttttcgttgtttttactagagcatcactcattctttgaggaattgacgactcaccactgatgacctggggagagattgagggcactccgttccgactcgacgcccccgacattcagccgtcgctggaggatgcgcccgcattccgagtgagtggccgactaattgtcagcaaccgacacgaacagaattcggaaccgaaaaatcccaaattttgtgcaaaaattcgattattcctttgtccctaaactttgttccattcatttttcagatccccgaagtgccaattagggagaaaatcgctcaaggaattgccgagcaaattgcgtctcgttaccataacaaacggaagagggcaatggaccaaatccaacaaatggcgccgtaagaggcggaagagatgcctttaattccgttgaattgtagaaagacgccaaaattcaattctgtgcgctcttccggcggtcgtttggccacaatgtctcctgccgcccgcagtcttttgggcgataaacttggcattcgactgggcactgatcggatcaaagtttctccaagtccgagggggtcagttgaatatttgttgtttaaatgtcgtaaaatacaattaaatcctcgaatttaagttcggcttcgagaacggtcttcagcccggcaatttatcagatgatcaaagtgaagaatgagcccaagtcgggcgcaacgacgcccaaacgggcggcagcgacgccgactttcgagcaggttcatcagttacggacgacctcctgagggtaatgacgacaatcgaagcaaaaaagcgggtccattttatttagaattccttcacctggtccttcaacactaatcaaaaacaaagaacaaagagaagcgcagcaaagaaaaggtaaataatgtcaacaaaaatcagaaaaacattcgaatggctttaagtttcggaaacggaagaaacccagcaaaatatgggaaaaaggccatcagctgcggatttcttctgatgtatgaattcaaatctacatgttctcctagcaagtgaaaaagtgacgtattttcaattatgtttttcccatttattttttcaacga

SEQ ID NO: 57137 - DNA, 606 bp, Heterodera glycines
  Genomic contig location: Contig_ID=SeqID_5167; Location=1774..2379; Strand=-
  SCN-specific regions: Sequence locations=1-606
  Gene Ontology: Mol. function=phosphatidylinositol transporter activity; Biological process=nonselective vesicle transport
atgtgcgcctacaaagtggtcaccgtcaaattcgattggtggtgcttccagacaatggtggagtcttacatccttaaggtgggtggtgcccatgcggggaataatctttcgattcgtctaatttcagcaattttcccccttttagcagtacgcccgccttttgtgcaagttcaatcgcgaggtgttctgctggatggaccgttggtacgggctgacgctggcgcaaattcgtctgatcgaagaggagacaaagaaggcattggatgaggtgggcttctactctgccaccgtccatccaattccaccgctttacgtaatcgttgtccattttgctcagatgaccggcaggccgcgtggaatgtccggctgaacgctatgatgaaccgcgagtgacgtgccgatgacgctgatctgtttgctcatcatattatatcgtgccgatgacgctcatctatttgctcgtcatattgtatataatatttgtcacaccatttgtcctttcacctccacgcattcatttcggcacttattgtttactgaacacactcccaatttcctcctgattgatatgtatgtattattgtgcttatgttgacagaaaataaa

SEQ ID NO: 57138 - DNA, 1327 bp, Heterodera glycines
  Genomic contig location: Contig_ID=SeqID_5168; Location=122..1448; Strand=-
  SCN-specific regions: Sequence locations=1-1327
  Gene Ontology: Mol. function=calcium ion binding; Cellular component =integral to membrane; Biological process=nonselective vesicle transport
atgccgttcgccattgaggagtatcaaattggccaattgttttctgtgaccgaggcatcgcgacaggttggaggaacttgcgcaaatcccgtggagtgagcggcgttttatctgctttttcttccttttacaggagaccggcggtggcgaaggcgttcaaatggtgcgcaacgagcccttcgaaggccaaagtctgttcaatggccgcttcacgtccggacagttcacgcacaaaatcatccacttagatacgtgagttttagagggaggcgcggaaatgtaattaatgctaattggtcgtctttttttctccagaaaagtgcctgctcttctgagggcgattatgccaagaggttcgacgacgctgcatgaacggtcgtggaacgccttcccgtactgcaaaacggaggtgaccaacccggactatatgaaggacaactttctgatccggattgaaacaatgcacttgagcgaccgcggcaccacaaaaaatgtatggatggaatgatcatcatcatcactaattaattgttaattatgccacaatttaattttccgtttttcaggcactcggtctgtcgaaggatgagctgaacgaacgcaaagtggtgcgcattgacatcgccaacgacaacgagtttctgaaagcagccgacatccttgacaacacccgaccgtcgacattccgttccgtgaacacaggccgtggtccgttggagcagcagtggcagaccaactgcgagccggtgatgtgcgcgtacaaagtggtcaccgtcaatttcaaatggttcggcttccaaacaatggtggagtcttcaatgcaaaaggtggcagattcattcattcgtcctgtttccaaacaccacctccaatttgttccctcccccttttagtcattcccacgccttttctgcaagttcaatcgcgaggtgttctgctggatggaccgctggtacggactgacgctggcgcaaattcgtctgatcgaagaggagacaaagaaggcattggatgaggtgggcttctactctgccaccgtccatccaattccaccgctttacgtaatcgttgtccattttgctcagatgcgcgcgactggcaacccgaaggggatgaccgataactgaacggcgctgatgaaccgaatgacgtgccgcgaggacgctgatctatttgctcgtatattgtatataatatttgtcacaccatttgtcctttcacccccacgcattcctttcggcacttattgtatactgaacacactcccaatttcctcctgattgatgtgtgtgtatgtattattgtgcttatgttgacagaaaataaa

SEQ ID NO: 57139 - DNA, 552 bp, Heterodera glycines
  Genomic contig location: Contig_ID=SeqID_5169; Location=79..630; Strand=+
  SCN-specific regions: Sequence locations=1-43,67-284,306-446,472 -521,544-552
aaagccaaaaatcgatgaggaaatcgacgaaaacaacacattctgtgacctgctttgggccgaccccactaacaatgcgcaggagcttcgtctttgcaaggattacgagccggacaaagggttcctcggcgagtacggcaactatcgctttaatacggtggattggtcccgaattttgtcaaccgttttttaatacttttacaatcttttcaggaccgcgaaacttcaattcagttcaacgaccgctttgcgcaggagttcttcaatcgcttcccccacatccgcggcatcttccgggcgcacgaaaaccaaccgaaagggcacagcatcaacgaggcgcgtacaatttgcacggtgttcagctcgcctcgctacacggaagacacggactgtggatctgtgctgcgggtgggtgctgtttttgccatggcatcttttatttcaattttcaaaattcttttttcccctcagctttctgccgacttgaaacacattcacttcgtcacgctgaaaccgaaggctactggagagaaattgagccgggaagaatga

SEQ ID NO: 57140 - DNA, 796 bp, Heterodera glycines
  Genomic contig location: Contig_ID=SeqID_26405; Location=630..1425; Strand=-
  SCN-specific regions: Sequence locations=1-410,451-796
cgattggcaggaaaattttaagggcgacgaagcgaattcggatggaattcgaatgttggcatttttttgcgcccggtttgtatcggctttccctgccggtgagtaacccaaaagaaatgccgccggctgattatttttaataattaacattcatttcatttagtccgcctttattacttcgtcttccgaatggattcaaataaatcccccaaatttggccatacaaattcatcttccggctgtttcggccattttcccattttgccaaaatgccctttccatcagttggactttgtccaattgtccaaaaattattgagttgcttgactttcgcttgcgattattagcaccgtttaacgagctcaatgaagacgaacatatgctctatttggaagtatttattatatctcttttttaaaaatttctttcattgttttaggaatttttgttagtcgtgccaaattcggaggacacttttctgcaaaaatcattcattggccttcaccagaggaatatcccgacaaattttctacgaattccgtgcacaaaagtttgaaatctcctcactgagcccattctttcgtccgtttttgccagttcgacatcattcacgagcagttctgcttcgagttggtctccgtgtccaagcagtcgcagcagcatcagtcgtgggacagaaaatgcattcggacggaggcgcaaaaggcggatggtaagcgaatatccatcgcataatgaatcctacggacattttcatgctgagacgaaatacaaaaagtgcaagtgaccaaataaa

SEQ ID NO: 57141 - DNA, 178 bp, Heterodera glycines
  Genomic contig location: Contig_ID=SeqID_26406; Location=46..223; Strand=+
  SCN-specific regions: Sequence locations=1-139,164-178
attggctcctggtcctatcaatctgaatatcttcggcttgttgttgatgagcgtgacgtgttccttggtgatttctacgataaccaggaatggctgctggtaaaacatttttatccaagaaaattgtaggcatactttgtaaaaaaaaaaattttaaatttttcatagaaaatttcaa

SEQ ID NO: 57142 - DNA, 167 bp, Heterodera glycines
  Genomic contig location: Contig_ID=SeqID_26407; Location=576..742; Strand=+
  SCN-specific regions: Sequence locations=1-167
tgcttgtgacataccatcatgcatttgtcgtattaaataatttctcatcgtcaacagcagcagtgtctcaatccgtctccactgatcgctcccatcgatcgtcggcgatttgcgacagtcaaaaagaaacggcaatggaacagaacggcacaacaatcggaggatga

SEQ ID NO: 57143 - DNA, 399 bp, Heterodera glycines
  Genomic contig location: Contig_ID=SeqID_26408; Location=634..1032; Strand=+
  SCN-specific regions: Sequence locations=1-293
taatctttggtttcttcaaactttctacgaaagtatttacaattagttcccttccggaccgagactctcgggaattgaccccgagactatcaacaaataaatactcatttctgtgtatcgcacagatagagcagggcgacttggtggaagtgtgggacgcgccgtacgaggaaaacgcgcggcttgccacggtgcaccgtctgcgcattgtgcggtgtcgttttgaccaacgcaaaggctatgtgatcaaaacgaagtgttggcccaattacataatggagaattgggtcagtggagatgaagcggaggaggagggagaagaagaagcacaacaacagcaggaagagggaagggaagacgaagcggaaggaacggcggaggaaaagggcggaagaaaaa

SEQ ID NO: 57144 - DNA, 225 bp, Heterodera glycines
  Genomic contig location: Contig_ID=SeqID_26411; Location=620..844; Strand=+
  SCN-specific regions: Sequence locations=1-59,81-225
atgaggtacataagtactcaacatttttaaatcaaaatttgcaaagaaaaaaaaattttgggggaaaattttaagaaaattttccaattcttagtggattttttgaaaaaaaattttaggtcgattcttaagggtgtattttttgtttttattgcatttttgttaaggaattttgccaaaaaatgtcgaaaaagtgaaaaaatagtgaaaaaagccaaaaagtga

SEQ ID NO: 57145 - DNA, 1160 bp, Heterodera glycines
  Genomic contig location: Contig_ID=SeqID_26412; Location=1106..2265; Strand=-
  SCN-specific regions: Sequence locations=1-34,67-75,103-200,225 -386,424-679,708-1112,1150-1160
atgtcttatggatgttcgaacttccgatttgattccggtttgccattttttatttccatactttttcaactggcattggcttttaaaaatttttcttattatttgaaacatatcatttcgttgcgcactgtataatccaggaacagcagcagaaaacagatcctgcccttggactttcccgattttttcctgacaaaaaatatttgttccttcccattgtaatttcctaaaacattaggtatggatggcatttagcagattttttgctgtaattattttggtcaaatattttttttttgcaaattttaagaaatttttcaggaaaaaaccatcaattttttaaaaatgcacctacatttaaaaaatgaaatttttaaaaatgctccttttttaattaaaaaaaagtaaattttttaaaaaattctcgctcctctaattgcacctgattgctttctctacccataatagatcattgtgggcgcttgtctggccggcctggttgtcattgtgctggtcgcctatctgatcgggcgtgcgcgtgccaagcgtcagggctacacatccgtctgatcaatcaattcttggaaagatggaaggcagactgattcgatcgacttgcaattgctccaattctaattcaacattcacttttcttagcattgacatattttattggcatttttaaatgattttgtttttctcattttatgactttttccgttattaaatatttgcgaaattaattttaatgatttaaaaatgccgtttaaatcagtttttccgccattcattgtagcattgcatttggagacttttgcggtgtgcaaatttcatcaatcgtcgctggtcttctgcccttacaaaaatttttaaaaaatgaagaaattatttaaaagactcaaaatccttttgaaaaacaataaataatgaaaattttttaactaattgaagaaaaggtctattaaatttttcgaattttttagggagaaaatcacttgcttcatgttacgtttatgtgtatcacattcatttagactaaaatgctcgcgaattattttgatattcatggcattttttattttttctgaattctcgagtattccttcagtacattaattatattatctcatttgtgacagcatttgtaatgccgaaataaa

SEQ ID NO: 57146 - DNA, 677 bp, Heterodera glycines
  Genomic contig location: Contig_ID=SeqID_26414; Location=770..1446; Strand=+
  SCN-specific regions: Sequence locations=1-137,178-323,345-677
atggattcattctgtttatacgcccgtcgattcgcttgtttttgttggcaatttcctgcacagttattcaattccaatgcaaattcgcatttcacatttggaagatcgcattcaagtgaattatatttgctagtgtcaaataatttaaaaaaattttcattttttatatttatttatgtcttagaaaaaacccattttgtgagttcctatggccccattacaggctaatagagagcaaatttagagctatcgaatgatataagaattaaaaatttgttatttttgaataaagttttatgaatatttttccgccaaaaaatttccactttttggttgttttatttgaataagcgacccaacacttttgacactagcgcctaaattgttatcagtagaaattttgatgatttattttcgtattttcagccagaaaaaaattaccgtttcccgcatttcaaacaaattttttgggctttcattgctcaaattgtgcacaaagccacacacagaatttatcagaaacaattgccagaggaagcacacaatagtcaaggatacagattttctgcgccaaaaaatgatcaaacggcaatgaattttgtcaaaattgatgatcaatggacaagggtcagtgtcaaattgtttaatgcttttatgtttttttaggtaaattatga

SEQ ID NO: 57147 - DNA, 161 bp, Heterodera glycines
  Genomic contig location: Contig_ID=SeqID_26415; Location=541..701; Strand=+
  SCN-specific regions: Sequence locations=1-161
attttcttcgttctctcccaccgctggtgatcaatgggcttttcccacttttgagatatgccgaacaattgctgactttgaagtatccggaagtaattgaaggcatcactcgacctcatcacttggtgcaagagtttcgggtgagaaaatgcattttataa

SEQ ID NO: 57148 - DNA, 1095 bp, Heterodera glycines
  misc_feature (995)..(995): n is a, c, g, or t
  Genomic contig location: Contig_ID=SeqID_26416; Location=348..1442; Strand=+
  SCN-specific regions: Sequence locations=1-216,431-447,585-603,626 -893,955-1095
atgagaagaggtacaaaagtgatcagaagaggtacaacagtgatgagaagaggtacaacagtaaatagaagaggtacaacagtgattagaagaggtacaacagtgattagaagaggtacaacagtgatgagaagaggtacaacagtaaataaaagaggtacaacagtgattagaagaggtacaaaagtgattaaaagaggtacaaaaattgaatgcaatttattataaattttaaaaaataaattaattattccttttattaattaaaaagagaattttgaaatgtacaataattgaatatttaaattaatatgaaattaatttttataaacaattaaaaaaaatatgaaattctttattaaaagataattattattttttacataaattcttttattattaatttacaacaaatctttaaatataaattgatacaacagtgattagtaaattcattaaattaaaatgaaaatatttttaacaaatttaattaaaaaaatacatgaaattctatcaattaaaaaaataattaatttaaacttataaaatttatttatcaaaaaaaaattaaattaaatataattttttatttattaactcaacaaaatattttattaattaaaatcattgaaaataacgtaaaaatgcacaaaaaaataatgttacaccgtccggattcgaacctgcccccccccctcaaaatgatgcctcagaatccccaatcacacagggattctgaggtcttaacgatgtcaaaagtaaaatctgattacgtattcgtgatcagtggcccaattaacccataaagacatgtttttggaagatttttattgaaaaaaatttttcactcaaaaatcctgtccaccccctttggtcccgaatcacaaaatcacttttatttttatatctttttttaaaaatgtgataaaaatgcaaaataaaatttatattatagagaaaaaaattgcggatttttgtagtattttacttttctncaatagcttttcagaaggcagttacgaattttttttctgaaaatctaaaatttccagaaattctggaataccttttttcatattgatgttaaaaacctaa

SEQ ID NO: 57149 - DNA, 1096 bp, Heterodera glycines
  Genomic contig location: Contig_ID=SeqID_594; Location=894..1989; Strand=-
  SCN-specific regions: Sequence locations=1-459,483-516,538-750,773 -861,949-987,1034-1096
atgcactttgtgggcggtgctgccaatgccgtgatgggtatgcgcagtgcgcagcaaatgctcaccgaatcggagccgacagcgaacaaaatggtgatgctaatccaccggcacaaaatcgagtaagttggcaaagtttgggacaacaacgataatggcaattggtgccaaagagcatcattattatgtattaattaggataggacttgccaaaatttaccatgatcaattcgatgatcacattgtgttatgttttagcgttgcgtctcgcgcagaaattgaacaaatcgcacgtgtggacaatttggcactgcttgagctgagctactcccggtggccagtgctggacaaccgccaagcgtattggagtcggcagttgtgcatgttggcggcactgatcgagcggctggaaaacactgtaccggccgacattgacgaaatattcttcggcactgatcgggaggaggaggagggggaggagggcacacggcgcgtaaggcaagtgacgtggtgatcgaatggtggtgatggtgatggctattgattctgatcactgattaaccgctgattgatttgttggtcgacggacatacggcggaccgacagatcgatcattcaaactgatcaaaataacacacacacatttatagggttgtcggaaaatcacaatttgtacatattttgaactaacattttttggcacttttgttgaaaagccggcaattctgatcgatccttccttgctgatcactctctctgtgtctctgtccctgcttttttcctttctgatcagttgatttgttcccccctatttttttctctgtgctccccgtaactttttctgatttgaaccgatgatcactgttttgtttttgtcttttgttttcttgtgttaccttctgtcctttcttttcttttcccttttctttccctctgtttttttcttttacaaattaatttcacagattgttaaatgtgcaacacataaataataatattgtaataatatacaataattaaaataataataatacttaacaaaatggtcatttttaaacaaatgtaaatttcaaaaatgttttcgttggccaataaa

SEQ ID NO: 57150 - DNA, 2305 bp, Heterodera glycines
  Genomic contig location: Contig_ID=SeqID_596; Location=1..2305; Strand=-
  SCN-specific regions: Sequence locations=1-1116,1138-1447,1472 -1593,1616-1923,1945-1971,1993-2305
tgaacggacctggcctgttcagtctgcctttcacgctttgtaattggattttatctgtcattttgaaccaatctgatcagttgttttgaaatctattaccgttcctcatttatttgattcatttgaatatttcttggcattttttggcacctttttacctttccttttgtttcaatttgatcactttatccatccttctgataagtttgctcctcattttctccgatcagttgatcatcttcccttaggtccgcacttggctcgccccgcgtgtgccacaagtgtccatgtcgcctgagcagcgcctggagcgtcggccaagtccggacgaaatggaagtgttctgtgacgcggacggcgtgccacggccacgaattttgtggtggtgggacggacgaccggtggcggacggacaggacgaaatgcggattatcgacagcacagcgctggacgagaaagtgcgcacgcggcaacgcctgttgttccagtccaccacgcggtccggcacgctgaagtgccaggtgagcaaagagagtgccaaaaaacaacgcacgggactgactcgttcattggtctcgagaagtttccactcaaaaaatgattaccgtatatactgctgctgttccgcctgatctaccgtattgccccaacagtaattccctcaccggtcccattccacagtaattccctttaccgtaattccccctgccataattgcttcatcggtcagagatttcaaattcgttttcctctctcattctctaggcaatcaatgagaaaggcactgctgaaaaggagttggaagtgcgtattttgggccccggctcgccaccgtcccagatcagttccagcccggtccaagacgggttcaggttgggccatttgagacccaaaatagcaattttcatcaccccattttcctgtccccgatcagtgttaattggctgcctccgctggtccccaacggcgatgtgatcaattacgtgatctactggaacaaagatgcggaagctgatttggccgattgggtgggactgaattgtccgcttgattttctaattgaaaaaatttacaatatttcagtcccaaaaaactgtgggcgccgagttggacaatgtgctgatcagtgaccagcaggagcagacgccttacgtaagtttaaagccaacaatttccttaggggttaatcaatgatataattaatgatcaaataaatttatcaataaccagttcggaaattatcgaaattgggttaattagtttatcaccaataagccaaggattgctcattagactatcagtggcaatttaaatcggtttgtcaaaaactttaaattgattgcgtgacagtgatactgatcacagaaaccgattaatcaatgctcaagctgatcaacaatgggactgatcactcaataatccctccccctttatccgtacatttgtcaaacctttcccctcccctccctctgaaggtgttccgtgtgcaagccattggctcggccgggcccggcatcatctcgcccagctacgaggtggtcaccggcctacggcacattccgctcgcggtcacaatccgcgtgctgtctccgccgccctccgttgcgccggagggcacactggtggagccgggcggccccattcgcttccaatgcgtggcggtcggacgaccgaagccgctggtctccttctcctgggtgccatttgaggcagccagcgctgagccgggcgaagggccggtccaactaagcacggagccggactcgaatggcgaagcccatcgctatgtgagcgcggagacggagacgcggacgaatacaaagcggagactgttgtgcgaagcgcgcaatgaccaaggccaagtccaggcggaacagctgttccaggcatgttgtgcttggccgactgtgtcgtaatatgacacaaaaatgaatttgacagtgggggtaattagggagggatgataaccgcagggaataatggataaaaagacaaatcttgaaaaattgagactgtgacttgggctcaaggctcggaactatgacttggcctccaatttgggatctatggccacaaaaaagtctagactcttatttcgaaccaacgtttgactttgtcctcccttttcctaaccatttctttataactttcattcacttttggaaaatgccattcttttgccaaattggcaaatgccctcgttattctttctgatcatttgccaattgtcccggtgctcaggtgctgaagccgggcggtgccccgcgcgacgtgtccgctgaggtggatggggacaaccgcgtca

SEQ ID NO: 57151 - DNA, 3953 bp, Heterodera glycines
  Genomic contig location: Contig_ID=SeqID_5170; Location=1512..5464; Strand=+
  SCN-specific regions: Sequence locations=1-110,140-183,205-557,599 -749,782-970,1003-1291,1313-1379,1401-1498,1627-1671,1703-1722,1744 -1849,1880-2035,2282-2381,2418-2646,2669-2914,2937-3241,3302 -3615,3676-3752,3776-3839,3861-3953
atggatgacccccgggggcatcaaatggaatcgaaaagtgaaattgaatgggtaattgctgatggggtgcgcacgggaggcaacaaaaacaacaaacgaattccaaccgcgaaaaaatgggcccccggggggacaaaatgtacaaaatgaaaagttattttccatttatgacaaaactatttattgtaaataaatgttgggtgacaaaaaaaacccatttaacacaattataggttaaacgaaaaaaataaatttaaaataggcacaaaaattggtttaatgcttttaatgacccccatcagcagaggtcttaaagtttgaggtttaattttagaaattaaaatgcattttaggagtaatcaaaataaggcgaaagaaacatggcaattagtcgctaattgctcggattttctcgacgcacgaccctcccattttcagggattttactcccgtgtccaacccatcggcaaaagtgccgtttagtcacgaattgactggcccaattcccgattgaatttgtcccgccattcattttaaaagtctctgtctctaattaattttaattttcaaaattcctttgtcaattccttttttaattgctcacttttgcgcgtcattgaatgtgttcacaattgccccttttacccttcacaattatccccaaaattcgccttttctcggtgaccttcaacaacactttttttctgtcaccaatttttcctcttttattcgccaattaattcaaaaaataatttttgtggaagattaattgagtaattaattgaaaataaatgttctttctcagatattttctgtcaccttttcaattgacgtcattttgtcttgcatttttctttcagtgttttttccctattttttgtcatttccaaaaatataagatttaaagttcaacaaaatttttgttcatttttaaattattttgtcaacaattttttggaattttgtggggattttttgatatatttttttaattttttatatccgccatcatttatggcattttatcgccatcatttttgtccgccaccatttgtgccatttgtccgctcacaatatttaatgccattagtccgccactatttatgccatttgtccgtgcccttttgtcccttttcaatttttctctgtgtcttccatttgtctcatccccctacttcatcattcatttcgtcaccactttttcgcccatttgtccctttttcttccatttgtcccttttattcctttttttgcccttctcgattgactaaatgctctgctgtccatcatcatttattttatgatttattttcattgccatcactttttttgctccgttctccgcgccattgccccataaaaaacgccgtcgactttttgtccgtccgtcggtccgtcgcccggggggaggacaaaattttgtttgattgatcgccgctgttcaaaaggctcaacttgcgcactaaaattttcaaattgttttcgcgaattctgcgggaaataattttatatatttcttttaaatttaatttatgaaaaatttttaaattaaaaaatatcatttttaaataaatttctctcattatttattttataatttaattttaagtaaatttcttaaaatttcgattataaattactcaaattattgtttccacttaattacctattcatttaattatttttcatttaattatctctttccctttcgttcgatgcattttcacaaattgtttttgcttttgcctattttgcttctccatctccaacaatcccaagcttgcttttcacgtggcaacagtggcgaaccgtcggatggcaatcccgaggcccaggggctaaaagtgccaaaaattttgaattttaaaattaaaaaattctcaaattttcagtcggaaaacgatgttcggactgttcagttgaagaaggaaaaacaaacggatgaaacggaagaggagaaagacgaggaaagttcggcagaacaaaaattgccatctgaattggacccggaatttgtgaaagtgagagaaattggaaaatttctttttaattaataaatatttaaaaaattaaaattttcttttttaacattatttgatattgtctttatttttgagggttttgaaaaactatttaatatttttatcaatttttaaaaaaatttttgcttggaaatttttgaaaaatcttatttatttgggaacaaaatatttgaatttaaaaatgaatatttctttgaaaaaatattttattgaaaatttaataattttttgaaatttatccaagtttttctattcaaatgattctttttaagacttatctgcgagaatttggtcatctgaagcacaatgagaatggcctttcccatggcgttaagtgcgtttaaataaaatttcaaaaagaaatattttaaaaatcacaaatattttaggcatttccaacgctttttgggctaccggcagacgggcaatgtcgacttgggaacccttcaaaaaatgtcgtggaaacgctgtgccaactctgacgagggctacacagcacaaggtgggggcggatcgatgaattatggcatttgccaggattattttggagtaaagaaaaatgccggaaatttggccctaaaaatcgaaagtcaaactaatttcctggcaaagttaccaaccgagaatggcacttgcattacagggttgttccgggtcgagaaaaatatcgggtcgggtttcgggtcgggtcggccgaaaaatcatcgggtcgggtttcgggtcgagaaaaaggccgggtttcgggtatcgggtttcgggtaacccggaacaaccctggtgcatgggtgcggatggcactgcaatatttgcagcgaattgcgccatttataggacgatggaaataaaaccaaatggaatcaggtttttcagccatttgctttgcttaaattcaagaaattcatacaaaatatctttagaaaaaggataataatgaacaaaaacaaatacaaaattttcgattccattgaacacaatcgtttaaaaaaaattctcaatttccttatctaattttcacccagacccccttcttaccagtgcttatttcgacccgaaacccgacccaaaatcatcgggtcgggtttcgggtttcgggtcgagaaaaaggccgggtttcgggtttcgggtatcgggtttcgggtaacccggaacaaccctgttgcattacacaaagtgtttaatgcaatggcactggctgtgttttaaataaataataatcattattttttaattagtccgataattaattaattacttaattattcgcatttgtttttttcgctttagacccatcgcaactttgggaacgttcgacattgttctggaacctgaacgcgtcgcaccccaagcagttcactcatggcgaaacgaagtcagccaaaatttggcacaatttgccaatttgaattagcactcattaaacatgttttattacatgcttttgcataattaacttaattgcgcttaattttgcagggaattaattgcgcaagcattccgcgcatgggaaattgtgatcaaaatcgactttctggagacgaacaatgcggacaatgcgcagatcattttcacatttgaaagcgacggagcaaaaaaggagaaaagcaaaaatggggaggaggagaaggaaaaggagggcaaaacaggcaaatcactttctgatttgataagcaccgatcggttggtcaaaaagacagagaaggaaattctgatcattttggcaaaaaacaaaatttgatcactttagaatttgttaaaaatttttcaaagtcggaatattcaattcgaaaaacgaatttataaaagtatttgctgaacatcaatttattatttccccatattctgagtaaattaggcgactttttttaatggctcaatgtttaagtttttaattttttactttttaaagagcaa

SEQ ID NO: 57152 - DNA, 957 bp, Heterodera glycines
  Genomic contig location: Contig_ID=SeqID_5171; Location=475..1431; Strand=+
  SCN-specific regions: Sequence locations=1-307,358-482,586-843,866-957
gcctcgccattgccaaggcgtcgtcgccgcccgttgcgcgaattgttttgaatgccgacgagaattggtccacttttcaaacacaagaagaggtgaaagttaaatattgctaatttaacaatttattttttcagggaaaaatcgacatttttgtggtaaactaaatatatttttcgaaaatttttggcattttttgccaattttgaggttttactccacgaaattggccatgcgcttggccttcgccattcgggagacgaacattcagtgatgttcccaatgtttgagcgttctgttggcgaacatgtaaaattaaattaattaatttaaaaattaaaaaaatatttaaataaaattctctaatttatttcagttgccagtcatttcaaatgatgatgtcgagcatttgagagcactttacggtgattaactgctaacaattcattaattattttcttaacatttgtgtgtgtttgaagtgctaattaaaaaattctaacattattaattaattttactctttgacaatttattatttatgatatttaaattattacatttttaattttttttaaattttttaaacccttctcttatgtcaatttgctaatcctttttttcttcgtttcggcttcatttgtttccgtatgctttttgttttgtttttttgccatcactttttgctttaaatatttttcaccatggcatttccctttgctttttccatttttggcattttttcagtgcttttcggtaataaaaatgatgggcccaaactgcgcgtgaagcgcagtagcagcgtcgccagcagcgcaagtgccgccggtgccatcgctggcggtgccaatgccaattcgaatgccaacaatgcgtttgcatcattttatgccgatgatgacaataccgttttgtgttgtgtgtgccctgcgccgatgacattaggcgatttgaagaaaa

SEQ ID NO: 57153 - DNA, 560 bp, Heterodera glycines
  Genomic contig location: Contig_ID=SeqID_26418; Location=260..819; Strand=-
  SCN-specific regions: Sequence locations=1-72,94-246,268-284,309 -319,352-433,455-560
atggcattgagtgaaatgccaaatcaaattgacacaataattagacgaattgaaaaagaaattacgatgaatgagcaggacaaagaacagcaactatttgccaaaatatttgcttatgcaagaacacaaaccaacaatgcattcaataattttttccagttagttagggttataaactcaaaaaatgggaaaactatttttatcagagtcgaaattgaaatttaatttcaaaaaatcacgatgttaaattttcaaatgattttagaagtatttgaagtttttggatataataaaatttaaaaaaatttgtaaatctgaagaaattcttgttaaatttttattaaaaatgcaagggtccacgacgatgccttcgacaccacagacccctcaattccatttttatgaaaccattacctaaaattaactatttgtcgaagacaaataatgaaaatttaacattttggcttttttcgaattaattaatgataacaaaattaaaaaaagagttaaatgttttcagatgacccctaaattaatgcttatcttttgacagaaataaa

SEQ ID NO: 57154 - DNA, 49 bp, Heterodera glycines; identical to SEQ ID NO: 51181
  Genomic contig location: Contig_ID=SeqID_26422; Location=680..728; Strand=-
  SCN-specific regions: Sequence locations=1-49

SEQ ID NO: 57155 - DNA, 630 bp, Heterodera glycines
  Genomic contig location: Contig_ID=SeqID_26424; Location=10..639; Strand=-
  SCN-specific regions: Sequence locations=1-190,212-630
  Gene Ontology: Mol. function=transposase activity; Biological process= DNA transposition
atgacccaacaacatattgggttgatgaaaagttctgaccctctgaaaaaacaaattatgcaaaaaatgatatttaattctaaacagattgaaaaagggaggcaggcaattgggatgaatcagcggacggttggccatcttctggccatttgcatttgttgtatagccattacttttgcaaaatcgaacgattttcaaaaaatggacaaaattcgcctaagacaactgttactttacgaattccgaaaaaattctaccccaacccaagctcttcgaaatatttgtgaaagtgagggcaatgatgcactctctctttctacagttaagcgatggttcacaaaatttcgtgaaggcaatgagcagctcgaagatgaaccccgctccggacggccacatgctctcgattcggacgacttggagcagcacgttcagcagcatccgtgttctagttcgcgccaacctgcagcagagttcggggtccatcagacaacagtgctcaattacctccatcagctcggcttcatcaacaaaaagggtgccgaagttccccatgcactgacccaacaacaaaagcatcagcgagtggtcacctgcactgaacttctcgcccgtttgagtgctggaatgtag

SEQ ID NO: 57156 - DNA, 1432 bp, Heterodera glycines
  Genomic contig location: Contig_ID=SeqID_5175; Location=283..1714; Strand=-
  SCN-specific regions: Sequence locations=1-1,24-29,61-156,179-303,325- 403,425-784,806-853,876-993,1015-1432
gatcgggatcttgttcagaaccgagtccattttcctaaaaattttggaagagaaaattctgaggatcggcaccgaattcagaaaagtgttttcaatagatcgccaatcagtccttcacaaactttttccaccgaaaagtcaatcgaatttttccaaaattttccaccgaaccaaattcatttttgtgaggaagaaaagcaattggtggatctatacagagcaacaacgacgcaggaaaatgcaggaaaggatgttatttcgtcccaattgaacccgaattcgcggccccaatttgaaagagtgttgaatgaagagatggtgaaccaacgccggtcaccaatcagcacgatttcgaacgaaataaattcggatatgaaaaaaaggagtccgtttgtctatgaaaaattttttaatggccttgtccaaagaatagttgaagccaaaccaatcccgaagccctcaaagtgtcaaaccattgaaatgaaagtccaaaattggaaggccaagtcaattatcgacccgaattccgaaataaatttcataaaccccgaatttctcttcaaaatgtctgtgagtgacaaaaccgattttctaaaatggagttttcagccaaaatgtgatctgacaggattgccttatgaatttgctacctacaaaggacaaaaaattcctgtttacggattggtcaatgtcccaattgatataggcgattcagaattagaaacatggtgtatggttaccaaaatcccactggaatatgacttcattttaagtggaaatctgctaaaattgttggagaatttgaagagagacgaagaccaagcaaatcacggccacgcaaatcctcaaaatttgcaaacatctcccaagttttcggcaccgcctaaaccacaactccgtcaatacaaaaaagtcggacaatcatcatcaaaaatgtggagacaaaatcgaaattcgtgtccgtttccactgaatttccaaagaatggacaagtcaaaaactgaattcacaaatcaaaaccacttaaaacaattttcgcatttcccaacgaaaattttccattcggatccagcacaattcagtccaaaattgcagccgatccagcctcgaacttttttgaattcaaaattcaaaaaagccaagattgagaaaaaggcatttgctcaacaattgcgtccaccaagcctcctctcaatacgaacccacattccccaaactctccccgtctcgaatatgtccgataattataattggaccattcccgaatttgcccgccattcccatcccgtctcccaaaatttccatttcagtaacagtttgatgtcacagcaatgccgccgctgtccaacaacaacgtcggccaggaggcctccatggttcgtggcggagggaggacaaacgcctaaacgcttcgcaggagctcagctggtcg

SEQ ID NO: 57157 - DNA, 300 bp, Heterodera glycines
  Genomic contig location: Contig_ID=SeqID_26428; Location=247..546; Strand=-
  SCN-specific regions: Sequence locations=1-158,216-300
atgggcatggatcatgggcaaggcccacaacatcagccatgggaactggacccgcctctgcccgagcagcatttggaaattgggccgcaacttccggcggaatgggcgtatcagccaccaccacaatgggctcaagttgtgcatgtggaacaacaaccgcagcagcagcaacactaccaccaccaccagcaacaacaacaacagcagcagcagcaaggcgcatgggatgagggatgtgagacgatgatgccacatgctcttgaccgaatccaagacaaggagtacggccaatatcagtaa

SEQ ID NO: 57158 - DNA, 941 bp, Heterodera glycines
  misc_feature (772)..(772): n is a, c, g, or t
  misc_feature (799)..(799): n is a, c, g, or t
  misc_feature (904)..(905): n is a, c, g, or t
  Genomic contig location: Contig_ID=SeqID_26430; Location=9..949; Strand=-
  SCN-specific regions: Sequence locations=1-331,353-412,476-941
atgagcgaacgacagttggccgggctgtccatgttgggaatcaacaaggtggtatggcatggcatttgccaaatcggcatttcctagtctgatcagaccacgatccaaaattacctcttccgatcagaccatgtaatccaagcaaaaggatttatgtgtccattttaatggatctgatcaatcacgtgttagtgccgactcacaatcagacatggaaggggtacattggtctttataggatcttgtgatccgatcagtttgaaaatatctgtttgaatcaaaatatggtccaaacaacgaatcatctggtttaagacgatcaaactcagtccaatttaaatatcaaaacaaattaatatttttgtgctaatcactattcgaactgatttgattaatcaaaagcatgcatttgttttttttaacttaaaattaaaataaactattaaattttttgagaataatttttaaatattttctttctattttgctttaggcgtacgaattgctcacgaattgcatttatttgtgtgatcggcaaattgaggcatgacaaaagaatatatattttttttataggctaacaactaaaacaaccatttgtcacaggtgttcggtttgaaagtgtacggtgcgccgtggcatccgatggtaggttactgtaacaacaactggtcaatattccattaattggtcaaaaataagtgccggaatcgaaattactgggccaaaaattgggtgtattaaccaattagcgtttaatcgcattaatggngaggggggggggggcagaatcggtaanttggcaattaattaatctgattaattacgcattcagcccggctacgcattttatcgccagaggggccaagcacttgttgcagaagtggaatcagatcccgagaannagctcgacgtgctggtcactcacacaccgccacttg

SEQ ID NO: 57159 - DNA, 922 bp, Heterodera glycines
  Genomic contig location: Contig_ID=SeqID_26431; Location=208..1129; Strand=-
  SCN-specific regions: Sequence locations=1-449,471-922
atggctcggccgcttcgcggcctgggactcaattcttcggcattccaatcacttggaatcactcaatccacctgcattccaatcaccaacaataaatctcgccgattcttctgcataccaatcgctgggactcagttctacgacctttcaatcaccgttactcaatccatcagcactcgaaacacctggactcaatctcaccaattctacataggcaaaacattttaacattctactggcctttttgtttcttgtcatttcttaaacaaccctcggcatttcaatcatcggaactctatctcaccaattctccggcattccagtcactgggaccaacccaccagcattccagtcactgggactcattctcctgcatttcaatcaacggaactcaaccctccagcatttcaatcactgggactcaatcctccggcattccgaacactgggactcaaccctctagcatttcaatcactgggactcattctcctgcatttcaatcaacgggactcaaccctccagcatttcaatcactgggactcaattctccagcatttcgatcactgggactcaatcctccagcattccagtcactgggactcaattctcatgcatttcaatcactgggagtcaatcctccggcatttcaatcactgggagtcaaatctacggcattccgaacactgggactcaattctccagcatttcaatcactgggactcaattctcctgcatttcaatcaacgggactcaaccctccagcatttcaatcactgggactcaattctccagcatttcgatcactgggactcaatcctccagcattccagtcactgggactcaattctcatgcatttcaatcactgggagtcaaccctcatttcaatcactgggagtcaaatctacggcgttccgaacactg

SEQ ID NO: 57160 - DNA, 1182 bp, Heterodera glycines
  Genomic contig location: Contig_ID=SeqID_26432; Location=266..1447; Strand=-
  SCN-specific regions: Sequence locations=1-393,417-593,619-907,929 -1182
cgttgcccgaatggcaaaggaggaattcggtttcgagcaggtttcggtttggaatgacacgttcgagaaaatcccctgttgcgccgccggaggaatataaactcggctctccgattgtccccgttgttggggggtataagactcgacgtggctcggccagggtatttccccgacggactttttgaacgtttcagccaagtggcgtgtttttattgcaatctttcagctttgcctcttttaaggtttttgacaacatttattttgccggtgccttcaaaggcgccgacggaatttcccaacaattcgtgcacattgagcgatacatgcaaaatttgcgttcttaccaaaagctttaccatcagaatgaaatggttggcgattgctttagtacgctattttatttgcttaattttccttttagtatttgaaagaccgcttgactgggcttattttgacgggatggcaaaggtattcccacactacgcctttgtgtgaacttctccccgccggcattccatcgttggcacggcaagcgatttttgtttcgcaatggatgaacaaaagagaagaacggaccgaccaattcatgcaggttttattaaattatttaatttatttcgatttattacatttactcatatttaaggagtttctgaactgttccgtacgtcactcgacttcggccaccaaatttgtccgcaaaggattcacttttccattcgtttttgaattcaaattctgcgattgtcaattccccggtgttgaactttacagtgaggtagtgattccggtggaatcctaatgtaattcgtaatatcagattgaagaactgaatttgttgcgatggaaagcggcgattgagcgatatataagcagtaatgaaaccgaaaaagagacacaaaatgaactggaaaaaatggaggaagaattcagaaaactccgaaagacggtagggaaaggggaaggttacgctgcaaaccctccgaaccctgactaaaattaaaaaaagaaccattggatgaaccaatgctccgtgtttatgccattagtttgtttcattcagatcgcttctcttctcggccatttcttttacgaggacacagtcgacgaatggttggctcagcacgaccatttgaatcgctttaatgatgatgacctcggtttgcctcctccaaaccgact

SEQ ID NO: 57161 - DNA, 426 bp, Heterodera glycines
  Genomic contig location: Contig_ID=SeqID_26433; Location=1034..1459; Strand=-
  SCN-specific regions: Sequence locations=1-63,85-144,166-202,224-426
atggcatcggatggacaagccttggcaaaatggcttttcacacatcgtccggacaatgtggcaaaggttgaaatgttctgttcagcgtcaacgtctgtgcttgctaaaaatggcatcgttcaaaatagtgcgtaccaataactgattaattatatttttaaatttccgtattttaggcttttgccaatgtttcatctcccgtcagtttcatcattgtcatcaatctaccgttacaattcgtcgtgccaattgactattttttatgcttctcaacgcaactcacggtcatcagcagaggtgaaagaatggatattaagaagtgatcgaccaatttgaaatgtggagatattttgaagtgctcataaaaattgttctttttgtcgcagtgatcaacgaatgtttctttgtgtgtgcctttagaataaa

SEQ ID NO: 57162 - DNA, 523 bp, Heterodera glycines
  Genomic contig location: Contig_ID=SeqID_26434; Location=479..1001; Strand=-
  SCN-specific regions: Sequence locations=1-523
atgcaaacgatggaattggcacttctcggagaaaaaccggccgagaaaggacagatcaatttgatgggcacccaatgggtgacgaaggatcagctgcagcagcaaatgcaggagatcctttccgatgacgaagtccctcaccccatccttttgactcgatcagttttttcagtatgcaaattttataattgcgctcgaatacatttcgcaattgccaaattccgcggaggaggaggactttatcatgtcattgcgtcgtgggattggagcaagtgaaaaaaatagacttttccgcgcaaaagtaccggaggtgaattggcatactcacttttgtacgttaaactgttaatgcgtccttttgttgcaggtgacgataaacgaagatggcaggagagaatgctggagaatttgcaagacgagggcttccgccgtgaaaattgtggtcagagacggaggcaccggccttttcacagtcaatgggcaacactattgcacgttccgttcgctcctcgcgaggcaataa

SEQ ID NO: 57163 - DNA, 466 bp, Heterodera glycines
  Genomic contig location: Contig_ID=SeqID_26435; Location=277..742; Strand=-
  SCN-specific regions: Sequence locations=1-466
atgcttttcttaaagatgctgaacagcttcctaactcatggctcttcttgggagcacagtgggcactttcctcgcgtcactctttgcgacctgaaggtaaaatttcctaatttgagcaccattactaataaatttccgaattattctgagtgccaattaacgtcatttttccgaatatttaataaatgggaattaatttaccaaaagttatcaactaataagattttttcgaaccgttcagatccgtcaaccaaacgaacgctttcacgagttcactgtccaatgtgtgctggtggcgaattttgtcagttaaatgcacttgaaatatgggtcaatttagtctggtagttttaagtctgctggaatgcctcaaagcgatcttttttttaattttaaggccgtaactgtttgtaaatttacaaattataaattaatgggcatgtttcgaggtagaaacattaataaa

SEQ ID NO: 57164 - DNA, 62 bp, Heterodera glycines
  Genomic contig location: Contig_ID=SeqID_26435; Location=151..212; Strand=+
  SCN-specific regions: Sequence locations=1-62
gaaaaacgagctggcgccgaaacgggagcgccgaaacgggagcgccgaaacgcgtgggtccc

SEQ ID NO: 57165 - DNA, 1710 bp, Heterodera glycines
  Genomic contig location: Contig_ID=SeqID_26436; Location=81..1790; Strand=-
  SCN-specific regions: Sequence locations=1-950,972-973,995-1268,1292 -1710
atgagtatagttcaagacgaagaatggaaaactcatttaggacaatgcatgtttaatgtacgagcgcgggttagagttgggggacaaagcgctgcaattggacacggaacgactgagcggacttcgcaacggattggagagggtccgtgggatggtggccgatcggattgacaccattcgcagcaaagcaccgcacgtggacaatcgggtgggaacaagaacgtggttatggttaaataatcacgaaattggtggtaacccccggcctatgagttaccaccaactcatggttaaatgaccacgaaagaagtatttctaaacctttttttaacaaaaataaaaggaataacgaaaataattgtcatcgataatcatgtggcaaatttttgagccaatcagaaattttatttaaaataaactaactgtaaataatttcccactaataaagagagccacatatcccacagctcttcgggtgcctctcttggaatttttttatggttaaggatttgtttaaccatcatcttatagattgggccaaggggttgaatcgtcttctttttttttcttttttaatattatgttgagattagggttggtcgggaccggggattttgggcaaaaccgggaacgggactttttggctgagaaaaccgggaatttcccggtcccggtcaaaaccgggacctaggtactcagttgtccgtgtccaggtctacgacctttttaaaaagtcaaattttttttgttactctctttttggatacacaaattccttccgtctacagcaagcggtggaaaacattcgccattcgctggtcactgccagcgacgccattgccggctcaaccaccgacgccgaactgttctattggctgccggacggtgttcagcttgtggtgatcgaagtaaaataataaaaacatttttttgggttacaatcttctgaaatttgttgaaacaaaatcctccaaaaatattttatttttggtttgcgataatcgcgacaagtcaccaaatttggtctcccatttcttttttttccagggagatcaaacaaatgcaccaactccgccctcctcgctggccatcttcaaattgactaagccggaagaagcgcaaaagacggagaaagcgagcggtgccaccaccgaagcgaaagacgcggccacattaccgttggcgtcctcttcgcccgccgctttcatccaagtcggcccctgggcctacccattggaaccgggcaaaacggcaattctgaagaacgaattgggtgtgtaatttttgccaaaatgctttttatttgcctactattggtttaaactgctcaaaattctctctttaggtgtttacgtgatgccgaacccaagccctgaccatccgaatatgttcgtcggtatcattttacctcgcgggttggcgcccggacttgagtccgaatttgtatatgccttgaagcaatttgcggtgctcaacagcagcgacattgtggacagaatgagcgaggagcaacgcgagaggaccaggtacttacaaagcacaccagcaaagcgaaggaaaattgaaaaatatcgacgaaaatgtttaagcgaacgtatcgctcaatttctcatccgaactggccaatacattgcgttgaacacacaaaacgcggcccaatggaccggcgaatacgtggcaaagatgggcgagcagtacagagccggaatg

SEQ ID NO: 57166 - DNA, 58 bp, Heterodera glycines
  Genomic contig location: Contig_ID=SeqID_26436; Location=2019..2076; Strand=-
  SCN-specific regions: Sequence locations=1-58
ccaaatgtttcattttatatattccaaaatttacaaggaataaaatatttgcttgaaa

SEQ ID NO: 57167 - DNA, 1427 bp, Heterodera glycines
  Genomic contig location: Contig_ID=SeqID_26437; Location=266..1692; Strand=-
  SCN-specific regions: Sequence locations=1-18,51-243,288-560,613 -681,724-972,994-1324,1352-1427
atgtatacaggtaattagtaaattattaaaaatttttaatgattttttaagaagaagatgcagaggaatttgaaaagttaagcattgaaaatcttccgcaaaataaggtcagtgaattgaatatgcaaaatgtcaatgctgcttcaacttcggctgcagctgctggaggctcattcaatggtttgttattatggggatatcatttatacacagtaatacgggcatgcaatattttttacactgttttttagtaaatttataaaataacttcttaaatataaataaaacttggtactgtatctaagcactcgaaataataaaattttgaatttatcggaaaacaaatagaatggtaaatcaaaagttttcgttactgtacaaagccatttgaatcgtagagccgagatgtttcgagactaaaaaatattaggcgtaaatgaggcatagggcgggactgctccattacgagcaagaagtgtgttggcgctatgtcgttatttaaaaaaccaacattatttgactaatttaagttaaaatcaatatttgccgcaattcatctcaaaatgtatttacaatcttttttgtattaatattttttgttgttgtaaagtatgttaatataatgtaggctaaaaaataccaggaatatatatgattataaaagtttattccataaaatcaatgtataattgtgataattcaaaaagtaatgaattttgtgatgggtttcaggaaatattgattttaactataatgatagttttttaaattacgcccattttgatggttttttaaataatgagggccaaaaatgctcgaaaaacaaagtattttagttcctctggccataacttttttaaaacataacgaaattttttgaaattttttagactaatagagaacatttagggctattgaatgataccaagaattaaaaatttgtttgcttttgagctaagttataaataatttttcatcaaatcatattgttggttttttaaataacgactccgcaccagtgtgttgcaaatatagggaggtgcagatgagtgggtaaccattccaacaagaagcccaggataagccagaaataattcgaagaaatccctgtaaacttttataattttgtataaaaattttctattctgatagacaatattaaaagctattgaatgataccaagaattattaatttgattgaatttaagcgaagttatgagtttatatgtcttacattttttttctacctcttggcggctttaagaaacgcccatagtggcggtttttaagaaacgacctagcatccataataacaattcggaatttaaccaaaatttcaaaactttttcaggctacgcgaaaatgcaattatttctttcagtttaattatgattttgttaaaaactggtgaataatattcgaataaa

SEQ ID NO: 57168 - DNA, 1496 bp, Heterodera glycines
  Genomic contig location: Contig_ID=SeqID_5176; Location=125..1620; Strand=+
  SCN-specific regions: Sequence locations=1-146,176-482,507-732,766 -884,906-1496
  Gene Ontology: Mol. function=hydrolase activity; Cellular component =membrane; Biological process=lipid metabolism
aataatgaacttcatattttgcatttctacgagtccaatgtttacccattcgccgttgaaatccatggagactttgctcggcttggtcgtattatttctggaaatgccgtcggtttggtgttaggtggtggcggagcacggtattcataaatattcaaatattttataatattttcatttaagaggtgctgctcacgttggcgttattaagtgagtgtcacaattttttctgtttttttaaattttcatcaattttagagctttacgtcagaatggcattcccattgacatgatcggtggcacttccattggctctttggttgggggagtgttggcgagtgacccatatgaccaagacggacttgagcaaaagacacacttctggtttacggtatgatagttctaacattaaacaatttcgttaattttgttcatttcagggaatgggttcggtttggaaggttcttatggttcgttgctcatttttgtttgtttccattaaaccttttgtcaggacttcacttatgggtacgtggcgcgtttcaccggttcccatttcaacagtttgttgatgggactgttcgatgaaaaacacatcgaggacctttggctgccttatttttgcgtgaccactgatattacgtgagtgattgaaaggaatataactgataaataattcattattccatttttatttagtgattctgaaatgcgtgttcatcgcactggttgtctctttctcactttttaaatcattttatcttttaccgatttctgcttcaattaggtcccctctggcgttatgttcgtgcgtcaatgtctttagccgtttggctgccaccgatctgtgattccgaagacggtcagtggtcggaccaaaacactttgaatggtgtttaatttaaggtcattatttgcttgacgggggctatgttaacaatctcccggcggatgttatgaggtcttgttgaattctcctgtgttatctcctttccctgattttcaggtcatttggtgcacgaactgtcattgcggtggatgtcagttcggctgatgaaaaagattttcacaattacggggattccattagcggtttctgggcacaattgagagcgctaaatccgtggtcaacgaaattgcgcattcttacgggccaggaaattcaggtgtttcgaattcccaaagaaaattccaacttgttttttgaggatcgtttggcttatgtgtccagtgtccgtcaattagaaatggtgaagaaagcgccatattgcaattatcttcgtccgccaattgcttcttttttgaccatggattttgctaaattcgaatctatcagggtgactttgtgaatttcgttgttgttgaagtgtcattcacaatatgtttttgcctttttagcgttcgggttatcgttacgcggcagaaattgttccaaatttggtcatgactaacgcccatctgaagacgcttattagtcatgaaaagatgcatgagcg

SEQ ID NO: 57169 - DNA, 1226 bp, Heterodera glycines
  Genomic contig location: Contig_ID=SeqID_5177; Location=67..1292; Strand=-
  SCN-specific regions: Sequence locations=1-907,929-1226
atgggaaaagacgaaacagtgacagcgcagccaacgaagaaaaaacaacggaagtcgtctgaaatggaagggcgaccgtcttctccttcgccagttcagcaacaccgtccttctacgacttcgagcagtacgagcaacactaccaccacaaaatgggtgaaggaaggcaatacgacggcaaaaagtggggcgaacagtaccacggcaaagaaagagtcggcactgccaaatgtgataagtcaaatcacggtcccatttccaaatctcaagaatttcaaggtgacagacttgggttgtattatgaaagagtatttcttttagataccaaaagtgatcgaaaatgctgaccctcctccttctacgagcagtgccccgcatttcgttccaaacaaaggaggaaccaccgaacttcagcaacaaagcagtcaatcgagtttagcatcatcttccaatgagaagggttcgcgcagcaaattcggcccattcaaatcttcggatcatttcgagcaacgtcgcccggggggaggagcaaaacaatcgaaaggagctggacaccaacacacacattaccaatacaacgacaaatatgcgggaggaggtggtgggagctcatcattccaaccacacaacgcgtacagccgacaaagagcaccgaaacagtcgcaagcgggcggtggaggacgacacgggggagggaattcggaacagccgagaaaacagcacggagcagcaccctcgacgacgtaattgacacgaacgaacccatccttttattttccgttcaattttgctttacaggcggccaacgtcctcttcatccaccgctggccatcgtttcactgtccaattccaacagcactctcgcgatggagggtctggtcacaatcagcagcatcctttccctccgttgttgcagcatttccctgcccaacagcagctcagcggcagcgttggttggcaagcagtacaaccaactaccggggagttcttccatcaacagcagaaccacaattatttgcctcaacagcagcagcaaaaactagaatggtttggccaagccaataatgaccaagagcatcgacaaaccgcgagtcattcagcgagtacagtacgaccaaaccaaacacggacaacggaccgacagagtggcaattgcagagaggaagacagaatggacaattcgccttcaacgggaaacggtctccaaatagtagacgacgaataaa

SEQ ID NO: 57170 - DNA, 1278 bp, Heterodera glycines
  Genomic contig location: Contig_ID=SeqID_5178; Location=184..1461; Strand=-
  SCN-specific regions: Sequence locations=1-555,577-669,691-1278
atgggcgccggtaccgacgacgcggagtcgcagcagtgcgaaacggtgactcgtccgtcttccaaactgaccggacgatgttcaccaaatccgggcaatagtctttcctctttgacacaacaaaacgcattttctacaacttccgaccaaagagtgaggccaatagagcagaaaaatgtggcgggcggaaacaccgactcttcccatttggcacaaatgtcagtggaacaacagcgccaaagatttgggatgaacgtggtgtacagacagcaacagccgaagcagccaattgcaccgatgggagggataaatccgaccaccggcagactaataatggcatcctcacactttgtgaaatgccaacgatgttcattttcaggacagccaacctggccttcgccattcttccagttctgacgtgttcaatttcgtgccggaccattcatttgaggacactccaaattttggcaatatttcaacgactccgtaccaattgccgactggggtagtgcgtcgtcgtggccgagggcgaagagcggggaattttggggaccgacacccgtccacttcctcctcaatcgaacacgaagggacgccagagtcgccgtccgattttgggacgctcagaaaaacgcgtgggattggtaaaaaaattattatcaaatctcacttaaattttcaatttctttataactaaaatcaactgctttttggttttagggaattcgggtcaacgcagaccgagaaagccgcgtaagccagccaatgtgagctttgaacaacgagaaggaattccacggtcgccgttccaacactcagaaagccatccgacaataggcaaaattccgcctcttcccactactccgtccaattatatttcgcgtaaatataaattttttgcttttctttttacccctttttgtttcagcccaaattgaggaagatttccgttccaaaatgatgtcagtttatgaaatgggcatttgcgagtcttcgaccgatgacgaggaaatggtttggcccatcgtttggcatcagaatagtgccttcgttttaaggacccacctcctccgccaaaagaactcatggctcataaccaatccgaaagttcgactactgatcaaaaaacgcctcccgaaatagacgaaagggcggctggaactgttgaaaacagtggaaatgcggcgaagaaaggtggtccgccgttggcaaagtgcagcgtttcttcctctcagtcgagcggcggcgatcagacggccgttgccgaccctcctcaaa

SEQ ID NO: 57171 - DNA, 1067 bp, Heterodera glycines
  Genomic contig location: Contig_ID=SeqID_5179; Location=18..1084; Strand=+
  SCN-specific regions: Sequence locations=1-43,65-1067
aaggtggtcttaaagaaagtgaacgtctctgaggattatgtacattattttaataagtttgggaagttgggacagaattatttcatcggaatcaatgaaaatgacgaggcgacgaaatcatatctcccgtacataaactgtcaggtgctttgatttgccaaactgaacaagaccctttcaatccaaattctgtttaacagaaatataataaaaatgactgcgacaagggaagaagtgatgggtgtatgaaaacggtcaaatgcgttgtgactgacccaatccgcggctcacagcaattggtgggtttaatatgaatttgctcacaaacactgaccaaagttcaaagggcactcatttgaccattgtaccgtttaggcttgcatggctaattattacctacgcgacgcatcgccaaacaaaagcttttctgagggcgacatcattgagccctctctgatggactgctggcagcacgaggagaggcaattggcggagtgtaagcagcaggacaaatgtgtggcggacgtgcgcaagacgggccaagccaatcagtcgtcactcttctgctgttgccgtactcacaattgcaatcgacagatggtctacgcggaggagaaatacattggaccatcgaccacgagtaacaaatcggtcatttcatttcccacccaatccttttttgccttaagcgtcctcttcaattgtcgactttccattgtccgttgggtttaacctacttcaattggccatcatcttctttaccgtccttttcatcgccattttcgtcgtcttcatcctttccatgccaaaattacgaaaaaaaatatgcaaacggagcggaactgcgaagttctttttgccgttttacagaaacacaaatgacggaaaggaccagcggaaagaattactcgccacggaatacgacgggcaaatcactttaccagatggagaaaaagtgcacaaagagaaaatcactctgcacgaggttctaacggtcaaaaggctgatttggtcgattttcttttcgagagagtgtccgttggtcgctttggccaagtgtacgaagc

SEQ ID NO: 57172 - DNA, 655 bp, Heterodera glycines
  Genomic contig location: Contig_ID=SeqID_26440; Location=687..1341; Strand=+
  SCN-specific regions: Sequence locations=1-312,343-532,570-655
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtga

SEQ ID NO: 57173 - DNA, 678 bp, Heterodera glycines
  misc_feature (213)..(213): n is a, c, g, or t
  misc_feature (219)..(219): n is a, c, g, or t
  Genomic contig location: Contig_ID=SeqID_26440; Location=1..678; Strand=-
  SCN-specific regions: Sequence locations=1-678
gaaaaaaatatttatgaaataaaaaatcgattttttcaagtgtccgtttggggtactcaaccatttatggggagcaaaaatccaacgcagaaataaagtacaggctatagggaagctattccggaaggattcggtctccccataaatctggggcgcatcgctcgggggggactgcccccaaaacaaaaaaatcgattttttcaagtgtccgtntggggntactcaacaatttatggggagcaaaaatccaacgcagaataaagtacaggctatagggaagctattcccgaaggattcggtctccccataaatctgggcgcatcggttcggggggactgccccgaaaacaaaaaaattgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaac

SEQ ID NO: 57174 - DNA, 780 bp, Heterodera glycines
  Genomic contig location: Contig_ID=SeqID_26441; Location=81..860; Strand=+
  SCN-specific regions: Sequence locations=1-110,151-585,608-780
ctacaagctgatcccgatcaagcttgccaattttgtcaagacgttcggccttgaaattgagggagtggacaacaaaaagtacttcccccacaaattcaataaggtaagggtaatttatgaaattaattaaaaaaaaatcattaaaatttaggcggaaaattacggcactgttttggacactctcccgccaatggaggactactacccgggtggtctcttccctgccgaacgcgcaaaattcgagcaatggtacgacgagaaccgggaaacagggtttgagctgaacgaagtgatcgccgactactgcaaaacaggtaaaagttctggaaaaaacatgcaaaaatattcaaaaaaattttgaagatgttcaaattctggcacatggtctggtaaaaatgcgacagctgttcttatctgagactcggcatgacatcaccgattcggtcaccatcccatccggctgcatgaagtattgggttcaattggcacaccacgacaaagagcgcgtcgccattattccacatcttggctatgagaagcgcggaaaacagagcactattgccagaaaatacttgaaggtgtgccaaaaaaaattaaatttattttaccttttcatttctctctcagtggcgtgccgaagaagagttgcgggagaatggccgagtcctccgccatgtcgaaagccctggaggggagttcaaattcggcaactacagcttggacgggatgatggagcggccggacgaggagaaaaacttggccattgaggtcaatgggtaa

SEQ ID NO: 57175 - DNA, 1153 bp, Heterodera glycines
  Genomic contig location: Contig_ID=SeqID_26441; Location=1066..2218; Strand=+
  SCN-specific regions: Sequence locations=1-605,628-680,702-787,834 -1031,1071-1153
atgctggaggacaacacagccatgaaggcgtacttcgacaactgcccggactccggaccaattgacttccacgacgccttctttggcggtatttttgggtttaaatttgcaaaataattttgggcacaggtcgaacagggcccgaatatttgggcgcttcggtgatcaaccctgagacgggcgactggaagagccgtacgatcaaagtgaaggactttaacagtctttatccgtcgcggtaagaaatgtcggaaaaaaatgaatagttgaaaaatctttggcactttaaggaatatgttcaccaattatccggttggccacccgaccgtggtgcagtttgacaaggacgtggaatggaggcgtccagaggacgttgttggcgacgacggcatccgccttgagggcatcatcaagtgcttcgtagtgccgccccgccactgccactacgatatcccggtcctgccgtaccggctcaacaaccgcacgctgtttcccctctgccggacgtgttccgaaatgtacccgcgcggcttgatcgaccccgagtacaattgcaatcattttgaggactctgaaaggggtgagtttgaagcttgtaattaagcaaatattttttcttaataggcttttcgacaacagtcacacacattgagctgcaagccgctctccgctcgtggtacaaggtgacgcatgtgtaccgtgcctatatctggcctctggcgtgcgattggagcaatgggctgttccactcgtacctgctgaagtttctcaaaatgaaatttgaaggtaaaatttaaaaaaaaattaaaaaaaattcattaacaaaaatttaagcaagcggatatccagcgtcttgtacggaggcgggcatcagcgaggaggagtcggcacggcggaagcaggaccacatcgacaaagccaaacaaaaggcccaagtccaccttgaggcggatcggatcaagcacaaccccgggctccgctacctgtccaagctgtgcctgaattcgctgtggggccggttcgcacttcggtaaaatttctttaaaaaattatgaaaaaaaaatataaaacgtacaggaatcggctcacaaaaaccgaaatagtcgaatgccattcagagctggccaaactgctcaacgaccaaaagtttgag

SEQ ID NO: 57176 - DNA, 1045 bp, Heterodera glycines
  Genomic contig location: Contig_ID=SeqID_26443; Location=85..1129; Strand=+
  SCN-specific regions: Sequence locations=1-84,106-604,634-1045
atggttagtgcttagtttttactatttctaaacaagttttcattatgacatatttggtaattggcaacaaatttaaaaaatgagtttgtttgcttttattttgaagcaatttgctcaaaactgtggtgtcccgtaaatataaattttttctgtccggcgatccaccgtcttttttatggtccgtctaacttcttaaatgcatttctattaaaataattcattgtcttttttcagtttttcgtcactgctacatacagaggctattgtcctgcccacgactctttcctgtacaaatcttggcttggcatgctgaatttgacccgtgcccaactgaacgacggagtgccggaccaagaacacccgaaaagggagcatcaatcgccacaaaagcaatatcatttggacgtaccactagaagaattgcctcagcgattaaaaatgtggattgtgccgtccggggccggcgatgtcaatgctgatgggtactttcaggtcaagcgcattgacgcacggatatgggtgagctatttgaatttatacctaaaaagcgtcacttcacagcacgttttggtacattcgtaaatttttgggcaacaaatcgtcgttttttaatttataaattaatcaaaatttcgatatttacccaatttttactgaaagtttcactgcctgtcaggtttccaatgagccggaatccgattcggatagcagcagtgtgaacggagatgccacaagcaacggcaacaacaacaaagtgccattgtcgcattccttcgcggcatggtttcacgaaatggtcaccaccttccaccattccaacatcctgtctgatgaacgaagaacgtccatacagcaatttgttgacgaactgcaacagggctttcgcaccgagaccggcgttgactcgttgcaaattaaactgttcggctccgttctatccgggttcggctccaacgactgtgacattgacttgtgcctgatcaacaccggcatcaccaagcaggaaaaagtgcagcagaacggggtcatctctcaagaggtttga

SEQ ID NO: 57177 - DNA, 318 bp, Heterodera glycines
  Genomic contig location: Contig_ID=SeqID_26446; Location=60..377; Strand=+
  SCN-specific regions: Sequence locations=1-137,159-318
acaaagaaaacactcaacgaatttggcaacaaagtgatttcggcggaatggaaaaagttggggaaaatgcgaaagctgtattatggcattggcaatttcaagacggaccagcaacgattttacgaattgctcaccgaatgcatttctctgctgactgaaacggacacttccaacgtttagacttttagactttgttttcacataaattgttgagaatttataatgcataaaacagagtcagtgcaataatattttcttattttcttttaattttttaaccatttccaaaaacataaatatttatttacctctgaataa

SEQ ID NO: 57178 - DNA, 1322 bp, Heterodera glycines
  Genomic contig location: Contig_ID=SeqID_26447; Location=1..1322; Strand=-
  SCN-specific regions: Sequence locations=1-177,201-343,365-1322
cttcgggggaccgtgccgggtgccgcggggtaagcagtgttggttcgtttcatcacggcaccgaaccttttggctagtcagtaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccattaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaaaaatttttttaagtgtccgtttgggg

SEQ ID NO: 57179 - DNA, 3268 bp, Heterodera glycines
  misc_feature (468)..(468): n is a, c, g, or t
  Genomic contig location: Contig_ID=SeqID_5181; Location=152..3419; Strand=-
  SCN-specific regions: Sequence locations=1-132,158-203,227-279,305 -540,563-893,930-1242,1284-1309,1340-1508,1538-1568,1610-1872,1894 -1940,1979-2156,2185-2209,2232-2544,2605-2674,2696-3030,3081 -3096,3135-3138,3173-3268
atggccatcagagaacggagaaggcgccgagtgatttcggcattcactgaacgaaaggataaaaaggggttttggtgagttatgcgtcccataattattttagagtcccgtgaaattttacacatcaaaacgatttatttatttttttataaaaaaacaagaagctaatagaagatttcatttttaataggacagcgcatttacttcaaaatatttttcaaatatttttgtgtttgaatgataatcggcgaaatgcgtcagacacaaatattacccacgccaggtgtttctggctttgctttagagccctccacaggccaatgcaattaaatccctggtgtgttcagtaattaaatggtaaataaattagaaggctcagacaaaaactaattgaggtttaagggccagacacataaataatttattacaaaacaattctgttaaatcaaatcgaaccgacattttaantaaggtttttataacataaaataatgggacgcataatctgccatgagaattcaaagtgaatgggtgattaattaagagtaattaataataattatcaattggatgggtcatcaattaatgaattgcctgaaatgtccttcttgagtctgaccacaaacgccaagagaacgtaaagcagaaagatcagcgcactcagtaaaacgttgacgagaagcaaaggcagtgccattgggccaaagtaagtgtcgtcgtgagttaagcacagagtgacgctaatcatcggtagccaattaattgccgagtattttactcactgatccggataatcaatggccatcgaaaagaccgaaatgataataaatcccgaatgaagcgaagtgctgaaaatgatcagaaaagcgtagaacgcttggtggcgatgtctgaataaaattaaaaatcattttaacatttttaaaaatgtgtacataaacgaattggcgaacaacgcattgacaaggcgatcaaagccaatccaaaaaagcgaacttaggccaacatttcggcataacaaaggaacggtttggacgacggcacaagggcctaaaaatattgaaaaatagaaaaaatttcgaaaatttgttgggaccttcaaacataaaagggtgtccgctgagggcaaatacccaaccgatggacagcgaaaggccaaaaaggccggaaaagagggcattggcggcgatcaaacagttgcacaactgacgaaatgtccttttaaatggcacaaataaagggaaataattttaaaataattaaattaaattatatttaaaattgagaaaaagcggactttgtcctccaagtgacaaaaacgagggaaaagttgagcagaaagccaagcgaaccgatggcccagcgaatgccaacggtcaaaaggaaagcgaagggcaattggttgttggggaaaacgccgaaaaactgcaaaaatacacaaggaaattttaaaatttttggtttttggtataatttaatcggaaatttaaatgataattttcggttacataattatattaattagatttaaattaatctgcaaattgaatttacctgcatcataaacaattaaaaaggtagcaaataaaagcgaaataatcttttaagaatagagagtcaaatgattctgagtactgtcataagtagagatcgaaccggtcggttatttgcggttttttcggtattttcatttttaggtttcggtttttaaccgaaaaaaaccgaccgagaaatttatgagtttttcgggttttttcggtttcggttttttttcggttttttaaccgaaaccgttcgaccgaaataattaaaaaaccgaaacaatcgaccgacttttttgacaaatcagttggccatttttttaacaaaattcattaaaaattcttaaaattttcctccggcggcgcctatcggcaccgccgaccccccaaaaagctatcttttcttaaaaaattagcccaaaatctcaaaatttggtatttttagacaaaatctgctcacaaatagcattaaaattacaaaaaaaaatttcctggcggcgcttatcagcaccgccggccctaaagttatggctagagctcacaattaaggcaccaaaaagcgcaaaatggcactgaaaaaaggcacaaaaatcccgaaaaggcatgaaaaaaggcatttaaatttttttattaatgatttttagggagcaaaacacgtaaaaactaaccaaaaaactaaattttgctgttactcagaggtgatctttcgctttttctattgataaaaatggtttattgtttttttgggaaaagataaaaaaattcaaaaaaaccgaaaccgaaacggtataccgaaaatttttcttcggttttttcaatttcggtttttttcggttttttaaccgaaaccgttcgaccgagaattttttgagtttttcggtttttttcggtttcggttttttttcggtttttaaccgaaaccgttcgaccgaccctcttgtccggtctctaattaaaattacgaattcacaattaaaagttaaattttttgagtcacattaagtttttatcaaattagaaattattttattttcataataaaataaaatatgttttaaaaattgacggattgtccactgatcaattgatcagtgacgtattgtccactgatcaattgatcagtgacggattctcaatttttaaaattatagggaggtgtaggcgaaaatggcagttatctgaatgaccaatttgataatttttgggtctttatttaaaaaaaaattttgggcagcggtgccgataggcacaccgggagggaaattttggtaaaatataacgaaattcgttaaaaaattttttatgtttctaatcttgcattcttttaaggtgccccaatattacccggaggcattccacgcaattcccaaggcccaattgacgttgtccagaaatttacgcgggcacgtggcaaaaaaaatacggtgagtaaatcagggttgaattttcaagatcagcattttgattttggcttaaaaatcagcatttcaaaattatttttaaatttaattaattgtttaattattaaatgaatttttacaaatgtcgcaggctcaattaaaatttttgtaattttttttattaaaattaattcagaaatttaatttaattattttattaaatttaatttatctcatttttaaacaatttacagctcgacgagtcgtcgaatcaggaggacgaggtgtttgttgaagctcatccgatgcaaccggtcactgctgacg

SEQ ID NO: 57180 - DNA, 786 bp, Heterodera glycines
  Genomic contig location: Contig_ID=SeqID_5182; Location=886..1671; Strand=+
  SCN-specific regions: Sequence locations=1-160,184-232,254-314,338 -374,396-576,651-786
atgcatcagtgccattgtccgtcaatgtttgcaagtgatcgggtgggatcacatcggccaatgttgtcccatttgacacacggcgagtaattgagcctaattaaagcaaaagctctttttagtttgggacaacaatcaaataaatacatttttttgagagtttaatattataaaaatataaatcaaatgagtcagacgaaattattgtaaaatttggaatgcacgattagagaaataatttaaaattttttttgacaaatttcgtataattggccaaaattgccctcctgatgtgcctatcggcaccactgctctaaatttttgttgtttttaataaggacacaaaaattaacaaaattggtcgtttctgttggataaaaaaatatttaataattgccattttcgtccacacttcccctataatattgcctcggaaaatcccatccctactttgagcgtgcgctttgtcggcactttgaccagcggaagcggcattgttgacagccgcgagccgacgagacttccgttggacagtggcgctgcgcgtccgttgcgcctttggcgtgtctgaaaaagaattaaaaaaatttaaaatcaatttaaaaaaaattaaaaatcaatttttaaatgtaaatttattttgataaaatgaacaactaaaacccagtcctaaacataatccatttttatatttcatttcagaagactctaggaaaatccgtcactgatcaattaatcagtggaaatccatcactgatcagtggacaatcgtcactgatcaattaa

SEQ ID NO: 57181 - DNA, 3099 bp, Heterodera glycines
  misc_feature (42)..(42): n is a, c, g, or t
  Genomic contig location: Contig_ID=SeqID_5182; Location=1753..4851; Strand=-
  SCN-specific regions: Sequence locations=1-26,91-366,407-590,613 -784,806-825,847-913,935-964,986-990,1012-1194,1256-1406,1460 -1480,1503-1531,1553-1647,1686-2091,2119-2138,2197-2465,2487 -2535,2557-2653,2720-2917,2946-2992,3014-3099
atggacaacaaaacacttactgtgggtataataattaaattntaatttaattgcttttttaatttatttaaaatttttttaaatttttttcttcatgctagcctgaccaacaacgggcaaagtggagaaaagaatatgcacacagaagtacgggccaccttttctgggaggtaactttttttaaagaattaataaattttatgaggatttaacaaattacttgatgaattttttttagggagcaaaacaccgaaaacgtaaccaaataacttaattttgagtcatttaaatgattttttaatggatttttttgtaaaaacgccaaaaaaggcaccaaaacggcaaaatgccaaaaaaggcaaaatgttaaaaaatttcattttgaaataaatattaaattaattttcccgaatttaagtccgaggacaacacgttggtagaatggcacaatgaaatagacgcgcaaaggtcccgctcgttgtccgcccgacgtgacaaaaggccggaggccccaccaaaacctctggtgggtcaattataatttttggtttttaatgtgcgaaatatgtaacaacatttcatacctttttgaaattttaattacaaataaaacaagtttgatcatcaaaaattctgattttaaaactttctttgaaccaacaaattaagtgatcttgctagccctaattattttctaatttcactgcataatttcattatttaaaaaaagttattttgagcaattaaaaaacttatcagcaccatattagatttccagaaaccttcatgatttttctctccctaaaattgggtttttggcgtttgttcattttttgtgattatttttgcgtcacaaaaattgagctgatcgatttgggtccactttctcgatgaaatacagtaacttttggaccatatgttagtaaagaaatgtcatgaagacaagcggtcttttttgtacttatttgttagaaagttttagatataagcttttttcaaaaacgttccaaaacttttaagaataatttgatgatcaagtcatgcattttgcccaacgatttttcgatcaatgtaaaaatcgtgacttaaccaaattaattccaggaatggagatgcacaaaatgtagtcacgagcctttttatacgcctcgtggactttctacccatatgcaacgagtgcataggtagatcagcattaaatcaattttaaataatataaatttttaattttaatttaaaaaataataatttatttcgaatagtggtgcaacacattcccccgtccgccggccatcgattcgcaccaccattgactttacggcggcatcacctgaaccagaagaggtgggtcatgatgccgtataaaaatatattgtcttgactcaaattaatccgaaaaattgatcaaatattttaaaaatgtgatttttattttgattttttaattaattctttttttgaaactttgatcacatttttctgatcagtttgttggtgagggtcaaaaaaaggtcgagaatttatgatagaattatctccacaaaataaaagtggtttaaaagtgatttgaatttactgtcagaaatattcccttgttagaaaaaaattgattaaatgtttgctcaaaaaagttttgcaaataagtccaaaaaataaaattttaattttatcaattttttaaaaatggctcaatcatttagctatggctcccccccccccccctctccctccttgggatagttggcggtcttatcttggagtcaaaatttaagaattagagtcttttttatgctttacaacaaaaaaaaaatgcaatttttagtaaaaaacaaaaaaatattttacactttttcagcccaaagcagccgagccgcccaccgaagtgcctcaagaacgatgggtggacccattgccagaaaagttgcaatttcagcagcaggagaacaaatttgccgagctcaaatgcaaatactcgcgcgccaatgccaaaggtgattattaaaattaaatttgaaaaattgatcatttttcattatttaaacgactgataaaatcataatcaattacttttttcaatttcaataaaacaccaaaaaataaatgataaaattaaggatatcttcaaatctatttttaggataataaaaatatattaattttaaaaaaaataaattttaaaaatttcttaaatttaatgccaaaatatttcttttcagtgcgctggtataagggccgcaaggagctgttctcggacggtctcaagtacaaaattctgatcgacaagcagtccatcacgctgatcatcaacaacccggacccggatgacagcggcaagtacaaatgcgaagcgaacggagttccgaccaattcatttttcactgtggagggtatgttttggacggggcggaggacaatagcgccaaatcagtttgaaataatgaatcactattttccagtaacaaccaaccaaaattaaatatttttggtggatttgattagtttagccttacgtgttcaatattgtttatttgccagtaaaattttgaaaaattttttattaaccaacaaaaagtttttttaacagattttcattagaaattgttaattcattaaccttgcctcaacttagggttaaggactttccaaggacgggtataattattattttaagtttttatcaaatttattatattttaataaaattttaaataaaaaaattgtttgtttatttttggatgatttcagacacgccaaaggggcaacggacgcgaagcggcactgctccggggaagtcgcgtcggctcgcacctgtcaacaatgccgcttccgctggtcaaagtgccgacaaagcgcacgctcaaagtagggatgggattttccgaggcaatattataggggaagtgtggacgaaaatggcaattattaaatattttttatttatttttgaattgatttgagaaatcgatatttttaacagttgaagccagttttaaatttgaaaaattaatttttgttgacggattgtccactgatcaattgaccagtgatggattgtccactgatcaattggtcatgacggattgtccactgatcaattga

SEQ ID NO: 57182 - DNA, 313 bp, Heterodera glycines
  Genomic contig location: Contig_ID=SeqID_26448; Location=1428..1740; Strand=+
  SCN-specific regions: Sequence locations=1-116,149-313
atgtcacaatcattggttgatctgatgaagcatttgttgagcacgggagaagacgcggatgtttattttttggtgggggacggagacggaaaagaggcgagtcttcttcaaatttgaaatttttttattattttttaaattaattttagtgaattgtcctttttttgtttgatttttacttaaattttaatcctcttcagcttttgtcagcacataaactgattttgaagcacacttctgaagtatttgcggcaatgttccgttttgatgctaaaaatgaaaaagcggaattcggtaaaaaatattaattata

SEQ ID NO: 57183 - DNA, 538 bp, Heterodera glycines
  Genomic contig location: Contig_ID=SeqID_26448; Location=221..758; Strand=+
  SCN-specific regions: Sequence locations=1-479,501-538
acgactccgacccctccatttaataatatttctgttttgaaaaccaagctgtatcgatgaaaaagcgtgtaagaattgccccgatagattattcgaaggttgggaatttcatgggctttgtttgggttggaattaatcgagtggcgggaaaggtcagtgattatttaaattaattgaacacattaattaattatgacaaaaaaggaaacgagcgagccaccagcagttgaattgccaacgattaaattggatatacatatttatatgttgtttaaaacaaactatttcaacagctttctaacccatagaaatctttaatttttccattgaattgtttaagaaacaaaggcaaaaaaataaagaaagtataaaagaatttttggccaaaaagcagccatcaacatttttaaattgcgtataaatctcgcaaaaatgaacaaattgtttataaattagagtccggaggaactctcgactcaaattttaatttagaaaataaaaagtccacaagaaataaccaagtttgtcaggttttttg

SEQ ID NO: 57184 - DNA, 1425 bp, Heterodera glycines
  Genomic contig location: Contig_ID=SeqID_26451; Location=50..1474; Strand=+
  SCN-specific regions: Sequence locations=1-1425
aaacactgccacggcaccagcaacctcctcctgctgccccacaagtgccgcctgttcccccacctaggagagggaccaaacgtcgccaccccccggaaaatggtgatgagagtggtgagctgcgcatacgtaaacgagtgaggcaagcgcgaagagtacgagtgtattactcaccagagccgggtccatcaacatcagcacaaagcgatgaacaacaacaacaacaacgtgaactgtttgccattccgtcaaatcagctgaccatggcacagagaattgagctaatatacatcaaatgcaaccgttatgccgatcgtatgggtgtccggggaaacgcaattatcaacactcaaaatgcacaaccattggtgcgaagcaatttgcgaacggccatcaggtatataattgacagaagagcgggtcgacctaccattagaccaccgggagcggaccaattggaggagcggcttaggcaggacccaattttgtattcattgacggctccaccaaagagaccatcgcagagcacaagcagcaggacgtcaataaagaaggaatttcagccgaaaaaatggaaatgatcaacaccactcttgacaagctgtacaacgatccatcctctcctgctgcgtttgccggtgttagtgcactgtggaaggaggcgcggaaaaagttaaaacaactacggaaaaaggatgtacaacactatttggagggacaccgcacgtacaccctgatgcgcccccggcgggtacgatttccgagagcaaaaactgttgcagcagggttcatgaccgacgtccaagtggatttggctgactttcaagcgctttctcgtcacaatcgcggtcaccgatacctgctggttgcggttgatgttctctcaaaatgcctgtttgttgtcccattcaaaaataagaaggccgaggagatgttggaggtattcaaggagcttattgagcaaatgccaatgatcccacaccgtatcttctccgacaaaggcaccgaattcaaaaacaaattgctcaaggaattctttgaggagcatgagattaagaagcatgagcccgtgcattcgtacttacaccccgcttccgtaaagatgaatttgtgcacatgagcagagagaagggccagttcgagaaggggtatttgccaaactatggagacgaaatcttggaaattgacgaggtgctgaaggcggtgcgccccatcagatacaagctccgggatgatcgtggtgaaaaattccggggcaccttttatgagcaggagttggcccgcgtgagaaaagatgccgacaccagttacagaattgaaaaagtgtacagaaagcgaagaaaaccggatggaaccacagagatgctcgtaaagttcattgggtatcccgaacgagaatggattgacgagtctcagattgtataa

SEQ ID NO: 57185 - DNA, 1099 bp, Heterodera glycines
  Genomic contig location: Contig_ID=SeqID_26452; Location=419..1517; Strand=+
  SCN-specific regions: Sequence locations=1-967,989-1099
atgttccccgatgacgatgggtacgaatcggaagatgatgaaattctcttgccacctccgccgatccccccgcaacttggccaccctccaccaaatgttccggtaatttcggtttcgcttttcgttgctttttctcaaatttccgagtgcttttttcaggcagttcgtgttcaaccaatgcatgttgggcagcagcggctgccgctgagagacttgccacaattcgaggaccatccgcaaaatgtgccggtaattttgggtcgattttcgctgcgttttctcaaatttctgcgtgcttttttttcaggctgttcgggtccaactgatgcaacaaccattgccgctgagagacctgccgcaaattttccaccctccaccaaatgtgccggtaattttgggtctttctttcgattgctttttctcaattcccgagtgcatttcaggcaattcgtgttcaaccaatgcagcaacccgtaccaatgagagccgtgccacaattcctccaccctccgccaaatgcgccggtaatcttgagtctcgttttcggttgctttttcaaaatcccgagtgcattgtttttcaggaaatgggtgtgggaccaattcatgatgggcaacaaccactaccactaagagcgttgccacaattcgcccaacctccaccaaatgtgccggtaattttggctcgtttttttttgttgcttttttttaattcccgaatgcttttttcaggccgttcgtgtccaaccagttcaacaaccgataccactgagagacgtgccgctatttgtcaacccaccaccaaatgtgccggtaattttggctcgcttttgttactttttttcaagatcccgaatgcattttttcaggtaattcgtgtccaaccgatgcctcaaccgttgccgctgagagacatgccgcaaattcaccatccaccgcgaaatgtgacttcaattcggatcaaattgtggttgctttttctcagtctctgggtgtttcttcagggaattcatgttcgacaaattcaacgggaatacgcagtaccgcaatttgcccatccgccgccaaacttgccgtatcatccaccagaaaacgttccg

SEQ ID NO: 57186 - DNA, 1017 bp, Heterodera glycines
  Genomic contig location: Contig_ID=SeqID_26456; Location=136..1152; Strand=-
  SCN-specific regions: Sequence locations=1-305,376-738,792-1017
atgcgaaaactcagatatccaaataacgttggaaaacgaccagagatcgcaggtgaaacaagtaaggcacgaaaagaagtcgcacttgacggaggtgcatttgttggtgttgaaattgacgcagaaaaaatggtcggcaaattgaacttttatgcggccggaatattatacaaagaaaaagatgaaaacgtgcaaccaattgagaaagtgccagatgaaaaagtgccaattgggaaatggcacaaattcgaagggcaagaaattgaactgatgccaagagaaattgatatgacaggtgaataacgaaaatattgatttattatttaattcactatatgatttaaaaataaattaaattaaatataattaaattttgccatttgaaagatgaaaatgacaacatttgcattgaatttttggcattggctgatgctgatgaaatgaaagacgatgcgcactttaaaatggacgataaagaacgaattcaagcaaaattgggcaaatatatttgcaaaaacatgaaagaaaatgaaaaaaacaagcaaaaggatcccaaaaagctaaattgcaaatttgattggacaacggtggacgatgttcaattttatgcggaagaagcaatgggcgaaatgcgggagaaatttggaattacttacaagaaattagcggtaattatccacatatcctaaacacattaatgataaaattcgattgaaactatgaacaattaaaagaccgaaaaaatttattgttttataaatggtaaaaaatatttttaaataaaatttttaggaatcttttctatcggatgacttagctgacctgggtatcaaagggaaaagctcaaacaaaatttatcgtacaaaagacgaaaagtttttgttaaagcaaattcctcaaccctatcaaatggaaacaatggaaagaacgttgaaagattatctgaagcatatgatgcaaatgggcgacaaatcatttatcaacaaaatcttttttgtgtttcgagtggaaattgag

SEQ ID NO: 57187 - DNA, 987 bp, Heterodera glycines
  Genomic contig location: Contig_ID=SeqID_5183; Location=58..1044; Strand=-
  SCN-specific regions: Sequence locations=1-375,401-477,589-737,770 -809,831-987
atgggccattgcgcttccaaggaccagaaggaccagaaaaggcacaaccggcgcattgaggaacagttgcgcaaggaggtcagacagaagagtgatgggagacgccaatttgtaccgtatatttccggagagaccggaaaatatactgtactgttggttgggatttgttaactgtagcgctgtgctgcagcagggattattgaatggcatactgtacccggaggaacactgaccgtaatgatagagcacgcgcaccgtaatgggacataaaagacctcctgtgggcataccgtacaaataccgtaccatttatcaattgggatggcactcagtattaatgtcagtgtgatgatataattaggtgccatggtgtggaaacaaattaattaattaatttccaattattttagcaatcgatgaatttgcgcatcatcaaattgcttctgttaggtccgttattccgcgaataaaatataataattattatttaaaatttatttgaattaattaatttaataaatgtaaaaatataataattaattaaaatgtatttttatttaattaattaaacgaataaataaaccaatttttcaaacttttttcggcatgacattttttgtcatgccgaaaatgcattaaaaattcactaagaaatttttaaattaatttaggcgctggcgaaagcggcaaaagcacaattttgaagcagatgaggtgcccaaaaacgggaaaaaacgatttattgaaaaaaaaattaaaaataaattttcaggattttgcacaaagatggcttctcaaagcaggatttgctgctgataaagcctgtggtgttgaggtgcgaaatggcatttgttctgttctttaattgatgtattatagaatttttgggttactgtaaaaaccggtatttaccgtttacccggttttaccgtagaaaattattcacaaaattgcctcaaaataccgccaatttttggtaaaattaaa

SEQ ID NO: 57188 - DNA, 837 bp, Heterodera glycines
  Genomic contig location: Contig_ID=SeqID_5183; Location=4250..5086; Strand=-
  SCN-specific regions: Sequence locations=1-597,624-837
atgggtttcggaccatttggagcagttgtaccaaaaagcggttgttgagccggagaaggcgcgcaaggagaagacaatggtcgaaatgcgagacatcaaggaacagattctgcagcgcaaaagtgcggcccagcaaattggtattggggacacggacggacggaatttttgtttttttttgtgaggggtcttcaagtgaaatgcaaggaaaatgctaatttttcgcctatgtcaaaaatcaagttcaaacttaagttttttcaatccctgaaagcctaaacagctttaaataaatatgattgtatgcgataatttgatagtcagcaaatttttgaaaaaaaaataatgaatctttcaaacaacagaattaatgcttctaatgaatcaaaagatcgtgttttcgtaattatgctaccaaggctttaaaaaaaattcaagtctgaatccgaattcgtattccaaatttggacaaaggcacaaatatccggggctcaaatctctgtctggacacgggcatgaaactaatttttgacgaatttttgtgtaattttaatttgattttgcttgaaatatgtgcaattttcgaataatgagaccttttttaatgtgtttttaaaattttaaggtgcgatgcttttcggagcaggaaaaaccgtcgctgacgacagatcgccgccgaaacgtcgtcgccgagacatggccggacaaaatgtcgccgagacaaaacgtcgccgggacagaacgccaccgagacaaaacgtcgccgagacaaagcgtcgccgggacaaaacatcgccgagacaaaatgtcgccgagaaaaaatattccaaaaattaa

SEQ ID NO: 57189 - DNA, 96 bp, Heterodera glycines
  Genomic contig location: Contig_ID=SeqID_5184; Location=400..495; Strand=-
  SCN-specific regions: Sequence locations=1-96
cacttggagttgtgcagcaaaaggtaccaagagttgaagaacattgtgatcaaagcggaacgtcgactgcttaatgtgctcggatttgttgtgcac

SEQ ID NO: 57190 - DNA, 101 bp, Heterodera glycines
  Genomic contig location: Contig_ID=SeqID_5185; Location=480..580; Strand=-
  SCN-specific regions: Sequence locations=1-101
cgtgacgtgctcaatgtgtacaatcgccttaagcaaatccatcatcggagaaatgcggtcgcatcacaacaacccgaagatttgcaaaagctgagcaaaaa

SEQ ID NO: 57191 - DNA, 1259 bp, Heterodera glycines
  Genomic contig location: Contig_ID=SeqID_26458; Location=19..1277; Strand=-
  SCN-specific regions: Sequence locations=1-482,504-945,967-1259
atgacatttgggtacaaccctaatgttccggcagaagtcatacttttgccagtgcatttccctggacattggactctaattgtccatgatgttcagtggggtactcattttgccgattctttgcctaccccctatggcaggttggattggcaactgacggataaaattggaaagatcatttctgacattttgccgtcagcagtgttgaccgggatttttaatgcggtaaatcttacggtacaacatgatggaaatagctgcgggtactttgtgtgcctgtatgctgaatcctggcttatgaacaattgcacttttgttctgccggatttgaacatcaattatgagaagaagcgcattttatggcacataaatgagctttacggctctgatattgtgccgtttcatccaagggaaggtgtttcaacatctttcgctgttgtgtctcatcacaatggggatgtagcgcaaacttcctccaaggtcataatgccaatggaagtggatgattcagcagtgcttccttcctcggaagatactgctgttcttgcgcaagcaccagtgatcggcgaaaatcaagctgacacccacggtgttgttgcggacacaattgtccagcaagaaccaatcgcgcaggctgatgatgtaattttcatcagacctaagacgccaccaaggcgatcaatgcgcgttcaaaaaaggctttcagcttctgttagccgttcgccttcaccggcgccgaaacgtcccccgccagcaaattcgctgggagtggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtagtatttgctgccggaagggaagagttgtgctgccaatgcttaacccgcatcctgatgagctcaaagagctgattgtggggaataagcaatcccgtgaaggaaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccag

SEQ ID NO: 57192 - DNA, 87 bp, Heterodera glycines
  Genomic contig location: Contig_ID=SeqID_26460; Location=2198..2284; Strand=+
  SCN-specific regions: Sequence locations=1-56,78-87
atgggctgcacaatgagtcaggaggaacgggcggcgttggaacggtccaaaatgatcgagaagaatttgaaggaggactttgtgcat

SEQ ID NO: 57193 - DNA, 297 bp, Heterodera glycines
  Genomic contig location: Contig_ID=SeqID_26460; Location=1588..1884; Strand=-
  SCN-specific regions: Sequence locations=1-255,277-297
gagggattatgacggatgagttgggaggccggaagcaatggcaaaatgaaaaatgaaacaaacgctgaataaaagtgattatagttgttgctccaaaaaggaggctaaggataaattaatattttaaaatgaatttgtagcaaaaagtgcgaccaaatgggaaatgaatgccaaatcacctcccaacaccctgccaaaccaaagctaaaatgggcaaattcaaatgtgaaagacggcacggcacgcgaataacattggcatttgaatatgaattaaattaataccaaaaataaacaa

SEQ ID NO: 57194 - DNA, 1158 bp, Heterodera glycines
  Genomic contig location: Contig_ID=SeqID_26461; Location=333..1490; Strand=+
  SCN-specific regions: Sequence locations=1-450,472-907,929-1158
gccaatccatcgctggtgatgttggacttgagtcgcaatgagctgattgacctgtcgccgggcactttcctctcccaactgaaccttctcctcgtcgatttgagcttcaacaaaattgtcagaactccgttcggcgcttttggccgtcggattgctaccgtattacttcaaggtaataaaataataactacagtatacgcaactaataattttgtttagaaaatcctttggtttgtgtggaacaaattcatatgctccaacagggaaacggcgtgttcattccgaacatcgaagacaaaatctgtggaaaggattcgacaacaaaatccacgacagtttcggaaattgaggcaaattaaaagcaattacctaaaataattatgaaatttatttcaaatttaacttcctttttaagtcactctccgccgatcaaatcgaagacaacgcatcggaggagacggaagcagcagaagaatccgcatttgttcagcaacagagcaccacgccgcccaagggatcgaccgaccaatttgctgagacaattgaaacaacgatcaatggccataaaatgggcaaaatgccaaacatacgcccaattcaaatagggcacaaacaacggcaaaaggcggcaacaacacaagtaaatgccgtagttaatttggctgtaataaaaagcaattattgcttttaattattaggtgccatctgccgatggttttgttgctgaatcgtcgccttccgccgaattaactgagcaaaatgccaaattaatgcagcagaatcagaaaaacaacggagctgaattggaccaattttcacttgaaggaaatgaaattaggcaccagcaaagaaaggacagcaaagtaacaaaagtcaattcaattaagctaaattagcgttaattatttattatttgtttaggaaataaattcgggcccaattcctctcaacgaaaaaattgaaaatggcgaaggaatttcaaaggtgagagaccgtaccgctgaaactgagtcacagactgcgaccgatacggtaattggagaactgaccgatgctccctcgtcgactacggtagacccgcgcaacgatccggccgtcatttacccgcacccggtcccatttttggccactgggccgaaacttcacacggcacacagt

SEQ ID NO: 57195 - DNA, 1625 bp, Heterodera glycines
  Genomic contig location: Contig_ID=SeqID_26463; Location=57..1681; Strand=-
  SCN-specific regions: Sequence locations=1-137,166-220,242-501,524 -651,673-740,762-791,837-1073,1095-1156,1195-1196,1218-1229,1259 -1276,1315-1334,1356-1374,1397-1499,1521-1625
atgtttataattagtaaggattacatttttaggctctaaaaaccgccaaaataggtaggctttaggctctaaaaacccaaaaaataggactaaaaatgcaaaataggcactaaaaaacccatttttaggggtgtaaaattttaaaattttatccaaaaaggtaacaaaattaacccaaatcagtattgagataaatgtttttaaatcacaaattcttgtcaatatataaaaaataaattttgaggtgaatttttgaaaaatttttcttaggggtgcattttttgaaaattttttgggtcgattcttaggggtgtgtttttcgtttttattgcatttttgttaacaaattttcggcaaaacgccaaaataggcaaaaataggttctttcaaaattttttaggctttttaggcgctaaaaataaaagcctagaaaatagtcactaaaaactcgaaaagccgcttaacaacagcccaaaaaaatatgtttttcgtgcgcatcaggccacggggagttcagacaggaaaaaataggcttttgcctaaaaatgtaatccctaataattattgaatttttgtaatttaaaaatggcaaaattcttaacatttaataccataatttatatgcaatgttaaatttgcgtcacatcaaacaaatataaacaaacaagcaaaggagttttaatattttttttcggaaattttttctttatttttcattcatttataaatacttagaacgaaaattgtaatcgattgttttagaatcaaagctaaatcgaaattttaagtccaaattttattttaaatttcttagttcttttatttttttataaattgtactaatagattcaatgaaccaaattactttttttcttaatttactgatttttaagattattttttatttgtttagttgtaattttgaaatttcttaaaacaattctttgaaattgtttatttcctcttttttgcagtgcttgagcaatttatctttatgttaaagttgaatatgaaattgtttgtttcgagaattgttcgttccacgtcgcaatttactttttgaattgtcagatgagttcattatttttaattattgaaatatatgttttctttgtaagtatctgatcgaaagtaaaatattcatcactgtcgatccggaacaataaattcattttaattcagtttatcatttaatttattggtttcctttttgttaggttattgttgagttattataaattttatatttattattattgtagagtgttaaaacccgtaaaaatgaatattatttaatttaaatgataaaaatatcattccagaattatgtgctgcttctaattctttgaaacttcataattttatgctcattatcctttttgtcatttattattttgttgaaaagcagagcaaagccaattttcggccatttcgcaatttgcgattgaataagcgtgccgattccggcctcaaggcctccttgatgttcattagaaccgagagaatataatgaagataaaaataggctttcccttattccttttataatcatttctatcatgaattatttgtaagtctatattctgatttttttcacatttaagttttcggctttaccgaataaa

SEQ ID NO: 57196 - DNA, 1952 bp, Heterodera glycines
  Genomic contig location: Contig_ID=SeqID_26464; Location=452..2403; Strand=-
  SCN-specific regions: Sequence locations=1-100,133-704,727-1336,1375 -1952
acaatgatgatggtattatggtgaataacaaagtttgtggtgctcaccattatcgtcgtcgtgctccgtccataccgaacattaccattgatgactacagtactaccaacaataacaacaacaacaatgatgctggtgttaatgaggcggttaatggcggcaaaatgggtgccgcaattccgttgccggcacccgccattccattgccagcacctgaaggcatgaatgaggataatcaaattgtagaccagcagagctcttctgtaatcgaaaattgggctttccgtgcccaagaatatcggaaatcggcattcgacacatccctggaaccaacagatccggaaaaaagccgtagtttaccgtgtttaggtttttggtcggaggcacgcacggcacacattattccacttaaaaacccgaaaaaatggttgacgaccgatcgataataaaatatcgaaatcatatcgatcgtgacgattaggtgatgttgatcgatgccctcaaaaaaattcggcaataggaaatcagcaattttttaaattgacaagagcttgggccaggacttggtggactcaggcctgggtttttcctggttactggcccagatcatttttcggcgacctggagcagttcatatttttttttcaaaatttcagcagtcgaacaccaatcgcaacatcaaaataacgaagcattgaatcaagcaaataaaaatgttgttgttgtcgttgataatgatcgtaatagtgcatgtgaacgtgctgaacttgatgaacatgtggaggagaagcaacacaattatggcataaaacagacaactgctgacgacattgacctcctacaacttcttgatgaaactgagcacttgactgagcaacttaggtgtttattagcattttagccgatggatgagcgggaagaagactaaaaaattttgaaatcgaaaaacggaggggtatgatacataccctgatcacttttttaaaattttgtactttttattttgatcaaaatactctgactaactttttccagacaaaaaatttcaaacttagataaaaaaaatcttagaaacttttttcgaagattgaacaatttaattcatcctaaaattaaaaaaaatcgcttggaaaatttttcaaaatttccttgaagttatgttcttttaaaatgaaaaaaaaccgctaaaaatttaatccgataattttgtaaaaatttaagagaaaatgcgatcaaattggagcaggagaaggagacaattctggacaaaattaacaacatcaaagcatcatcggcggctggcattaagccgacggcagcgcaattttcgcaaggcaataaatttttttttaaattttaaattctaaaaaatttcccaattttttttcagccgaacgtgacggactgatgttgaacatgcaacgaattttggccaggtgcaatactgtgaacatatcaattgaaacgccacgtgatcagcaccaattcaaggcattggagcaagtgaacaaggtgggtggtgcgattgttggtgccacactttttcaagcagtccaaccggcggggatatatgccagttttgaaagtccagggcgggtaggcatttgtgccaacgccatcaaaaacatttcggaaatcggcatttagacggctcaaaattcggaaaccggattccgattctaaaatgatatttttccgagccatagggatcagatcaggacacaatgtgtttaaagttgcactccaaaaatttggcattatgaaatttaaataaaaattacacaaatattttagaatttttagatccatgagcatacaaaaaattaataaaattcatttttttagatgatacaatcagtgttggaccatacaaatggaaatattgcagaatcgaaacaaaaaattgccgcctttttgaacgcgtgccatccagacgaagttggacgctattg

SEQ ID NO: 57197 - DNA, 118 bp, Heterodera glycines
  Genomic contig location: Contig_ID=SeqID_26465; Location=143..260; Strand=-
  SCN-specific regions: Sequence locations=1-118
atgccaatacgaaaaagaaaatgccaaagtgaaaactcagaaaaacgaatgaaaaatgatgtgacaatatgttttattcttgagaaaactgaattggacataagacatttatcagatg

SEQ ID NO: 57198 - DNA, 1041 bp, Heterodera glycines
  Genomic contig location: Contig_ID=SeqID_26465; Location=475..1515; Strand=-
  SCN-specific regions: Sequence locations=1-223,258-490,520-560,673 -737,796-808,839-1004,1026-1041
atgcaaaattcaaaagttgagtgccgtcgtagtgccgacggcgcaaaaagtcgcactcaagagtctcagactcgactcgagaaaagtctcgggtttttttcgtctcggtctcgagtcttggatttttagtctcgagcagcagtcagtgcccttttttatttgttttttcgaaactcgaaatcacggcattttacttgcttaattttgctgaacccaaacccgaaactcttcatgaaaaataaatcaaatgatggcaattaggcacttttaatcaaaatacaatttcatgaaaaacgtattttttgaatggacacgcaattagggaaaagcagcaaattgacaaagtcattaattagtgcacggaacggcaggggaaaaaagtgtcagaaaggcctaatgtactggcaaatgagctccatttgtttaatgaagaacttgttatactgactcaaattggaaaagcaatgggaaaatgggcgaagaaaaaaggaaataaaatataattaataaatttaatttgacaatttcgttattttatgtgagaaatgatttcatatgtgatattatttatatattttaaaatcttttaaataaaacattcgtaaaaaagatatattcaagattaataattttcatttgtaaaatgtttttaaagaaaattttaaaaaatttctgaaaattgatgtgacattaatttttccagctttaaaaatcaaagatagaaaagttttgaggagtttttaacaaaaatttaatttaattttgttttgattttttttctattttttaatttatcttaacattggggaaaaatattttaatttctaaaaaaaattttcttggaaaatcccagtttattcccgatcgtaatataaatcgaaaatttaaaaatggaatatttttcaaaaaatagtaatagagaaaatgattatttaacattaataattttgtttactgaaattaacttcataaaacattataatttagtcgtaaaactgaaaactttttctaaagcaaaaataattttcttgtaaaattaaa

SEQ ID NO: 57199 - DNA, 912 bp, Heterodera glycines
  misc_feature (10)..(10): n is a, c, g, or t
  Genomic contig location: Contig_ID=SeqID_26466; Location=1141..2052; Strand=-
  SCN-specific regions: Sequence locations=1-285,308-912
atgtcatctnggaaggggatggtggtcgccgtggaacccgtcgctgaacaccagcaacaacaacagacggacgattcgattgcggaagaagtgttttcggaggacatcgtttccaccttcaaaccgtcggagaagtcgctgcactccattctgtcattgcgtagcaattcgatgagcaccagtgcgcgggacagcatgggcaaactgaggagggactcggccagcgaagcgctgctcaaactgagaacgatgaattgcgtgccggagctgagaagtcctcgcgagtccaaaagtccacccaagtaaagccattgcatgctttcagcagtcccaatccaaaatttacagacccctgaggtcgccacgtggcattgaccgttttatggccaaattcccgcacaactcttcccgagaggccagtttcagtgaagagctgagtgtcaagggagaaatgctggaggaattgccgaatgcgagtcaaattgggatggtaatttttgggcaatcggtcccactcactttacccttgaattttttagcttttcgatgtgagtggagcgtctgtggaaggaactttgtccaaattggacagcactgccgactcaaaacgtggacagtcggacatttttttgggcacagatttcgtcgaatccaataaaatggagagaggcaattcgttgggcggttttggtgtgccggaaggtgaagtcttttggggaataaatcaaaaacggttctgtttgagtttgttcggctggtgtcaaggcacgggcagagaagacaagccatgttcagttggatactaacagaattctgttggcacaatttgtctacgaccacctcaacatttggccgactcaggaaatgcttatggagacagacctagaagtcatcaagggcttgcgcatttga

SEQ ID NO: 57200 - DNA, 665 bp, Heterodera glycines
  Genomic contig location: Contig_ID=SeqID_26466; Location=149..813; Strand=-
  SCN-specific regions: Sequence locations=1-665
  Gene Ontology: Mol. function=pre-mRNA splicing factor activity; Cellular component=actin filament; Biological process=signal transduction
cacctcaaatcccgccgagtccgttcccttagccagtgcccccacttccgccgagtccgttcccgtcattgccttcatttcctctgggttcatttacgccagtaccaccggtcccactgcctccactttcccccgaagtgcctccacttcggccgagtccgtctcccgaagtgcctccacttcggccgagtccgtctcccgaagtgcctccacttcggaggagtccgtccccaaaagtgcctccacttcggaggagtccgtccccaaaagtgcctccacttccgccgagtctgttcccgtcagtgccgccagtaccaccagtcccactgcctctactttcccccgaagtgcctccacttcggccgagtccgtctcccgaagtgcctccacttcggaggagtccgtccccaaaagtgcctccacttccgccgagtatattcccgtcagtgccgccagtaccaccggtcccactgcctccactttcccccgaagtgcctccacttcggccgagtccgtctcccgaagtgcctccacttcggccgagtccgtctcccgaagtgcctccacttcggaggagtccgtccccaaaagtgcctccacttccgccgagtctgttcccgtcagtgccgccagttccaccggttacaatgccaccaacatttcca

SEQ ID NO: 57201 - DNA, 342 bp, Heterodera glycines
  Genomic contig location: Contig_ID=SeqID_26466; Location=568..909; Strand=+
  SCN-specific regions: Sequence locations=1-312,336-342
gtggaggcacttttggggacggactcctccgaagtggaggcacttcgggagacggactcggccgaagtggaggcacttcgggagacggactcggccgaagtggaggcacttcgggggaaagtggaggcagtgggaccggtggtactggcgtaaatgaacccagaggaaatgaaggcaatgacgggaacggactcggcggaagtgggggcactggctaagggaacggactcggcgggatttgaggtgattagagaacggcgactgatttgatgaaaggaattaaaagagaaattccccttttcatgttaaatcaatgttgatcaacgacaaataaatcttttt

SEQ ID NO: 57202 - DNA, 660 bp, Heterodera glycines
  Genomic contig location: Contig_ID=SeqID_5186; Location=33..692; Strand=-
  SCN-specific regions: Sequence locations=1-660
atgactaattcccaaacggttggagcagaagtgcgcggaacacgttctggagaagaaacgtctggagcagaagtgtgcggaacacgttctggagaagaaacggttggagcagctgtgcgcggaacacgttctggagaagaaacgtctggagcagaagtgcgcggaacacgttctggagaagaaacggttggagcagctgtgcgcggaacacgttctggagaagaaacggctggagcagaagtgcgcggaacacgttctggagaagaaacgtctggagcagaagtgcgcggaacacgttctggagaagaaacggttggagcagctgtgcgcggaacacgttctggagaagaaacgtctggagcagaagtgtgcggaacacgttctggagaagaaacggctggagcagaagtgtgcggaacacgttctggagaagaaacgtctggagcagaagtgtgcggaacacgttctggagaagaaacgattggagcagaagtgcgcggaacacgttctggagaagaaacggttggagcagaagtgcgcggaacacgttctggagaagaaacggttggagcagaagtgcgcggaacacgttctggagaagaaacgtctggagcagaagtgcgcggaacacgttctggagaagaaacgattggagcagaa

SEQ ID NO: 57203 - DNA, 979 bp, Heterodera glycines
  Genomic contig location: Contig_ID=SeqID_5186; Location=3879..4857; Strand=-
  SCN-specific regions: Sequence locations=1-623,645-683,722-819,841-979
  Gene Ontology: Biological process=salinity response
aagaaacggttggagcagctgtgcgcggaacacgttctggagaagaaacggttggagcagaagtgcgcggaacacgttctggagaagaaacggttggagcagctgtgcgcggaacacgttctggagaagaaacggttggagcagctgtgcgcggaacacgttctggagaagaaacgtctggagcagaagtgtgcggaacacgttctggagaagaaacggttggagcagctgtgcgcggaacacgttctggagaagaaacggttggagcagaagtgcgcggaacacgttctggagaagaaacggttggagcagctgtgcgcggaacacgttctggagaagaaacgtctggagcagaagtgtgcggaacacgttctggagaagaaacggttggagcagctgtgcgcggaacacgttctggagaagaaacgtctggagcagaagtgtgcggaacacgttctggagaagaaacgtctggagcagaagtgtgcggaacacgttctggagaagaaacggttcgagcagaagtgcgcggaacacgttctggagaagaaacggttggagcagaagtgtgcggaactcgttctggagaagaaacggtcccagcaggtaacagacgtgacattaaaaaagtgaagtttgattgttcacttttgcaggtttcgctacctcaacgctttgggaattggcttctttcaatgctccagggaccagcggcacaccaacttttcttcgaactgatgagctccgagaatttctccgttcgcgccgctccgactgatgtgccaccgatgagtgctctggcgccgtccctttgatcatctgttcttttgctgcccattgatcatatactgctgttctgtccataatccctacctgtaattatatcctgtgctaacaccctcatttatgttccatatttaacttataatccgtctgtattaatttctcgcataacctgtacttgtattgtgtaaataaa

SEQ ID NO: 57204 - DNA, 3152 bp, Heterodera glycines
  Genomic contig location: Contig_ID=SeqID_5186; Location=1673..4824; Strand=+
  SCN-specific regions: Sequence locations=1-849,871-942,964-1882,1904 -2345,2367-2464,2503-2541,2563-3152
  Gene Ontology: Mol. function=DNA-directed RNA polymerase activity; Cellular component=actin filament; Biological process=signal transduction
atgacattgagtttgatgcttggcttgaagatattggtctccttcacgcacgtcgtacgtgtccacgatgtggtggagacacatcgattaaggcaaaagaaggccgccgttatggaaactggcgatgcaaaacaaagaattgccgaaaagaaactggctatttggtcgggacatttttcgaaggttctcttgctattttgtacacagttagtggtgttctagggtcaaaattatcaaccaagcaaacttttgaattgacttatttttaggcgcgtaaatatgaaaccattgattacattcagcaggaaactttgtcgattggtttaacttttgccgtgacgtttgtgccgaattctttgtaagacgacccattgccatcggtggttaaggtcctagccaatttttttctggggatttttttgtgtgtaggaagattagtcgaaatagacaaaactctgatccagcaatacgtacttcctggtaaaacgattgtcagtgacgaatggcgatcgtaccgcggaattccgaatctcccgcagaactatgcccatttgaccgtgaatcattcagaaaactgtgaatcccggaaaccgtcttacacacacgcaaatatcgaatcattatggaagaaattgaaaaggaattttaaacaacagttcgggaacaaaactgaaacatatgatacgtattttcccgaatttatctgacgtcggcgttttggtgatcgtgatactgttttttataatttttggttgcatgtatctgagttttatccgtgccaataactgttgcaaggctcactaacacaattgaaccgattttattgaataaatgtgaatttttaggaaactgtattttcgaatttttgttcaagtccgggttcgaggttcgaaatgggtcgaaacggatgtcagattcgaattctacggcctaaaaaccctaaagacaattttatctctgaaaaaatttttgaaattttttttcaaaaaaggggggcaccatcggcagtattaccgacttggctaatgtgtcaaaaaattgcaacttaattaagcccattctcgtcaccagcagcagcagcagcagagaaaagccaaagcaaagaaaatccgactgatcatttcgttggaaaagaattatatttgagaaatggtcgatcagaaatgctctctcacattttcatttgttgattctttcgttttttttggtgttttacctttcacttcttaggtatttcagccgcagcgttatgccttgaccatttacgcacaagatttaccatttgaaatcgtaagtttgaggggggattggattgtaatgctaattggtcatcattttcagcaaagtgccgtctttctgagcatgaactatcgtggaacgccttctcgtactgcaaaacggagctgaccaacccggactacaggaaggacgactttctgattcggattgaaacaatgcacttgagtgaccgcggcaccaccaaaaacgtgactcatcatcatcactaattgattgttaattatgctacaattttcagttccgtctttcaggcactcggtctttcgaagggagtgctgaacgaacgcaaagtggtgtgcattgacatcgccaacgacaaaataagtgaatgccgagaaaagtgcccgccggtgattttcggcggttgccaatcacgaaattttgacatcatttgtctactaatttaacattactgaatttccctcgaccgctggtacggactgacgctggcgcaaattcgtctgatcgaagaggagacgcagcgggcattggatgagggatgaccgcctctgaacgctgatgatgaaacgcgagtgccgtggcgatgaagctgacctatttgcttgttaatgtatataattcactgcttgtcctttcatccccacgcatttttcgccacttattgtatactaaacacaccccaatttcctcttaatttaattggtttgtgttgtgcttatgtggcagcaaataaatgttcgattttaagatttaagcacagttaaagattgaaaaatgccggactcggagaaggacccgaatttgaaattcaaattgtgacttaaaaactgatgaaagtcacgaaaatgtcagaaaagtgcaaaaatgtcttacataaaatcccaaaagtaaaaaaacaaataaaactgcaaaatagagacttcaacttatgcagatgaacatatgttttatttacacaatacaagtacaggttatgcgagaaattaatacagacggattataagttaaatatggaacataaatgagggtgttagcacaggatataattacaggtagggattatggacagaacagcagtatatgatcaatgggcagcaaaagaacagatgatcaaagggacggcgccagagcactcatcggtggcacatcagtcggagcggcgcgaacggagaaattctcggagctcatcagttcgaagaaaagttggtgtgccgctggtccctggagcattgaaagaagccaattcccaaagcgttgaggtagcgaaacctgcaaaagtgaacaatcaaacttcacttttttaatgtcacgtctgttacctgctgggaccgtttcttctccagaacgagttccgcacacttctgctccaaccgtttcttctccagaacgtgttccgcgcacttctgctcgaaccgtttcttctccagaacgtgttccgcacacttctgctccagacgtttcttctccagaacgtgttccgcacacttctgctccagacgtttcttctccagaacgtgttccgcgcacagctgctccaaccgtttcttctccagaacgtgttccgcacacttctgctccagacgtttcttctccagaacgtgttccgcgcacagctgctccaaccgtttcttctccagaacgtgttccgcgcacttctgctccaaccgtttcttctccagaacgtgttccgcgcacagctgctccaaccgtttcttctccagaacgtgttccgcacacttctgctccagacgtttcttctccagaacgtgttccgcgcacagctgctccaaccgtttcttctccagaacgtgttccgcgcacagctgctccaaccgtttcttctccagaacgtgttccgcgcacttctgctccaaccgtttcttctccagaac

SEQ ID NO: 57205 - DNA, 525 bp, Heterodera glycines
  Genomic contig location: Contig_ID=SeqID_26469; Location=13..537; Strand=+
  SCN-specific regions: Sequence locations=1-22,44-63,85-104,204 -329,393-426,448-525
atggactggatcaatattaacttaaataaaataaaaacaaagtgtaggtagatgagcagtcaactcatatttaaaattaataataccctttctcatcggaaaccttaattaaattaattataatctttatcaaaaattgtatacaaaatttattaaagttttataataaaaccgaaaattgtaattatttttaaatttttttagtttttcaacgtttgaccggtgaccccccgctcggcttcaaaccgagtttaagtcaaaaaagccggcagtgtacatcgaaaagattgaaaaaagccaatgataaaaatgaagaaataccttatcagaattattactttttatttacttaatttttcaattatcataaaatatccaaatttaaaataatagggacatttaagaacaaaaattgttattgcaatgaaaaaagattgatatttgaatttactcaacgaattgaaaatatagtttaaaaatcgaaaaaaataatatattagtacaaaaataagcaaagcaaactaa

SEQ ID NO: 57206 - DNA, 305 bp, Heterodera glycines
  misc_feature (44)..(44): n is a, c, g, or t
  Genomic contig location: Contig_ID=SeqID_26470; Location=61..365; Strand=+
  SCN-specific regions: Sequence locations=1-305
aaaattccctcaaaaataaaaggtaaattgcgcaccgccctccnctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 57207 - DNA, 135 bp, Heterodera glycines
  Genomic contig location: Contig_ID=SeqID_26470; Location=695..829; Strand=-
  SCN-specific regions: Sequence locations=1-135
aggatttttatatttatactctatcccagaaaaatggctatctctttttttgataaattttatacacatacaaatgctctcgagcatgatagggagggcggtgcgcaatagaccttttatttttgagggaatttt

SEQ ID NO: 57208 - DNA, 119 bp, Heterodera glycines
  Genomic contig location: Contig_ID=SeqID_26474; Location=47..165; Strand=+
  SCN-specific regions: Sequence locations=1-64,94-119
tcgctgccgctaatcgcaaattgcgcaacgatgtcgccacggaatgtgccaatgtcgccattcatcgccagcaacagcagcagcagaagaacggaagtgccatcatcatgcaaacttaa

SEQ ID NO: 57209 - DNA, 415 bp, Heterodera glycines
  Genomic contig location: Contig_ID=SeqID_26474; Location=829..1243; Strand=-
  SCN-specific regions: Sequence locations=1-31,53-114,136-312,334 -363,385-415
agaaaggcgacggcgcagctgcggcggacaagaaggaggagaagcgcaaggacaaacacaaatcaaaggaggggaagagcgacgacagcaaccgccgttccaagaaggacaagcacgggaagaaggacaaaaaggacaagaagaaggacgccgccgagccagcagctaacgccggagaacagagcacagcggagacgacccaagcggacgaatagccagcgatgagaacgacgacggtgcacgacgacctctcccccttcacgatcagtcccccctactgcttgctgttgtttgtgtgaagtccgttccccatattttgtacatattccatgtgatcagagcgaccttcctaatgtgatcaaaatatgtatgtatgtataatatccattaatgtgctgcttcatattcgctattt

SEQ ID NO: 57210 - DNA, 118 bp, Heterodera glycines
  Genomic contig location: Contig_ID=SeqID_26477; Location=897..1014; Strand=+
  SCN-specific regions: Sequence locations=1-118
tgtccgtttggggtactcaaacaattatggggagcaaaaatcccacgcagaattaagtacaggctatagggaagctattcccgaaggattcgatctccccataaatctgggcgcatcg

SEQ ID NO: 57211 - DNA, 168 bp, Heterodera glycines
  Genomic contig location: Contig_ID=SeqID_26478; Location=1..168; Strand=-
  SCN-specific regions: Sequence locations=1-168
agcgctaaatttatcagagtgccaaaaatcgcatgagatctaaccctaaaaaaaatggtctaagtaaaaatcgaaattacgctcaaaaagtttctcaaacaattttagcgcttccaattccttctacaatcgcctttatacatccctttatgagcgctaaaattatca

SEQ ID NO: 57212 - DNA, 438 bp, Heterodera glycines
  Genomic contig location: Contig_ID=SeqID_26478; Location=442..879; Strand=-
  SCN-specific regions: Sequence locations=1-438
aaaatggtgtaagtaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgc

SEQ ID NO: 57213 - DNA, 285 bp, Heterodera glycines
  Genomic contig location: Contig_ID=SeqID_5188; Location=362..646; Strand=-
  SCN-specific regions: Sequence locations=1-118,140-285
atggtacgaattaagcaatcttttccttccgaggatcagtgttcttcatcatcattgcatgataatgattcacgaccctcaaatgatcaaacgggttcaaagctcccgttcaaaaaagcggatgaaccggttcaaagctccggagaaaaaaagcggttaaaaacttttgaaaacgaacatttgaataaaaaaagaaaattgcaagacactgaacaagaaaatgttattaatttggatttgattgacttggaagatataaacatggatatgattgaccttaatgaa

SEQ ID NO: 57214 - DNA, 117 bp, Heterodera glycines; identical to SEQ ID NO: 53938
  Genomic contig location: Contig_ID=SeqID_5188; Location=1913..2029; Strand=-
  SCN-specific regions: Sequence locations=1-117

SEQ ID NO: 57215 - DNA, 1447 bp, Heterodera glycines
  Genomic contig location: Contig_ID=SeqID_5189; Location=618..2064; Strand=+
  SCN-specific regions: Sequence locations=1-325,362-411,435-455,483 -553,583-988,1016-1260,1282-1288,1310-1447
atgacgcatttggtgccgaagttaaggtcggaaactgccgaggattttgaacaaattcttctgttcctctgtcaggtgcgcttgaccattacgcagttcaaagattgcgatgacaagaagggaccgagtcgagcaggcctatctatttcagtacttcaaaagagatgccgaagagttggaaatttggattttggaaaagctacatacagcggttagtagccaaaaaataaaaattttagcttaaatctttcgcgaatttgttgcaaaagttcaggtcgaaaactgccgaggattttaatttttgtgttgaaattttcaagaaaatcttatgtaaaaatactttaaaaaactttcatttaaagatttctagtatttgaaaatcagctcgaaaattattttcttatcttggagaattttttattatttaaagttttctcattttaaatgaaagttccataaattttttaatttataaaaataatgttaacattttgcaggccgagaaatttttaaaagttcccctgcaaaaaattgcttccttggcattttgtccacctgctctttcaggcccacagctggacaagtcaggcaatgacatgattcagccaggtatgaaaaaagtttaaataattcaaaaatatgtaaatcaaaaagtcattttgaacagcgacattgctggccaccaacgacttttggcgcgatttgaacactgcactgacgcagcgaaagcataaggggcccgagcgcgatttggccgcattggagtcgaaggtggcacggcaaggggaaatttagcagtaaattattcagacacaaaatgtcctgctttcaaacaatcccttcacaaacaagatcatggctctgctcgataaagctctgccattgagtagttttcgtgtgacaagcacatagcttaattccgaccatagaattgttagtgctgttcgagagacgagaccgagaaaattggattatgaaagagagattgataaaaaatatgaaaaattttcaatatctctctttctgaactggtggttaaatgtaaaagtaagaacagaaccaagaccagttagatgagagctaaaaccacaaaaaagtcagacttttcgcatattttatttataacttttttacatgtcgatttatatttgtgatttttgggatgccaatagagattgtaaagctttcgaatgataccaagtttgttgaatttatgttatgggctaagttcattttttatttaaatataccttagttcgattaaagccacttaaatttaaatgaaaaatctgttaactgaaaatcttatatatttacgttcccctcccccaaggtggacaaactcggcacagagacgaaccaattcgtacaaacggcaccgcttcatgagcgacaaacacgacttggtcgagtgaccatgagcattcaggtgaatgagcacaagaca

SEQ ID NO: 57216 - DNA, 1278 bp, Heterodera glycines
  misc_feature (1201)..(1201): n is a, c, g, or t
  misc_feature (1276)..(1276): n is a, c, g, or t
  Genomic contig location: Contig_ID=SeqID_5189; Location=2694..3971; Strand=+
  SCN-specific regions: Sequence locations=1-14,36-136,160-348,370 -388,411-450,472-767,790-913,937-1161,1190-1278
atgtatagaaattctgacttttttcacttttattcaactatggttcctccccatcctcaaaaatacagtaagtattattgtttgggagatttggctttgtgatataccaaagaaacgaggcaattaaaactaatgttcacatggattaattaaatatttcaatattttcattcttaacagataaagtctgcacccactcattcaatacactgtgccgaaaaagtcaacgattgttggacgaagagattaaaaagtcggtacgaaattttcagtgcattcagatgtggttattagctttgtttttaaaatcttaggatcattccataacactattataatttttgattacctaaattattttttataagcatcattattttaatcgatgaaataatttaaaaatttttaatgttgattcggtgtcgaattttaatttgtaagctttcccataatgtggggtttttaatgtttgaaaaataatttgagtcaatttaatgcgaaatattttcatgcatttctcacttttcgattttgtaagaaaagcgccaacacatcagatgacaaaaaaaaacttttttctaaatttcagtcaacgaaacaatttcccatttctgccacccatttcattttttggatttgcgaaattattccccataggaaagactcagatagttcaaggtcatggattccacccatccactgccatcaagtacataattgttaatgttgcaactgactatttttgctaaaaaactccattcagtttgaaaatctttgtcccagttttacaactgtaatcgtaggtcaatcgcacaatcagtcattgtgttttggcaccccattttcgtcatttttccttccaaattttcactcttcagtttttcatccattgcctataacaatttgttcacataaaaataaacttttcttttaaaacccgccatatttttcagtcatcatttgtcattacaaggcggaaagcgtggcccctctgctcacatttggctctcagtttggcattgtgttggctgttctctccgcctattttctcatttggaaaccctccgccgtttgctcactcgtcaaaaggtagtgagtgaccaactttatttataaattacctttcctatataaaattcaaaaacattttgtttagatatgaaaattttctatttatattaatttaattgcgttagcccanaagatggataatgaatagggattccttttttcgtaagaaaaatcgcgaaataagtacaaaaaagctcgaaatcgnta

SEQ ID NO: 57217 - DNA, 1135 bp, Heterodera glycines
  Genomic contig location: Contig_ID=SeqID_5190; Location=985..2119; Strand=+
  SCN-specific regions: Sequence locations=1-73,95-257,279-299,324 -333,355-380,406-467,489-690,712-735,757-1135
atggggagtattgatgcacctgaacacacctctccgtggactgttcttcttatcttcaccactcaatgtccaaccggagaaaaactacaagaccgctgcacgggctttatcgtctcacatgatctaatcctaaccgcgtcacattgcgcgttcatgagttacaatgaaatcgaattgagatgcagatacgaagcagaaactcataaacaatggtgagttctaactaagattgaaacttctcattatgcatgacaaaaattttaatgaatattttaattgttatgccggccgagggcaaacaataatattcaaatttatttgaagacaaaataagttaagaaatagcaaaaaaggggagggatatcattgtgaggaagcacaaatgaaaaatgaaaatacaaatgacagaatgggtaaaatggtagttctaaactcgctagcagtgactgaagtggagtctgtaaattatctgcaagaaaataaacagaaacacgaatactcggtgttcaattcgattcagttgactttctccgtcgaaaaaatttattcggagacaaaataaataacaaggagcaaaatcggagtgtcgattgggaggaagaaccgataaatgaaattaatacaactgatagaatgggtcaaagggcggactatttatgtggaggataatggagagagagagataacagatgagagacaaatacaaatgaatatgggagcggtcatattagtcccaaacctaacatttttgatatatactagggtcagacgggtccaggtaccagaccgggtccaggcctggataccctgctttttcaagacccgtacccggacccagttttttgaaaatccaatacccggtacccgacccggcaggtccgtttccaaccgggtccaaaaacacactgtaacaatcggggtcagagtcaaaatattagcaaagttgaagggaaaaaaaagtaaaaagaataatttaatttattgtaaaatagcaattaatttctcctgtggcctagtggttattctgtttgattcatttctttctttgctcaggttcaattccttcttatatcagttgggtttaacattttttttttaaatttttgtttaaaactgccattttatcattaagtga

SEQ ID NO: 57218 - DNA, 1142 bp, Heterodera glycines
  Genomic contig location: Contig_ID=SeqID_5191; Location=164..1305; Strand=-
  SCN-specific regions: Sequence locations=1-339,361-614,636-678,743 -773,803-1142
atgaaagcaacaaataaataccttaattaccgcatagtcaaatttaagggcgaggccatccttcaattggtgaggcgaaaattcaattggaataaatatattgttgatgtcttctccttgtagtagttgtgcgttttcgctgggattgttgatgtccaaatatcctatgtaaatggctaactcttctggtgtgtgttgtaacctgaaggatttcattttgcggtaagtcttaggtatttaggtaaaaaccgggtccgggtatttccgggtccagaaaaacagagtccgggtccaagtttttaaactggatccggttactgggtccaaccgggtcctgaaaaatataaaaatcaaattttcctaaattttttcataataaaagcttatattaaaaaagcatgaaaatataatattttacaaataaatgctttaatttttccaattttattgctattcaaaccatttttgcggcgagccttttccgaaaaacttttcacgaacaggggtgggtccggcggtgccgataggtgccgtcgggaaaaattttgaaaatttactttgatttgttaacagattttagtgaataaaatgaccaaactttgtggttttagcacaaaaaatgttcaaattttcaagaaatatagggataaaaatttcaaaatttcttatgggatattgtaaaaattaagaatttttttgtaaattctattaaaacaagatagttattttatttaaaaattttgagctttattcacttaatgataaaatggcagttttaaacaaaaattaaaaaaaaaaaaatgttaaacccaactgatataagaaggaattgaacctgagcaaagaaagaaatgaatcaaacagaataaccactaggccacaggagaaattaattgctattttacaataaattaaattattctttttacttttttttcccttcaactttgccaatattttgactctgaccccgattgttacagtgtgtttttggacccggttggaaacggacctgccgggtcgggtactggattttcaaaaaactgggtccgggtacgggtcttgaaaaagcagggtatccaggcctggacccggtctggtacctggacccgtctgaccctagtatatatcaaaaatgttag

SEQ ID NO: 57219 - DNA, 553 bp, Heterodera glycines
  Genomic contig location: Contig_ID=SeqID_26484; Location=533..1085; Strand=-
  SCN-specific regions: Sequence locations=1-553
atggcactgttcgaatctcgtggaattgtgttgcaacagtgtgtcgacttcgaccggagaaggcgtcgaacatatcaaaggatgtaaggggaacagctgattagattcgggattcggaatgagaaaaaaagccgggattttgcttgggacagccaaattcaatggatctggatccgggattccggagtaaaaaaaggctcggccgacccgggattcaggcggaggaaccctgttctagacaaccctagtagtagtaatgctcgagaccgaaaatttcccgagactcgagaccgaggcccaaaaaaacacgagacccgtgacttgaatgtaagcggaatattcagttaagttgaacaaaaaaacattaaattttttcgaggcatggatgcttccaacgttggtttgtcaatgggccttgacgtcctttcaaggatcaaaaatgataagtttggttgcaccaaaagatcaaattaagtcgatcagaagtttttaaatatttttggatttcaaaataatacagtaaccattgggctatcgaatcaaaaagaataaa

SEQ ID NO: 57220 - DNA, 66 bp, Heterodera glycines
  Genomic contig location: Contig_ID=SeqID_26484; Location=9..74; Strand=+
  SCN-specific regions: Sequence locations=1-66
aatatgtggacaaagtgttgtccaagcagcatcagatgtacgcggatgcgagcgaccacatgctgt

SEQ ID NO: 57221 - DNA, 535 bp, Heterodera glycines
  Genomic contig location: Contig_ID=SeqID_26485; Location=1253..1787; Strand=-
  SCN-specific regions: Sequence locations=1-51,73-151,173-466,488-535
  Gene Ontology: Mol. function=general RNA polymerase II transcription factor activity; Cellular component=transcription factor TFIID complex; Biological process=transcription initiation from Pol II promoter
tccaataatcaaaaattgcgttgctgttgtagacctcaaaataccccttgatattgaaaaaatttatttaatatctccatccacaaaatataatccacgtaaaattcatgctgtaattatgaaagtgtataatccaaatgctaccgccataattttctcaactggaaaattcgtatgtacaggagcagctaatgagaaagaatgtaggcaagctgcggagcaagtcaccgaacgaataaggcaatgtgggtactacgaggcacgaatccacgaatttgcggtgaagaatttgattgtgacagcagacgttggttttcatatacgcttaggacctctgtccgactttctacgcgccaaatattgttccttcactcctgaactattccccggtcttgtctatcggaataaaagccccaaagtctccatcattgttttctcgagtggaaaattgaatataaccggaagtaaatcaaagacagaaatagattctgtatttaacaaattttattcattattatgtaattttaaacattaa

SEQ ID NO: 57222 - DNA, 922 bp, Heterodera glycines
  Genomic contig location: Contig_ID=SeqID_26485; Location=799..1720; Strand=+
  SCN-specific regions: Sequence locations=1-119,146-302,324-502,524 -817,839-922
atggaccgattagacacaataattgcatctctccttaactgctctgcacgtaatttatgtgatcgtcttaatcacccggatgagattcaaaaagttgaaaaatacctcaaaggaaaaactctacaaacaacatacaaaaatcaactaggtgagtgcaaagattttgagtacggtggaattaccaaagaatgtgcccgtaagcagatggcttacaatggtttcaagaatgtgaccgtcgaccagcatttttatgtacggcaccgcatttgtcttcgctattcaagcaatccttgcgtaatcgaaaaacacaagaatggcaatgaacgtttctacccacttgaacttgtgaaagtgaaggacaatgatataatttatttagggcaaaattttcctaaacctttaattcgtgatgataatatgtttattgatgatcaacaatatttgaattggtaacttaatgtttaaaattacataataatgaataaaatttgttaaatacagaatctatttctgtctttgatttacttccggttatattcaattttccactcgagaaaacaatgatggagactttggggcttttattccgatagacaagaccggggaatagttcaggagtgaaggaacaatatttggcgcgtagaaagtcggacagaggtcctaagcgtatatgaaaaccaacgtctgctgtcacaatcaaattcttcaccgcaaattcgtggattcgtgcctcgtagtacccacattgccttattcgttcggtgacttgctccgcagcttgcctacattctttctcattagctgctcctgtacatacgaattttccagttgagaaaattatggcggtagcatttggattatacactttcataattacagcatgaattttacgtggattatattttgtggatggagatattaa

SEQ ID NO: 57223 - DNA, 4109 bp, Heterodera glycines
  Genomic contig location: Contig_ID=SeqID_5192; Location=1..4109; Strand=+
  SCN-specific regions: Sequence locations=1-737,762-795,819-1010,1032 -1231,1297-1341,1378-1396,1450-1709,1731-1967,1989-2318,2341 -2627,2649-2827,2849-3599,3635-4109
  Gene Ontology: Mol. function=metallopeptidase activity; Cellular component=extracellular; Biological process=body morphogenesis (sensu Nematoda)
ttacggttccgtgagaatgttcaggccctgatgcgatcagatatgtgctagagcggggggacaggtctgatcagagaggatgataaggaaattgatcggagaatggaagagaaagaatattagctgatctgagaaataagacatgattggtcacccccaggcactgatcagagtagtagcaagggaattgattaccgcctcggataactccgatagttctccatgtttggctcattctatttgatcagcagcgtatgatcaatgtatgaaatccctgctcattttagctgcttcactgagtacatcggtcgcaatggcggcttccaggacattatcatcggctcggaatgtgccgaggtttcttgttggtgccaatggcaaaatttaatggttggcacttcctctgaccatgtaggaatatgtggtggcacacgaaacggggcacgccctgggctattggcacacgcagtgagttgatcagtgccgtaaaaaaccaaaatgataattgcttgtttggcacaattcagtcaacggcccgaccgggagaagtacattagcatcaattggaggttggcccggtggaaaagtagagaacggaagagagcggacattttgccaatattttatgaaatttttaatccgatttaagttttacaaggctttcttttttgaatttacccgaatcgaaattgcatttatcaatttataagtccactttggtttatcagcagtgcccgttatattttttaaaatatatttttcgaatattttaccgaatgaaaagcacaaaaaaagcttttaccagtttttcttttcaacagagcgagtttttatcacattaaaaaaatacaaattatatttttggatttttgaggtttttagcaaatatttggggtttttggcaaattacacatttagatatttggcatttttagcaaatataaaccgggccctgtttatcagatagtttaatcaaaactgtgttgtattcattaggctttacttgaccaacaatgccaccaccacaaaactaacctgagggcctttttggcattttttggaatgtcaaaatgtttaaaaattcaaatttcggcatttcgttttgtccgctctctgagaaaggggacggggaattctgtgggggcatgtacaacaacagcttatcaattaacacactctgctgaaggaatgtgctggaagaagcgaccgctgtaagtttttaagtttctccattttatgaattataaaaaataataaataaattgttgaaaacattaaaaaatatattcaatttttgatattgaattccaatttgataataaacatatgagattttgatcaaatattaacacaatttccattcagtccttcatgcccttccggtcaatgcttcaagtaaatatttattattttaaaatatttttcttttataaattaaaataattaaatcaattttgaaattgcattttcatttcaattcattttttgattttttgaattgttttatgatgcaaaatcaattcacaaataactgactcggaaatacatattccaattagctaagaccttatagtaaaataaaatgcttttcccgcatttgcaatttccctctcattagtatgattaattgcgtaattagcaacgctccgccccattcccccaattatcgctaattaattgccctcttccctttcccaggcgttcggcatcaaacaggtgggtggtgttggtgagtgacgcaactgattgtgttatgtgtacgtcctgcccatgcttcgcccattttttccatcatccgaaggtgtccactcgtcgagcaccgtcagtgcctaatgttttttccctttctcccgcggaggggtgcatattctaattaggctaattagtttgatcgcccccgaattttttttcagaattttaacacattttttacatttttccattgttcataacttttttgcattgttaaaattatttgatgttttttggaaaaccaagcttgtccagatgaacatttaaatgttaaattggtgtcatgacaactcgtacaattgcttaggttaagcctatgatttaggcttaggtctaagctttaggctatacctaggctcgtttggacctaggcttaggcttaagcttgggctttattttggaaaatacgaattgccttttgtacgaattgtcattgacccgcaaatgcttaaatgctacggattgcctttccgatcggttcacctgctttttgatcagatacgactacggttcgctgatgcactatcacgcggttgcacatgcgcgccaagtgtccgacttcaccattgtgcccaaggagctcaaatatgtgaccacaatgggcaccgaacggatggcatttttggacgccaaagtgatcaacggttgtttgtacaaacgaatgatgtgccctgggcatacggtaaccgtattttcctcccctttcagacatttactgtccaagtcagtctctcccgatgggatcgctacaaatgaaattatgtaatggcacttccccatcccattccccactgatcagatgcctgctccggtttgggcgagttgggaagacccgtaagtgacgtgggggaaaattgggaggaagattagtgggttttacgggaatttttcgagagtcgagactaaggcacaaagaaaatggcgagaatgatctccgatgacgtatgacaatttttggaacatttggttttaaaaaccgaaccaaatttactgagatttttcatacgaatagaacaatccgagagctaacgtatgatatcaagactgttttatttggctgtgtttgtgaaaatttatcatgagtttttcttgaaaaatctgtaaaattgagagtttttttatgaaacactctgacatcgactcataccaagcccaaaaaacattcttgactttggaatccgaagagttgggaacccaagcagtggacagagttggacatgcttatgctctgatattgatctcatttcgtgttgaaaatggggaacccctcaattttcctaattctccacccctccgttcagttgcgctgccaatcaggcggttacccggacccgaacaattgcaatgtgtgccgatgccctgaaggattgggcggcaccgaatgcgaacggcttcagccctcaagtgggtaattagggggacaaaaagccgggggaagggggggagggataaagccaatggaaaaggaggaaaagccgtggccaaaaagggggaagggaaaatggggacaaaaggaagtgcaaggaaactagggaattgtgttatgccatctcagactgtggtgccgaactgcaggcctccgaccaatggcaaacattgcgaagtccgaacggcaaagacattcagtgctattggaggattacggtgagtgggcactttcattttggtccagacattgtttgccaaatattagtgattctcgagatcgaaaatttcccaagactcgagaccggggcttttttcaaaaaatattcttatgcacttaaaaatcgaaacaaagtctagaacacaatccatttgactaaatatgtggtaatgtatgtatataatccatgaaaaaggttaccaaattatgtatttttttaatgaaataattttttaagtttgaaaagccaaattaagggtgtttgtctggtctcgagatcgagactatcgggcttcactaataattatgccaatttcagtccgaagaaggaagccgagtccgtttccgcctaagcgacggcgaagtgagtctcggcaattagtcgacccttgtaaaaatgctttttttagtttccatgctcctacggctgtcaggtaaaatgacgcttttccgaccactccttaattagcacaccgtttgccccacttttccctccttttcagtcctatgtcgagataaagcacaaattggacgttcggctgaccggctttcggaggtcggtttatatattggccaatctttccgacacacatttcgcagttgttgctatcggcccaaggaggacaccgtgtcggatgggaaccaaatttttgtgatttttcggcccaacgggcgcaccgcgcgcttctcattgcgcttcatccgtcaggcg

SEQ ID NO: 57224 - DNA, 1241 bp, Heterodera glycines
  Genomic contig location: Contig_ID=SeqID_5193; Location=449..1689; Strand=-
  SCN-specific regions: Sequence locations=1-126,154-300,323-357,379 -422,585-1216,1238-1241
atgctaaaactattaatttctctattgattctaaatgtccaaagtgattttttatccttataaccaaaattgttagcatttacgaatttgatgttttttgtgtgttagagatgtgaaaatagtacgccaaaaagagagaaaaagtaatgcaaaaattttaatcactccataactttctaattcgacctattttaatattaacttgacctattaaccgatgcagaatttttttctctatcgatatgcagaatttaaagaaaatctataaggcgataaaaaagttctatagagcgaagtgaatgttgttttttacatcataaaatggaagagatactacgccaaagtgagagaaattacaaagaaaaagaaaaacgacgagatagtacaggcttttctctgcacagtggagttgacccatagtggggagaggaagaagagaaacagagagagagagataatgtgataatatgacaccaaaaggggagagagagaaagaagttgatagaacgattaaagaaagaggggggaggatgaaaagagtagagaaaaagagaaacagatataagagtgtgagagagagaaagttgttgacaaatgagataatgtgaaaaaacagagagagagagagagaacgcaactcgcgcgctaatgataatgaacatggaaaaaagaaattgccacattcttttgtcagacggtgaccggctgttcgcgtcgggactgaaacggattgacatttctgagtcggactccgaggtggacgacttcttgccgacctgcaaaaagacccggaggagaagccgccaatctgccacataaattaaagaacgagcttttccaatgcttttggaggatctcatttgtccgatattctttaccctataatttaaatgcgcgcctttcccattgtctctctctcttcgccaaatttagctttatttgtcaacatttcacttcaaactcttcagcattttttgccgtcctcatatttggtttagtgtattcaaatcgttgttttttgttgtgtcgcttttttcacccctttcccagtgcttttttgtcgtttttttcattacattgatattatttggatattgtgcaaattacacacaacagcagacatggatgggtgctttcattaaaaaaaccaaaaatttccagccaattccaccgccgataacctccctcgaggtccggacaatccgtcagctaattttaacaaattattctttttcatttaa

SEQ ID NO: 57225 - DNA, 1012 bp, Heterodera glycines
  misc_feature (12)..(12): n is a, c, g, or t
  Genomic contig location: Contig_ID=SeqID_26491; Location=816..1827; Strand=-
  SCN-specific regions: Sequence locations=1-63,99-976,998-1012
gatctcctcttncggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtaaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaaaggaagtattttcccacggtcaattgtatacggccttctctcgggcaacggacggaaacaatgtccgtgttcatgctcccaaccgggaaattgatgccctaggccgagccaaagtgctgattattgtggccacgcatatgctcaaattacagtaaatgagcaatagtcca

SEQ ID NO: 57226 - DNA, 283 bp, Heterodera glycines
  Genomic contig location: Contig_ID=SeqID_26492; Location=1070..1352; Strand=+
  SCN-specific regions: Sequence locations=1-283
atgtctccgtccatttgtccgtgctcagtgccaacaacaaacttttgcttttctcccgcttttcctcccaaatgccatcgccggcggagggcgaaaatgcgcaaacatttcaatacgtaagaaaaaagcaaacaaacgaaaggcgggcaaaaagaaaacatttgcaggtcaactacggcaatgtgctcatttttcagctgagggcgaaatgcgccgacggatcggtgggccaaaaatgcacggaaatttgtgcaccaccgaaggcggggtcagccaaaagaaa

SEQ ID NO: 57227 - DNA, 1179 bp, Heterodera glycines
  Genomic contig location: Contig_ID=SeqID_26494; Location=306..1484; Strand=-
  SCN-specific regions: Sequence locations=1-192,214-623,647-1179
atggtggccaagactcctctgcaagcgctcctcggcatcttcctccttcgctcgggcgttgcttcttcgctgacggcagcacagacgttggttgaagtgattgtaaaggctcagccaaaattggagctttgcatgtattttggaaagaggggtgatcagatcagttcgggcaaatacccaacggaggaagaccagcgaaaagccctggagaagtgggctgggtcatgttatgtggccagacaggctttggcagccaccggattcaacccgctggaaatggaggagccagaaggagtcaattcccttcctgaatccgaaaagctgaagtggaaagaagtgtttggccaaagcgcttgggccctcgaatgtgtgcgggcgacggttgtgcacaaagcgggccgctttttggcacaccagcgcgttttgctcggagattcatcagctgccgccctttcacaatatatccccaattcattttgcattggacaggaggggtcaatggcagacatcattcgacaatttcagccgaccattttgtcaagtcgagtaaaagcgatgcttataatcacaggccgtgactcgcttgtcgccggagaaactgccgaatccattgccgaacaattcgaaatggtggtggagctgtgccgtcgcttcagtcatgtcaaaatttattggtgcccgcccccgtatgtccacaacaaatccgctgaatatgatcaattgatcgacaaaatgagggccttaataaataatggacccattatttcaatttgcatcacagaaaaaggccgctctgttttggaaattttccgttttggggatcatttcaacaaatatttggtcacggatgacggtaaaatgcgcaatccggggtgcaaaatccttaaagcttggattttttcccaatcgtcattccccggagacattgagctgagtgtgcgcacgctcaagtcagcggtaggagtcccttcgagagatcaggccgatcctcgttcggacacgaccacagctgttccgagagaccgggtcggtcctcgtcgagaccaaaatccgtcgttccgaattctccatggacgccgtggatcggtgcgctatcagccgtaccaaggacatttgcacggacctgcgcgagtccgtgactccgatcgccgaaatgatggccgcccccatcgtcgttga

SEQ ID NO: 57228 - DNA, 245 bp, Heterodera glycines
  Genomic contig location: Contig_ID=SeqID_26498; Location=1177..1421; Strand=+
  SCN-specific regions: Sequence locations=1-245
tgcgcaagaaaatcacggcctccaacgaattggtggtggagcaggacgaaggggtcgcaaaggccaaaccgccgaacgaacaccgctacaaaagagccgccaaagacgaaaatgaaaatgacgcttttggcgaggacgacggggatgaaaatgattacgatggtggtgaagatgagcatggcatttggctaaattggcgcgccaagaaacgggacaaccaaagcaacaaattgggcggtggctaa

SEQ ID NO: 57229 - DNA, 2730 bp, Heterodera glycines
  Genomic contig location: Contig_ID=SeqID_5196; Location=1483..4212; Strand=+
  SCN-specific regions: Sequence locations=1-65,90-300,322-453,475 -1598,1621-2363,2387-2696,2718-2730
  Gene Ontology: Mol. function=motor activity; Cellular component=Z disc; Biological process=leading edge cell differentiation
atggaatctctgaatatggatgcaggcctcagtcttaatagctccggtttggcactcacttcagtgcattcaatttatgttttgtttttaggtcactcgactttcgcattagctgagaaggaaaaccaaattgaacagatgcgacgcaaattgcgtgttttggaaagcgacaacgccgaacttcgcaccactttgcctcgactcaaagacgcgcagggcaaagactgcactggcgaggtttgtgctgctttctcaatcctggaatcagttttgtgaattttattcctcattatcagatgatcaaaatgaataaggaattgctttcggcaaaggaacagtgcgagcgatggcgaaccgattacatggagttgaccaagaagtacgacatgtttgagaagtcgaccatcacgcagcttgaccagaaagacaaacagatgacacagcttcgacaccaagccatggaaatggaagaggaaaacggaaaggtacgaattccgtccattcattttgatgagccctcaaaaggatgcaataattcaaatttagttgcgcgaaaagcttgaaaatgagaagtctcgagtgtggcatttgcagcgcggagagtttgaagaccaattggccacgccaaaggccgttcagaacgaaggggcagacgatcagttgtcaacaccaaaggtattctcattattttttcaaatttgccatttctcttttttttaatttaattctgtttttaggctcacaatcagatgctggccaacattatgtcgaaaataccacaaaatgttgacgttgtcgaagacacttacctgtgcaatgtcgatgatgccgaacagctcgctgcacatctgctgatgatcctcgagactttggacaagaatttccataatgcaaacgaacttcaaaatgacatattcacttttctggcatcgcacagcatttgctccaacaatcctgaaaagtttgccttgctcaactcggtttacaagaaagtggtcagtgttttttttgaaactttcaatcacttaatttaaatttcattttttcaaaatgttttagactgacaatcgtttggcgcaaattcgtgccggaaatgagcagtttcgttccaacatgtcggtgggcgacaaagacttcgatgcctgcatgaaacacttggcggtccatgactccatcaccctttcgtccataccttcgtttgccggcttctccaaggaaattgcatttcaacttgaagtggagttgcacttttagaatcaacgcctctctttcattttttagacatcaaccccggaaatggacaacgaccagaatttgacttctggctcatttttcgccggcaatgtgacttgtcgcacctcaactcttctcgaggtgtgcgttcggatgttcgagaaactgcgcgggaccgtcgagtttttccaaaaccttctcaaaattcttggagtgagcgccgaagagttgggcgaggacattgccaagaagttggaagcaatgaagctggatttggacgtttccgtcggagaggcccagtcgatgctttctgaaggaggaggcctggctgcgattgaggattcatttgcacaatgccgagtcgagagggagcagcaggtgaaaagtcggattcatgggaggacaagaacgggaatcccatgataagcaaatcagctttttgtattcaagataaatgacatgaaggtcgagattgagaccatgcgcaaaagtcaacaggacgtggagcagaagcagttcaaacttgagcaatcgttggcggaggaacgcgatcgaatgctgaaagtgacggcggaacgagacgctttcgcgcgcgaattgcgcgatcgggagacggaagttgagcggttgaacagcgaaatgaaggaattgcagaagcagacggaggagttggaccgaatgaagcaaatgctgcagtcggaggtggagaaaatggtgggtcattgccaaaactcaagccaaaagcatattcataattgcacattttttaaagaccaactcggaactgaaggagaaagtgctggtgcacagtcgggaggagttggccaaaattttcgacacgatgtcagtgtgttaaatgcttactaatataaatggaggcattttaattttgaactttgacatttctttttttatacaatcaccgttaagggaatacaccaagtcaagttgcaactctgtggtttcgtcgctccgcaaaaagaagccaaatattgggaagaagcagccgacgcaggacactcaaaaacagtgagccgacgatagccatttgtgatccattttatagaaagacgtgccgatgcctggcgataatctcctgacacatcatttaatttaatcgttttgctgactttaattctttatatttcttccattgttttccttgcactgtgcctactctgatttgtccctcgcttcaatgctttcatttgactcaaaattattgtgcggtaaatttggtgctgactaacttgcgatgggtttcgtttgatctctctgtttacctcgccttcgtttacccttttctctctctctccgttttctttcaactttctctcctcttcatcccattgatctgatcaatagagcaatgcagaaattgcctcaagcaaacttccgctaataatgccaaaaagcagtcactttcccccacaatccttgacggctgtcaatttggtgtcaattatttgctgcagctgtaattgatgctttaattaa

SEQ ID NO: 57230 - DNA, 429 bp, Heterodera glycines
  Genomic contig location: Contig_ID=SeqID_26499; Location=41..469; Strand=-
  SCN-specific regions: Sequence locations=1-6,28-55,77-146,178-203,246- 248,270-273,296-429
atgaaacttgtccatcctgagcctttgccagtggaacgtaaattgctgatgaaaacgttgaactgcgccaatttgtgtgtgtttccatttgtacgggttgaaccaccgacaaaatcggcggaggaaattttgtgtgtttcaatttcatttattaattcaaaaaaaaatttaattttagaaatagcactaattatattttccactttaaaatgtaaatttaatttaatgtgtttaaatttaaatttcagtctctcaagcagcagcagcagattccatcaacaacatcagcagcaacgttatacctttcgagcccgcgaaatttgcgaggcattgcttcaggacgatgatgacgaagaacaattcggagggccatcatcggtgatggaaagaaattccaaatttggccaaacccaaaatgggtggccaaat

SEQ ID NO: 57231 - DNA, 1041 bp, Heterodera glycines
  Genomic contig location: Contig_ID=SeqID_26501; Location=116..1156; Strand=-
  SCN-specific regions: Sequence locations=1-281,308-946,968-974,1031 -1041
  Gene Ontology: Mol. function=transcription co-activator activity; Cellular component=transcription factor complex; Biological process =neurogenesis
atggagaggactactgttatattcctgctggtacggtacttttgtcctacaatttacagtcaacgacggcaacaacgactacgaaactgtcctcctcgtcaacatggataacaacggatgttgaggaaactggcactgatgactcatcatcctcatccaactcatcatcatcctcctcacaatcagttgtggttgtgatgccaccggcatcggatcagttgcaatcgtcgccagtgattgtgccgtttctgccgccgatcggcgctctgatcaccattgatcaacaacaacaacaacaacaacaacagttccatccgatcaacaattatgagacgtactgtagcgtgccgggccgtctcacactgttgtccaaccagaagaagtaccgggtgtcagttggggaaatccaacgccggctggcaccaccggagtgcatgaacgcgtccattttgggcggcattttgcgcaaggcgaagaacaaggacggcggacgattgctgcgtgaacagctccatgttcgtgttttggggaattttggcatgtgccgtatttaaattgtcgaaaacccaattttgaaaattttaatcccttttttcctggaatttcggtgaaatttcgagaactggcttaggaaagttcacattttctcaggttttgttcagaaattgagggcatttttttcgctgactgttacacaaatgtttgaaactgatctgagctgatcagatattttataattttggtaattgtgatcataactgagaaattagagttctcggccaagtgatcataggtgtatggtaattaatttaatagatgtacggtgttgagctggcgttaggacgacgaaaacagagcccattgagctgcttctcgagtatggtggagcaggaagcagtgcaggcaagttgatcaaatattcacatttaatcggacttttttatgtacctgaatgggtattaaatttaaaaaagcaaatttgggggccaaaattccccatttttgttttaaaaacattgccaaaatttaattaataataaa

SEQ ID NO: 57232 - DNA, 1019 bp, Heterodera glycines
  Genomic contig location: Contig_ID=SeqID_26502; Location=153..1171; Strand=+
  SCN-specific regions: Sequence locations=1-399,421-441,473-863,885 -974,998-1019
atgtcaaccgatacgttgaaagtacaattgaacggatgggaatgggtcagaacatttcgggttagttattcttttgcttgccttttaatccattgtttatttcaagctgaatttggaaactgcactgccaaggcgtcctcagaagtcattcgatccatcgctcacatcgaaaatgaaattggcaatttcaacacggcgattgatgagactttgaacacctttaggaaggaggctgagaaggtccaatgccctcagcaaagtttgtcaatatcaaactgattctaacaattgcaggctcaggctaagctccacgcttttgttagctcttgcaataagcgtcttcacagccaacgcggacagatcgaccaattctcagaagcgactttgggccgggttcaaaaaatgaacaatatcatgggagatcaggttggtggtattaactttttgatttaaaatatattttaagaaagagtcgacttcgtctatgcgagtgcatctgaatgccactttgaacgatgctcaatcaatggttgatcggtttgctcacagtgactacaaacgtgttatcgccacgggtaaaaaaatggagtgattattaaaaaagaacatccatccaattataggagttacgcctgtccgtcgcagaaacagttttagcgaggaattggtcgaacttccgccggcccaagaacttatccagtcgcagcagcagttgtgtactccacgtcgcaccagcttttatcggacccgcgactccattttggactcttccgactttctcacctctcttttatcaccaaacacgcttaaagagaacatgaacagcaccaagatggacgaagccggcaaattggagactatcggtgaaagcattgaacggactgcgagttcgaccctcagctgtagcagcagaaccgagaagagagggaaatgatggaaggacaaaagaatgacggcgaaatacaatactattgattttatgtttttctgtataacagtgattagcgtaaattggcgca

SEQ ID NO: 57233 - DNA, 546 bp, Heterodera glycines
  Genomic contig location: Contig_ID=SeqID_26503; Location=624..1169; Strand=-
  SCN-specific regions: Sequence locations=1-240,268-510,532-546
  Gene Ontology: Mol. function=protein binding; Cellular component =cytosol; Biological process=regulation of protein catabolism
atggccaccgcgttcaccgacggcgccaattttgggggcatttccgccgaggaaccgttgctgatcagcgaagtggtgcaaaaggcgttcattgaggtgcgttgatcgctcatgatttgaattcaatttgagatatcgaattttttaaaaaaaaaattcgagaatttggtcccattttttaacatatgaataatttttttgtagttacttatcccatctttggaaaatagttaagcgtaattatcaaaaagaaaaacaacaacgaaatttaggtgaatgaggagggcactgtcgccgcagcagccacagcaaagaatgtgagatattgttcgagcagtccgggcaaagaataccgttttgtcgctgaccatccgttctgtgtgtttctgacccgtgatgacactgtgcttttcagtgcgattttccgcaaatgattccatcccattgatatttaatgcgtttaatttgatgattgattggctgctgttttttatgtaaaaatatttatttgtgtgtgaaatacctcaaatttgtgccaaaaataaa

SEQ ID NO: 57234 - DNA, 621 bp, Heterodera glycines
  Genomic contig location: Contig_ID=SeqID_26504; Location=454..1074; Strand=+
  SCN-specific regions: Sequence locations=1-569,591-621
atgacataagggtagaggctgaccacgtcaatgcacaaaatctcctccccttcggcacacacgtggtggagcttgaacggctccgtacgaccacccctcaacgcgtcgctgcgtgggtcaagcggacggggcacaaacacatgctcataccgccccctcagcgccgggtccctacgcagccgctccttccactcacaggcccacaccgtgtgcagctcacagccgtgttggtgctccagctcccacaaacgccgcaccgtccgctcgtacagatcctccgccgtccgaccggcggccaaccgttgttgccggttggggaagcactcaacacatcctagcaataaatttggatacaaaaaaaatgggggctcccaagtgcgcgaccgtgatagtaacagcccatccactcgatggccatcgggcgaaggggcggctcccgacgccaaaggccgtccacccgatacccgctgtcctcaatgtgcgcctctccgacggaccagctcgcacactgcacctgcgcgcccggatgctctagctcaaagaagcgaatgtagcgcctcgactcggcggaagcacgacgtccacgcaggtagccgccctccggggagtggaccaaccggt

SEQ ID NO: 57235 - DNA, 597 bp, Heterodera glycines
  Genomic contig location: Contig_ID=SeqID_26505; Location=1280..1876; Strand=+
  SCN-specific regions: Sequence locations=1-597
atgcccattcccggcgtactgtcacagcaaattcgaggccgaggagagcattcgaaaggctgcgaaagtgttggggagagaaggtccgtacagagaagtcacaccacaaggggcatcccgtttcgaatttgccctgtttcgaattcgaacattttgatacataattaaatgagtttcaaatgccgtttcaaaaaaactttaccaatatataattggtatcgaaaaacgggggagaatggaaccggatatagccgacatcgcaagaatgtggcatcgattttccggtcatttagcgataaaattacggtttcataaaaaattacaaaaaattttggttattgaattctggatggataaaaaaagacattcaaattggcgacttcctattaggcaaaatcagccatataaactgaatttcatgttttcgcgatattgggtttttccgtcaattccttttttcttttggtaaatccccctttttttctttgtagccatttacagtgtcatcgctcgtgtcggtccgttgtatggggagggtgaccgccgttcgttggtctgtgatgccattttgcttacccatcggttcggcgctgtgcc

SEQ ID NO: 57236 - DNA, 60 bp, Heterodera glycines
  Genomic contig location: Contig_ID=SeqID_26506; Location=365..424; Strand=+
  SCN-specific regions: Sequence locations=1-18,40-60
atgaaggacagcaaagtgattgtggccatcaacaaggacaaggacgcgcccattttccag

SEQ ID NO: 57237 - DNA, 964 bp, Heterodera glycines
  Genomic contig location: Contig_ID=SeqID_26507; Location=55..1018; Strand=-
  SCN-specific regions: Sequence locations=1-121,279-336,514-527,710-797
  Gene Ontology: Mol. function=cytoskeletal protein binding; Cellular component=cell-cell adherens junction; Biological process =embryogenesis and morphogenesis
agaaagtggaaaagaaagagcaagaggaaccgattgtggaagagaaagtggaagagaaagaggaagagaacagaaagtggaactgaaagtggaagaggaacagaaagtggaactgaaagtggaagagaaagtggaagaagaacaaaaagtggaagagaaagagaaagtggaagaagaacagaaagtggaagagaaagtggaagagaaagagaaagtggaaaaagagaaagtggaagagaaagaggaagagaacagaaagtggaagagaaagaggaagagaacagaaagtggaagagaaagagaatgtggaaaagaaagcaagaggaaccgaaagtggaagaggaacagaaagtggaagaagaacagaaagtggaagagaaagagaaagtggaaaagaaagaggaagaggaaccgaaagtggaaccgaaagtggaagaaaaagtggaaaagaaagaggaagagaacagaaagtggaagagaaagtgaaagaggaaccgaaagtggaagagaaagtggaagagaaagtggaagaagaacagaaagaggaagagaaagtggaagagaaagagaaagaggaaccgaaagtagaagagaaagtggaagcgaaagaggaagagaacagaaagtggaactgaaagtggaagagaaagtggaagaagaacagaaagtggaagagaaagtggaagagaaagagaaagtggaagaagaacagaaagtggaagagaaagtggaagaggaacagaaagtggaaccgaaagtggaagagaaagagcaagaggaaccgaaagtggaaccgaaagtggaagagaaacagaaagtggaagaagaacagaaactggaagagaaagtggaagagaacagaaaaagtgaaaaaagaaaaagtggaaaagaaagaggaagagaacagaaagtgggagagaaagagaaagaggaaccgaaagaagaagagaaagtggaagagaaa

SEQ ID NO: 57238 - DNA, 562 bp, Heterodera glycines
  Genomic contig location: Contig_ID=SeqID_26508; Location=1434..1995; Strand=+
  SCN-specific regions: Sequence locations=1-217,239-247,291-387,409 -417,448-562
atgtcaatttatcttcagctgtgcggtctggtcgcccttctgctgacagtccaatgctggccaaatccgcttttccccttctgtttgggccgtgtcgtcgacttctttcagttgttcaacgccgtctgtgtccacggcttcttcctggtcggcactttcttcttggcattggcacatttgttcagtgccccggacgcattttaccattacaatttccaacttttggtagttttttattgaatgttcaatttatctatttattattcatttattaatttctgtatctaattgggcttaggaacaattttactgcgctttggcctccgttatgtatttgatgggctcagtgttcgctgttttgaacatgctcaaggcaatattcgcccctctgtggttttttcatttggtaactttttgaattattatttttttatatttttattttaagtttgtaacttttgccggttttggcctctacgcattcgacttttggacacgttggaaacgggacagtcagttgaggaaggagcaccagcagaaccaatccgtctatatcacttga

SEQ ID NO: 57239 - DNA, 1427 bp, Heterodera glycines
  Genomic contig location: Contig_ID=SeqID_5198; Location=265..1691; Strand=-
  SCN-specific regions: Sequence locations=1-300,322-454,482-522,545 -904,926-1050,1073-1126,1148-1248,1271-1278,1301-1320,1343-1427
atgatggaaattcccgaccggctgaccaatccgaagaaaacgccgaaacggacacaccactgccgccgcccgacgtatttgacacaccaggagagcacatgcacgcggctaaaatgcgtgccgtgcaagccaaaccaaaaaggacgcgcaatgattcgggaccggatcgcgtcaatgccgcttttcaaaaacgacaaaatttatcttgcaatattggacaacgcacaattcacttattgtaagaaaataacggagcaggtacatttgtcaagtttgtgatgtaatgaaaaataagagaaaagcaagaactgaactaaaggttgctaaatctatgatctttcatcaatgagtgctttcgattggtgtaattaggggacggttaaaggatttcggctgggatagggacaccgcccttgggaaacgagacctttttttgctgttcacatcgtttgcggtgcatttttcaaaaatattattttttccttaaagatttcaattgtggaatgatccatattggtttcctttctaattataagcccaaaacacctaatgatacaatttgcaagatcagaatggaaatggatgggaaggcatccgatgattcgggacttgcggcagttcgtcgccgaggcacaccaccacctggtaaagcatcagaggttaaaactacacctctatacgttgttaaatcgtatcaaatcccatgaattagaaaatccaaaattaattttgagacccctttttaggcaaaaattcatcccttcgaggatgcaaacggcaggaactgccgcttgctcgtcaacttcttgttggcgcgcaaaccatcgaattgcctgaagcattcagggatgcgtatttttaagttttgacggcacagattttctacatcgaccgcccaaattgtttctttgttgaatatttgattggcttttcttatttgcgcatatatagtaattttttctcacctcagtccattcaaaatttaccacacatttgatctggtagaatacgagtgtaaatgagcactttagacgggtttgcaattcttcaggagcctttgcttaacaaattttttctcatccttttcaaaaaaatcaggtcctaaattttgaaagttgatacactgatacaatgccaacatctaaaaaccatttgttagcgccacgtttcgatgccaatgcaacagttgttaacggctacctatcattttgtcactgatcgtttcgtcactgatcatttcgtgactgagaaataatttttaaaaaatgttggcaaaatttcacatatattttaaaatttcaattattctgccccaaatgggagtcgggggcgtttgggccccagtttttgggccccaagcacagaaaaatgaaaaaacacacagtaaaaacaacttttaaaatttcagcataaaaatgtaaaataaa

SEQ ID NO: 57240 - DNA, 197 bp, Heterodera glycines
  Genomic contig location: Contig_ID=SeqID_5198; Location=2251..2447; Strand=+
  SCN-specific regions: Sequence locations=1-42,79-197
tttttgggccccggggtcgcttgggccccaacccaaaaatcgaaaaatgtgcttttttaaaaattaagattctaaaaactaagcctgagggatccctcgtcacttgtcataagttaggttcaattaacattcgctcatgttttacaattctacttattccaaatcctattattttttaatagttaaccaatttgatg

SEQ ID NO: 57241 - DNA, 829 bp, Heterodera glycines
  Genomic contig location: Contig_ID=SeqID_5199; Location=613..1441; Strand=+
  SCN-specific regions: Sequence locations=1-557,609-657,688-753,776 -799,822-829
atggcggtagcggcacttgatacggagttcggaaatttggcggttttccaaccgctgattgactggtgtgtgaactttttttaaatttaaaccccactgaaattacaggctattaatcaattacgttggacagcccaggcccaatggcacatggtctcaaccaacttttcgccctgaacaatggaacgtctacacacgcacgcttaatgccgatgcacggaccaacaaccactccgaggcggagcatcatcgtctacagggcgccttcaattgccgacacccgtcgatttttcacttcattgacgtgctacgtcgtgagcagaagacaacagacgtcaaatacgcgtcattcattgccggagaggagccaccaccaaaaaagcgaaagtttttggcgacagatgaacgaattcttaatttggtgcgcctttacgtcccgatgaatgcaggcaacatcaaccatgatcacaattaccacaatcgcaatcaatttcacattattttggagtttctccggggaatttctcgcaactatcgaatgaacccgtgaatttctgttaatttttacattttttattgttaaaattattgttgaatttatttttaaactgtttattttacatttttatgctgaaatttaaaaagttgtttttactgtgatttttcatttttctgtacttggggcccaaacgaccctggggcccaaaaacgagggcccaaaaacgggggcccaaacgcgggggcccaaaaactggggcccaaacgcccccgactcgaaagtaccgtataacagattttatctattttttattaaaaatctctagagcaa

SEQ ID NO: 57242 - DNA, 1288 bp, Heterodera glycines
  Genomic contig location: Contig_ID=SeqID_5199; Location=2138..3425; Strand=+
  SCN-specific regions: Sequence locations=1-253,276-280,302-693,715 -1103,1125-1288
  Gene Ontology: Mol. function=peroxidase activity; Cellular component =peroxisomal matrix; Biological process=determination of adult life span
tctcccgttgactttgcttcacaacaaatgaatgagtacaaaagcacaaaaaaggtgccgtttctcattttgttttccgctcttaagcctttcctttcctccgttagaaaatggaagtgctaacgatgtccaacggctcacccattccattcacaataaaaatgccgttttgtccgttggtccccatggtccgatgctaatgcaagacgtcggtgtgttccgtccttttattaatacgttttttaattgtccctattaaattgagtttcattgtttgcatgggattttgggaaatttattttcgaatgattaattagcttcaaaaaaagataaactcaaattgccatcggttcagaatgcattcaattaggccttttgaaaggagggatgttttatttctataattagtaagggaaatgaccgaaagggcaaggcaaaatgaaaagcgaatcctttgccaaagtttccatgagcgggatttgtttccaaagtttatttggacgaaattgcgcacttcgatcgcgagcgcattccggaacgcgttccggaacgcgttgttcatgccaaaggcgccagagcacacggctacttcgaggtgacaagcaaagacatggccgagcactgcaaggccgccatgttcagcgagatctgaaaacggacgccgcttttcatccgtttttcgcgtgtcggtcggtgctttcgttctccttttttaattggtttgacaattatttcaggtggagataaaggtttgttgtgcatgttgtttgtgaattccaccaattcactgctggaaagtcgttttcttttttaaaagacatttttttgtttttggcataatgtaaaatggtggcattcgagtggggggggggtcttacaaagcaaaggcaaatgctgaccgaactctcgaacataaaaggtggagaatcggggagcgcggacaccgcgcgcgacccacgcggttttgccatcaaattttacacggaggagggcaattgggaatttggttgcaaacaacacaccggcaagtcaaattccgtaccaagcaaatgacacccaaaacaatgccttggtattttgtagattttcttcatccgcgacccttttctctttccaaatttcattcattcgcaaaagcggaaccccgccacccatctcaaagacccggaaatggtcagttggaataaccagtggagcaagtggcagagaagggcataatggggatgggttatatgttatggcaagaacccccaaaggaaggactacgacggagtgggcatgagggggg

SEQ ID NO: 57243 - DNA, 86 bp, Heterodera glycines
  Genomic contig location: Contig_ID=SeqID_5199; Location=1097..1182; Strand=-
  SCN-specific regions: Sequence locations=1-86
atgtaaaaattaacagaaattcacgggttcattcgatagttgcgagaaattccccggagaaactccaaaataatgtgaaattgatt

SEQ ID NO: 57244 - DNA, 50 bp, Heterodera glycines
  Genomic contig location: Contig_ID=SeqID_5200; Location=1365..1414; Strand=-
  SCN-specific regions: Sequence locations=1-50
cccatcttttcgaagagcctggcacaatggaagaagttgtacgccttgca

SEQ ID NO: 57245 - DNA, 1046 bp, Heterodera glycines
  misc_feature (27)..(27): n is a, c, g, or t
  Genomic contig location: Contig_ID=SeqID_5200; Location=1..1046; Strand=+
  SCN-specific regions: Sequence locations=1-216,238-1046
  Gene Ontology: Mol. function=peroxidase activity; Cellular component =cytoplasm; Biological process=determination of adult life span
cgaacgatggaatgccttccattcggnaaacaattctccgggcttcctatttagcttatgactctcgaagaagcgtcccatttccgttggaatccgttcgatgtgaccaaagtttggccccaccgtctcttccctttgcttcccggttcgttcgttctccgtttctttcttcattcttcttcgctgtttgtttcagttggtcgaattgtgctcaaccgaaaccctcaaaattattttgccgaagttgaacagtcggcgtttgccccttcgcgaattgcattgacttttcgtccgataaaatgttgttaggtgtgccgtccgttgcgttgcctttgcattaattgccttttcttgcgccgcagggcgtctcttctcctaccccgacactcagttccatcggctgggcccaaatttcatgaaacttcccattaactgcccgttcagaagccgagtgagcaacacacaaatagatggtttggcatgcccagacgacaacggaggtggcacttttcaatttaagtcatttttgctctttttttccgatggtgcccccgtttatcacccaaattcctacggaaggccgaaggaattggccactgctaatgaaagtgcgttttctgtctccggcgatgtcgcccgattcaattcgggggacgaggacaattattcacagcccaaaatgttctgggagaaagtgagaggggtgaggaagaggggaccaattctcgagatggcttaaggttctcgacgaagatcatcgcaaacggcttgttgccaatatcagtgcctcgttgaaatcgacttctcggccggtccaagaacgcgcggtagcgaattcggcaaagtcagtgccgactttggcagtgccctacaggcggagttggagaaagggtgtcagtcaaggctgacagcacaattaatgaggaacaatgagagagtgatgaggagacgaattgtgaattaaaaataattaattggcataaatgacatcatgcaatcaaaccacccgaaccaattaaataaaattaattgcctatgcaaattac

SEQ ID NO: 57246 - DNA, 1757 bp, Heterodera glycines
  misc_feature (1690)..(1690): n is a, c, g, or t
  Genomic contig location: Contig_ID=SeqID_26509; Location=1..1757; Strand=-
  SCN-specific regions: Sequence locations=1-38,62-95,272-275,359 -400,493-1173,1200-1243,1275-1504,1592-1617,1639-1757
ccaacaaaaaagcatcctcaatcaactcgttgaacacctcctttcgtcctcatcatcatcaacaagcagttcaaaggtgaagaaggaaagcatggaaaaataaattaaattaaattaattttaaatgtatttttaataattaaatattttatttttaataattaaatatttaaaaaatgaatatgcataattttgttttacttaaaaatgaataaaatgttattgaaaaatattattcaatcatttttgaatcattttaaataaaatttttcgtttaaaaattaatttaaaaattaaaaatggaataaaataaaaaataaataaaattgaaagaataaaagaaaaataattttaaaaaaagcacggaaaactaatttttaacctaaaaactatcgttttcaattaaattttaataattttacaaaatctcgcacagtttaaagtatttaaaaagaatttaattattcatttttcaataattattaattatttcttcccccccccccccttcagcaggtcccacttttgccatcgatgcgccttctgttggcactgtgcctttgccttgtgtacattaccgtctccgtcagctcgtcaaacattgccgtaaggcaaattttgcccaattaacaatacgcaacgctaattagcgtgacggcgaattgccggctaattaattaattagcagcaaatgtgaacgctaattaggttgcgcgatcactagatggagaaaacaatcaattaacggcggcggcgataaacttagcgtgaccaaagctcattagcacaataattagcgtagcataataaacaaagggagggggggacagagtgattaattagcaaataaatgataattagggcaaaaaattgatgcgatctaatagggctaagtagcggagtgagaaatgccctcatgcccgtgacaggtggcagtgatttgcatgatcaaatgcgaaaggcggcacggctaccacggcacgttggaatgggagacggacaaagaggcaagcagagggacggatagagctggcatattacatatagccgactaattagtgcggcaattagtgccatgaaaccaattagagcgctaattagttttacggtctttggaaaatacgtcaaaacattttggcatcatttggaaaagctctgaatgtgccgtatcagttaaagaaattttaaatttttaattacgaaaattgtggccaaagaaatggcctaaaaatggagtttggcttattgctgtttttaaaattaattttttgcaattatgagaggctatttattaggacatttcagaagagaattttgagtggtgccggagatgttcggtaattttggcactcgtattaaaccgggaaatccgagaattcttttgaggggagggggagaatttcgataattcaaatagaatttttaattgcacattttcagggccttcttcttgcagcacaaaacattggctcacttttcatgttggcgacaggtaaacaaattcaaaaaaaacaaaaaaaaaatttttttttcaaaaattttcgtccaatttaattaaaaaagtattaaatattttatctaaattaaaattccaatacccaaatataaaaattcaaattttaaaacaggcttttttgccgaccgaatcaatggcaaatggatggtcgcggttggcttggcgttgtgtttnggcggcaatttgacactgccatttgtggcatcccaaatcgtttggtacgcatttggcgcccgaattg

SEQ ID NO: 57247 - DNA, 1839 bp, Heterodera glycines
  Genomic contig location: Contig_ID=SeqID_26510; Location=1..1839; Strand=-
  SCN-specific regions: Sequence locations=1-38,60-307,329-572,594 -1017,1040-1107,1134-1839
attttcggcagaattggcaactttgtgacaagattttgtcaaaaatataagaaaatttgggctccggcggtgccgttaggcattttcggggaaaacttagggccaaattacctttttttctgaaaaaactaaaattttcattccccctccatggtacgggcctagccataattgtggtttgcattaaaatatgtgaaaacccgtcactttttttatataaaaaaagcattggtccttttgtctcacaacagagaaatgcagccgcttttcgagggtttttaaccgcaatttcattttccgaaattgaaattccattttttcaattcagagagtcaaaatatggacaataaataaacaattgtctgctttttcttcacagaggtatcttgaccacagcatggacaacattcgccgctgcagggaataccgcaaattccaagccatgcaatacgaccaaaggtcgaaaaatttgtgcaaattttttaaagatgactgaccaaaaattactgttttcccgttccaaaaaacaagagttttacatttttaagttttttcttcttaatgaggcatattggaaattaaaaattgaacatcggcacaagctcgtaaaaaaacctttcagcaaatttctccttatgaaaaaaatatttaaatgaattcaagatttttaattgttctttaattggatcaatcacgccgatctctcgactaattttacaatttttctttccgttttttaggtttttgccagatcgactgattttcctgggcgccgacctcgccgcagcccatttcatagtgcacaggcaaaatttggcacaagatttcaaaagaaaaacatgcctttttgtcgcctttttaggcatggttccgtcaaatttgtcggcgacgaccactggtacaagcgcgagggacgggcgggcacttactatttgccgggcaccaaaacggagggcttttacgtggaggcaattgacgcttccggcaccgaactgatgttcgaaggtgggcagaccgaagaaaaaaggggggaaatagaattgatggaattctttaacaaaatacaacttttctcgcttattatgagcaggacgtttccccaccttcgaaaatttgttttttaaattttaaaacggatatttttcagatataggaaattataccaagtttttctagcttttttttaaattctgtgatgttcctgaaaaattttccaaaaatttttttcttggaaattcttatataatttaagtttgtaaataaaaaaaaatgtggggaaaacgacggggcagaggagggaatgaaatgcaccccatttctgagcttggctttaactaataattttattttttacgcgattgtttttgtttttttttctatggcacttatccccttccaaaaaaacatttttacttccctcacacgaaggcttcgacaatttgtacgacttggaattccttcggatgctcagcctgagggactgtcgatggatcgacgattgggtgctgagccgaattggcggaatgttcgccaacactttggaaatgttggacctgagcaactgtcacagaatatcggccaaaggtcagttcgagaataggattttgatccgggaacccggtccgaatgcagcagcaacagttgctgtctgggattgttcaaaacccgggccctcgtgtgtgggtacacccccaaaacgtcgccggcttcgcggggacgtaacgtcgccgcaaaaaaaattaaataaaacttttttcaaaattgccataaaaatttaaaaaaaacctaggtgttactgagaaagtaaaatttgctgcatttcctgagaaaacaaaattt

SEQ ID NO: 57248 - DNA, 1068 bp, Heterodera glycines
  Genomic contig location: Contig_ID=SeqID_26515; Location=776..1843; Strand=-
  SCN-specific regions: Sequence locations=1-77,136-189,214-634,656-1068
atgggtttaaatagtgagcaaggaggaaaagcaaaagcaaaaaggggtaagtaggtaaaagatgtaaggatacgtagaaaattaaagtatttttgtaattaattatttaattgtaatatgatttaaaattataatgttttaggtttattggaagattagggaattatattgaattaggttgaaatagtgaagaaaagggaaagaaaaagtttaaagggatggtaggaaacaaaagtttatggtgaaattggtttaaatagtcgcagagagcgaggaagcaaaagggaaagagcgcgttagtcgtttgaagaaagatttcaaaatttccaaatgaatggaaaaaatgcacttttgctggaaatgacctgctatttatactccaccgagtaggcggggctatttttcagcttggctaaatttggcactttgccaaaagaggcagctgtctcaagcacagaatatctgatgtcgggttttgcatagtcacaactgtcacaattaatcattgactcacaactgaaagtcaaccggcaatagggatattattgacacttccgtgggtattatacaatcaaaatgcgtccaaggggttattaatgaccattccattggttttggctcggtcagaaatgcacaaaaaagaattcccaaggggataattaatgaccactagcttctgttggacagacatgttcacaaaagaatggttaatggcgctcagttggctttggcacaacatactccacatctcgtaaggagatatttataacactttcggaggcattagttagaaatgcactcaaaggaaagattaatgaccctccgtaggcttagcgttggtcaaaatgcacttaaaaggaatgttaatgactctctgtagactttgactactcaataggctttaggtctcagaactgaaatatcccgtgggcactgggagtgaaatggctaaacttaaaaaataactctggggctcaaatggcggcactgtaaaaataactctggggctcaaatggctgcgctgtaaaaataactctggggctcaaatggctgcgctgtaaaaataaa

SEQ ID NO: 57249 - DNA, 423 bp, Heterodera glycines
  Genomic contig location: Contig_ID=SeqID_26516; Location=653..1075; Strand=-
  SCN-specific regions: Sequence locations=1-423
taaaaatcgtattacgctcaaaaagcttctcaaacattttggcgcttccaattccttctacaatcgcctttatacatcccattatagcgctaaaattatcagagtgccgaaaatcgcatgtgatctaagcctagaaaaaaatggtttaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 57250 - DNA, 819 bp, Heterodera glycines
  Genomic contig location: Contig_ID=SeqID_26517; Location=12..830; Strand=-
  SCN-specific regions: Sequence locations=1-87,109-257,305-327,349 -558,580-592,615-639,661-763,785-798
atgcgtctgcttgaccattatgcccaattttttggcttggactctccgcccattgacccgtcaaaaacgctccaacgattggccgcagatatttttgtgtggtacaatcggatggaatcaaaaccgagaagcatcggaggagcaaatgggcaacaatttgcggattttttgtacttttattgccgaatttttaacgattctctgtccaccgaaattgcaagagaagcgagttttatgttcagcagttttgttgacggtaatttaaatttattaatagtaaatattttttaaaaatattttttttcattagaaacatttaaattcgttgaaaaaatggagaaaaagaaattggacgacccaaactttgaaattgcattggcagaaatgattcattccgtccgagaaaagggcaaattgggatggattgaaagcggggacaaattcaatgaaccgatcgaagcgatcaaagcgatgcattttgctgaactgaacaagtttttgacaaataaaaaaaagcaaaaaaatttatatggaaaatttgctgcgattttagcaggttaaatcaaaatgattaattagacacatacgtattataaaaaagtaatttgaatgctaaaagttctgctttatttagacgtggccaaaaacaaaggcaaccaacaaaatttattgcaaattttgacaatgaatgacgcaaaaacattcttagaaatggcgaatattaattttgctaaagacccaaattttgacatgagtttaattgaagtgaaaaaagaagaaaaagcggcgggaggtcggcgtaaaaaagagaaaaataaa

SEQ ID NO: 57251 - DNA, 588 bp, Heterodera glycines
  Genomic contig location: Contig_ID=SeqID_597; Location=120..707; Strand=-
  SCN-specific regions: Sequence locations=1-7,32-98,131-544,582-588
atggacaaccacaacaacaacagtaacaatggcggtggcagcaataacggtggacgaaaaccgcccccatcccggaccggtcggaagcggctgcacgagaacagcagcggcggcggcggcagcaacagcgccaacatttttgtgggcggcgacacttcttcaaccgtgcgcgccgtatcaagccgttctcggcaaccgcagcaacacaacaattacaacgacttggagctgctgttgatcggcggcactgaagacggaaacagtacggcaccgcaaccgcagcatgctcagacggttcagcgaccaactggcacggagaatggacgacaaatgctggtgagttcaaattgggggggggggggactcgttaaaataaaagtcattttggcactctgttaaatatatttttggcattttctgaaatttttggcaaaaaaatttgaataattttcggaaaacaaaattaattttgtcttttaaatcattgggtttaaggcggtcaattcggcgtctcatggcacgcccgtggatggagctttgccaaatgtggacggcggcggcagtggtggtgtcttggctcagcgtaat

SEQ ID NO: 57252 - DNA, 1194 bp, Heterodera glycines
  Genomic contig location: Contig_ID=SeqID_598; Location=169..1362; Strand=+
  SCN-specific regions: Sequence locations=1-757,779-850,872-1194
atggtttccgcccactacagcacactcacaaccgcaccgccatttgaatcgacgagcactttgagcaccgcagtcccatcagtaacttcgtcatggtacagcacaataactcgaactgaaacgatgacaaccacgaagacaaatccatggacaacaacaacatgggcaccaatgacgaccaccaagcaaagatggactccaacaatgtcaaacagcgcatcaacttggacgacaagacgaacccgaatccaatacgtcacgaaagcaagaagccaacaaacggatgcaacgacacctcccaacacaattaaatcggcaaaatcagcgaaaagagacttgggaacgaatcgtgacggcgcggacgttttctggtgttccgacagaggcagcacgatctgggagctcaagggccccgagaattcaccattctgtcgtcctccaccatcactcaccgcggaatggcacaatctcgcaattgaactctacgccaaaagcatcaggccagagcagattgattccgcgtggcattgctccgtcaaacgaactacggagaattattataccaatttgttgggcgacaagtttgtgaccatcgtaaaagaattcccaccggtcaacaagcgcatctgcaagcaaatggcactgcaccaggaatgcccatacgccaagtccgaaatgatcaaccacgagggacagctgtggtcaactaatgacgaactgaacgtcaatttcccaggacccatttccggactcttcaagggtgaacagacaagcacagctacgaactgttttgtgcaaccagcaaccatattcgtcaaacggcagactctacaaatgctttcgccagtccaccaagtccaaaactgtcaatactctgcggaattctgtcagttgccagacaacacgactctgatatggaaatcaacgtgctctggagatgaatgcaaaatgtgcgactacgatcgagcggaaatcatcagcggaaaatttaccgcagcttatggagaaacagtagccacgtggatatccgacgatcaccagaaggccttgacattcgccaaaaaggctcccgaactcatcgcctgcgacggcgtacgcatcgtcctatctgaacagaactttgggattgccaaagatcaatacgacgacataacttcatccgttgatcttccacgcatggcaactcgacaatga

SEQ ID NO: 57253 - DNA, 1243 bp, Heterodera glycines
  Genomic contig location: Contig_ID=SeqID_598; Location=3431..4673; Strand=+
  SCN-specific regions: Sequence locations=1-448,471-1133,1156-1243
atgtctgggccaatacaaaaagggatcatcaatgcactcaaaactctggacaatgccaaaagcgccacctcactccttcaacaccccgacccggacctgtcaaactgggaaaatgccatcaacttggaggctcaatttgatcgcgtcgtcaaggaaatccgtacaacggaaatgcagatggacagtctacgagacttatccaacgcttggattgaacttctcgcccgcctgaccggagacgacaaagacaacgacgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagggaagcaaaggcggatcaattggccaatccgcagcaacaaccgcccatgccaccagcaatggcagcaccaatgacaatgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactccgcaatctactgggcggagaagcgcgagaactcatagcgggcttccgactggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgaaggtcctcaagtgttcacttccactgctgctgctgctgctgcccaaatttgacaccggcggatctctgctgtcgcgcatcggcggcgctccgctgacgtgctgttgatggtcggagcgattggtgctgctgctgtcgtgatcagactgatcggtgaacgagggccggcctcgcccaatttgacgccaggcattacactataaatgcaaaaagccatttttgcgcatgtccctattttccaattttgtgaaagcccttccaatataatggcaccatttctctcccccaaagctctagcgcttctcattttctacaagcccccccccccccggccttaatcacatcaaaacacacacacacacacacaaagaaaaatga

SEQ ID NO: 57254 - DNA, 3286 bp, Heterodera glycines
  Genomic contig location: Contig_ID=SeqID_598; Location=5201..8486; Strand=-
  SCN-specific regions: Sequence locations=1-49,105-154,187-597,635 -650,677-785,809-942,964-1388,1427-1962,2059-2519,2576-2595,2641 -2795,2817-2842,2864-3286
cagttcacttcaacccgatttgttcatcaacagcaaaaagtgcgtcgaccaacaatatggacaaccacaacaacaacagtaacaatggcggtggcagcaataacggtggacgaaaaccgcccccatcccggaccggtcggaagcggctgcacgagaacagcagcggcggcggcggcagcaacagcgccaacatttttgtgggcggcgacacctcttcaaccgtgcgcgccgtatcaagccgttctcggcaaccgcagcaacacaacaattacaacgacttagagctgctgttgatcggcggcactgaagacggaaacagtacggcaccgcaaccgcagcatgctcagacggttcagcgaccaactggcacggagaatggacgacaaatgctggtgagttcaaattggggggggggactcgttaaaataaaagtcattttggcactctgttaaatatatttttggcattttctgaaatttttggcaaaaaaatttgaataattttcggaaaacaaaattaattttgtcttttaaatcattgggtttaaggcggtcaattcggcgtctcatggcacgcccgtggatggagctttgccaaatgtggacggcggcggcagtggtggtgtcttggctcagcgtaatgtaagccgggagtgggggcgggtgtgtgtgagggataataatgggatctctctagccaaaaaaacttggtaaacgggtgaccatattttttaaccgataaatgaagcaccaaatgtcccccttcttatttgagtgcaaaaaaatggtgtttacattttttaatcctttaaggtgcgtaatttgaacaataatggcggcagcggtggtgttgctgatgcaaccggtgctttgcatgccgtcgctctgcccgcacaacagccattggcattgaccgtaagtttgctgggagttggaggaggaaatttattttatgctttttcatgtttttttcaaaacacaggtctcaaattcgttggacaacggcggcggcattgtgcagcaaccgaatggtgctgtttcgggcgcaaatgtgcccatgtggagtttgaacaatgtacgttttttggggaggggggaatgtcaaagggtagcagggcttttactagcatttcgggtggcccttgatttttgccattgtaaaacggcacaaattcgaacaatatatcttatttaatggtttttatttttttattttttgcagtctgctgctacttttgccgctctgatgacggccggcgggggtgacggttcatgtgcagcccgtcccggtggtgggatgccttcgatggtgcgcggtactgttggaggcggacttgaggtggcgtttttttaaaatttttgtgccaatgttgagggaagggaggtggcaataaaaatttaaaatttcaaaattaatttcttttaaaggcgctcccgcccagtgtgcgtgaagcggttgcacttgtgcatgcacggcagcggcagaagatggttaacaacaacattcagcccgaatttgcgtctgttgtgccggcaattggtgagaatggtttctcaaacctgtggtggatttacttggagtggcaaccagatatggtgatgaagtgagtgcttttttaaatttcattttcagcatttccattttcccgcttttcagccgcgtcgtgggccttgtcgtcctggccggcccgttcacaacccaaaccgacatcagcggctacgacgtgcgcatcatcttcgaccaccacgatttggagcacgaaatggcgatgcacggctggcaggagtgtgtgccgcgcatgagcaacatttgtgccggtcaaattgtggaattcacacgcctcaaagtgcgcgcccaaggtcacaatgcgaagggcagctttccgttcaccctgctctacaatgcggagtcgcggcaccgcattgttggacagagctcttcggcggtggccactacaggtggaaaaaaaacattttaatttttaaaaataataattttttccctattttttttttttttgagaaaaacatttttgattttaaaaaataataattttttcccattttaagtgttcaatccgccgtcaacaaacacgccaataattgttgaagcaaatgacagcaacagcaatgccatttccattccaagcggtgtcatcagcggctcgataagccagcagggcggaaacggcttgtttggcggtggcggcagcaatgtgatggcggcacctcatcaaactgatcagcagtccggcatgagtgcaaatggtatgtgaagcgattccccaccccgcaaaaatgatcatctgatcattccccacccccgcttttagcaggaagcgaacagcaccgcctgatcatgcaaagcgatgacgattatgacggcgaggagcagcaggacgaacaaatccgcgggagtggcggcagcgacgggggaccggcagcgaattttgcattgacatctgcgggcactgttgcgccgcgaaccgagaccggcgtttcgtcaacggtgaggaagtgaagaaaaagaaagaaaagaaagacaaaaacagaaagaaaaagcaaagaaagaaaaaacgcgctcgcataccatcatcatacacatacacatatacacacacaaataaatgcacacatacatttgttcattgaatttgaaaatacaatgttgtttgttcttttgttgtgtcgttgtttttgtgttgttacatagtgggggggatttgagtgtctgcgggcgtgttttttgcggaaagtcatgcatttttcggtacaaaaatttaaaaaaatgattccaaattttttagccatggctttccgcaacgcgcccgcccactcctggtccatcgtcatcatcaacaaatgcccacgcgcgccacaacatgcagcagcagcctcgctcttcgccgcctcccgtccgtgtttgttcaatcaccgcacaacgctccatttcggcaattgttcgccaaatgaatacaaacgctgcggcggttgctcgggacgagagccgttcgcgcgaccgtcgccgtcttcgtcaactcaatgcccagccgcgccagggtcgccgactctcgacgccccgctcttcacgcgggcgcaacacgttgtcaccgcgcccgccccacaacgtcatcaccattgagtcggatgccgaagaagaggcgctgggcgtggcgcaacaacagccgcttgcggacgaagaccagcatttctacgacgacgagatgctgttgattgaagaccaaattgcgcaagggctcgtcgaggggcagccaacgaagtggtga

SEQ ID NO: 57255 - DNA, 5398 bp, Heterodera glycines
  Genomic contig location: Contig_ID=SeqID_599; Location=63..5460; Strand=+
  SCN-specific regions: Sequence locations=1-1002,1024-1378,1412 -2311,2333-2487,2509-2649,2671-3643,3665-3859,3881-4243,4265 -4371,4393-5398
atggccacgattttcaacccgtcgaggccatgccatagcatgatggcaaccatcttcattgatccgggaagccaccggtcattcatttcaaacacggcagccaaacaacttgaactgaccgtgctcagaacggaagaatgcttccttacgagctttggagaacgcgaaccaaagcgttacgtcagcgaccgagtcgcaatcggctttttatgtcccaacggggaccgactcattttcaacttgaacgcactcaagtttctgctcaacaatttgcctgtcctacaactgaacacattggacaagcagcagcttcaacagaagaagctttttccgccgcatgagtcacgacaaccggacgtcatgctcggaatggacgtctggcatgacttgcacgttcagccaattgaacaattgccgagtggatttacgatttgtcagtcgaaaattggcaaaatcatcagcggcactggacgaattgaactcagtcaaccgtcaaatgtgacattcgtccttacggtcacagacgaaaatgtcttcacagcggaagaagacttgaaggccaacgaagaactcaacaagttctacggcctcaacatcattggcatggacgactcttcaacgctaatcgaccgggatgaagtgatgaaaaatttcaaggaaaacttgtcgttcgtcaacaacaaataccaaatcgcattgccatggaacgacagagtggcacaattgccaacgaattatcatcaagcaaaggcaaggctcataagcctcatcagaaagcttcggacaataaacttggtcgacgaataccaagcaattctggatgaacaacagcagaattccatcatcgaactggtcaattctgatcattcttgtggtccagtccactacctgccacacagggcagtcatccgaaccgacaaatccacaaccaaaatccgcatcgtgatggatgcctctgcaaaacccaaatccactccgtcggcaccatcactcaacgaatgcctgcacacaggcccgctacttttgaaagacctgaccggcattctccttcggttcagacgcatggaaaaagtcatccttgctgacattgaaaaggcattcctacaattgggcgtcagagaacaagaccgcgatgccacacgattcctttggcttgctaacccaaaggaagcaaatctcgaacagctgaaacgagaagacttccgcgttttccgattttgccgagtcagtttcggattaaccgtgtcaccatttctgctcaatgccacaatcagggagcacctggcacttcacgacacggatgttgcacaacgcatcagtgacaatctttatgtggacaacatcatggtggaaatcaaaccaagtgaaaacagcaatcaactggtcacagaagcaaaaatcatttttgaatcagccggaatgcggatccgcgaatttttcgggagtcacatcgacgagctaaaagagcttgactcatccgaattggcccaagacctcgaaaacacaaaggtgttaggcatcgaatggaagccaagacacgatcaactgatcttcaaaatgccaatcttcagcagtccaaccacaaaacggaagattctgtcacacatcgcaaaagtgtatgacccacttggacttatttctccagcactgttgcccgccaagcattttttgcaaatcgtccaaaatttgaatttcaaatgggacgatcctctgccggaaaaaatggcacttgactggatcaaactaatgcatgcgtgggacggattcggcttcaacttcagggtggaattccctcgtcacatcgcgacaagtcccaacgaagaatttcattgcttctgcgatgccagcaaaacgggactcggtgtcgcgctttatcagctcgcggacagttcttacggaaaaaaggaaagcaacttgatttttggcaaaagccttgtcaaaccgctcaaagtggccgaccacgattcaacaattcctaaattggaactgcaagcgttaactttgggagtcaaagtgacaaagttcgtccaaactcaactcaacttcgatgaccaacaagtcatactttggacggacagccaatgctctatcgaacgtctcaaggaggaacggaaatacgacagattcgtcaacaatcggctgaagaaaatcagagaagcacgtttcaaagtcagacacattcgaacggatgaaaatccggcagacatcgcttcacgtggaacagatccacagagtctccaatcatcattgctttggcgatttggcccagtgtggctaaccaaagttagccaatggccagaatcaaacgtcacttacaaccccggcgaagaaataaaggaagtgacggaacctcccattgtcgaatggagtaatgccgtccaacagcgcgaagaattcgttcctgcgatccaatttgagcgcttctcaaattggaatcgtctcagagcaacagctgctcacgtcatccgattcacagtggccatgcttcaaaagagacaaaattccgagccgacgagcagtccgcttctcacacatggacacccattggaaaaagggccattaacagcaaaggaattggaaatggccgacgaatggattctgatcgaaactcaacggcaaaattggccctcagaatccgtcatcactaatttgaaactcttcaagacaaagcctctggaaacattgaagtgccaaggacggctaggaaatgccaacctgcccatccatagcaaaaatccgatatttttgccggctgaggcatggacaaccaaactcatcattgtccacaacgatcggattcacaatcattgtggaccgaggattcttctatccaaaattcgcgagaaattttggattccacgaggcagacaaacggtccaaaatgccctttactcaagtcgaattggatgtttggaatgcaaaagggaaaaactgaaaccatacgcttatcccgaggctcctaatttgccaaaggagcgagtcaacgagacacgaccctttaacaacaccggcattgactactttggtccactaaaagtgaagagaggactcgaaacggtgaaagtgtatgtcgcactttttacctgcctcaccatccgagcaatccacctggaagtggcagaagactattccgccgaagcctttctccgcgtgttccggagatttgccgcacgacgcggcgtaccaagagtcatcttgtccgaccaagggacaaatttcatcgctggagccaaggtcatcaaggaaaattggaccacagacttactcacactcgaagtgcaagaacagctggctcatcaaggaatcacatggaatttcaacacagcccatgcaccatggaaaggcggcacttgggaacgactgatcggcattactaaaaatgccttgaggagaagcattggacgcagacttctcactttcgatgaattcggcacgctcgtcgttgaaatcgaagcaattgtgaaccatcgtccgttgacttttgagtcagaccgcgaaccagacccggtactcagaccggtcaattttttgatcccgtacggatcaacggaaaccaattttccgtcaatggcaacggatccggaagatccagaatatacgccgaatcccaacaagctgaaaacgatgcttcagaaggctgattcaagactgaacagcttttgggaaatttggagatccgactatctcctttcactgcgtgaacgtgcaaaccaacggttaaacaacgaacgacaaactcctaacgaaggagacattgtgcttgtggaagaagaagcaaatccgcgatcagtctggagcttggcccgggtccttaaagtccaaataggacgggataacaaatcccgttctgcattaatttcccacaagggaaaagaaaaatggagagctgtaaatcagctctacaatttggaaattcaacccgaatttccagaaatccactccaccgctttcgtcatgagcaacttggacaacgacatcgacagcgtctctctcgccggcagtgaagatgaaatgccgcagccgaaaaataaattccgcattccgaaacgcaaacgggcatttcttcggccaatcccgcagcagcacagtcctcttcaaggaccgcgtcgcaaaagaagggagttacaagactccggattacgcaagctgttttgcgcaatatcagagccagaaggcgggagcaaggcaactactgaagctgtcaacgaaagccgcgccatggaaaaagcgccgcaaccgatccaaaaagaattcaacgaaaaaatggcgaagaaacagagagagaaggcacggataaaaacatcggatcgattaaagcaaaaactcgccgatttgtcaagtgtatctgcacaaacggaagcggaaaaagatgaacaacagaaggagagagaaatccacgatcagcagcgagctgaaaggcgaaatgaagtaaaagaagcattcgaaaaaccatcgcgcaaagaaagagaagaagcacgctcattttggagtgcgaagaaggccgaatcaatgaaagaaaaaacaaaaggccgaccaatcgaggacatgccaaaaaacaacgaagttttactcacgtactgtcaacggatttacggcaatgataattggcagtttctctggaaaaatggacgcacttccagggagcttcatcagctcgaaacgcaaggatggacacttcatgaccagaaaggaaaaatggtcgaaccatccgaattcctcggtggtactcgaccatccgtgaacgtccgattcaaagaaggccactacaccaatctgacaccggaagaaatggtcttccatggcccaccggttagtgagagcgaacctgaaccggaaatcgtagtcacggaggaagtatcgtcctcagagcttcaagaagaaaacgagcgacgagtccgagagagcgggacacactcccccaccgagcaccgcacgttccgagaaccggaagagttgcgcgattgaatgttaccgaacgagagctggccgaaaggagaacgatacgtcggttgataacgattttaaccgagatgttctggtgaacgacacgagagctgtgccggagtgcacgtatcggcgaaattgcttcgactcgcgaaaagagcgattgagatggattcgaagattgcgagagcaatttctctgatgaacgcgaatgcttttcgacttggtccagcgacttttaaatcttcgcggcgaaacggtcgtcctccacgaagaatacgtaatgccgtccaccttgacaccgaagcagttggctgagaaattttggaaagaacaattcgtcaccaaaaatcggcaactcgttaagcaagaatcgctcattgatctgctgaagcaatggagcacttcgtgtgatcactttggagcattaatgcagctgaaccaatttgagcca

SEQ ID NO: 57256 - DNA, 327 bp, Heterodera glycines
  Genomic contig location: Contig_ID=SeqID_599; Location=5942..6268; Strand=+
  SCN-specific regions: Sequence locations=1-327
atgatcttggcgcgagaagaagacgaaatcatggaagttgatccgacaccttcaacatcagccgcaagcagcagtggacttatgtccagaaacacaataaacacgctgatggtcatcagcatgttcgcgctgatgttccttcagccaacagcagcggcaccgttacgcattcatcgagcctcattaagccaaaatgcacaaagattcctccaaatggtatctgcacactacagcatactcacaactgcaccgccgtctgaattaacaatcactttgagcaccgcactcccaccagtaacttcgtgtggtacagcacaagcacaataa

SEQ ID NO: 57257 - DNA, 1227 bp, Heterodera glycines
  Genomic contig location: Contig_ID=SeqID_5201; Location=971..2197; Strand=-
  SCN-specific regions: Sequence locations=1-40,62-235,258-1026,1058 -1132,1165-1227
atggccacacaacagcacaatgttcaattgtatttgaactattcatttaatttctttataagctcagacaggacagtttcaacaacaacgaaacggtgtaacgattcgtctaaatttgaatcgattgtttcgttccgccgccaacggcgaccctcaaacaattattgttcaacagcacacaattccttcttttatgcgacgtattgttgcagaagttggttgcactttcacgactttttcttcactctttccatttttaggctattgactcatgcattctcttccttttcaagttgatcatcgtttatttgcttgttgagttcgaattaatgttagtccaaaagaagggatctcttaacattttttccaattccagcgaattggatcaatttgaacgaattctttcaagtgaatcggatgttcagactcttatcgatatcacacaggaattgttttacattgaattggtgtgcaaactcttttctgcgttgattgaggttactatttatttgttattttgttaaaaattttaacaaggtttatttttaggccatttttataacctttggtctctccgggtttcctattggctgtacccctggaaaatatttgttggggcttcgtgtgatttcatgtcttgatgttcaaccaatagttggctcttcggatcgtgtgatggtcacctgcatgccgagtgttggtttcagaaggtgggcttttgtttggtctgttcctacaaaaatccctccactttttctttggctccgattctcattttgtttaacctgccgttcgtgtccaaagactcaccaaaattttaaacaattggatcgcaaaacgtttttttctgttgtttaattttttttttagctcactaactcgcgctgtgatcaaaaacatgctgaccacttttttgttccctctcagtaccgccttttatctgttcaatcataatcgtgctatttatgatttggctgcaaaaacaatggttatttctctggtctaaaagatcttttttgtgcgttgaattattttttatttataaacttatttattactctctacaaattattttatcacttatattttcatttacggattggacacatactttttttggttctttacgttttatttataaatgcatatatatatatatatataaatttcggttagaatggaagagcagcctaaaaaattagaagccagaaaggactctccaataaa

SEQ ID NO: 57258 - DNA, 271 bp, Heterodera glycines
  Genomic contig location: Contig_ID=SeqID_5202; Location=562..832; Strand=+
  SCN-specific regions: Sequence locations=1-125,150-271
attttctaagaaaaaataggagttttgggggcgcggcggtgccgataggcgccgccggcgaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaacgccaaaaaatgcaaaggcgaaatgcgaaaagcgaaacctcggcccatccctgct

SEQ ID NO: 57259 - DNA, 121 bp, Heterodera glycines
  Genomic contig location: Contig_ID=SeqID_26520; Location=1071..1191; Strand=-
  SCN-specific regions: Sequence locations=1-121
atggctaaaccgaacaataaacacaaactaatcagcaatgatttgatcgcttttggaaataagaaacatttaatgggcggttttatcagatcaaatcagcggagggattcttccgccggtg

SEQ ID NO: 57260 - DNA, 1287 bp, Heterodera glycines
  misc_feature (45)..(45): n is a, c, g, or t
  Genomic contig location: Contig_ID=SeqID_26522; Location=322..1608; Strand=-
  SCN-specific regions: Sequence locations=1-379,402-592,615-818,841 -1287
atgcatttatttatccatatttttttgtcaattcacatctgtttntcaaccttttcttatgcatttgaatcactcaattctttgggcacaatcggaaatttgtcgcacaaccaaaaaacggtaaaaattggagaatgaaattagagaccaaaactcattttagcgaaaatcttgttgggattttgcgtaaatccgctccgtatttttcttagctttccgggattttccacgggcgagtaagaatacacgtttaagaattgcatttttttggcaaaaatgaattttcttgaaaacttaataaactccaatccaaaaattttaatattgttttcggcggcgttaacgatttttaagcgactttttggcaactttttttcaaaagattttgatgttttgcaaaatttgcatttattaattatgaccaaaaaatttaaacaaatgaaatgaatggatcggagatttaaaagaaggcaatcccaatattttaagctggttgagctaccaaaaagtcgggaccgtcggcccagaacgaggaaaaataaattttaaaaaaaccaatttttcgccaccctaaaaaaataaaaaaattaagcaataatcaattttgggtattcccaatacatttgataaaattcagaccatatttggcaataaagtgctggctaaacgatcgacgagtggaatttcaattgttagcggaagcggagggaaaaagccgccacataaaggatcattaatcaaaccatcaaaagcatcgccaaaaaagaaaaaagcaaagtcatcgatgttttctaaaattgctaatgcttttaaaattgttaaagacaagaaaaaggacggaggaagttcaagcaaatcgaccaagtcaaaaaagtgagacatgaaaaagcgttgccgaatgatttgataaataatttgacaaaagtcaaatcatttgttgataattctgtcaatttttgggactgataaatgaattgtttgttgatatttgattataaaattattaattaggctgaaagccatagcttttttcattgtttatcaaatccaatcaactcagcacctttcgaaagctcaacaacttttttgctgaaaaaaagcataaagattttgcaaaaaatgcagttttcaatcaaagcatacaattttgattttcttttaaaattgactaaattttctttcggtgaccgatcatttcttcactaattgtttcgtcactgatcatttcttcactgaaaaaatcttaaaaacaaaaattattcctttattttaatactagcaaataaa

SEQ ID NO: 57261 - DNA, 458 bp, Heterodera glycines
  Genomic contig location: Contig_ID=SeqID_26523; Location=313..770; Strand=-
  SCN-specific regions: Sequence locations=1-113,135-458
  Gene Ontology: Mol. function=microtubule binding
atgcgcaaattgcacgcggcgttagacgaagcacgcgacttgctggagttagagcaattagcagaccgattgtgcacatttgtgcgggccaaagaagggatggtcggtgcggaagatttgggaaaagatttggagcattgccaatcactgtcagtgattgggggagcacaaacggacaacagatgaccacccaccccttcaaatccaggctggaccggctggacgaaagccaaggaatcgacgagggcactctggcggaggcgaatcgcctcgggggacgattgatcgggcgaaagtcggccgaatcggactatgtgcgcaaaaggctggcggaagtgaacgaaggctggcaacggctggcgggccgactgagcatctaccgaacacttctcaacgcggcactcgcaggtcagcggagtgaccgtgccaacggaagtgacggacgcggcactatttaa

SEQ ID NO: 57262 - DNA, 289 bp, Heterodera glycines
  Genomic contig location: Contig_ID=SeqID_26524; Location=633..921; Strand=-
  SCN-specific regions: Sequence locations=1-289
atgccattcgataacgcattgcactgccatagacaggaaatatgggcaaagaatggccaagggatagaaataacggagtgtgggataattgaaggtaaaagagggacaaaacgacgaaaacggcggaaatattcgttggatcaaaattcgtttgaagcaaatgttgccgattagcattggctaaatgttgcactgggaaaagccaaaaagaaatagattcttcaatgttccagtcggcatcagtctgttaagttaagcgatttaaaagttaataaggcattttaataaa

SEQ ID NO: 57263 - DNA, 160 bp, Heterodera glycines
  Genomic contig location: Contig_ID=SeqID_26525; Location=300..459; Strand=+
  SCN-specific regions: Sequence locations=1-160
ggaggaacgggcgcatttccgataccctcagacaattgatgacgccaaaaggcttggccgtgtgcttatccgttacaaagaccaacatttttacaccgttctttcgggcgtcgccgccatttatttgatgtctgttttcattaatgacaatatggtactt

SEQ ID NO: 57264 - DNA, 1092 bp, Heterodera glycines
  Genomic contig location: Contig_ID=SeqID_26526; Location=330..1421; Strand=+
  SCN-specific regions: Sequence locations=1-338,380-649,679-733,771 -858,964-977
atgccattggacggagcaatcggacagcatttgaacagttacgggtaccgaagcgatggctcattaggctgcaatggtatcagtcggccgtataaaatgggatttggcaccatgccaatgccattcaacgcggcgattggacaacagagggaccgccgctacgttgggagtgccaattggtcatttccattggaatttgtgcccgtgccaatgccatcggacggcgcattggcattccaatcgccagcattttccaccggagatgtggtcggatgcggcgtttgtttggccactcgacagatctttttgacgaagaatggccgacgaatcggtgggccaaacacaaaacgaaaaaagcaaataatttaaatttcaatttgtcagatgactcctcttttttcactacaactcccatcaattctctgtttccatgcgtttctctgtggactggcgacaaaattgaggcgaactttgggccaagtttcaaattcaatttggccactctttgaagaaagctgaagaaccaacggaaagggcgattaatcatttagttaattaattcattatgcatttttcactttattttttcacatttattttcagttttttatattatttatcatgcgtatttgttaacaaataaattttactgttctttttgtttgtcttcattttttcatgtaaaaatttgatggaaaaaatggaacaggaagaaactcttgaacctgaagagattaaaaacttaaagaaatttttaaaatattaaattactcaaaaaatctctttttttctttcccctcatttatgtcccattgtgttacaatttaaaacgtttttctcaaaccctttgcccaactgtaaaaattaattaaaactaaaaatacatatttctatcatatgaaaatattaaataaaaaaagtctgtaaaatataaaataattataaaatttttattataaaaatgaaaaaagaagaaaaaagcttacaacaccttcgattcccaggacgtctccgttccaagtactaagaaggcccaacgttgcttaacttgccagatcggacgggatggcgtgctttcaacgtggtatggtc

SEQ ID NO: 57265 - DNA, 1017 bp, Heterodera glycines
  Genomic contig location: Contig_ID=SeqID_26529; Location=565..1581; Strand=+
  SCN-specific regions: Sequence locations=1-83,119-1017
atggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagactatgtctatcctaacttccaacaactccttggcaatgacaaggagctgctcaatcgtttgattctcgctccgcacattgacacgtgcgacgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaacagacggaaacaatgtccgtgttcatgctcccaaccgggaaatagatgcccaaggccgagccaaagtgctgaatattgtagctactaatatgctcaagttacaataa

SEQ ID NO: 57266 - DNA, 858 bp, Heterodera glycines
  Genomic contig location: Contig_ID=SeqID_5204; Location=297..1154; Strand=-
  SCN-specific regions: Sequence locations=1-80,213-476,498-634,671 -685,709-736,760-833,855-858
atggtggaaaatatagagcaatgggagggacatctcctaaaagagaagcaatcaaaaaatgcaaatggtgaaaaatggcaaaaaagaggagaggagaagaaggcggacgaagaagaagaggaggagggaagacaaaaaggaggagtgagaggaatagaagagaaaggaaagggaaaggaagaagagggagaggaagaaaaagggaaagaagacgagggaaaggcaaaggcggaatattcaagcgaaaaagcggatcaaacggcttcttcaatcaaaataagtgacctgcaacacgacataaaaaacattttcaatagatttgaaaatgagcaacaaaattattgggtaattattgaaagttggattctcatccccgattattcgtgggtcaaaaaaccgggggtttcgagtcgtattgggcgtttgacaaattcaacgtttggtaaattcaaataccaacgaccaacaaaaaatccttatatatatgtagtagggttcgatattttgcaaaaaagcctacagctggacctaagtcgggatttttatgtgggacctggattttctggacaaaacccaggaaatccaggttcaggaaaaacccaatgtcaaggaccggatccgtgcctggatctggattttttaactttatttaaaaaataaataaataaatcgagcttcatatctattaatcttttgttttattttgactaatattacgagtgtattctttcaatttactaaaaaactaaacatttaaagcacgtcgaatgccctgagaaaacaattgaaatcgatcttctgcgagaagaggacagaaaaatattaggaggtaaaaaatcaaatgaaagagataactag

SEQ ID NO: 57267 - DNA, 2020 bp, Heterodera glycines
  Genomic contig location: Contig_ID=SeqID_5205; Location=15..2034; Strand=-
  SCN-specific regions: Sequence locations=1-645,668-1360,1390 -1693,1730-2020
atgaacaccactggcctaatgcgcattaagcgactgatggcgcatagaagcggcaccgaacggcacaaaaaagagttgttgcgctttatgactgttcaaatgctcatggaaatgcgaatgttgccggacaacttgcaaagccaaatcagcgagagaaaaggccaggcggcggatgaagcgggtttatccgctcgtctccaatcgccgcgtggctttaagttgctgatcgctaaagcgaatacagccgcagcagacgctttgcgcaactttggttcgccattccaactttgtgtgttgataaaaattgccaacttcgcttatgcacctaagcacaataattctattgatgcgataacggaaaaaatggtgaaaaaattgcgaacagacgaatgtgaaaacggaatagtgcaggcgcaaatattgaaaaaggagatggccgcagaactaggcgcaaagatcactgtgataatcgccgaaatagccagtgccgacttaactaagttcagacggctttttagctttcccggcacaaaaacccggcttctgcggttggttggttcgagggaacgaattgaagaattagacaacaaaattggtttgacacaaaaatttgcggaaaatggtggggataatttgtttttgaaataagttaacaatttatttagagcccaaaaatgacgaactcctttggactcattatttatttgtcatgctaactaataacaaaattgaactgcaaagccacaaaattggcgccgacttggtggtatttatgcactttcttggccaaacatttaatgccggaaggcacatgagaaaactttttcggctgatcagcgattatatttccgaccaaatttatgatccaatttttgatagcgacgaagatgaactaaacgaaattgaaaaatttttgagggagaaaatgtttttggagacaaagaaaatggtggaaaaaattagcaaagatgacaatgtaaaggcatcaatccaattcaaaaaatgggaagtaattgtgaaaaaagtagcaaaaaaaggaacggaaaatgggaaagaaatgaaaaaaataggggaatggattggccaattgcatcgggcaaagtttacccagctgataagacgaaataataattggaagacactgaaaaatagtgagtcaaaataactaataaggcatttcatataactataattaaccgctcgataaattgaaatcgaagaaaaaattttttacttaataactagagaccgactaaaaaggcaccaaaaaatcgcgaaaaaggcactaaaataggcaccaaaaaaattgaaaaaaggcatgaaaaggcacgaaaatcccgaaaaaagcatgaaaaaaggcatttaaaattttaaaaaaaatgaaattttgccgatatattttgaaaaaaaaatttcaattcttagtagtgtattttctggattttttttcgggtcatttcttaggggtgtgtttttccgatttattgcatttttgatggaatttttcggaaaaaaatgccaaaaggcaccaaaacgacaaaacgccaaaaaagtatgaaaagttaaaaaagccaaaaaaggcaaaataaaagtcaacggagaaggctcaaaccacgtggaaaatgtgttatttatgcttaatatatcgaaactacttcgcagaaaaaaggcatatgcctcaaaagtcggtctctattaataacattataaaaatgaaaaggttgaggattaatcagaagacatttgaattattttagtcctgcaaagtaaaggcacggcgaatatacgacaaaaactgttgaatttatttgatacgaatgctgtggaatcagtttttgaggaattcgatttcaaaaatattagtgaggcaactggtgacatccgtaattcatttgatattaaatggcaattagagaacagtgacgaatacggagagtttggcatgatgaaagaggaggaggaaagaagtacacggacgaacagagaaagagatgaagagaggatgagggaacggtgccga

SEQ ID NO: 57268 - DNA, 945 bp, Heterodera glycines
  Genomic contig location: Contig_ID=SeqID_5206; Location=659..1603; Strand=-
  SCN-specific regions: Sequence locations=1-590,666-823,845-945
atggacgaaaattcgcctcagaatgcaatggcagaaaatttaggtataaaagaaagacaaaaataaataaaagttaaagtgttttaagatgataaagcgactgaactgatcaactttttcaaatcttacattctgcaaatggttgaagctccgctggaaacccatcaaaaatttcaaataaattcggccaaatggaatttggcgcgaaaaattgagggaatgttggcatttctcacggaattgggcacaaaactgaataaaaatgggcttttggatgaaatagaaaggctaaaaagcgattgggacgaaattacggaattggaagagaaaggcgaggaagaaaacaacaaaatgctttgtttaatttaccaaaacggtgcccaaattctcaaaatgatgttaacatatattgaaaatgatgagggaatacgtgagaaatggaaggaatatttggacaaacacagagtgttggacatcattgaggtaggccgagtcttacaagccaaaaacatggtaaacaaacaatcgtaacacggagggcttaaaaattaccaaatttaaactaatttgctgacatttctcggcacgtcttaataatattatataaaaactatatgttaaaaaatagtctatatagaataataaatgataaattttaaaatattgcaatcgcatagccaattaagataattgatccagttgactgcgctgacactgaaattaatgcgcgaattagcatgtgtttgcttaacgagccattacaatggcatataattgggcaaaatttttacgagttgttggaaaatagcgcagagcttcgccattttatgtgcatgtgcaataaaattgcaaattatgcggaaattaaaatagtgctgggcgaaatgatcggtaggaaatatttgacacttttggacgacgaatttccggagattatgcgcgcag

SEQ ID NO: 57269 - DNA, 883 bp, Heterodera glycines
  Genomic contig location: Contig_ID=SeqID_5206; Location=4243..5125; Strand=-
  SCN-specific regions: Sequence locations=1-1,23-156,192-264,287 -466,488-561,583-794,816-883
atgaacgttcttctgcggaaatctttatcagagacgttgggactgaaatccccatcatctttgtcacccttagtatgttagaagatattccctctattttaaagcttgtaaatatcatattcattgacgaggcaggtcaggcacctaccaatcaaattattcatattctctctctggccccaaatttggaaaaaatccttgctgctggtgacccaaaacagctacaagttcgctcttctgaacttcctgaggaattgctccaatatggatttaattcatttctttctcatttaatttttattcctaacattcccaacacaaaactcacaatttcctaccgaggacacccaattctcacccaatgtcttgctgattctctttatcatggagatattgttgccggtgtaacggccgaacaacgctccatgattacctcttccaactttccgctacccaatcaaactgcccctcttcttcttgttgatctcccaaatcctgattatagagaattaacctccttttcacgattaaattcggcccaaaaccacattgcccattcaattctctcccttctctctctcattttacctccatctgcatcaattacttgtctctgtctgtactcggcacaggcaaaagctattagatcccttacccccttaaatgtcacggtcttgacagttgattccttccaggctcaagaatctgatgccatagtccttatcaccacccgatccctccccaccactcccgacgagatgaggcaattttcgtattcctatttttcgggcccacaccaacttccctttctctcgttttatatgatgtatgtatgtattggtttcgcataaagtgtaattgcctaatcgcttcaaataataaa

SEQ ID NO: 57270 - DNA, 1071 bp, Heterodera glycines
  Genomic contig location: Contig_ID=SeqID_5207; Location=170..1240; Strand=-
  SCN-specific regions: Sequence locations=1-115,137-161,183-189,212 -589,640-1029,1051-1071
atgggcgatcaatcgacgacaattaatgcgcctcatttggccacttcatcatctggatatatctgtgaaacattctctgcagaggaggtaaacatataaaataatttttgcatgtgttttatttggaaattttgaaattcgtgcttatgttttgataagaaattttaaattttcccatttttgggcgatatatttttataaaatatcatttgctagtttgattgcatttttgtaatttttggaaaattctaaaagttgataaaaatttcattaatttttttgtcagatatttattgccttaaaagcgtccggaaagaagaattaaaaaagcagttatataaaaataagtaaagattaaagttactttccacttgagaacggacaggattgggatcccgcgggattaaattcaggagcccgacataaggatccattctgagcattttatcgcgattgagctggatcaggatttcatcgggaatccttcccgactatttcgccatcccgcgagatcctgcgggattggaatcccaataactttttcgaataatttccattttcgtataaaggacttgcaacaattaaacacaaaaaattaaagttaaaaaaatcatttattatttactattttttaaataacttccccaccacaaaaattttcaaatttacccaaaagttggccatttttttaaaattctttaaacaaatcccaactaaattttcaaaattaccctggcagatcttaacggcaccacttgacctctcctttcccccggaaatttttcgaaaaagcgcgccgcaaaaaaaagttaaaggttgaaatgctattatttctcaatcgagttgatcaattataaataataaatgcgtttgaataaatctttgcaaaaaaaaaaaaaaattgagttttagctaatcccgataatcctccgtgatcccgaaaaaaagcctcgggatttatcggggtcaagagttggacgcgaacccgactcgggaatcctcctgctggtcgtttttccaaaatcttgcgattctttctaccccagcaattgtacagtctttacttttcac

SEQ ID NO: 57271 - DNA, 215 bp, Heterodera glycines
  Genomic contig location: Contig_ID=SeqID_26532; Location=813..1027; Strand=+
  SCN-specific regions: Sequence locations=1-51,88-215
atgttggcattgagccggcactctccgggttgccaaagtcgggcatgtgagtttttataaattaaatttaaaattatttaaatttttcagccctccatttcggaccacagattttgttgaattctcacgccattacattgcctcatatgggtcccaagaaaaattcttcatcatgcgcattgggcgcggctcgccgatgggctcatgtgaagtga

SEQ ID NO: 57272 - DNA, 179 bp, Heterodera glycines
  Genomic contig location: Contig_ID=SeqID_26534; Location=294..472; Strand=+
  SCN-specific regions: Sequence locations=1-79,113-179
atggctatctatttttttgagaaattttctatgcaacaaacgctctcgaacatgaaacgaagtgcggtgcgccgtggccattttatttttcaaataatttttaaatttaatacatattccagaaaaatggctctctttttttgagaaattttctatgcaacaaacgctctcgaacatga

SEQ ID NO: 57273 - DNA, 146 bp, Heterodera glycines
  Genomic contig location: Contig_ID=SeqID_26534; Location=544..689; Strand=+
  SCN-specific regions: Sequence locations=1-79,113-146
atggctatctatttttttgagaaattttctatgcaacaaacgctctcgaacatgaaacgaagtgcggtgcgccgtggccattttatttttcaaataatttttaaatttaatagatattccagaaaaatggctatctatttttttga

SEQ ID NO: 57274 - DNA, 146 bp, Heterodera glycines
  Genomic contig location: Contig_ID=SeqID_26534; Location=796..941; Strand=+
  SCN-specific regions: Sequence locations=1-79,113-146
atggctatctctttttttgagaaattttctatgcaacaaacgctctcgaacatgaaacgaagtgcggtgcgccgtggccattttatttttcaaataatttttaaatttaatagatattccagaaaaatggctatctctttttttga

SEQ ID NO: 57275 - DNA, 1554 bp, Heterodera glycines
  Genomic contig location: Contig_ID=SeqID_26536; Location=196..1749; Strand=-
  SCN-specific regions: Sequence locations=1-94,116-884,906-948,973 -1009,1032-1554
atggacatgagtgtgcaagtgacattcattggagcactcataagtctctttcaatgtgccagtagcagaagagatgctgacgaagaaatggaagaacagataaaaacatttttcgggctgaacataatcggattgagcgacaatcctgaagaagaggacaaggaagaagtgatgagaacgttcagaaagggcttgacattcaaagaaggaagatatgaatgtggcctaccatggaacgaaagagtaaaggatttgccgacaaattttcaacaagcgagggcaagactttgtggcacagtgaagaaattgcgagaattgaatttggtggacgaataccaaaaaattttcaatgagtgggagaggaacgggataatcgaaagagtgccggatccaacacaaacaactggaccggtacattatctcccacatcggcccgtgataaaaatggacaaggccacgacaaaaataagaattgtgatggatgcatccgcgaagccagcaaaccacaaaggagccccatcgttgaacgaatgcttgcacacagggccgttgttgctaaacgaattgaccgggatccttctaagatggagaagaatgaaggatctaatcctggcggacatcgaaaaagccttcctccaattatcagtgagagaggaggacagagacgcgaccagatttctgtggctggaggatccacaaaagacagaaatttcaagcccaacatatgtgagaaccgttgtgtttcggttctgtcgggtttcatttggattgacaacttcaccatttcttttaaatgcaaccatccgcgaacatctttcattctacgacacggttctaccgcaaaccataatggagaatttgtacgtggacaacatactgatcaatgtgaagaagaatgaagacatggcgcaaatttgccacgaatcgatcgagctgttccgtcaagggggaatgaagctgcaggaatttttctgcagtaagccgatcgccatacgaagccttcctgtggaattattggccaaaaaccaaaaggagataaaagttctcggaattccgtggacgaatgaggatgatgaaatttgcttccgatttaaaaaatttgccggaaagcacacgaagaggaacatcttgtcacacattgcaaaaatttatgaccctttggggttagtggcgcctgcagtgctcccagcaaagcattttttgcaaaaacgttttgaagccaaaaacggctgggatgaaggattggaagaagaattgattcatgaatggaatcaaatcatggagacttggcaaacgaaagaggggacagaggtccaaattcgattcgcacgaagagtcgacaacgaagacgaagtggacaaggaaatgcattgcttcgcagatgcgagcggaaaaggcttaggcgttgccatttacatccgggaatcgacagaaaaaatgagcgccaatttggtgtttgcaaagagcctggtgaagccctccaacatatcagatgttgcggcaacaattccaaaaatggaaacaatccataacgctgggagtgaagttgttaaa

SEQ ID NO: 57276 - DNA, 1274 bp, Heterodera glycines
  Genomic contig location: Contig_ID=SeqID_5209; Location=541..1814; Strand=+
  SCN-specific regions: Sequence locations=1-69,91-746,768-1041,1064 -1274
  Gene Ontology: Cellular component=nucleus
atgggccctttggaccttctgaacggcacttcttcacagttgaggtcgcatctgttttccgctcagcctgcacaacaaatctctgtgaacggaaatggcattggcttggccaatgccgcggcgtccgctcatcaccccgcgactccgtccgttcccaacaatcgcttcagcccgcgttcgacagcagcgaacggtattaactgtccaccgtcatcgtctgccataaatgggacaactgtgaacggatcaccgctgaatttggccactcaaataggaaatcagacggtcggccttgtggagagcatccaccagcagcaacaaagggcgatggccgcagcactgaacagtcgcggagggacagtgaacggaagcggaaacaatgcgctggacgaattaaatcagttgaaccaattgcgcgccatgctgccctttttcaacccgcaccaactgctgccgatgggctcgctcaatgggttggctgcttcgttaatcgggccacaagcactgatcaatgcggtgggcgccaacgccggagggaatgtcgcgggaatgaatggtggaggaagcgggcggaagagggaattggagggaggcggcagcggggacacgagggagtcattgaacaacaaagtgcagagaggtgggggagagaagtgccgaagaaaggcggcggcgaaacgcagcggctaatctgttcgtttaaggggacgcccagacgacgtccacgtcgcccacctccaccaacagccctgaccagtccctgcagcacaacggcttccaccacccgtcctcccatccgccgcctcatcacagctccgaccgtcgtcggtcgctattcctttccaacgccaattccgtgccaacgccttcctcaacggtcgcttcaacaacggcattcgcaatggccgcggctgcccaacacgcggcagcagtggcagcccaacagcgagaaaacaacggcgaacggacgctgaagtgcacggggtgtcaggaacggctggaggatacgcattttgtgcagtgcccttccgtcagcggacacaaattctgcttcccatgttcacgaaaatcgatcctaaaacagtggaaatcgcatgtgagaatcgagaggagaataataagagcataatgccacccacaacaattaaacagatcattagaaaacttaaaggattaattaatcaattaaggaagtgcactgtccctccggggaaaaatgtccattgatcaattccagccaaccgtggacattcatgccgcaggagattcagact

SEQ ID NO: 57277 - DNA, 521 bp, Heterodera glycines
  Genomic contig location: Contig_ID=SeqID_5210; Location=646..1166; Strand=+
  SCN-specific regions: Sequence locations=1-384,406-521
atgaatgggcggggaaggaccccaacaaatggggagacgaacggcggcgcaccgatcggaagcgaaacggcggtgagtcacttcaaccaaacagaagggcacaacggatgccaataccaaactgttcattgtcagatgtgcactcttttgaacagcacaaaatgtgtcaaggaatcgttggaccaccccaacagatctcccggaaccgtaagcggcgactcatccggcggagaaaacgctgtggcactgaacggacaatcgccgtaacaaaactgcgaaacggacctttattacagacttttcctctttccatacacctccattttcgtatctctaatttctgctgtttgactcggctaaattttaaaatgacaaatttacgccatttgcatttaatttcaaaaagtcaaaatttttgttgccattgcgagcaaacattgatgatgcatttaccctcttatttaatatatggatagggatcggatttttaagggcgaaaaaaacgcgaattaaagccgaaa

SEQ ID NO: 57278 - DNA, 833 bp, Heterodera glycines
  Genomic contig location: Contig_ID=SeqID_5211; Location=13..845; Strand=-
  SCN-specific regions: Sequence locations=1-239,273-273,295-362,384-833
atgaatattttcggcgtcatagttgcaggacgaatggtcaagactgatttcacaacacataaagaaggcgaatatacaacagagctttttgatattgccaagtgggttttatagaattatgggtaaatagaatatttgtcattcatcaaatggaattggttttatttggtctattactataattttttggaagattttgacgtgacagttattgttttttactagcaaaatacagacgatttattttcattaaaaagatttgaatctaatatttattgaaagaaaaataaacttctaaatgtgttgggaggttgtaatgcacgtcgaattacttattattaaaaatgactggcttttggtctgtaaatgtatttttcagcataaatcacatcgttgtttttctgaccggtcttcaaccattaccaccggacattggcgcatcaagtgacctatcggaaaacgcattgtcaatctaatcatttttaaagtatttatcagttggccttcgatggaaaagggaatgggttcgatggaatggagtaatttgggattcattagcaatgaaaagccaagcgcaattttccgagttgggcaggtaatcctttagattaataactcatctttttcttttcgtattgagcattccgggtcattggataacgaattagtcaattttaattaagtaattacctccttaatcctaacgaaatcgaacattcataatttggactttacagagaacgtataaaatttaattctgattgtttgccttttgctcttttcagtgttttttttaccttgctaattcatttaaaaccaatcggcgaaataaa

SEQ ID NO: 57279 - DNA, 500 bp, Heterodera glycines
  Genomic contig location: Contig_ID=SeqID_5211; Location=1267..1766; Strand=+
  SCN-specific regions: Sequence locations=1-455,491-500
atgcctaaaattaaatccaaatctgaattgatgcgcaagtgggtcaacagtgagtttcactgctgaaaaccttgagaaacttttgatttacaattacaaaaacatccgatataatttatgagttgggctataaattatatgcttttgcatattttttctgcgcatactatgaagaaggggctcaaaaatagcatttatacgttaaaattttttgatatgattaaagttttagtgcatataaaagcatatttttggagttttcgagaataaatgcatattttgccattttttgcgtttttacagcatatttcggtcatttttggcaaatttctataagaaaaatgcaataataacaaaaaaatacacccctaaggatcgactttttgggaattaaaaaaatatacgcttggaaatcgaaaaattttgaactttttgcaagaaattttgaaaaaaatttttgatactaaagatataaaaaagggattttgtttgagtataaa

SEQ ID NO: 57280 - DNA, 572 bp, Heterodera glycines
  Genomic contig location: Contig_ID=SeqID_26542; Location=310..881; Strand=+
  SCN-specific regions: Sequence locations=1-170,192-572
atgccctcccttctgtcatggcctggtgtgcttctgcttggttctcagccgaattgctgctcgattggacggacttttggatttgcgtcaacttccaagcggatcgcacaaatgtgccgttggtcagtttggtgagttcgaaaattcaaatttttcgaatttcagattttgtttaaactttgtttgcatacacgaaaacgaacgaaaatgcattttttttggtgtcgaacccgggtttggagatccgaaattgttcaaaatgtgattgtcacagattcatgttcttcagcgaccgaaaagccttagaaaattattttgagtgactttaaaagttaatttttttttttcaaaaagggtactatcatatctctgaaaatattattaccctacattttccaacttttaggtgctcagcattgtgttggcgtgttcgttcgtcttcgagattttcttcaagaattcgctgctcaaaaagcagttggccacggaatgtgccatcgtgtgaacaatacgcagagacgagacgaatcgggaacgatgctgatgccaacaaaacacaatcaatgcgatga

SEQ ID NO: 57281 - DNA, 784 bp, Heterodera glycines
  Genomic contig location: Contig_ID=SeqID_26543; Location=951..1734; Strand=+
  SCN-specific regions: Sequence locations=1-731,758-784
atgccaagtgaaccaccaagtgaaccatttgaattggtgaacgaacggactaaagaaaagctgacactgaaacagaagagcgaagaactaaacgaattagcggtagtgtataattggcggttggaacggcgtccaattggggagacggcgacggcggcagttcaatggaaagaccgctacaattcggatgtcaaagccaatttgaacaatatcatatttaatctgtggagtttcaataaatccattgggtgagcagcatttgatttgtcgaaaaatttaatttattttaggccattgtagccaccagcggaagaagaagcggatcaaagcatcgaaaatgttgtcgtctgactgcgcagaagtgaattaattaatttagaaatgatcgatctcaacctgatgctcattttctctcagaaatgccttttgttgattttttcgttcgaattatataaacgtattttttttattgttttttgttgggcaatttctttagtatcaattgaaaaaattgttaagagaaatttgttaatattttatgtggtttccggagtaggtcgtttcggcgccgtcgttttggcgccagcctcagtttttggactataacttttttctttgtcaaccaaatttacaatcttgatatcattcgaaagcccttcatgtgctctattagccttacaaaaagcgaaaagattttctagtatgtaaaaaagttattaagaaagaacttcaaaatttaaaaaaaatttaaaaaaaacttaactttcaaaacattttttcaaaa

SEQ ID NO: 57282 - DNA, 144 bp, Heterodera glycines
  Genomic contig location: Contig_ID=SeqID_26544; Location=215..358; Strand=-
  SCN-specific regions: Sequence locations=1-46,89-144
atgagcgggcactttggcaccttaactccacgtttggttcatcccacatcgccagttctgcttaccaaaaatggcccacttggagctcaaacattcaacgcctgggttcagagtcaagcaaccctggcttcatacccatttaga

SEQ ID NO: 57283 - DNA, 156 bp, Heterodera glycines
  Genomic contig location: Contig_ID=SeqID_26547; Location=203..358; Strand=-
  SCN-specific regions: Sequence locations=1-32,59-156
taagcctaaactttttggcctgtttaaaaaggaattaaaaatttttaaaatatttattcatctcccttttgatagaaaaagcatcagagagccttatttaactcttaattaacatttggtgcgtttcagagcagtttctgaaaaaatatttatgaa

SEQ ID NO: 57284 - DNA, 436 bp, Heterodera glycines
  Genomic contig location: Contig_ID=SeqID_26547; Location=615..1050; Strand=-
  SCN-specific regions: Sequence locations=1-56,83-165,187-209,235 -390,417-436
ggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaa

SEQ ID NO: 57285 - DNA, 831 bp, Heterodera glycines
  Genomic contig location: Contig_ID=SeqID_26548; Location=473..1303; Strand=-
  SCN-specific regions: Sequence locations=1-8,30-184,206-831
atggcatgcgcagtcgctgcagaacgagccacaattcatcaagagctgcaacgattcactctcatcacggagctgatccgagtcgaagaactgcaggagacgcaggtgaacatcacgttcagacaccaactgaactccgtgggcgagatgatggacatgttgcaaatttgggaagaagatacggcaatcagctgccgcgtcgaccaaaatgatgagaccaagccgtgtgctcttggatttgttcgacgcattgaaaagcgcgcacttgacaacggatttgaggtcagagtcgaggtgtttttggcatttcaggatgccaaaggacagaaggtgtgggagcagttcgaattccttcgggaaggggcattggaagccgttgagcttcgtcccatggtttccacgcgtgcactgatggaacgagctgaacttctgaccaaaaatggatgctccatcattgccaaggaccacgcatcgcctgccaatgtgatcatggctattctgctgggacggagggtgccccggaacgtagcattgcaaagtgttgaggaaaaggtgatgaaaaagggtgccgttgggcttttgaaggcaggacagtgcgattccgcggaacgaatgctcgaaggggtgccgagggtcgtctttcaacaggcgggccctggtacaggcaagacctttacggcggcggcaatcatggctgccatcctgcgcgaggacccggcgaggacccgtcgacacgcatcctggcaatggtaccgccgaacattgccgtctgtaagctggtgttggaaatggaggaagcgctgcgcgttgagggccaacccgagccaatga

SEQ ID NO: 57286 - DNA, 581 bp, Heterodera glycines
  Genomic contig location: Contig_ID=SeqID_26549; Location=51..631; Strand=-
  SCN-specific regions: Sequence locations=1-97,131-344,367-519,569-581
atgtcggagttcactgcccaaatgttcctggagaccttaaaggtgtaagtcgtaaaaaattcttgaacttttttaattttacaccctcccgctcgcaagaagttattttatacattttacaattttctgcagacatcaaaaagattcgcgacattttttcgccgcgagatggatacaatcctatgataaagctaacattgaaaatcacttattacaacaatgtcacatttattatattccattattattaacattttgaattaattaagtatcattttcccatatttttccaattttcttcatattcattccaacagctcaacgcagaatgccgtggtgccaaaagcctcatttttggcacattttttgaatccttttgggcacattttgaatcgtcctttcatcaccacgttgccattttcgtccgtcagattgcctacgccaactttgcagcttttgctcgattttttcattgccatcgaaacgggctaaacatgaagccaattcaaaaaaaagaagaaattatttgtaatttattagtaaagtatataattttaatttaaaatttcgtttaaaataaa

SEQ ID NO: 57287 - DNA, 164 bp, Heterodera glycines
  Genomic contig location: Contig_ID=SeqID_26549; Location=153..316; Strand=+
  SCN-specific regions: Sequence locations=1-113,136-164
atggcaatgaaaaaatcgagcaaaagctgcaaagttggcgtaggcaatctgacggacgaaaatggcaacgtggtgatgaaaggacgattcaaaatgtgcccaaaaggattcaaaaaatgtgccaaaaatgaggcttttggcaccacggcattctgcgttgagct

SEQ ID NO: 57288 - DNA, 1361 bp, Heterodera glycines
  Genomic contig location: Contig_ID=SeqID_5213; Location=869..2229; Strand=-
  SCN-specific regions: Sequence locations=1-186,209-513,535-874,896 -1022,1048-1252,1274-1361
atggcctctcgcaagcagttgccctccttggccggcattttgctcgagttggagacggacacggcccggcaggtgacggcgatgcttaagctgcaacagttggacaaagcgctgcacaaagccgcacagagtcagcggcccgacttgcgtaagtcgaacgaacggtgaccattttagttccatttttgatcagttcttttggtgattcgccacttgcgcaactctttgaccaaccgcgacatggaattgttactgcgcaaagtgccacaagcgctgagcatttaccaagttccccttttaatttggttgtaaatttcaacattggcaatttcacagagtgaaatccgtgacgaagcgcccgaacgattgttggcactttacgagcaaaacgacgactttgtgcggcaggcgattttccacttgggcagagcggagcaaaaccaagcggaggactttttcgacacgtcgaaagtggcggaacaattgggaagggcggagaaagcattgcggcaaatgcgggagccgacgagcgcacaattagtggccgaatgtgcacaaatgatcgtggacaacacaaaacgggaggaaaaggcacggcacttttgctgggtttggtcccgattttatcacataactcccgctactccaacgttttttttgtcacggtaaaaggaccttttattctcattacggatctgtcaagacattggattagaccccttccatatgttcttctctttcagtacaatacgccgatggctcatttgaccgtccgcgaatcgtttatttgggcggcggcacgggaggaaatggcactgatggaacagttgcgaaagcagcacagactcaacgagaaacagtgggtttttggcaacttcattgtttcatctttttctgaagggttttcctatggacagccgaaggctttgcacgcggcggaaaatggcaacaattcgaacaatacgcaaagtcgaagaagagccccacgggctatttggtgagtgattggcaaaacgttacggtttgtttaaattttcatttttggcttttagtctgtcatccaactttgtgtcacttacggcaacaaaaatttggcttttcgcctcatggaccgactgaatgcgtacgaggagcaagtgaaggcttatctcatcctcgggtcagtttttgaaatttgccctttttacgacacatcgccaacacaattcagagaagtgaaaaaggcagcgacattggcagttgaaagggaagacttgcaaatgttacagagcatcaaatgccgactggcgccatcttctgccaattgggaggaagtgaagaaaatcacggacacattgctgaagaaggcagcacatgcctaa

SEQ ID NO: 57289 - DNA, 658 bp, Heterodera glycines
  Genomic contig location: Contig_ID=SeqID_26551; Location=632..1289; Strand=+
  SCN-specific regions: Sequence locations=1-176,200-272,295-658
atgcttggaggatcaaaacagtctgttgtgagtggagaggagaagaagcagcagcagcagcagccaccaaaaactaatgtttccgttggtcgtccattgatgtctccaccggccacggagtcgaaagatgtccttgacattatgcttggaggaccaaaacagtctgttgtgagtggagaggaaaagcaacagcagcagtcatcaaaaactaatgtctccgttgatcagcctttgttgtcttcaacgcagccgaaagatgtcattgatgatctttttggaattgttcccaaaacaggtgaaaaaaatcgtgcacaactgtttctcaacgaaatgcttggtgggtctgatgagaaagaaaagggtccaccactggagctactaatggaatttgaacgtttcaaaattgtttttcacgatccagcaatcagtggtctatcgttctcgcctcaggtcggccgagtgtgctgtccgaactgtcactttgttcttctcactgtatcactgcaaatatttgtgagccactaagctttgattgtccgcgttgtcgtatccccgttccggtacaatagcgagatgcttagacttgagatggttggttttgaagtgtctcatggacgcagcttaatttaacggcattttattataaaatacgaagaaa

SEQ ID NO: 57290 - DNA, 804 bp, Heterodera glycines
  Genomic contig location: Contig_ID=SeqID_26555; Location=744..1547; Strand=+
  SCN-specific regions: Sequence locations=1-78,100-193,224-490,512-804
atgggtacagtctgggcattctgtgcactgttgtacaatgttcacctgttggctgcccaaaataacggtaaattccacttcaaaaccttaattaagattaaatttcttttaaaccatttcgacccacttgattaaaatggtctaaattttcggatcttatgggcagacttttttgaaaattgataagataaagaataaattaaaattgaaaataattttaattggcagcatttaatgccgaagagatttgccgtcccatcgatggcacaccgttccacgcccaatgccttctctcttctgtagtcaaacagaaaggcttcatcccaaagcatttgcgcccgccatggctcaactcaccgctgtttgaggacaacaagctgagcagcgaggccaaagaatcggaaaatggctgtttttcctgctacagagggacaaaggcgagcaatggcaaaatccaggacgaggattactgtgcatgcgtggtacggtgttgagaatactgtataataaacttatctttaatattatatatcaaggtacaggactagattctgtttatttattaaaatcccggaaaaattgaaattttatacttttcgtaaaaatatgggatagaaaaaaaaacaatttttttaaagtttcggttcctctactattaaggataaagccaacgcagatatatcaatgctctgaatttaagtacaaagatcaagcaccgaatgatggattctcgaaaataattggaacatttgatggcctaaactgtctgcaggatttgtataaaatggccagttggtgaaaaaa

SEQ ID NO: 57291 - DNA, 618 bp, Heterodera glycines
  misc_feature (24)..(24): n is a, c, g, or t
  Genomic contig location: Contig_ID=SeqID_26556; Location=929..1546; Strand=-
  SCN-specific regions: Sequence locations=1-216,255-269,296-412,434 -442,478-531,570-618
atgccaaacggatcatcgattacngtgttggtctacgaggagaaggaaatgacgaacagcaactacacaccaatttgcgatgacaacaaacaacgcgataattcacgatcatcccccaacggcacgcacaaaaagtgagaaataaataaaatgagaattttttcaattgtctaacttaagtttttctatcaaaaaatattaaatttgtttcaacactaaaaaaaatttttttcaattttttattttcaaaaaatccaagaaaatttcaagggaacattgaaaaaattttcagcaattgtttctctggtctgagtgcccatttcttagccggtcttcatgcgttggaacggctctgacaactttccatggatgccaatgccatcggcggaggggcaaaagacaacgcaaagggcggagagacggcagacgccgaggcaaatttgttttaaaacttaaatttaattttttgtttctgcagctgcctctgcgcagtgcttcactcgaaaaattggatctttcatccaatgctccaaattttcttttaaattttttttttcaatttattaaatcacgtgaaatgcgtaccatctgttaaaaaaaattctgcatcaaaataaa

SEQ ID NO: 57292 - DNA, 579 bp, Heterodera glycines
  Genomic contig location: Contig_ID=SeqID_5214; Location=743..1321; Strand=+
  SCN-specific regions: Sequence locations=1-74,113-233,264-360,392-579
atgaaaggtgttcaaattaacgaaccaattcattcggctaatgatgaacttgatgagccaattaaaaagtgggccaaaacaaagaaattaagcaaaccaaagtggaaaatgccggtaattactagtaatgagaaattacaaattgtgctaaaagattttataataactgtagcacagataagaatggggcttattgtcaatgtgaaaaattattataaaatacttacggaatcaaattaatcaaattttttttattatttttagattgaaactatggctaatcatgatgatgaagcttatgccgacctttatgtttataatgcaggaaactatactaatgcaggcgaagaatgtcaaaattgtttgaatttctcaaaaattgatggcttaattggccaattaacggaatctttgaacgcaaccgaaacaatcattaatgagctagtcaaaaaatttaaacttgtgccaattgatctcgatagcccaatgtcaagtgtcacaatgcttgaccaaagcacaaacagtgaaagaattcatttggcagggaatgtgattaacagcgcaattattggtaattag

SEQ ID NO: 57293 - DNA, 394 bp, Heterodera glycines
  Genomic contig location: Contig_ID=SeqID_5215; Location=51..444; Strand=+
  SCN-specific regions: Sequence locations=1-137,159-265,289-370
atgaaaaatttaaccgatttgccatcatcctcaaaaagagggttaacacatcaaagcagttttgtgatcatggagatcagtgacaatgtcaaaatggatgaacaacattcagatgataaaaatggacaagaaaaaaaggaggccaaaaatttggaaaatgccgaaaaagcgatgaaagaatttaacattcggaaaaagaatgtgaagtgccaaaagtgtaatgagcgtgccaaaatcctcagaatggtccagcaaatccagaaaaacaacaaagaacaaataatcaaacttgtgcaaaattgtaaacattcgaatgaacaagaagagtttacagaacccaacataattggcacaacaatttacggtgaacaaaaataaataaaattaatattta

SEQ ID NO: 57294 - DNA, 1322 bp, Heterodera glycines
  misc_feature (408)..(408): n is a, c, g, or t
  misc_feature (1069)..(1069): n is a, c, g, or t
  misc_feature (1077)..(1077): n is a, c, g, or t
  misc_feature (1090)..(1090): n is a, c, g, or t
  misc_feature (1092)..(1092): n is a, c, g, or t
  misc_feature (1099)..(1099): n is a, c, g, or t
  misc_feature (1105)..(1105): n is a, c, g, or t
  misc_feature (1122)..(1122): n is a, c, g, or t
  misc_feature (1142)..(1142): n is a, c, g, or t
  misc_feature (1154)..(1154): n is a, c, g, or t
  misc_feature (1163)..(1163): n is a, c, g, or t
  misc_feature (1170)..(1170): n is a, c, g, or t
  misc_feature (1178)..(1178): n is a, c, g, or t
  misc_feature (1186)..(1186): n is a, c, g, or t
  misc_feature (1192)..(1192): n is a, c, g, or t
  misc_feature (1196)..(1196): n is a, c, g, or t
  misc_feature (1206)..(1206): n is a, c, g, or t
  misc_feature (1216)..(1217): n is a, c, g, or t
  misc_feature (1225)..(1225): n is a, c, g, or t
  misc_feature (1241)..(1241): n is a, c, g, or t
  misc_feature (1254)..(1254): n is a, c, g, or t
  misc_feature (1261)..(1261): n is a, c, g, or t
  misc_feature (1267)..(1267): n is a, c, g, or t
  misc_feature (1274)..(1274): n is a, c, g, or t
  misc_feature (1276)..(1276): n is a, c, g, or t
  misc_feature (1301)..(1301): n is a, c, g, or t
  misc_feature (1309)..(1309): n is a, c, g, or t
  misc_feature (1314)..(1314): n is a, c, g, or t
  Genomic contig location: Contig_ID=SeqID_5215; Location=1094..2415; Strand=+
  SCN-specific regions: Sequence locations=1-64,86-129,168-265,289 -425,483-524,546-682,732-745,783-1155,1274-1322
atgcaattggcatttaccataatctctactcggactgaattcaacgagaattcgaaattagaagtaacattggctaatgcagatagaattggcaaagctttgcttggcatttctgaaccaattgagcacaaatttttagaatatttaaaaatttcaaaaatatttttgttggccgattcattgggtgctgatgaaacgacattgatcgaagctgaatgcaaaaatttggaggttttgcagttgatattagtaatgtggctgagaattttttaattctttttcaacaattgacctttttgcgcaaaattttaaacaaaaaaacgcacaaaatttcaaaaattttcataaaggctttacgaacataagcgctcataaagaccgacacatttagctttcttgcttagggtntatgaagcgcaatgttctttttatatatatttattaaactaataaataaatttttgagaatattattattttttgatgaccttttacgtcaaaattttaagcataaaaaacgaacaaaatttcagaaattttctgttgggaggctcataaaaattcttttggcaaaaaatgaccgaaagaaaaatctaacaaatttttcttgcttggtattatttattcataatgctctttttaaattttgactgcaaatagagaacattaattcaagcaaatgttttttaatatatttttttaaaaacttgtaaataattttttttttttttgtgggttgcttagattaaattaattaggtttttatttaaatttaagaaattcattaccaattttggtgcaactcgtgcaccatcagccgaagaaaccaataaaattggcaaaaacaatttggaattttacatccatcttttcaaagaaatgcaacagttactggacagcattaagcgcacaatcaaaattgaaataagagaagtgtggaaagacctaattgcatttgtagaaaagtttgaggaaaaattggaaacatttgccaaattaacggaaaattgaaaaagaaaaaagttacgacgcgattgtttgtatttgacaatgatgaaacaatgggagnccttttanaaaaaaaaatttnanttttctnattttnaacattttaccactttntaaaacaatatttctctatnctaacacttttncaattatantaaattnataaaacnttctatcnatttanaaancataatttcnttattaattnnttttactntaaattttaaattatnaaaattttaattnttttttnttttanttttttntncctaaaattcccatccctattaatntaactttnatttnctctataa

SEQ ID NO: 57295 - DNA, 637 bp, Heterodera glycines
  Genomic contig location: Contig_ID=SeqID_5216; Location=388..1024; Strand=+
  SCN-specific regions: Sequence locations=1-142,164-171,217-286,308 -392,416-479,506-576,598-637
atgacatcgaaagccttgacaaatgccaaaaacaaacatatcgtggcatcaaaatttgcatttggaaatattggaatccaaaatgtgcgttggatttttgttcgggcggaggcggtggattatgtattcgacgaatgcatgttttacgatatgtttaaaattttcatactgtatttatgataataaaattatcataatattttttttcaaatatatgctttcatcattttgcgacttctttccgatatcccatgtgaaggctatgttggaaatcgtaaaccggcactttgattatatctttgttcattatattcatttttctgaattttttttttgacaaatataatattcaaaaagaaaatttttagaacttgagaattattgagtttctctaattaatttttaaaattattttccgtattggaaaatgaggaagatatgctttgagtcacagcaacctttattgaaaatgaactgaaaaatgtaattacaaaaattcttgaaacaaatggtcggcaggcactaaaaagatcaatttggtttttttggctagttttaaaaaggaaagaaatattctaattttttattattttgggtggtaggaaaggttacaagtaattactgttaattcacaaaa

SEQ ID NO: 57296 - DNA, 592 bp, Heterodera glycines
  Genomic contig location: Contig_ID=SeqID_5217; Location=292..883; Strand=+
  SCN-specific regions: Sequence locations=1-350,416-422,460-592
atgtccgacaatatgctaaatacaatttttcaaaatggttattatatgaaaaaaaaatcttcgaaatcctgaaaatatgtaaaaaatacaacatatgtaccaaatatatataaactctaataaatacgtaaatataaatacataaaagtatcaacatacgggggaagagtgattcgctcgtcagaagtggattgtgtgtattacgtacaggtttagttactctgagatctcatagatatgcgctagagcactgtacaaaagaagctccacacgcaggggtacgacggtcaaagtaggctcaaaaaatgaactcccataaatattcacaaggggtccccatatggaaatgctaaaattaaattgattttatatttttcaattatataatatatttttattacaaattatatttttacgatttcgaaatgaaagaaaaaataattaactaattttttcagtaaccgagaaagagtttgaaaaagaattaatagtaattgtccatgaaagtgtgatgtttaatggacaatgctctttttttgattagagacaaatgccgtggatttggcattggaaaggcggagtgccaatctaa

SEQ ID NO: 57297 - DNA, 484 bp, Heterodera glycines
  Genomic contig location: Contig_ID=SeqID_26561; Location=717..1200; Strand=-
  SCN-specific regions: Sequence locations=1-129,158-203,225-311,339 -366,398-431,454-484
atgacaacaacttttaaagcccgaaatacagcagcttttgatggtaattaataattaattagtggagagaatgcatttgaaatattttgtctttttcagaaatttgtcttggaaatttggaagtgcaacagaagagcaaaaagaagaacaaagaagacattgtcaaatttgacgtcgatcgcccgggggaatgcccttctgtaaaaattattatcatttttctgtttgtgactgcccctttcgttctgttctccgttatggtcatttcttattatttcatacaatttcaatgacaatttgacattattacgaatttaaaaaaataatttaattaatttcaatcaaacgtaaatcattctcgcaaagtttaattaattaattttttatataaattaaactttttgcatcgtattatgccgacagaatggttaaaatgtttcaatcatattataaaataatttaatcactcggttactgtaataaa

SEQ ID NO: 57298 - DNA, 272 bp, Heterodera glycines
  misc_feature (126)..(126): n is a, c, g, or t
  Genomic contig location: Contig_ID=SeqID_26561; Location=196..467; Strand=+
  SCN-specific regions: Sequence locations=1-272
agagttacatgggatcaaactctcgaggaaaaacgggaccagaaaaagggattgggacacgacgccggggtgaaaaaatcgttatcaggattgagttttgtttaggccgaaagccattattatgcncaatgagcgacagttcaattcggagacttagcattctgagcattttgccaactgatatgagtcgtagccaccaccacaaaggcgcgaaaatggatggaagaattgtggttttggtttgtccgaaagcaattaataaagcagattaa

SEQ ID NO: 57299 - DNA, 1230 bp, Heterodera glycines
  Genomic contig location: Contig_ID=SeqID_26562; Location=388..1617; Strand=+
  SCN-specific regions: Sequence locations=1-22,44-54,97-101,123 -489,511-787,809-898,921-1068,1090-1230
atgtggaaaaatccgaaaaaagccaagaaggaatggaaagaaatgtgagttattaaatcttattttataaggtttttgaattaaagaaaaatatttttcgtataatttgatatttcccagctctctctgcggcgactgttggctgtcagtgttccaatttatcggcccctatgaactcgggttgaaatttgcgttgctcagtgatcgatttgaccatttggtggacgagcatttcaagacgaaaaagtgggcgatgggtttcctggaaattcgtctctcctcaaggggaaaacgcgcggtgattgtcaacaattttggcgacggacagcgcagtttttatccaattccacaaaagccattgcccagcaatatcgtcggatttgaaagcattcgtataaggtgccaaagacagacacttggcttagggggggggctgaattcaaaaattcaatttttagggtttcatttttttagagtctcgaattaggcggtctatttagcaggaatttgtagctgcttctcgccaaaaatgctattttttgccatttggtctccatttttttaatatggtcaattgggtgtccggtgcgggtgctcattttttcaattctcacatttttaaattggtaataatttgctaaaatgttgggaagggacgaaacacaactaccaggccaactcttaactgctccgacttgtaaactgtttttcggccaaaaaacgtagtactttttcaaagtcaacaaaaaaaaatacaatttgaaattcaatcgaatattttgggtagatttttgtcagatgatttttgggttgaattttaaaacaacatttaaaggaattggttgtccaacagtatagacaagttcgtctgtagaaattgtgaaaattccgataattctagcaaattcggttttaattgtggaatttttttgttttttttccactaaaaatagagttaagctctaatctaaccctaatggccaataaaactatctttttaatcccaccaaacgcgcaaaatttttttgttccaatttgcagttacgtcgaccaacacgtcgtccaatttctccaccgcattcgccgccttttcgactctgtcccgacaaacctttacattgcgaccgccgctttggccgaaactgtctaccgcccgaagcactttgtccgcagttgcgaggcgattcgccaacacattttgccgctgctccgtgccaatgtccgcgccct

SEQ ID NO: 57300 - DNA, 431 bp, Heterodera glycines
  Genomic contig location: Contig_ID=SeqID_26564; Location=483..913; Strand=+
  SCN-specific regions: Sequence locations=39-40,62-138,161-243,295 -320,352-431
atgattattttttcaatgtttttgaaaaataaattatgccaaattttaattggtaaaatatacaaatccatgtttttggcattagttttgtaattttgttaagaaataaatttattcttttttttctattcatttgaagtttcatgttccgtgggttgaatgattttatttggttgataagctgttttttaacaacttactatattttataattaaagttattaaatgattggacacattaacaaataattattttgaaatgatttcttaattaattatataatttaaaataaactgtcatcagaaaagctttttttctcattttaattttaaaaatttgtttattattttccatattttgtagataatacattcctgaaatcaataaacttcaagtttcggaatttataaatacaaaaaaagaaatatta

SEQ ID NO: 57301 - DNA, 880 bp, Heterodera glycines
  Genomic contig location: Contig_ID=SeqID_26566; Location=15..894; Strand=-
  SCN-specific regions: Sequence locations=1-257,279-315,405-670,840-880
atggacaagcatttgatcaccgactttgagcaatcaaatcgtctgctgttcaacagcttttcctccacgcctctcccaatgataattcagcgaaaccaaagaactcaatcaacgcaaagtttgactaccgcaaaccaaaaactgcctttggttactgtagcgactgcgaaaattccgcaaatgtttcgtttcaatacccaatttgatcaacgaagattgaacattggcagcgtcatccactttgagtgtaccgtagaaaggtgtgaggaacgaattggaaaaacgccgtcggcgataacgccatgcccacgggtgaaaaacaaaagcaaattgaaagaaataaattaaaaataattaccaaaaaaaaaaaaaaaattcatttttgtttaattttatgtttaaaacgtaaagcattaaattttttaactttccaacaattcattgttgttctttgtagacaaattgtgatcggaaacggatcatcgctgagaaacagcagcaaccggtgatcacaacacaagcggaacagcatcacaatgttgatgatgccgttgatgaagatggcgcgaaagtgacgggcgaggacgaggagttggagctggtcacccaattgttacgggcacaacaactggaggaggagggagaggaggaagcccaatttggcggagtggaaggagaaacggacgaagacgaagcagtgacagaagcggcacagaagaagcagcagaagcaaaatgggacggaaatggcggacgaaaaaggaaaaggaaaagcaaacggaggaaaagcaaagggggaagcggggaggaacagaacggcacaggaggaagaagaagaagcaaaggcaatcagtggaggtgccaacaatagaaaagcataa

SEQ ID NO: 57302 - DNA, 366 bp, Heterodera glycines
  Genomic contig location: Contig_ID=SeqID_26567; Location=16..381; Strand=-
  SCN-specific regions: Sequence locations=1-36,59-111,145-185,207 -228,250-275,329-366
attctgcacgcgaattaacaccatttttttcaataaaccacattttcattatccattttctatcaagatcacatgaactttactatttcctatatttgtatcgcgtaaatcttataaaagatttaaataatattaattttttaagattctacaccgcgtctgaaaccttcaaatctgtaagtaaaatattttccacaaagtgctaatttttccgtttctgttgaatccattatcaaatgattttttatcagagcattaataaatttcgatttatcatttatataactaaaatatttttaatgattaaaataatattaatttatttatagatcctgcactcgaattaacaccatttttttcaataaa

SEQ ID NO: 57303 - DNA, 684 bp, Heterodera glycines
  misc_feature (684)..(684): n is a, c, g, or t
  Genomic contig location: Contig_ID=SeqID_26568; Location=19..702; Strand=-
  SCN-specific regions: Sequence locations=1-130,159-278,300-307,373 -380,402-574,617-684
gttgaacgcatcaaactcacttgtgagcaaacacttgcccaatcagtcgccgatgccgccgagtttgacaaacattcctatgaaatttcgatgctcaacgaaaaattacgggttgaaaaaagagtttttgaaaaaaaaattaaattttaaattattttcagcaagtttgcatcaactattcccatcaaattgaggcattgaatgagcaacaaagacacgaatatcgtcaattagtccgcacaatgtatgccaatgaaaaaagtgtgtaccatggaggaacaaaagcggtaatttttcttattgttagaaaattttttttttaaacttgtaaaaatgatattttcaaaaaaaaatgatgaaatttttttataagaatgtttcaataaaaaatcttcttgaaaaagttttcaacagatttttcgatgacttacaatttagtagttcatataaattttcgaaaaaatcgctgaaattttttcattttttgttgaaaaatttctgtttgaattccccctctttaatagcagcccccccccccccctcagggattccaatttggactgccctatcccctatttcatttatagaaatttccttttcagtttgcttccctggcaggcagttttagctgtgctgacgacacattgtacaactgtccttcaacagccaatgcttttgcaccgn

SEQ ID NO: 57304 - DNA, 471 bp, Heterodera glycines
  misc_feature (33)..(33): n is a, c, g, or t
  Genomic contig location: Contig_ID=SeqID_26569; Location=896..1366; Strand=+
  SCN-specific regions: Sequence locations=1-79,120-291,338-471
atggcttataatctgttcgctaaattgctgctntgtttgaattgcctgcggcttcttttgaccaaatttgtttttatggttaataaattaaataattattaactttttaaattttttttgtttaggtgttgatgggttgccaaaatgaattcagaaagaagaaaagcaacttgcactgttgcttttgtatgcatcacacaactttggcaaattgaaattgtttaaatgcgattactactgacttatagcgtagaatattttgatattaatcacttatatataagtatttggatatattttattttttaaacttatttggatatttttattttttaaagtcatttatttgtttcacttaaattgtagttcatattgttaaatttatttttttaattcactaaattatccgcaaatgtcggctaaccccgaaaacatgtctagccaacaaaatagtctgcataagagtgtcga

SEQ ID NO: 57305 - DNA, 171 bp, Heterodera glycines
  Genomic contig location: Contig_ID=SeqID_26569; Location=501..671; Strand=+
  SCN-specific regions: Sequence locations=1-171
atgcgaaaagcgaaatgcgaaacgccaaaaaatgcgaataatgcgaaaggcgaaatgcgaaaagcgaaacctcggcccatccctgcaccacaccccgttaaatgttgccatcatcattatcttattttttcatccataatataccgtagtgcgacatttgcggataattta

SEQ ID NO: 57306 - DNA, 1497 bp, Heterodera glycines
  Genomic contig location: Contig_ID=SeqID_5218; Location=3084..4580; Strand=+
  SCN-specific regions: Sequence locations=1-260,282-514,537-611,633 -880,902-945,980-1073,1224-1306,1348-1439,1461-1497
atgggaacggagacggacgggcggacaattttaggcggaaaatggacaaaaagggacgaacaaaaagtcactcatcagcagataaagtggactaattgtcctccccagatttcctcacatccgtcaattcatttcattcattttgtgagccgaccgacactaaacggaggactgaatgaatgacagagtctcccaaaacgatattgaacaaagataaaatttgttggttggccccccaggggagaaagcgggggaagcgcggattaaaaatatttttgggtgctatggtggccacatagaaaaaagattaatgatggtttgtggcacatcctcaacacagttttagagatagatgagtaaggaagtaagtggtggtggtctctcatcacttaaaagttgtttagccaaagaatgatgggacgaattgggccggccaaattgtgacgctgccctgtggccaatccgaaaatctcccaccccatcttactcaatcaaactctgccgaatttccaaggccaaccaaaatatatttattctttccatcgcacttgaatggaatttaattgaaagaaattaggaaaaattggtggcatttaattttttggtccttttgcttttgtcctggaattcaagtacgcctaagggcaaatgtcccatggcctttgtgggttttaaggattatcattttttggtaatgataaaaaagtgtaataccttgaaagtttttaatcattctgacggttttcctaatttatacctatttaaaaatcaaccaaactaaaatcttatttgtcagcaaatttttttgtgaaattaatcattcatttcagtattagaaaaagagtgatttttgatttttaatcggattactcttaattcaatagaagtgcataaatttggtgtgtgctgcttcagaaatttcatttatcggaaaattttacaataaacctatcaatcaaataaatagtaattatcattactagcataaaaatggaggattgcttctctgacgtaaatgaattgtgaaaatcatttgttataaccaaagagtttttttgttttaataatcatgcaatttttaaaaattattttaaacaaaatcattaagaagaaaataaaattatttcaaataacgaaacattgaataaaattaattaatttattattttgttaaataattttattttacctttaaaaatattttcttattaattaaatttaaaccgtgagtgttttgttagatgatttaatataaaaaagacaatcaaaaaccaaaacttctgtgatatataagcaataaaaaaggataaataaattatttttttagaaaaaataattgtaaattatgtactgtataaaatactaaaagatatacaacctcatacagtaaatgcatatattgtaaaactcacaaatcctacacagccacaaaattgtattaagagctaaaaatacaaccaattacagtatgacggtttaataagcctatcccactga

SEQ ID NO: 57307 - DNA, 2205 bp, Heterodera glycines
  Genomic contig location: Contig_ID=SeqID_5219; Location=1..2205; Strand=-
  SCN-specific regions: Sequence locations=1-2,26-73,100-118,208 -220,242-307,330-595,618-873,896-1240,1266-1266,1299-1365,1390 -1411,1433-1447,1528-1542,1660-1660,1851-1907,1929-2205
ctttaagaaaaattcttacattttccaatatttgttgtaattatttttttaatgttaattttttccgagaaatttcaataatatttttgaaacaaaattttctattaaacttttattgaaattctttaaaattttaatgttttttatgtattttctttttaaatttttttcattaagtccttttttattttcttttttctatttcttaaaatgttaaaaatttcatcctctcctcttccctcgttctttttcttcttctcaccaaacattcgcgtatggtagtagactaaaaatcacacaatcgtgctaaaaaattatataatatttttgtgtaaaaacgggtgggtgtgaatgtttaggaaaaatagaaaaatttcttttattgtattcaatcgtaacaatgctttaaatgattagaaatattttaatcgtttttttgtggtcacttgtcactacgaaaacgacacccattcaaaaaaaaacatttgttttcaagcaatatttgaattttgcgcaattatgctttaatcttaatttcttttaatctgatttgctcctacaaactgagcctatatctaaaacaaaatcctgactatttccttttttcaaatattttaatgcttctttaaattcctgaaaattcaacctcatactttctatgaagttcaagaccgaaaattcctcggggttcaagaccaagaaacttgccccgaggcgctcaaaaaccgagatcatgattaaaaaaaactcaggactcttttctcgagtgagactgactcggggtaccgggaatctcgaacgacttacttattcatgatcacgtgaatcccgttagggttagcatcattttgccatcaatttggccaacaactggctgattgattgagggagagcattttaatgctttttcggctttggtcaaacaaatttttataacatttttttgccgaatcaaattttttctttttataaaaagtttcttttttgttcaattttccccttaacaatgcttactttgttcttgtgcggctttttttctcctatgtgtgctttgttcaaatgcaatcgccgccccgtcttaaaatgcatcacacaaaagcaaaacttttattggtggaaggaggggcgatgggggggggggggaatttgcaaccagagccatagcagacataacgtcgaactgatcaacggatggttaggtaagcgtcacctccaccaatagtgactcgctgtataccgatggcatgctagctttatctgttcggtcaatacgatgcccattgtacttgttgactggtatgatattcgagagcaaaaacgacttatggaattgcgagcttcagtctcactacacggtcgttctgatactctttatgagaaagcgttcccactttacgagcaatgttcaaataaagctcatgaccaatttctaaacgaccttgagagaattctaccgagtaacaccacaccgctcattgtcagtgatgctggctttaaagtgccatggtataaatccgttgagaagctcgggttggtactggtttaagtcgagtaagaggaaaagtacaatatgcagacctaggaggggaaaactggaaacctatcagcaacttacatgatatgtcatctagtcactcaaagactttaggctataagaggatgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgtccccgacccgaaaatacggtacgatgatatactggaattaattggtgaaacagtaaggaaaacacagagaaaaagttcgaaaaaccgatggaattccggaaaagtatttactcggaaattttaaccaaaatttgagatggattcaaggaaaatttaaaaaagcggacaaaaaattctgtatttggcatactgtaatcaaacaaccgacacacacacacacacagtgataatacggtagaatttagtggcaaaaaaatgcacctgcgaatcgatgcccaaaaagaggaccatacagaagaaaaggatggaccaaacattggtgtacggtagctggagaatgcctgtaaaataaaca

SEQ ID NO: 57308 - DNA, 928 bp, Heterodera glycines
  Genomic contig location: Contig_ID=SeqID_26570; Location=232..1159; Strand=-
  SCN-specific regions: Sequence locations=1-928
atgggatttcctcacagaccagtgcaaatgacgataccatattcatccacaaatcccatccccgcagtcgcgcctgttcaagctatgccaatgatcgggggcataccgtacggaatggtttcggctggagggcaacttgcaatttcaccgtcattcggcgctcaattggctccaaatcatggagttgctggttttggcagaggagtgcctgccgggcaacagttcattggacagccgcttgttcttggatatccgcaaaatgctggattcatccaaccgacagttcgttttcacttaccgggtttatcacccaccaaaatactcaaaaatcatcttatagaaatgaaagtttaagaatgtatgatgtcttactagtaacaatttcaacaaaaaactctaaatttttctaaattaacgccgctaggcctttcctattctccaatttattttagaaaaactcacttgaaaaaatgtggtgaaaagcaaaaaatcatgtttacatggctggtactcttcacaaattttaggcgcccccacccttaatcaatctctagccttaaccgcctttttcacgtattttaacaattagatggttcatccgaccggacaaatgatggctccaattgggctttacccatcagttgccggcgtagttggacctccacagatgaaacagcctccaatatcgcaaactgtcatggcaaatatgcctccgcctcagccgttgtatgaaggtgaaatttcgtttgttactgtttctctgaaattccttttagacgttgaaccgttgtctgctgaagagcacaatgccattctttacaattccagtgccgaattccacactgccttggaagccagtcgttggaatgccgttagtgttttgccggatgctaaaaggaaggagctgtacaatatgcttcatgggtag

SEQ ID NO: 57309 - DNA, 901 bp, Heterodera glycines
  Genomic contig location: Contig_ID=SeqID_26570; Location=1217..2117; Strand=-
  SCN-specific regions: Sequence locations=1-39,61-548,570-720,742-901
atgatgacaccacatcaagatttccataattcaagcgtcgcaatgcaacaacaacaaacactttgtcctcctgaatcaaccttgtggatgggcgacttgaaaccggaatgggatgcaaattttgttcgtgaagcgtttggagaaaatgcaggcgatgttactaatgtcaaaatggtattacgagaacgcatacataatagccacgttttatttgaacaaattaagcggtcgacttattgtttcgttgaattccgagacggaccaactgctcgaactgcgatgttgagggttaatgggatgacggtgcgcttggggttttgtctattgaaattaatctgttataattaagttacctaatgatccaagtgggacgtcgcgctttaatttggcctttgcaaattcgccccatcatatgtaagtattatttggttttttctcaccttaaaactctaaggtctattgaatacaatctttttgtgaacaatttggctccagatgttgatgatgtggcactgtttcgagtaaagtttacaattcttagaattaccctttgtttgttttagttgtttggtgaacgctatatgtcttgccgaggtgcaaaagtttacagaaacgaagatggagcatcgaaggaacaaggattgttcggtttacttctgaaactgaccaacaaaaggctttggtattaaacatgtgaaatactaatgaatccgatttgttaaggttgaactgaacaaacacaaatttcatggccgcgatttatttctcaagcttgcaagaccgaaaactcgtggtggacctgccgagaaacgatttccgggtcatggtggcccccccaatatgttaggtcacgggtacggagctgcaggtggattcggtaaaaatgtcataattgaataaa

SEQ ID NO: 57310 - DNA, 724 bp, Heterodera glycines
  Genomic contig location: Contig_ID=SeqID_26575; Location=307..1030; Strand=+
  SCN-specific regions: Sequence locations=1-468,507-724
atgatttatgacttactggaaaagtctgtatgtcggaatcacgactttttttggtgggggaggcataacaaaaagagcgagagagtgcacgtggtataccggaaagaggctagagcactaagaaatagtgttccaacaacagagagtgcacatggtaaatggaaaagaagaggcaaaagatgaatttctcaacttaaataaataattcaatttatatatgttcttttctcagcaaataggggagtaattaatatgagctaacaataattaaggtgtttatcaaggtcccttatcacaaatataacctttttgttctcatcagatatcatctctgacaaagactcaactaaatgaaatgaatttgatcagattttatgcaattcattgcctttatcccctcccgtgactggacaatccgacagtggacaatccgacagtggacaatccgacagaagtggacaatccgacagtaaatttctattttaaaaaatattttcaagtcattagatgcattttactggccaaatgcattttgaggtgtccaatcaaaagtaaacttagttatgccataagtatggatgcgatttacagtaactaaaaccgccaaaatcgttagtttttaggttctaaaaaactataaattgcatccctagtcatagaaatagagggtgatcatggacgccaaaatgctctattggagcgtaaaattcaatgtaaaatgcca

SEQ ID NO: 57311 - DNA, 127 bp, Heterodera glycines
  Genomic contig location: Contig_ID=SeqID_26576; Location=348..474; Strand=+
  SCN-specific regions: Sequence locations=1-77,108-127
gtcattaaaaatctgttgaaaaataatccccccgtctccattaaaggccctgtctccaattatgtccccctttctaaagaggttgaaaaataatccccccggggccttaattagagaaaatacggta

SEQ ID NO: 57312 - DNA, 858 bp, Heterodera glycines
  Genomic contig location: Contig_ID=SeqID_26579; Location=36..893; Strand=-
  SCN-specific regions: Sequence locations=1-415,442-858
atgtatgttaaaagtagcccctaaactaaataagtaccgataaatttttggctctaatcctctattaactgcaaaatttcaaaaagtcgtggaattttagaaagttatcgtgactttttttatggtcgtgtaaactgaatagatcccgattatatcatgctttcttaagtttggcaagtacatttcattaattggacggtgcggaagacacttgcacgaactgaaactgaaggggatgtattcacgaaaagtttttgttggcgatcagctgtggtcatatgtccctaatttgcggcatctctgttttgatgacacacgaacttcgtctgacacagtgaaagccatcgcagcgcaactgccaaatttgaaaagtgtggccttctcagacattgtaatgatttgcgaatattaaaacactgcttatttgtttattttaatctcaggattggagttgctcttcaaatttgaacatgtttctttcaaatgcaaaacttatattccttcgttttccggtggacaaattcccggaaaggttaactttttccgcattgccacactcattacgtatccttaacatttgcgctcgtcgaactgagaatttttactcaaatcgaaagacctcgcgaatcattgaaattcttcaattggcggcaatttactgtcccgcactttctgttttgatgttgccaattgagtttcaggcgggtgaacgtattctcgacgaagtgggccgattcaatcggtatttttgattttttgagcatcatcctagctgcgtagacgaaaaaatttaacggttttctgaaaagttcttaggtttacaattcaagtttttcagcggaatgggtttttaataaa

SEQ ID NO: 57313 - DNA, 857 bp, Heterodera glycines
  Genomic contig location: Contig_ID=SeqID_5221; Location=920..1776; Strand=+
  SCN-specific regions: Sequence locations=1-372,394-857
atgaaccgacgtttgtggaaaatgtgaggaatttttaaatgatacgattttcggcacttttgcagtttattgggcccttacgaaaaaccacagggatgagagattttgaggtaaaatcattagtaaaaaccaactcgtactgtgaaaaaaaacaaggtaatactatagatggtggccccctttttgagaaaaatttttttttgttctaaaaactcgtgaaaacatgtttatggtggttttcgaggtcggagaacccgaatccaacattaattttgagcaatttcgaatcccggacccgaattcgaacaaaaagttgaaaaaatttgtctcaaatcgtagcacgagttgggtttccggcttttgattttgtaaattttcaaaatttgctcaccacttttgcgtactgtgaaaaaacagaaatttacctcaaatcgcagtacgagtttgcggtttcaggcttttgatttgtaattttttcaaaattacctactccatacttttgtttttcattgggcccttaaactataaaaagtgccaattttctctttttaagtaattttttacgtttgcatttcagttggatttgtggcgacgtttggatggacattctcccatcttttgaacgtgctgaacttggcctcaaaattgcattgctttcttaccgttacgatgctttgatggacaaacattttgacggaaaaaaagaattgacaatttggaggacaatcaaaatttgcgacggcattggcccagaaccgaaattgtctgtacagatcgaggacaaaagggtggaatttccatttcccgactgtccgttgcccaacaaaatccgctttaagcatctttggattacgtaa

SEQ ID NO: 57314 - DNA, 1430 bp, Heterodera glycines
  Genomic contig location: Contig_ID=SeqID_5222; Location=537..1966; Strand=+
  SCN-specific regions: Sequence locations=1-430,452-1221,1243-1430
gtacattgaccattccgtcattgaatttctccgttccaacaagcacatttgggacagaaatggcaccaacttgctcattcaaatagaatcagacacaaatgttatcaagccgatttgggatgtttttaccagtgaaatttggccaatttttgctaccaacattcgccatttgagctttgccggtcactatttggacaatttgcgtcgtctcgtttcaccgacaattctcactgattttgatcaattgaattcaatcgattctggagttctattacccgatggaattgctgacgatggaccggatgcaactgctggccaagcattgttcaaatgggtgcacactccgagcaaaaatggccaaccgaagcaattggtttgtgcggattatgacgaagaagtgaacatcgactgggtcaacagtttcaaggaggtgtgtttgttcacattctcataaaatttgggtatataccgctggtaccactcacttttttgaaaaaattttcaaaatttttaatcagatgggtcaacaatttgaaagtggtgtgtatgtgtgtggtcggtcacataaacgattgactgattgattgcctttgattttcgcttccttttttaggcatttctctgtgccaccgcttcagtcagctataatatccgacttgaactttatgattcgtcgacgccaattgagccatttgaattgatgaacgaacggactaatgagaagctgacattattacttgttggagaagatggctatgaattcacagaaaaactgttgaagcgatgtccaattagtgaaaaggcggcgacggatcaatgggaaaatgaaaaaaattgggacgacaatttgaacaatgtccaattcagtttgttgggtggcaaaagtgggtaagtgaaagataattcacagttcacacctaatttgtgtttaattacaggccttatggccaccagcggatgaagaaaaagaagcgggtcaaagcatcgaaatatcgtcggactgcgcggaagtgaattaattatatttgagaaaagccgatctcacacaattggaatttgatttgatgccatcattttctctcagaaatgcttttgtaatacatttatttgcttgcttttaaatgaatgtttggttatatgacagacacagcaatatgtttcggattacaatgaagagattatccgcaaagtttgtattaagcgagccattcattttttaacgattaaaatagaaagtaaatgtttacctgtttttttctcaaaataagcaacagaaaaatgttaattctaagtagtgatgttcgagagtctcgactcgagaaaagtctcggttttttttggtctcgagtctcgggttttcagtctcggtctttgagactttcgagaccgagacttttttacacccctaatgatcggctttttgtttagaa

SEQ ID NO: 57315 - DNA, 155 bp, Heterodera glycines
  Genomic contig location: Contig_ID=SeqID_5222; Location=2683..2837; Strand=+
  SCN-specific regions: Sequence locations=1-155
atgtccaatttaatttgtgtggtggcaaaagttcgattgggtaagtgtggtaaacgataattcaattcactcaattcaaatttcacttaattttaggccattggccaccagcggaagaagaaaaagcggatcaaagcatagaaaatgtcgtctaa

SEQ ID NO: 57316 - DNA, 488 bp, Heterodera glycines
  misc_feature (381)..(381): n is a, c, g, or t
  misc_feature (394)..(394): n is a, c, g, or t
  Genomic contig location: Contig_ID=SeqID_5224; Location=1879..2366; Strand=+
  SCN-specific regions: Sequence locations=1-274,337-488
atgaagaggaagagagtgtgccgagaagggaaatgtgtgagtcgagggggggaggacagtggcggttagagccactaattgaaggtcaccggaggggcagcagatggaagcaaagcgacgggaaagagaaaataagggaccatatcttttttagcccaaaaattaacacattttccgagaaaaaatttaaaaattggtatggactaaattatataataacgagggctgggaatttggctctaggaaaatcggacactggaaaatcgacaccaactttaaattttaaaaataattttttgattctttgctttaatatttaaaatacatataaatttagcataaatacacatcacaaattacctataaaaatggacaatttanacaaatctcttgngatagggattatgctttctttacgtaaaaatagcaattggaaaatgcgccagtaatacagtattttgtaaaataatattctgtagcaatatgta

SEQ ID NO: 57317 - DNA, 708 bp, Heterodera glycines
  Genomic contig location: Contig_ID=SeqID_26580; Location=854..1561; Strand=+
  SCN-specific regions: Sequence locations=1-117,140-232,281-294,379 -633,661-708
atgctgatcaaagcgttcactgccaccagcatggcatttttcgttctgtttttggtcgcccactcatttgaattggctcttgcttttgctgttgtagacaaagatgaagcacaatcaacaacaacagaagcaaaaaaccaagccacaacatttattccaaactcgaggcaggatgatttggaagcagcagatgctgctgaattgttgggtgtacttcttgaagaccatgacgaaccacaacaacaacatgaatggccatataacagcaacaacaacaacagaagaaaagtggtgtcatcatcttcctcagtgttctcttcttcatcatcatcgtcgtcgtcgtcatcttatgaggataatgatgatcatgaccataatgccgatttaaagccggcatcattgccgagaatggcacggcggataattgtgcagcaacaacagcattacggcaatcggatgccacaacaacggcatcaacgtagattccgcatagatccatcacatcccatccacattctgttcccgttgccagcaagggaggggcgcaagactcaaaaccctttcggcatcaccattctgaaggcacgaccggtggttgatgaggtcggttttattaaaaaaaaatatgagcccattgattattaaaaagaatggatttatattccaatcgtaaattaggtatctaaacagatgttaaaaagttaggta

SEQ ID NO: 57318 - DNA, 146 bp, Heterodera glycines
  Genomic contig location: Contig_ID=SeqID_26585; Location=958..1103; Strand=+
  SCN-specific regions: Sequence locations=1-146
atgggaaaaggaagggcattcgggcaacggctggtccaaaaggggccacacaatggcaaaggaaagggagggcactcgagcaggtgcggacagggagggcactcgcacagacagagagcagcgaaggccgggtgcagtgaaaggcg

SEQ ID NO: 57319 - DNA, 215 bp, Heterodera glycines
  Genomic contig location: Contig_ID=SeqID_26585; Location=582..796; Strand=+
  SCN-specific regions: Sequence locations=1-215
tcgtggcgacaagaaatttgcttcgaactctgcggggtgaaggggacgggaaggggatgaaatgggcgaggcgcgcagagtagccgttcgggggaatgtagggggtcgggaccgatcggagagcgatgagtcgtgccggttttcgtccaggcaaatagaccaagttgggcacaattttaataagagtatgtttattgtgtcgacctcaaacttgg

SEQ ID NO: 57320 - DNA, 979 bp, Heterodera glycines
  Genomic contig location: Contig_ID=SeqID_26586; Location=75..1053; Strand=-
  SCN-specific regions: Sequence locations=1-327,351-439,471-979
gtgaatttctgctacgcgcacgacacttgcccggaatgcattgcaaagggcatctgggaccagccactggaccgaagctgtggaatctgtgggctgacgaggaccttcgcatgggcaccgttcgagttctacaacaccgaagtggagaccgcctacgttgtggacgaccccctgacggccttcaccaagtggctcctgcactttgaagctgatgtcctcggccttgaccctgcggagaagcgccgcaaacggaagcgtgcgaatggagacaacaacaacaaggcccggaatcctgctgcaaatgccttcatcgacatggaagcggaagacgacgacagcgatgacaacgatgcagaaaacaactacatgcttggctatgatgaggagggagagaaaccacgctccgtcaccacatatgcctacgcccacgcaggtaaacaaattttaacaaaaataaaaaggaaaatttatcgatttttaagggtcacgttacgatcacgtgctgatctacggcgagatgctgcgcatgggtgtgcgtcccgaactcgtgcgccaggggaatcacctgctggagatgaaggcccgcaagaggggagccatcacaacgacaatcttccgggacaggtaaactgtgttaaaataatataaaataatcgattatttttcagttacaaactgatccccatcaagttggcttcctttgtgaagacgttcggcttggaaatagagggagtggacaacaagaaatacttcccgcacaagttcaacaaagtaaaaaaaatcaataaataaaaccaaaaataatcaataattaaggctgcaaattatggtgttgtgctggacactcttccgccgcttgaggactactaccctggcgggcacttccctgaggagcgcaagaagttggagcagtggtacgaggagaaccgcaacacgccctttgacctccgtgaggtcattgcggactactgtaaagcag

SEQ ID NO: 57321 - DNA, 977 bp, Heterodera glycines; identical to SEQ ID NO: 26589
  Genomic contig location: Contig_ID=SeqID_26589; Location=1..977; Strand=+
  SCN-specific regions: Sequence locations=1-800,974-977

SEQ ID NO: 57322 - DNA, 2343 bp, Heterodera glycines
  Genomic contig location: Contig_ID=SeqID_5225; Location=113..2455; Strand=-
  SCN-specific regions: Sequence locations=1-48,70-471,494-994,1017 -1118,1140-1252,1275-1575,1597-1791,1814-2089,2118-2144,2167-2343
  Gene Ontology: Biological process=development
cccaaaaaacgctgccctcgtcggatctgagccccgtgttggagcagcggagcggcgccggcggcagtgttctcggcggtgtctcttccgttggcggcgcgtcaactgcggcgacggcgcagtttttctcatccgcctcggcattggcatcggaggccaattcaatgcgtggctccaccatttcgttgaccggtgctgggcttggtggggctggcagtggcactgccgccacttcgacgcacgcaccgccgagccgactctctgcgccgctggacactcagtcgttgacggcgagcagttgtggcgttggaacggcgtcaggtggaggacgaggcgagtgacgacaaattcatcgttttaacattttaattttgccggtgaattgtcctatttggaatttcatattgttatattgaaaatttattccgaaaattgcagtttttacaaaagaagggagcagggaaaaatctgaaaaaattttttttttttttttgcgtcggttatgtccaggcgacgttttggaatgtatccacaaaagaaattcccaaaaatctcttggaaaattctgtgcattaattttttgaactgctttctctgccaaattatttaatttttcacttcagctttgccttccacaacctctgccggtggtggcgctgcttcgtcttccgcctccgtgttgcgttcgagcatcaaagacagcagcggcggtgcggccaacaaaaaggacccgtccgactcgacgcaggcgctgtttctgctggctgaggtcagtagttagccggccggctaatcaaattaacggctacttaaatctgatacctaatactcttccagaatctggctgaacttatcgactcggtctgcaaaagtgaggacaaagaaaaactgttgcccgcactgcaagcagtttggaacaacacattgccctatttgaaagcgaaaaggtacgggtgcacttcgtttccccccccccccggtcgtttcccccccgaaaaattttaaaaaaaaaatttcaaacctagaaatttttcataaaaaaattcttggaaacgacgggggggggggggggggacgacctgctcccaaaaggtacggtttgtcggggacattcgaatggattttttgcccaaagttttattcttaaaaatttgacccgggaaaaattacaaattttgcagatacttgcctaaaatgataaatttgccattgttttggtcattttccgaaaaatttagtcccttttatttgcttttgaatttcattttctgtttttagtgctaagaatgtgcgctttttcttggccagttcacaatttctcgcttcgatgagttcctacaattacatgcgttcggtgtggaagaaaaatgcgatggatttgctgtgggacaattgtatgggaataatgaaaaattcaaaaacaattcggatcatttacctttttttctgcagcattcttcaaaatggacatccacgcgttgcgccaatggctgatcgtaatcgacaatttgatgaccaacgacaaaacatcgttcaaggaattgcttagtcggtttttgcatttttagcaaacataatgaaataaaatttggtttttgaaccgaaaaaaagaaaacatgaacagattttccaacaagacgtataagcagtttaccatgtttcaaaaaaattgattcagaacgattaataattgtaaaaataaacggaaaaattcagcgcggatcaccacctccacgtcgaccactctgtcaacactgatcaccagcaaggagcaggagtacgagatgcgtgcccagtacctgaagcggctggcgttcgtcattctcagctcggagctggaccaatatgcgggccaattaaacgaaatccaaggcatattaagaaaaaaatgttatctagcatggcattttgtcgttgcaaatgaccgtttttactgaattgccaatttgcagaacggctgacagaaaatttacgtctttgccaagtgccggtgatccacacgcaggtgttcacgtgctaccgcgtgctgttggtccgcatgagtcccagttcatttgtgtccatttggccgtcgatggtcaccgaattggtgtgatattaataattaattcctaatttattgccttgccaatttcatagtaaaattgttttaatttaaattttttgtccaggtccatgtgctggcacaaattgaccaccaactcacttcaacaacaccaacaagcagttccggaggcgcttcttcgtccgttgatgaacagaaatcggtgcgtgacgagcagtgcatgcagctgttcttggccgcttgcaaattgcttgagacgctgtgcgcacttccctccg

SEQ ID NO: 57323 - DNA, 1711 bp, Heterodera glycines
  Genomic contig location: Contig_ID=SeqID_5225; Location=894..2604; Strand=+
  SCN-specific regions: Sequence locations=1-423,445-546,569-1069,1092 -1493,1515-1622,1644-1711
atgcaaaaaccgactaagcaattccttgaacgatgttttgtcgttggtcatcaaattgtcgattacgatcagccattggcgcaacgcgtggatgtccattttgaagaatgctgcagaaaaaaaggtaaatgatccgaattgtttttgaatttttcattattcccatacaattgtcccacagcaaatccatcgcatttttcttccacaccgaacgcatgtaattgtaggaactcatcgaagcgagaaattgtgaactggccaagaaaaagcgcacattcttagcactaaaaacagaaaatgaaattcaaaagcaaataaaagggactaaatttttcggaaaatgaccaaaacaatggcaaatttatcattttaggcaagtatctgcaaaatttgtaatttttcccgggtcaaatttttaagaataaaactttgggcaaaaaatccattcgaatgtccccgacaaaccgtaccttttgggagcaggtcgtcccccccccccccccccgtcgtttccaagaatttttttatgaaaaatttctaggtttgaaattttttttttaaaatttttcgggggggaaacgaccggggggggggggaaacgaagtgcacccgtaccttttcgctttcaaatagggcaatgtgttgttccaaactgcttgcagtgcgggcaacagtttttctttgtcctcacttttgcagaccgagtcgataagttcagccagattctggaagagtattaggtatcagatttaagtagccgttaatttgattagccggccggctaactactgacctcagccagcagaaacagcgcctgcgtcgagtcggacgggtcctttttgttggccgcaccgccgctgctgtctttgatgctcgaacgcaacacggaggcggaagacgaagcagcgccaccaccggcagaggttgtggaaggcaaagctgaagtgaaaaattaaataatttggcagagaaagcagttcaaaaaattaatgcacagaattttccaagagatttttgggaatttcttttgtggatacattccaaaacgtcgcctggacataaccgacgcaaaaaaaaaaaaaaaattttttcagatttttccctgctcccttcttttgtaaaaactgcaattttcggaataaattttcaatataacaatatgaaattccaaataggacaattcaccggcaaaattaaaatgttaaaacgatgaatttgtcgtcactcgcctcgtcctccacctgacgccgttccaacgccacaactgctcgccgtcaacgactgagtgtccagcggcgcagagagtcggctcggcggtgcgtgcgtcgaagtggcggcagtgccactgccagccccaccaagcccagcaccggtcaacgaaatggtggagccacgcattgaattggcctccgatgccaatgccgaggcggatgagaaaaactgcgccgtcgccgcagttgacgcgccgccaacggaagagacaccgccgagaacactgccgccggcgccgctccgctgctccaacacggggctcagatccgacgagggcagcgttttttgggctttaatgtaaaaatgggatttgaaaataacaaggagagaatgttaaattgagaccaaatttggattggtatgtttttctctatttgttcaagaaattccattcacgggcacccaatttacaattggttcccgttgtacaaattgaaaa

SEQ ID NO: 57324 - DNA, 2535 bp, Heterodera glycines
  Genomic contig location: Contig_ID=SeqID_5226; Location=1892..4426; Strand=-
  SCN-specific regions: Sequence locations=1-655,677-680,702-1191,1213 -1779,1801-2535
gtctgccgacaaacggaaacgtgttgcttcctccgctgcgcgcgactcaacgtatgaccagacaagcctggtcggctcactgctcggacccggtgacgcagcagcggcaatgccccggatcacttcctacgctggcggggacaccatccgacggattcgaacggggcaccggcgccaggactcgctgcaggagtccattttcagcaccggcacacaggagttgcgcttgttcgaccccaccgagttgcccaactcgacatgtcccggcgaccacaagcagccgttgctggacgaaacattctctcacatgctgttctatgccgagagtccgtccattgttgacttgggccgtgccgagaagctgttccgcaccatgggcacactgttgcgcagtggcaacgggttgggccgtcatctggtgaacagcatgctgttcaccaacatgtccgagctggtcaaccggaccggcaccaccagcagcggaaagactggaggcggcaatttgtcaaacattggcaccaactcggtcaacaacagcatggccaccattggcggcgcttccacagcagccactcagcaactgctcgacttcatggcacgccactaccaacacatccagggcgacggcttttggtgtacagaaacggcacatgatcagcagaacttcagtgtacagaagaaagaggatggcattgctggtggtagtggtgggacagcggctgtcacttcaacaagttcggaaagcaaatccgggcaacaacaacggcactcgactctgttcgaaattttctcaacggtatcttttcgggttatatttgctgaaatttggatttatttgccttataaggttgtgctgtatttcttccgctcttactacttgaactcgcccatcaaccatgtttccgagactgacttggtcctttcgtggaagtgtaaggtcgcgctgtttacaaagccttcgattaaaaaaatttgtcaatattttagatggtgaacctttttccttttttttagaaaaaccaagttttttgtcattataaatagttcaggactgacgaatccgattctgaatttgttctatccaattagggttcgggccaaatttagaaacatgaatttcgatgaattttgggggtatgggttcgaatggatgcaaaacgattctaaatctgtaaccaatgaacagcattatttctttaaaagtctgattttccctcgatcgttcacagattgccgccctcgactgtttcacggaattgctgcacattcttgacgacactgtgagggaggccagctccaaggaattggccacatttgtgcagcaaatttatcggcagacaaaaacccaaaaagtcattctcactctgatgttggccgccattccgacaccaccgaaccaaaaagggtggaggtgtgtaatgatggtttggttcggttccgggatgcagattttctcccatttttagcggcatattccattttttgaatttttcccattttaaaatttttcgaatttctttgtaaaaaccttttaattttaataaaatccccattttttgtctggcatttgacgtcgcctatttttgccagattccccataaatttcgtttttattttttcaaattataattaactaattgctttttcccaggatgcctctctcaatggacattgcggagttcaacaacggaccaccacacagcaaacattttcgcgatctgatctttgcctaccatcggtcgctgctcagtttggcctccgcgctggtggtgctcgagtacagtcttcatgttggcactcggcacttctcttctcaggttgaaacatcatatttccatggctttttatgggttctttttttgaaattccatcaaatcaaagttttttctattcattttataaagatatgaaaatttctcccaaagaataatatattttggcctttcagacccatttgttggcccttccgatcaatcgcaacgcttctccatcttctcagatcactgaaaaccagatcaactacaactcctcccaaaatcggtccaccattcgtgaggcgcgctactccgtcgttgagctccgcctgttcctcggcgtaattttgaacgcgttgaaacggtgtccggcaaggcatgaactgtggctccattttcttgtcgggattttgccatatttggacaggttttggatcttttttatacgcatctttctgtttatcgaaaacaatatttcagagccttggccacttttgtggtgcatacggttgagcagatttgtcgaaatctgtacgaatgtgtgttcatcaacggctccaccgcttccgtggcgggattgaacagtgcggcgttggcattggtcagcaacagtcaacagccaatgggtgcctccgtgatggaacatccgaaaaatcccattcaatttgtggactaccgcatcaatcggaccaacgacgtggcaacaacagtcggcgacgatggcacaatgccaaccgttatttacccggccaattacattttgaatgtaagagttctttag

SEQ ID NO: 57325 - DNA, 354 bp, Heterodera glycines
  Genomic contig location: Contig_ID=SeqID_5226; Location=2295..2648; Strand=+
  SCN-specific regions: Sequence locations=1-332
gccttgccggacaccgtttcaacgcgttcaaaattacgccgaggaacaggcggagctcaacgacggagtagcgcgcctcacgaatggtggaccgattttgggaggagttgtagttgatctggttttcagtgatctgagaagatggagaagcgttgcgattgatcggaagggccaacaaatgggtctgaaaggccaaaatatattattctttgggagaaattttcatatctttataaaatgaatagaaaaaactttgatttgatggaatttcaaaaaaagaacccataaaaagccatggaaatatgatgtttcaacctgagaagagaagtgccgagtgccaacatgaagactgta

SEQ ID NO: 57326 - DNA, 563 bp, Heterodera glycines
  Genomic contig location: Contig_ID=SeqID_26591; Location=614..1176; Strand=+
  SCN-specific regions: Sequence locations=1-260,282-421,446-563
atgtcgctcgacaacatttctgaggcaaaccaagtgattttgctccgattgttaactgacaaaatgctgaatgatcagccgcccaataacacaattatgctgaaaattttagaaaccattaatggaaaaaaaggtaaacaaaataaaaaaaaatttgtaatttggtttatgatttttcgaattactggaaatatccgaaatccggatttttggattttgacatttttatgtcgatttcgactaaaacaatttgtctttaaattatattttttgtggcaaaagctttgaacttttttagaaaacattgtccgaaaaaataatttcaccgatcagtgatcagaaaaattatcggacccgccaaatggacagaaaaaaaatgtgccaaatttttcaaaatgccaaaaaattgatgcgagttaccaatttaataaattttaaaatttttcgtattcaaatttgaaaatttgtttagattttgaacagctgagtgctcattttttgattaccgatgaatcggtagaagtctacatgaaaaagtatcgagaataaaattaacaaattaa

SEQ ID NO: 57327 - DNA, 173 bp, Heterodera glycines
  Genomic contig location: Contig_ID=SeqID_26592; Location=1133..1305; Strand=+
  SCN-specific regions: Sequence locations=1-80,102-173
catttttgatggcatcaaaaattgttccaattgccgtttcgccctctttcaactttttgcgtcgtccattgccttcgttggtctctcttcgttctcttttcaaatcgccattggacgcgccgttctgtggcatttacaggacaaatggcgggatttgccggacggatgacatt

SEQ ID NO: 57328 - DNA, 207 bp, Heterodera glycines
  Genomic contig location: Contig_ID=SeqID_26593; Location=323..529; Strand=-
  SCN-specific regions: Sequence locations=1-21,44-207
tgtcggctcttctcccaaccgtccctcctcctctccgtcctccgaatccctcgtgcttttcgtctttctcgtgatcgcgtggattgtgctttggcttcatcagtcagtgtgctttatctgttctgcggatggaatgaactgatcagtttgctcgccgagtcgggcttcgtcggtcgtgcgaaggcgaacattttaaagtgtcacggg

SEQ ID NO: 57329 - DNA, 549 bp, Heterodera glycines
  Genomic contig location: Contig_ID=SeqID_26594; Location=419..967; Strand=+
  SCN-specific regions: Sequence locations=1-148,170-186,216-528
  Gene Ontology: Cellular component=cytoplasm
ttggccaaggacggtttcgacattgtcatcccgcagtgcagtccgttgagtccgggcgaactgctcggctgtactgcgcccgttctgcccaaagatgtgacggcacttgtgtaaatttaatttaaacgaattttaatttagacataaattactaaaaaataaatgcctttaattcaaaaaaccttcaattttttaatttcttaaaaaataaatttgcactttttcgggtgggcgttctgctctctgcataaaatgttcattaaatgccatttttgttttaatctttcagctatttgggcgacggtcgctttcatctcgagtcggcgatgatccaaaatccgtccgtgcccgcctaccagtacaacccgtactcgcgtgagttcacccgcgagcggtacggcactgagctgatgttggccaaccgtgacgcggcggtcgcagtgacacgcgacgcgcaatgctttggactgatccttggcacactcggacgacagggcaatgccaaaatattcaatgtgagtgagcagcagagggggagaaagagagaga

SEQ ID NO: 57330 - DNA, 134 bp, Heterodera glycines
  Genomic contig location: Contig_ID=SeqID_26595; Location=429..562; Strand=+
  SCN-specific regions: Sequence locations=1-134
ttctcggttctcgattcccgagtcgagaaatttctcgggttttttgggtctcggttctcgtatcgtttcccggggtcatttctcggtctcggtttctcggttcccggtaaaaatcacttctcgcacagccctac

SEQ ID NO: 57331 - DNA, 67 bp, Heterodera glycines
  Genomic contig location: Contig_ID=SeqID_26596; Location=82..148; Strand=+
  SCN-specific regions: Sequence locations=1-67
tgtccgtttgggtactcaacaattatggggagcaaaatccaacgcagaattaaagtacaggctatag

SEQ ID NO: 57332 - DNA, 443 bp, Heterodera glycines
  Genomic contig location: Contig_ID=SeqID_26597; Location=326..768; Strand=+
  SCN-specific regions: Sequence locations=1-443
atgctccaatttgtcggacttcaagttgcggaccagcaaatagatgaagatcacgatggggataacgtggatggtcatcaccacggtcatcgtcgacttggacagcaccgagtcgtggatttggcccgcacatggcggcttctgttcagggagctgttgtcagaaagggcttttcagcatttgacccaccacaatgtcgtcgtcgttgaagaactcgcactcgaagtactgctcgatgctgaagcgccctgctctgttcacctccagaagaacgccgagcaatttgacgagcagaaaacggacggtgtaaatggactcagtgacggtcacgtgaatggtcaatgcttgggtaatgctcaaaatcagagccaacgcgggacagagctgagaagcgcaaaaaataaggaatatatgtaataaataactcatttaaaattcaccaa

SEQ ID NO: 57333 - DNA, 468 bp, Heterodera glycines
  Genomic contig location: Contig_ID=SeqID_26597; Location=751..1218; Strand=-
  SCN-specific regions: Sequence locations=1-109,131-240,287-468
atggtttccgccaccattttaatctgtcaaattgccaatacaataattttcgcctcatttgcctacaactttggcaagctgtacatcatgttggacgattacatgcgcaaaacggacgccatgaacatcacaatgccaaactcgacagtgcaattccaatacaagggcataaatgtggacagaatcaccaaaattgacaatgtaattaacaaggcgaaagctgccaaaaacttactgtggaataataaaaattattttaaatggaaataatttttaataattttttcttggtattaaattgccattaattttcagtaccatgaccaattatggaacttattcattgcggaagtgattgagctgattttcccagtaatcaatctgtttatgttcgcttggattgtcaaagacaaacggcggaggtttccgtcccgagtccaaatcatttatttggtgaattttaaatga

SEQ ID NO: 57334 - DNA, 576 bp, Heterodera glycines
  misc_feature (522)..(522): n is a, c, g, or t
  Genomic contig location: Contig_ID=SeqID_26598; Location=1063..1638; Strand=+
  SCN-specific regions: Sequence locations=1-82,104-178,200-299,321-576
atgagttcgcaatacaaattttggaaacgattgaagctggacatcaacttcgtaagctttttaatgaattattgtattttacatattcctttataaattatccctttatcatggaggcagactgttcgtcgtcaattatgatgataaggatacctaaaatagaaataattcaccaattgtatttttattctcttttcagttgcgtcacacttttttgactcaattgtgtcggaagtgcccgatgaaaggaccaagcacatccatttcgttgaagaaagccactattcggtaaaaaaccagtcgatgctttaatccttttgaattttggtcagcttgtcggatggtaaagaccgtagtgcacaaagggactacgggcacacattcgtcaattagctgagtccgactgactttgcctgtacgaagtaaatgttgctcaacaaactggatcgtggactgatcacgtggcattgagcagaagtgaaaagagaatgaagcgaaataagtgacaaggaggccattgtngggaagggtgtgattgacggttgaattacgcaattttggtgattatattcgaaa

SEQ ID NO: 57335 - DNA, 642 bp, Heterodera glycines
  Genomic contig location: Contig_ID=SeqID_26598; Location=413..1054; Strand=-
  SCN-specific regions: Sequence locations=1-124,147-173,212-254,295-642
ctttctctcacagacaccgattccttttggcatcacaaacataaaatgctaatggatcaaataatatcggatactttgtgccctaggcaatataaaaggagggccgaatccacacaaatcagtcagaaaaataaaattaggttgggggaaatgacgcttcacaacgtttgctcttttaaattattcaaaatatgaataaaatttaaaaaatgtaagacttttgtacatttttcttattctccaacaattctcagtaattaaaaatatttgttgttaattattttaaaattttatccaaaggactccatcaccccaatagttgttaaacgatgcttctcaactgctatttttcatcttaattatatgcggaaaagtctccacccgaacattttgaaaaatttaatttttgcatcagaatttgaggattttattatgcgtaaaatttgtttgaaaattttcgtgtgtttttctttcttttcgttcggtttttaattttcgtgaaaaataaatatttcgttccttttgaaaagcatttttttttttggtttttgcacaccatggtacgggttggtgcggttgctggttcgaaacatgccggatttttttggcattagggcagcgaaaaaactataaatttgcaca

SEQ ID NO: 57336 - DNA, 671 bp, Heterodera glycines
  Genomic contig location: Contig_ID=SeqID_26599; Location=527..1197; Strand=+
  SCN-specific regions: Sequence locations=1-155,177-257,283-671
atgccaattaatactgccactttggccgatcggattaagctgttgttggacaacgcagctaatgacggcgatgtgcattttttggtcgggaaaggagagcaaaaagaggcgagttaatcatgagaaagcgattaaaattaactggcaaaatgtcagggtttcaaaccaaattaaagaactaaaagccgggaattaatttgtcgagattcacatacatattggctctgaaggcgctacgggaaatttttccattttacataaatttattttttaaatttatttgcttaatttcaatttgattcaggagttatatttaaaaaaaagaatatcggactctaaaaatcagattttgggtgtgtgtttgttaatagattttgacgattaaattgtcaattttgattcatgttttaaaaattttcaaagggattgagtgtcaggcggtgccaaccgacgcggcccagaaacatttgagcaatttttatcagattaggactttccaaatcttaacaaatctgataaatcagactaaaaatgactcttgatttaatgatatttaaatttttaagcttttgtccgctcacaaaatgattctgaaaactgtgtccgatgagtttaattcattgttccaatcagctgaaattgaaaatggggagatcgatggtgcaaaataa

SEQ ID NO: 57337 - DNA, 261 bp, Heterodera glycines
  Genomic contig location: Contig_ID=SeqID_26599; Location=1304..1564; Strand=+
  SCN-specific regions: Sequence locations=1-88,130-238,260-261
atgctcaaattcatttacacggacaaattggatgagctcagtggagacacagtattcaaagtgctttatacgggtaaaataaaaatggttttaaattaatttaaattttcaatctaattttaatatttagctaaaaaatatggcatcacctcactgatcaaagcgtgcgcagaattacctttgtcagagctggacaatgtgtttgaaatgctactcaaagctcgttccattgaagaacatgtaaatgtgtcaataaaatag

SEQ ID NO: 57338 - DNA, 913 bp, Heterodera glycines
  Genomic contig location: Contig_ID=SeqID_5228; Location=864..1776; Strand=+
  SCN-specific regions: Sequence locations=1-645,669-913
atggatttaattcttgcaaccgattggataaacaacgcttatcccgaaatggatttacaggacaccaacaaagagaacaaagagccaacgaaaaagcaagaggaggaggcggatgatcccagttggatcagcctgattgacgaggagatgaagcgcgagccgctcgctccaattggtgaggaggcgccagcaacaagttttgcttttggttttcatttggacattacaattttaaattaggcactccaaaaaaatgtgcttgcgctgaacgccgtcgccccgtcccgctcgtggaccacctctgcaagcggttcaaatgcagcgcccacgagctgcatgtgcttttcaaaagcttagagaaacgccgggacattgtggagcatttgcgctccgtccaactgcgcaccgcccacctccgcccggccgtgcgcaattttccggtccgttgcaacgatctgtccatcctggacacccactccgccccagcttaccgaggctacctcggcataacggtttttttaaattgttttatttgtctgtaccacaaaatttaaaggttaggatgcactactacataaagcatggcatccgcttgcgccaccctaatttgccttgcgtagttgaatttggaggcggagatcacaaacttttttccctcttgaaattttgtccattgttttgtagatgtgttcaatttccaattgtactgtggtttttaaaataaatgttgaacccttaactcgagagcaatttttggcaattgcgcaacgtggcgcaaacacggagtacaacgcacggcgcttccacgctatcatcatgcgcatccgtacaacaacgggcaaaactgtggccgcactcgtcttccaatcggcgcgtgtggtcctcaccggagtaccccacccaaacagcgcaa

SEQ ID NO: 57339 - DNA, 1924 bp, Heterodera glycines
  Genomic contig location: Contig_ID=SeqID_5228; Location=2151..4074; Strand=-
  SCN-specific regions: Sequence locations=1-812,834-1924
ttgacgaacctgcacggatgtgaactgcacgtggtttggagctgtcagtggatggagcgtcttcgtcacgacccggagctgaagcgcaggtacgatgccgtgttcgtcccctgcccgctggacccgcgcaacgacgcactcaggggaggccgcacagagccgttcaagctccaccacgtgtgcagcgacgacgaagagattctgtgcatcgacattgtcagcctttacccccacgtcatggtgggttttctgtgaaggtgttcatttcttacggataaaaaaaattcagaaggccaaccgcttccccgtgggcaacccacgggtcgtgacgcgtgaagtattgctccatccaccaacagcaccacttccgtggacatctccggaaaacaacagcttccgagggttgctgcttgtccgagtgcttgcgccacgcaacatccgtgtgcctctgctcggctaccgcacaaaggatgggcgcttcacctttccattgtgtggctggtgtgccgatcgacgacagcagcggccgtgccgacacggagacgacaggcgctcgtgggtgaccgcctacacgcacgtcgaactcaacaaggcactccagctcggctatgtggtcaccgacctatttgaggtagtcactcatttaaaaaaaaaaaaaaatgttgtgcacgaaaacacaaattaggtctgggactacgacgagtgggacggcacgctgttcagcagctacgtcaacacgttcgtcggtctcaaagtgcaggcgactggttggcccgaggggtgtgtcacggaagagcagcgtcaagcctttgtggaggactttgagcgcactgaggacatccggttggactcgtccaaaatggaggtcaaccccggcctgcgcctcattgccaaaaccttggcaaactccttgtggtaaagatttttggcttttaattttgaaaaaaaaaagatacctacagggggaaacttgcgcagcgtgtgggccagacggagattcgctacacacggactccggctgaattccacgcgctcctcgacgacccaacactggacaagttggactttgtccacgtctctgaccacatggaccgctgcgtcgtgcggaagcgacccgagttcgccaaggcgccactgacgaactgcctcccggtcgctgcattcgtcacatcgtacggccggcttcagctgtacagctatatggagcatgttttggccatcgacggtgcggagctgctctactgcggtatgtttgtcacaaaataaaactttctgtggacattactatgttttagacacggactccatttactacgtcaacaagatgggaggcccgtgcgtagcggaaggagaagcgcttggccaaatgaagcgtgagcacagcgaccgccgcatcgtcgaattcattgcgggtgggccgaagaactacggcatccggcacacttcgcgggacggcaccgatgaacgagccaacctcaagatacgcagcttccgcctatcttacgcggccgagcgggtgatcaattttgaggcgatgaaggacctgacgctatccacttacaacatcgacggacccatgtgagttcattaattaaagttatctttgctagtcaaatttttttatagcgatgatgtgttggacaacgatgacccttacgtgtacggcggcggcgaacaccgtgccatccgggtgaatttcccgcaaattgaccgcaatgtgtacgccgacctcttcacacgcgaggcgcacaaagattaccggccctactacgccaagggacgtgtacgccacggaatgcagacgcgtccctttggctatgtggaggatgatggaccaccgaacgatggacaacggacggagcgacgaaagagaaattttgttgatcatgaccccgcccaaccagggcattccgggtggttttga

SEQ ID NO: 57340 - DNA, 106 bp, Heterodera glycines
  Genomic contig location: Contig_ID=SeqID_26600; Location=1045..1150; Strand=-
  SCN-specific regions: Sequence locations=1-106
ctttttcagcagattaattaatatacgatgacaggtgataatacaatattgatacgcaatatgcatcgcagtaatgcgtgaatatatatagaagataaagttttta

SEQ ID NO: 57341 - DNA, 1594 bp, Heterodera glycines
  Genomic contig location: Contig_ID=SeqID_26601; Location=8..1601; Strand=-
  SCN-specific regions: Sequence locations=1-40,95-161,190-205,227 -306,353-384,406-438,552-558,580-917,947-1062,1108-1175,1199 -1459,1481-1594
aagcgcaggagcaagcgcaggagcaagcgcaggagcaagcgcaggagcagcaggagcaagcgcagcagcaggagcaagcgcagcagcagcaacaattgcgccagcaggtgggtaaagaaagcatttatgccgcatttttggatcctctacgtttccccccgaaaaattttaaatttctattaatatttaggaatattacgaagctaagaaaattttcaaaaatttaagtcctatccctgagctttcaaaagaaccatacgtgtgcaaggggcgtggggtcagcggcaaaatttattgcgttcgaccatttttttaagtttaattatatgaattatttattaaacaatttattcttgaacaatttcactcatcataagtgaattttaataattttcaataatttttcaatcgttatgaaaacttgaaaaagaaaagatgaaatattaatattttatttaaattattagattcacttatgaagaatatttattgatctacaataattgattcaattaaattaattattagtataattaaatttacaaaattatcaaatgacaaaaattttcacttgaaatatgggagaaaaaagaattttcatttgaccccctttttagctctgcgagagtgtaaatcgtagactcatcattcaaaaagcaatttggtagcaaatctgtgctctttccaatgggattagtcaaaaatttttccttcgccaacttcgagaaaattttatgtttgatcgaaaaatttcaacgcagaaatgcgttttttaagctcctttctttaaaacaattgagtaaaaaaagaagaaacctaaaaattgcgactctattgataaacaaacttttcgggtttttacgctatattttattcagccacactgtttgattatatacatacatatggcgcatactgtaaataaataaaaataagtttatgcaaattggtgatatagcaaaagaacgaagttgatggttaaaaaacgggggttgccgccggtggaagaagggtctgatttttgttatattttcaggagaagcagcggaaagaaaatgcccgaaaaaaggaaaacttccaaatgaagcaacagcagaagcagcagcaattgcgccagcaggtgggtaaagaaaacatttatgccgcatttcgggatgcactatgttactcctcagaaaaaaaataaattaaaaaaaatcacatattgatttttcagaatattacgaagaactaataaatttactcaaaaatttttttaaaaatcgctaaaaaagttttcaaaaatttatttactttttttttgaatatatggattttccatacttttgtacacttctttgagcaccaagacccctgaagatagaatttttggagaaaataccactgttaaatgatttttcttttaatcctatatattagagctgagcgggaccgggaactttgacaaaaaccgggacttctcaggtttaaaaaccgggactagtccagttcaccgggacttcccggtcaaaccgggaataggtactcatttatttatacgttattttcaggggtacatggcaactcgccgacgcacgactcgccgacggactaa

SEQ ID NO: 57342 - DNA, 566 bp, Heterodera glycines
  Genomic contig location: Contig_ID=SeqID_26602; Location=265..830; Strand=+
  SCN-specific regions: Sequence locations=1-1,23-119,142-258,290 -300,326-531,555-566
atgacagcggcgggggcaggagtggatggggctgttcaaattttgtccaccctgttcctttttgccaactacgcaatcgtgctgccaatgttcctactgtgttggatgatggttgtacactggctccgccgccccggcctcatgccctcgcctcatcagacaccgtcgacatcccaacacccccaccgccacggtggccttcacaccatatttgagaacaccgttgagcagaaggcaggacaggagaaagacgtacggcaacaacaacaacaacaaccacaacaacaacgccacacatcagctgctgctgctgctgctgctactgtcattacagaggccatggtgcgtgaggcgcaccggatgacctcccaacttgctgccgcaattccggagcctatgcgtagcgctgtgacctcctccgtggccattcctatgcttgtgtcggcacaaagtggcgctggtagaaaagaagcaacgcaacaaaacagtgaagaagaagaaaaggaacgcaattgatatagtgatggaaggaaaaactcaaatgtgtttaccaatggctcagtgaa

SEQ ID NO: 57343 - DNA, 974 bp, Heterodera glycines
  Genomic contig location: Contig_ID=SeqID_26604; Location=1153..2126; Strand=+
  SCN-specific regions: Sequence locations=1-75,99-164,188-194,218 -429,453-974
cggggttagcgccttcggcgcatccttccaatcactgggactcaatccaccagcattccaatcgctgggactcaatccaccagcattccaatcactgggactcaatccaccagcattccaatcgctgggacacaacctaaagcattccagtcactgggactcaatccaccagcattccaatcactgggactcaatccaccagcattccaatcactgggacacaatccaccagaattccagtcactgggacacaatccaccagaattccagtcactgggactcaatccaccagaattccagtcactgggactcaatccaccagcattccaatcgccgggactccaaaagcattccagtcactgggactcaatccaccagaattccagtcactgggactcaatctccggcattacagtcactgggactcaatccaccagcattccaatcactgggacacaatccaccagaattccagtcactgggacacaatccaccagaattccagtcactgggactcaatccaccagaattccagtcactgggactcaatccaccagcattccaatcgccgggactccaaaagcattccagtcactgggactcaatccaccagaattccagtcactgggactcaatctccggcattacagtcactgggactcaatccaccagaattccagtcactgggactcaatccaccagaattccagtcactgggactcaatccaccagaattccagtcactgggactcaatctccggcattacagtcactgggactcaatccaccagaattccagtcactgggactcaatccaccagaattccagtcactgggacacaatccaccagaattccagtcactgggacacaatccaccagaattccagtcactgggactcaatccaccagaattccagtcactgggactcaatccaccagcattccaatcgccgggactccaaaagcattcca

SEQ ID NO: 57344 - DNA, 394 bp, Heterodera glycines
  Genomic contig location: Contig_ID=SeqID_26605; Location=1143..1536; Strand=-
  SCN-specific regions: Sequence locations=1-15,376-394
  Gene Ontology: Mol. function=DNA binding; Cellular component=nucleus; Biological process=regulation of transcription, DNA-dependent
atggaagataaagtggaagaggaaggaaagaggaagagaacgtggaagaggaacagaaagaggaagataaagtggaagaggaacggaaagtggaagataaagtggaagaggaacagaaagtggaagaggaaggaaagaggaagagaacgagaaataggaagagaacgagaaagaggaagaaaaagaagaagaggaaggaaagtggaagaggaacagaaagtgaaaagtggaagaggaacagaaagtggaagagaaagtggaagaggaacagaaagtggaagagaaagtggaagaggaacagaaagtggaagagaaagtggaagagaaacagaaagtgaaagagaaaatggaagaggaacagaaagtggaagagaaagtggaagaggaacagaaa

SEQ ID NO: 57345 - DNA, 162 bp, Heterodera glycines
  Genomic contig location: Contig_ID=SeqID_26605; Location=1635..1796; Strand=-
  SCN-specific regions: Sequence locations=159-162
aaagaggaacagaaagtggaagagaaagtggaagaggaacagaaagtggaagagaaagtggaagagaaacagaaagaggaagataaagtggaagaggaacggaaagtggaagataaagtggaagaggaacggaaagtggaagataaagtggaagaggaatag

SEQ ID NO: 57346 - DNA, 958 bp, Heterodera glycines
  Genomic contig location: Contig_ID=SeqID_26606; Location=375..1332; Strand=+
  SCN-specific regions: Sequence locations=1-208,230-359,383-875,899-958
atggccgaatttcgcgccgcagacaatttcgatggacttcgagttggcaatggtcggtgcggtccgcacagtgcttccggcatgcagtgtccgctactgtttttttcatcttgtccgcaacatgaaaagacagatcagaatccttggcctcacacatgtcaattgaatttttcagatgataaatttttttcttagtagtttaggcttacaacactgatcctgctttcgccgagaagtctaagatgatcacttcattggcctttctgcctgtgcaccaccttcaaaatggccttaatgttcttcatggacaaattccaccacaacttaacggcgttttcaattggttaagtccgaaggcgaattttattatttttttatttttctaggtttttggacaactacattggccgaatgcgtttcaatgttccaatgacggcgcctctgttccacccgcacgaatggaatgttcatcagcgcaccttagatgatgctgatcgtaccaacaagttcgccgaggcattccatcgcaaacttcagcggcaatttatctgcactcatccaacaatttggcgcttcattgacacgatcagatgtgagcaaaaggcaattgacgcggacatttcacgttgtgtcatgggagaatccgctccacaaaagaaaaagaagtatcgcgaagccgacgcacggattctccgactcgtccaccgttataacgacatcaataacaatcacctcccccaaaatgatcacaattatgcaaatgtcaatgtgaatccgaaaacgttaacaattttctcactggtgtttcccgaaactatgaaatgcgaccttagtttgttctgaaatttgttattttttgttatactatttatgtgtttttataaattaattattttttccgtttgacgcacacccgaccaaactgacaaattattgtagaagatactagccgcaagaa

SEQ ID NO: 57347 - DNA, 104 bp, Heterodera glycines
  Genomic contig location: Contig_ID=SeqID_26606; Location=1..104; Strand=-
  SCN-specific regions: Sequence locations=1-104
aaataaatgtgagttatgaattctcttttatatgcaaccacgcgaaaacggccacgcgacggccacgcgaaaatggccacgcgacaaggaagcacgcgaaaacg

SEQ ID NO: 57348 - DNA, 1411 bp, Heterodera glycines
  Genomic contig location: Contig_ID=SeqID_26607; Location=45..1455; Strand=-
  SCN-specific regions: Sequence locations=1-21,43-100,122-201,223 -449,472-501,524-1158,1180-1411
atggagctcagtctgttcagaaattataaggtaactaatattagaaaatttttaccaagcatacttccccaaaagacccaaaattataagatcaattgataaattttaagaaaataaaattgcgtaatattgccaattgtaccccaattccgaatcccgaacccgattcaaatgaaaagttgaatatttaaattttcgaatttttcacctaaaaataattcacctaattgatcttttattgcagcaagattgatgcctttcaattttaaacgattatgtatgaactttcattttaattcgccaacttattcataatgcggaatctaaaaatagcgcctctctgctttctttactgttaagaaattataggcaaaatgtcacttgaaatcaaatcccattaatgaaagaatatgtaacaaaaactttgtgtatttataatcaatccgttgtttcttatttgttagtgaaacacagaagaatttccggcggaaacatttatttttgctataaaaggagaaaaataacggagaatgtccattctcccagcagtattcttattttccaatcacacgtcacagccgcagcatcgttctgcttcatcggtaatcgtcacgcaccatgaggaagttcgcctacttcaaactgtgccaagccgtgctcacttctgtttttctgtggcaaattctctcaacgcaccaattctgtggcgagtttgacgagcctaagggtgtctttcgcatttgattgtcaacctaattaaagttccattcttttcaggccttcttcaactctgcagtctcctccagccattgcgaacagttcacgctcatcggaatggactccaccactggcgaatacggggccatgcccgacaagcagaagtggcacatgcaactcatggcgagcagcggcagtggccaaccaattgatgaacagcaacagaatcacatggacgagttttcgtcaaaattgccgactgttggccgtcactgtattccgattgcggtcaatgatctctcaatacatatgacactaatcccattatttttttagttttctctcgtcaagccctgggttcgcgacaacaaaagtcatctgcagaaggtcgctgatttgtttgccattcaattgctctgcggattgctgtctctgtttgtcattgccatgcacgttttggaccaaccgcgctcttggggatatgaggtgtgtttaaaaaagaaattagcaccttgatcactatttcgcatactttcagagcatcgactacgaacggaccactttttgtgctgtgctctggtgctgtcctgccctggtttcatctgttttgctgctccactggacgtcctactggcattgcaccaatttccgcgcagattccaccaatgtcccgctgatcactttggtggattga

SEQ ID NO: 57349 - DNA, 112 bp, Heterodera glycines
  Genomic contig location: Contig_ID=SeqID_26607; Location=1469..1580; Strand=+
  SCN-specific regions: Sequence locations=1-112
agggtattggagtccgtcatttttatttgtttgttatttatttgctgacatggctcaattagctgttgcagctcctctgccgccaacgacaaatgcaacagcggccactgct

SEQ ID NO: 57350 - DNA, 724 bp, Heterodera glycines
  Genomic contig location: Contig_ID=SeqID_26608; Location=529..1252; Strand=+
  SCN-specific regions: Sequence locations=1-108,130-724
atgccgattttgttttttcactcgccgaaatggtcgttggatagtcgaatgcaccaaatttggaaggcacaggcaatgccaaccaaattaacaccgactgactttccctttaccattttaggacaattttacgcgatttcaacgccgatctctattggtgatgtgagaggaaagactaaaaattattttcgaatgtggtcgaatttacaaataaaatttgttgtagaaacaaaccgaaagaaaaacgatcgaattgtatgaaaatttttctattttatttcaaatttgttggaattttgaccaaacctttgcgtcacggtaaaaaataatggtgcccataaaaatgctgtgagacgtataaaatagattgggtggggtgtctttggagagtgtttgagtttgtgttcctcctcctacccggtgctgctggtgtctctctctgatgaatgcgtttcgtcccaatgtcccccgtccgcaattggtgctgcaattgcattaagttgaggtcgcgttgacagatgagtgctccccccgtgttggtgtattggtcgccttttgcaagtgcatttccgcagcacgaacatttgaagcagtgcgtgtggaacacgttgaacagtccgctgcggaagacgagttcggccggttcgattggaatggcacagcgggcgcagttaggctggcacgacgaagtgccgaaagatctgtcgggggcggactttggtaa

SEQ ID NO: 57351 - DNA, 196 bp, Heterodera glycines
  Genomic contig location: Contig_ID=SeqID_26608; Location=1034..1229; Strand=-
  SCN-specific regions: Sequence locations=1-196
atctttcggcacttcgtcgtgccagcctaactgcgcccgctgtgccattccaatcgaaccggccgaactcgtcttccgcagcggactgttcaacgtgttccacacgcactgcttcaaatgttcgtgctgcggaaatgcacttgcaaaaggcgaccaatacaccaacacggggggagcactcatctgtcaacgcgac

SEQ ID NO: 57352 - DNA, 514 bp, Heterodera glycines
  Genomic contig location: Contig_ID=SeqID_26609; Location=996..1509; Strand=+
  SCN-specific regions: Sequence locations=1-18,40-277,299-399,421-514
atgatggctttcggtttgtttttaacccattttcttaaacattgatcaaatttcgaaatttgatttttctgttagaattcgggtccataactccgggtcccgacccgttcccgtgcaactctacttctattttattgtagaaatttcttatcgatcaaatcaacagaaaatgagtgagtgattggatgagagcgcttatccatcggtcaatttgcgctttgtccctttttcttcttccacaataaaatccatggacaatctcactatgtccgcttcactgtcataaaatcctttggtcggatccatcaattccttaatttttgcaattttattaagcacaaaaagctattttgactgtcactcactgtaaaagtaatcattataagtccccagcaagtcgatttgttgttaaaagaatggtcaaattttttagtaaaatcctccgttcctttcttttgtgaaacaattcgaaaagtggcagaacatttgcagctccaatctccatcttaattaa

SEQ ID NO: 57353 - DNA, 2990 bp, Heterodera glycines
  Genomic contig location: Contig_ID=SeqID_5230; Location=383..3372; Strand=+
  SCN-specific regions: Sequence locations=1-263,285-382,404-915,937 -1604,1626-1924,1946-2600,2622-2990
ctaaaaacagcggttctgttcaacaagaagccagtcgaattccatctcgacacggggtcggacattgtcgtcattgatcaattgacgcacgaatatgttggacgaccaccgatcgaaaaatgcaacgaaattggcaaggctttcgacggcacaaaaatttcctttattggaaaaggattcggtacattcaaatttggcaaaattgaagtggagcaaacattttttgttgccaaagcaggctcactaaatttgttgagctgcaaaatgatggatttatttgggcttttagacgaattaaagctgaagatcagcaaccctgcagtaaatgcatgccacgcgaatggcaaaaaggctgagaattttatcccgaatgaagcaacgcagattgctgggacaggaaccgaaattcaagccctggaaaaagaatttcacgaaattttcagtgaagaattgggccattgcctaaaggagaaggctcatcttgccctaaaagatgacgcaaggccagtctatcgcaaagcccgaccagtaccctacaattcgttagaggtggttgagagcgaactgagccggttggaaaagatgaacgtcatcaacaaagtcgaacatttggagtgggccgcacctattttgattgttaaaaaggctgacggatccgcccgcctttgcattgattactctacgggcctaaacgatgcccttctcgactgccaatacccacttccaataccggaagacatttttgcgactctaaatggaggaaaaattttctcacaaattgatttgagagacgcctatttccaagtcgaattggacgaaaattctaaaaatttgtgtgggctggcaacccacaagggcaattaccggatggaaagattaccgttcggtgtaaaatcagcccccgccatatttcaatcaattatggataaaatgttggcaggattggaatttgccaccgcctatttggacgacattataatcgtcagcaaaagcattccggaacacaccaatcacttaaaagaagtttttggtcgaattcaggcatacggattccgcgtcaaattggcgaaatgcaaatttttccgtgatcaaatcaaatatctcggacagattatcgataaaaacggacgccgaccggatccagcaaaaatctatgcaattagccaaatgcctgcaccaaacgacattccatctctccgatcattccttggtatggtaaatcattaccaacaatacgtcaaaaacatgcggttcatccgaaaaccgctcgacgatttgcttaaaaaggaaattgattggagttggagtgaaggatgcgaaaatgcatttcgaaaaattaaggaaattttggcatcagatttgctgctaacacattatgatccaaatatggagatcattgttgcagctgacgcttccgaattgggcatcggagcggtcatttatcacaaatttcaggacggaaacatcaaagcaattgcccatgcttcaaaatcactcgcccctgcggaaaaaaattattcgcagattgaaaaagagggcttggcgttaatttttgcagtacaaaaattccataaaatgatttatggacggcatttcactctgcaaactgaccataaaccccttgtcagtatttttggcagcaaaaagggaattcggcagtgcagtgccaatcgtcttcttcgctggtctttaatccttttggcctacgattttacgatcgaatacatcaacacaaaggattttggccaagccgatgcgctctcgcgcctaatcgccaaaggaaatgagaccgaagacgagaaaatcatcgccatgatcaatgccgaaacggattttgaaacaaattttggccaaacaatttcaaaattgccattaaaattttcggacctagtcgctgcttctgagcgcgatgaaaatattattcaagtcaaaattttgtcaaaaatggctggccaaatgaaaaggccatggacaaagaaaaccaaatagtccgtgatttttgtcgaagaaaggaagaactttcaattgaaaaaggatgcctcatgtttggagaaagagtggtaatcccgaaagtcttccattcaaagattttaaaattgctgcacaaaggacatcccggaatgaagaggatgaagcagctggcacgccaatatgtgttctggccaaaaatcgatcaggacattgaagattttgtccgtgaatgtgtgccatgtcaggctgctgcaaaagcgccaattaagacaaatttacagtcatggccaaaaacatcaggcccgtggcaacgcgtgcacctggattttgccggaccgtttttcgggaagcactttctgattgtggtcgactctttttcgaaataccccgaggtattcgaaatgtcaacaatttcaacggcaatgacaattgaaaagctaagatatttggcttcacggcacggaattccagaaacattggtttctgacaacggcacacaattcaagagcacggaattcgccaaatttacagcggccaatggaatcaatcatttgttctcggctccatataatcccatgtccaatggacaagcggagagatttgttgacacgtttaaacgtgccttcagaaaattaaaaggggagggaatgtcatcagtgaaagaaataattgagacatttttggtcacatatcggaccacccccaatgattcgttgccggactcgaaaagtccagccgaaatgctcctgggacggaagccacgaacaactttggacctgctgaagccgcctccaattcagccgatcgaacgtgatcaggcaatggagaagaaattcaatcgccgatttggcacgcgtcctcaaattttcgcttcaaaggacgcagtttgggcccgacatcgcctttcacaaaattggaaagccggaacgatctgtgggtgttccggtgtcatctacaatgtccgatttgaagatggatccagcggtcgctatcatgcgaatcagctgaggttccgaaag

SEQ ID NO: 57354 - DNA, 519 bp, Heterodera glycines
  Genomic contig location: Contig_ID=SeqID_26610; Location=258..776; Strand=-
  SCN-specific regions: Sequence locations=1-519
atgggctttttttgcaggtccaatgtgcttttgcatttagacctcaccatcccgctgcgatgtgttgggtgaggattgccaagcaacccgggaattgttactcaaggctgaacaacttcttgagtgctgttcacccgccaaaaaaccttacccatgtacatgcgggcgtcgttcccctcgcgttccattagtgtgtttttacttaattatttaatctcaatcagattaaaaatatgaaaattttaattttcagggtaagtgttctcagtcacactccatggtgaaaattgctttttaaatcagaatcaatagcggacatcagcaaaagaaagggcgacccattggaagctgatgacatattgtacacaaaggaagatgcgcaggaaatggttgacgaatttttcgaaggtgaaaatgagctatgatattacatatctctatattttatgatagatattcttcaaaattggtaccaaattttgaaccctttttatacatatttttggcagtcctaataaa

SEQ ID NO: 57355 - DNA, 83 bp, Heterodera glycines
  Genomic contig location: Contig_ID=SeqID_26611; Location=348..430; Strand=-
  SCN-specific regions: Sequence locations=1-83
atgcacagctcccatcaaatccacggcattattatgggaatccgggaaaatgatatgtctggggacgaaaagtctgatagact

SEQ ID NO: 57356 - DNA, 597 bp, Heterodera glycines
  Genomic contig location: Contig_ID=SeqID_26613; Location=39..635; Strand=-
  SCN-specific regions: Sequence locations=1-251,274-597
atggcactcaacccaccaacatttcaatcactggcactcaacccaccaacatttcaatcactgggactcaacccaccaacatttcaatcactgggcactcaacccaagagcatttcaatcactggactcaacccaccaacatttcaatcactgggactcaacccaagaacatttcaatcactggactcaacccaccaacatttcaatcactgggactcaacccaccaacatttcaatcactgggactcaacccaccagcattccaatcactggactcaacccaccaacatttcaatcactggcactcaacccaccaacatttcaatcactgggactcaacccaccaacatttcaatcactgggactcaacccaccaacatttcaatcactggactcaacccaccaacatttcaatcactggcactcaacccaccaacatttcaatcactggactcaacccaagagcatttcaatcactgggactcaacccaccaacatttcaatcactggcactcaacccaccaacatttcaatcactggactcaacccaccaacatttcaatcactggcactcaacccaccaacattcaatcactg

SEQ ID NO: 57357 - DNA, 1275 bp, Heterodera glycines
  Genomic contig location: Contig_ID=SeqID_26614; Location=854..2128; Strand=+
  SCN-specific regions: Sequence locations=1-105,128-706,728-748,772 -1239,1261-1275
gttttgatgcaccgcggaatcgtgccaaaagtggtcagtctcaatttattgggatggagttacgccattcttttatcattggggaataaccaacaaatgtgatcattgatttgaacaaagcaaaaaattaataataatcagttggatgatcaatcatcgggagtctcgagatcaaacaattcttagtataaacaatgattttgattagttatcagtgggggggggcatatttaaattttaaaaaaacgacgaaaaatgtgtatcattttagccaaaaagttgctacgtttttcaggcgttccgttgccctccccccggcgcatttccaacgcggtgcacgtcgaccgcgacttcagccatgccaagttcacacacatggtcatgcagttcggccaactgttggaccacgaactgacccactcgcccatccaccggggaccaaacgacgaaattctgaactgcacgcggtgcgactcgcacgagacaatttcagtgcattgcatgccgatcagagtggagcgcggcgatccggtacggtgcgggggatttgataatttgatttattgaaatttacaaaaaaaaataatcagaattcttattgatgtaaaaaattcgatctaacaaaacttcaacaataatttgactgaatttgatattgcatattctctaattggattaatagcttcaataaagtccattataattagggattggatttttatgttttccctctttttttcttgtaaaaatgttcttttggggcttttcaggatcttattgttagcagttcttttgaacttttccaatattttaagtataaaaatgcaatccatcgttataattatcccatttttcggtatttttatacaaaattcaaaatcattgaaaatttaaaaacctattattgttaaagatcattttccattccctgcagcactttcccacccatttgccaaatggggagccgcgctgtttgcccttcgcgcgctcattgcttggccaactgacgctgggctatcgcaatcagatgaaccaaatcacagcttttattgatggttccgtggtcagcaaatttttttaatgggacccgaaattatacgttaattaaatgttcattttctttcattatttaaattgaccctttcagctgtacggctctacccaatgcgaggccaatcagttgcgtctgttccgccaggggctgctgaacttcaccgaccttggcaattggaatccgatggcattgccccagggcaaccaggagaaggattgccg

SEQ ID NO: 57358 - DNA, 594 bp, Heterodera glycines
  Genomic contig location: Contig_ID=SeqID_26616; Location=267..860; Strand=-
  SCN-specific regions: Sequence locations=1-507,549-594
  Gene Ontology: Mol. function=transcription factor activity; Biological process=regulation of transcription, DNA-dependent
atggtgttcgacaaccgtaggccgcacaacacgcaggtgctcgagaagttcattcgccaggagatgggggccgagacaatgttcagcgacctcaaatggccaaggttgcttcggtgttcccaaaatgtgtcagggacatagcatcgccgaaaaaaatctcggaaaaaaatccttggaattttttttttgaaaaatatgtgtcgttgaaagcaaaaaaattttttgtaaaatttcttgaaaatatcttctttttttttaaatttcggggacgttgccgaaaaatatttatatgggaagataaaatttgaaaattgaaattatttcctcatttaaaaaaaaaatttccagacttatgttcaccaccacgcgggccgagttcttcccggttcagctggagctgatgcgcaactacaaactaccgacaaatgacgaggagaatgaggagctcggctaccggacgcccgacgatttgttgctgtggaaagtgttaaggcgttcatcggcgggtaaaaaaaaaattttttttttaagttacaaaaaaattttaagcccctacctactttgccagtgtggacaacaaatacattgatggag

SEQ ID NO: 57359 - DNA, 735 bp, Heterodera glycines
  Genomic contig location: Contig_ID=SeqID_26617; Location=416..1150; Strand=+
  SCN-specific regions: Sequence locations=1-157,225-404,445-735
atgatttctacaaacgatgacactgattcaagttggatagccattgacaacggtatgtacctgagtattttccttctgaaattgttttctctgcaccttcacattggccttgcgttctataagccttacaaaatttttgccaatctttgcttgtaactaaaatttaaaattgaaaagaacaaaaaaaattgaatgttaaaaatatatttaaaaagtaaaaaaatcgagttgggtaatatttttgagtttagtttaatatccatttctagatcttcaatttttttacagtcacagtgctcctttatttttgtcttaacataaaatatttaaaaaatgattcggaattcaaaatttacgcgtttaaaatattttggatgaaaaaaattttgccagaaagaaaaccctgaaaatatttgctattaattagaataatttatttcttaattaatctgcgggaagtgctaaagaaaaaataattcaaattcacatttgttcgttttaaataaagaagtaattcctctcaatccgtgcgacacaaatttgtttgatttggtcaaacgcaggaattctccgcccaaaatagatcggttgccgaatccatggcttccgtttttcccgttcttaaatgggttggacgacgaactgcttgaatgggtattgttcgagctatgaaattgagtttgataagttgccgaatttgtttgattggggggctgaactccaaacttgtcacta

SEQ ID NO: 57360 - DNA, 633 bp, Heterodera glycines
  Genomic contig location: Contig_ID=SeqID_26619; Location=476..1108; Strand=+
  SCN-specific regions: Sequence locations=1-96,126-633
cacagctgtccgatctgttccatgcccgagtcatcgccctgtccgtcgccaatttcaagctaaaaagcgtgcgattaaaatcattttagcgcatttggaacttccccccttttttcccctcttttgtccccacttttgtgccgtccccgccggccatcccctgctgttgctgatggaccgaaatggaggcacgccgtgcactgacgccgccctgctttttgaactctttgcggtagtaataggcggcaactgcgggcggaatgttgaatttacgggccgcggcggtggcgccatggcattggacgtaactggcgacagtctgaggagggagagaatatagggagggaacaaagccaacacactctgcacaaccccctaccattaaacccatctgttcaaaaatgccaagaaaatcgccaaaatttgaaatcgcccgagaatggcacagacgggcaaaagcccccccgggcgagcctcatccgttcggccacacctttttctcctccggcgtgcagtatttagagcgtcggccccgcggtgccgattccgcgccgcttccgctcatgtcggcaccgccggcggagaacagactctgctgttgctgagtgccgggcgtcgcgaaggacgacgcgg

SEQ ID NO: 57361 - DNA, 894 bp, Heterodera glycines
  Genomic contig location: Contig_ID=SeqID_600; Location=3909..4802; Strand=+
  SCN-specific regions: Sequence locations=1-255,287-894
  Gene Ontology: Mol. function=sodium/potassium-exchanging ATPase activity; Cellular component=sodium/potassium-exchanging ATPase complex; Biological process=transport
atgcctaaacaaaagcctaaaaatgatatcaacgaactcaagcaggaagtgtccatggatgagcataaaattccacttgaggaattgtttcgacgatttggaagctccaaggataaggtaactttaaatgacctagtcttttcaattgttactatttcattcaaatggttactgttgcttatgccagggattgaccaaagcgaaggcgaaggaggtgtacgaccgcgatggtcccaatgcgctttctcccccacgaacaaccccagaatggatcaaattctgcaaaaatttgtttggcggctttgctcttctgctttggattggtgctatcctctgttacattgcgtattctgtcgattgctttaccatggaacgaccaagcaaggacaatgtgagttcatgtccaatttagttttaaccaatacatttccagctttatctgggcattgtgctgatgtctgttgttatcatcactggctgcttccaatattttcaagagcgcaaaagttcgaagattatggaatcattcaaaaatttggtgcccacttacgcattggtcattcgtgatggggagaagacgcaaattccgtcgagtatgttggtggcaggcgacgtcgtggaagtgaagggaggcgaccgcgtgccagcggacattcgaattgtgtcggggcacggcttcaaagtggagtgagtgctgtgtttgtctaattgctaatggttttggtgcttttcacttgaagcaattcttcactgaccggagagtctgagcctcaatcgcgttcggcagagtgcacaaatgagaacccactcgagaccaaaaacattgcatttttctcgactaatgctgttgagggaaccgcgaccggagtggtcatttacactggggacagaacg

SEQ ID NO: 57362 - DNA, 443 bp, Heterodera glycines
  misc_feature (92)..(92): n is a, c, g, or t
  misc_feature (116)..(116): n is a, c, g, or t
  Genomic contig location: Contig_ID=SeqID_601; Location=1814..2256; Strand=-
  SCN-specific regions: Sequence locations=1-233,272-275,302-443
atgtcggtgccaagatcgatgcaaagaatggtcacagtgcgagagggaagtggaatgccgaacagaacatacatcaggaaaggtaagatctntaaaatggaagtttttaggaaacntaaaaaccacaacctccggaatgttagagctgatcgtataagcaatggacttttttaaattatcgaaaatgagacggccttcctccacgccggtcacaattgactgaatgttcaaagaattaaaaaataacaaacaaataattataataataaatcacagcaaagttgtcgtccagaagaatcatatccgccgcttgttttgacacgtccgacccggcaattcctacaaatttatttcattacgttctccgactttttgcccacccattgccactccgatgtcagcctttttcagtgccggcgaatcgttcactccgtcgccggtga

SEQ ID NO: 57363 - DNA, 1792 bp, Heterodera glycines
  misc_feature (1676)..(1676): n is a, c, g, or t
  misc_feature (1700)..(1700): n is a, c, g, or t
  Genomic contig location: Contig_ID=SeqID_601; Location=466..2257; Strand=+
  SCN-specific regions: Sequence locations=1-369,405-442,466-764,801 -1011,1034-1490,1517-1520,1559-1792
  Gene Ontology: Mol. function=sodium/potassium-exchanging ATPase activity; Cellular component=sodium/potassium-exchanging ATPase complex; Biological process=neurotransmitter uptake
atgaccgtcgctcacacttggttcgaccagcaaatcgaaacttgcgacaccactgagaatttcacgggcgacagacacaaggctcgcgagacggagacggcactgttgcgagtcgcctctttgtgcaacagggccgagttcaagcctggacaggtcggaatcggcgttaaacggaggccctggaattgtttgtttaggattcggttccgattctcaaaagggaatgcaccggcgatggttagacttttgccttatgattaaattaatcattgacaatattccgttccaattttagcttcggaagttgctctgctgaaattcacagaaataaccgttgggaatgttgttgaatatcgtcaaaagtatcactttaatagcatttttgtgtaacaatacaaattttagacatcgaaaaattgccgaaattccattcaattcgactaacaaataccaagtttttcttttattacatcgcataactctgtttatttgctttcagttgtccatccatgaaaccgacgacggccaccccggttatttggttgtgatgaaaggcgcacccgaacgcattttgcaacgctgcagtcacatgctgcttaaaggacaggtgggaaatggtaccgacggaacagattgacacatttttaattaaggatgtggagatgacccaccaaatgcgcgaagacttcgaacgtgcctatttggagttgggcggaatgggcgaaagagtgctcgggttttgcgactttcgcttggaccacgacaaatttcccaaggtttttggagtcttaaggttctcccattgctttttatgttttttagggatttgagttcgatgttgaaggccccaactttccgatcgaagggttccgttttgtcggtttgatttcaatgattgacccgcctcgtgctgctgttccggacgccgttgcgaagtgccgtagtgcaggcatcaaagtggtgatggtcaccggggatcatccgaccacggccaaagcaattgccaaatcggtgggcatcatttcggagggcatggaaactgtcgaagatatcgccgttcggaaagaaatttctgtggaccaagtcgacccgaggtcggtgttaacggaaaacggtttgagattcgaaattcagagaagccaaggcgattgtaatccatgggagtgatttgcgcgagatgtaaataattgacccataattgcaattcttccttttttgttttttaggaatgaggaccaattggccgaagtcatcaataaccacgatgaaattgtgttcgccaggacttcgccacagcaaaaactgatgatcgtcgagggatttcagcgtcagggacaaattgtggcagtcaccggcgacggagtgaacgattcgccggcactgaaaaaggctgacatcggagtggcaatgggtgggcaaaaagtcggagaacgtaatgaaataaatttgtaggaattgccgggtcggacgtgtcaaaacaagcggcggatatgattcttctggacgacaactttgctgtgatttattattataattatttgtttgttattttttaattctttgaacattcagtcaattgtgaccggcgtggaggaaggccgtctcattttcgataatttaaaaaagtccattgcttatacgatcagctctaacattccggaggttgtggtttttangtttcctaaaaacttccattttanagatcttacctttcctgatgtatgttctgttcggcattccacttccctctcgcactgtgaccattctttgcatcgatcttggcaccgacatg

SEQ ID NO: 57364 - DNA, 765 bp, Heterodera glycines
  Genomic contig location: Contig_ID=SeqID_602; Location=116..880; Strand=+
  SCN-specific regions: Sequence locations=1-117,139-716,746-765
atggctgacaacggtttttttccaaaggacctttaccaattgcgtgcgcaatgggattctcgtgggattaacaatctcgtggacagttacggacaagaatgggtagatgattaatgatcaacaaaacttcctttttatccttatcatcaagataatttaagacttacacggaccgaaagattctcgaacacacttgtcaaaccgccttcttcgttagcattggtacgattttttgtgccaaatcaaaaatttaaagaattccttcaaaacgacaaaccgagctatctaattgtattccgtttaagtgattgtccaatgggccgaattggttatttcgaagactcgtcggaattccattgtccagcaaggcatgtccaattgggtgttgaacttcggcttggtctttgagactttgttggctgttttcctctgctactatccgggtttggacacaagtctccgtatgtatggacttcggtaaatcgctttttatcattttgtccacatttttatcacgtttcctaaggttctcttggtggttccctgcactgcccttcgctattctgattttcatttacgatgaaattaggcgctttttaatccgtcgtttccctggcggatgggtggagagagagacgtactactgaagaatgatgacggtttaatgtgaagaagttctgcaaaacataaaccaaagcgttttttcagatcaaatgtaattggtatgtgtgtatgttattgtataatttggctgttattctgtaa

SEQ ID NO: 57365 - DNA, 1595 bp, Heterodera glycines
  Genomic contig location: Contig_ID=SeqID_602; Location=2023..3617; Strand=-
  SCN-specific regions: Sequence locations=1-444,467-527,601-726,749 -858,880-1595
aaagcgattggatgttttccgaatgcattggcgaattacgcgaaatcagttgaaagtcatcgagaacaaacaggtcatttcattcatccatttccactcggcatgacaaattaaggataattaaaggacccaataggtcgttatcatcgtaaattatggcacatttacgtaaaataaaacggtttcagtcaaagggaaagggcaccggacttggccaagaaggcgcgtggagcaaacggcgacaattgcaagcgtacgctttgattggcacgaacaaagccgaattcattgtgttgcggcagatgaaaagcataagttgggaaaagacggacctgcatttcattttcgaactgaagcggctaaaccacgacaatttggtcaaataaaagagaatttaaaaatcggaccaattcattggctctttataataattgtcattgatagaccacattcatgggcatctcctacaacgaaggggaccgcttttacatgtgccattcgctggtcgaacgcggcactctcgaggtgagcgagagagagaggaagtgagagagagagaagagaaagagagggggcgagagaagagagagagagagtgaggacggcacggaaaagcttctcaattatttgctaggattacatcaacgactttgacttccaattggacaacactttccgctctgcctttctccgcgacattctcaaagtttcaatttgctgatgattctttctccccctcccctccttcacaaaaagggcatccaatatttgcacaaatcctccgtcggataccacggcctgctgaacctgcaaaatgtgctgatcgactccaattgggtgctcaaattgaccaattttggcatttgcaatttgctaaactgctgtattcaacgcgaacagctcaaattagtcgagattattccaatgacaagtttgaaagcatttcactgctcaaaacgatgctttcctttcagcttatttaaccatcgctccggaaaatcttagtgaaattgcctatggcagggaatatccccgcggcacgcccttaggcgacgtgtacaggtccaaattcatttatttaatgcccaattaaatgccactttcagttttggcatggctctttaccacattttgtttcgtctcgccccgtttgatcgcacaactttgagcccgaaagagatcattgaggaggtgaagcgaagaagtctgaagccaatcctggagaacacttcgccagaagagaagccggcaattggagagaaaaacggcaaaaggcgaaatgattgttttttgacagttagtggacgcgatggaacagtgctggcagaggaaccccgaactgaggcccaaactccgtcatttggcccaagtgttttccaacgtgttccaggcaaaaaaatgagagggggtgggggaggaaagacagaacgaactcaaagatgaaaactgctgacaatttaggcatcgcagggcaatttaatcgatcaaatgcgacggatgaacgaaaagcacgcgctgaatttggaaaatttggtggcgcaacgaaacgcggaactcgcggtggcacgagaagagacggaacggctgctgcatga

SEQ ID NO: 57366 - DNA, 833 bp, Heterodera glycines
  Genomic contig location: Contig_ID=SeqID_603; Location=733..1565; Strand=-
  SCN-specific regions: Sequence locations=1-153,175-177,199-506,528-833
atgcccttttccgtggtactgctccaacttctccttctcctcccttatgttctgtccttgctcaaagtcggcctcgtagaatctgaccctttgctcgtcgccctctgtctccaggctttgaccgacgcgcgcgcgcagggaaaatgcacgacggaagagattcagtgagtgaatatttggaaaaattgaaaaaataaatggcaaaaaattagggggggggggggggaaacaatgcgaaggcaaaccaacggaggagaaacaacgacagccctcggactgttcaccccccccccccacagaatgatgaatgtctcttgcggctgtggcactttgtccgacttttcgtccatcagtgaaaaccaaaacaaaagcgcctcctttggcactgtccacgttggcgagttgtatttctaccaaaatgtgcaagcttttgtgggcagtcgctgtgcggaggaggcgcgcgagttgggccgacttgcccgtttctggcgaggcaaaaccatctgtctaattgttgaaaatattttaactcattagtgccggtaattaaccgcgtcggcaccagcattgctttacttcgtcgagagcttttccccactgtcgtacaagtcacagacacaaatgtgtacggaatggcccaagcggtggcccaattcattggcgcgatgaaccaaagcgaagttaaatgttttaggccatatttgtttaatcgaattcttccgctcagattgttttggtcggtccgatcaatacggacattgaaaagccgcctttgtggaagagtttgtcacaagtatttgcggaacgctttaacggaatccagcaaagactga

SEQ ID NO: 57367 - DNA, 1319 bp, Heterodera glycines
  misc_feature (851)..(851): n is a, c, g, or t
  Genomic contig location: Contig_ID=SeqID_603; Location=2208..3526; Strand=+
  SCN-specific regions: Sequence locations=1-34,68-143,166-235,268-1319
atgccattatcccctgtcctcattctcttccgcttccttccgcttttccttctcctcctccttcccccagccgttgttccgcttcagtgttttcaaactcagcattcgctttccgcttctctgcagggcaatgccctcagctgtccctcctcctccctctcttgcaccaaatccaccgatttcaacatgcaaatcatcgcgcgcacctgtcaaagcacaaattgcacggtgagaaactaaaaatacaaaaagaaataattaatttctttgcggttggccattgattgattaataattacgtttagttccccaacggcactctctcctccgtgccgttgtgcttcaattcgtcctcaaatacccagtcgtattgctgctgctacggcgacagttgcaacggaatggcgaaggaacacaaaaatggactaatgaccttcttattgttgttcttttgcattttaatgggagcgatggcaatgaaaaacaaaatttgaaggaaaaaggcaaatattaacagagataaaaatgataatagacaattcaaatcagtagggaaaagtaaaactgatcagaaagagaaatgtacatgatcaatcgatccaaactagaattgaatggtcactgatcaaaataaaaatcaccgataagtcttcaaatgaaaatgagctaaattagtaacgacagaaaaggaccgaaaaaagcaaattaattggtggtgccctaatattgtcgtgttatacttcaaccatatatcgggtgctttcatgctcttatctcattttggcactcaataacaagtaatggctctcaagtaataccagacatctcgcccccagcggatggcgaagtgngcgaaggtggaacactttcggaattggacatttgcagactttccaaaatatcattaaaaggaagcaaaagaaaatcaaaaaaataaattatagaagaataacagcagtgaaaggaatgaagaaaaacagtgtttatcattctgcaggcaacaaaatcaacaaaagaacgccgcatccctgtgaagaatcaacgttcacaaattttgcggaattattccatccctctgagccaagcgcagaatgcaatcatccgactcgccctgcgaaaccgaatttttttaatataaatcccttccaattacgaacgactgaccatgaagcgcaactttccacaaatggcgtacttcgtcgttttgccggtaatcattcgcccagtcgcctggtccacctcgacaacctccaattgaatagaagcgtggtctttagccgaaatgattcgagaagacgacgaactgacaagaaagaaaa

SEQ ID NO: 57368 - DNA, 158 bp, Heterodera glycines
  Genomic contig location: Contig_ID=SeqID_604; Location=652..809; Strand=+
  SCN-specific regions: Sequence locations=1-92,115-158
atggctgtcaaagacgacccaccggaaattaggggtaagttgtgggcaatcatgaagattatttgtcccacaaaaaaaaaaggaataaaaattcaaaaaacacttttttaggggttatttggtgcgctgagcacgaatttgaccttcttttgacttaa

SEQ ID NO: 57369 - DNA, 1189 bp, Heterodera glycines
  Genomic contig location: Contig_ID=SeqID_604; Location=110..1298; Strand=-
  SCN-specific regions: Sequence locations=1-221,243-245,267-424,447 -651,673-874,896-1189
atggccgaattggacaaattgatcagtgagacgaaagtgaagtgtaagtcacacaaaagtttcacaaaagcaagttttgtccaaatttagtcgataatgatctgaaagaattggagctggccaaacgccatttttctttggattttgtccaaaggatggaaacggaattcgcgaaaatttttccagaggtaattagacgatgggagtagaaatggtttgccagattgaaaagtctcttcagcttctaaatggaacttcctaaattcaccctttcgaaaacattaggttactaaatttcaggggtaacatcctaactcctctctttatcctggttttaaacaatgaaaatcttacaaagtcccctgatcatgtcccggttttcataccaactgaaaaaagttgccaccaatggcaatgcatcagcaatatttgcaaaaattgaaaatttgaattttttcaaatgttcgaatccgggttcggggttcgaaattaagtcaaaagaaggtcaaattcgtgctcagcgcaccaaataacccctaaaaaagtgttttttgaatttttattccttttttttttgtgggacaaataatcttcatgattgcccacaacttacccctaatttccggtgggtcgtctttgacagccattggttttatttatatttgaatatttggctaaattaggaatggtcattaaaaaatgattaaacgaatatatgaagcgattaaatgaagtggtcgaaataataacaataataccgatggcgcccctcacttttcggcaaaagaaaataggtagttgcataaaatgttagtatgaagaactcaaaaatggtccaccttttatacactagctaaggaaaaaaaaagaattaaaaatttattttcctttattggcattatgtttgtactataaatcaaatacactgatgcacagcttttggaatctgagggttaagtggatgaataacattttcgtctccaatccttttcaattttgaacgtcacttttcatctagagggagaggagtatttctttcactttacttcaattttagatgtttgaatagcgaccgaatatgctcaggaaaaccataaaaacacttcaaccgatatataacgccagaacagcattccgttttcagaccggaggttatgctgcgcctggtactgaagcacaagcacaggaa

SEQ ID NO: 57370 - DNA, 464 bp, Heterodera glycines
  Genomic contig location: Contig_ID=SeqID_604; Location=1818..2281; Strand=+
  SCN-specific regions: Sequence locations=1-218,240-352,380-464
atgattgaaacggaaagcatcgacgagttggaggaggctgcatttggggagcatagtgaacgcgcggagggacaacgccctggcggacggtcggacgacgccaatttttacggtccctccgcgcggcgttcgccttcctcaatgaccagcggtggcagaggcacaacaacagtccacacacgcaatttgctcgctttttggtgagttatttgttcttgcattttcaaaatggaaatttagcgattccaccgtcaattttagtgtacaaaaaatcgcattcttcacaaattcgatacaaagcaatgtagaaaaatccaaattttaggctcttaggcctttgcaacaatttcggttacgtggtgatgctcagcgctgcccaaggacattttggaacggtcggcaacgctgcaaaacgacacggttctatgcattataaaacgaatcaaacttttgaatttttataa

SEQ ID NO: 57371 - DNA, 220 bp, Heterodera glycines
  Genomic contig location: Contig_ID=SeqID_605; Location=78..297; Strand=-
  SCN-specific regions: Sequence locations=1-220
atgaaaatgggacgaaagcgacaggtaagtgacttcgccaagtccggcaccaaagctggcaaaaattacgcctaaaattgcaaaaaataaaaaattgaagtttttttgctatttcgaaccaagcaatccgacggagaaagaagtggaaaatgcgacaattatgaagctggttacctgcagaagaatgaagtattaggaaacgaatcgagtggcgaataaa

SEQ ID NO: 57372 - DNA, 862 bp, Heterodera glycines
  misc_feature (580)..(580): n is a, c, g, or t
  misc_feature (712)..(712): n is a, c, g, or t
  Genomic contig location: Contig_ID=SeqID_5231; Location=2771..3632; Strand=+
  SCN-specific regions: Sequence locations=1-750,772-862
ttgcccttattgtcctcttttcccctccttttccctatttccgttgggcgaatgcttcatttcattcaatttagcagatggctttccatcaataatgttttaggaagatggggacaaactttgcttgggttttgcttatgctcggcgagggaaaaagaatgcatgggaagggagtggaagagcggcagagattgccttgggcatggcaatggaatggccagagggaataatgggcggctcttctcttttgttgggccgtgcctttttgagaatttggtaaaatgccgggaagaaaagagagtgtttaacggaggcaatgagagagttttcatctcaccataaaaacattctatgcccaaaaggatggaattttcatcttagatttctctcccatcaaaattaaatcagaaaaaatctgaaaaagtcgtagtttcttctgttcgaatggatcgtctctcgtggtatcagacgggcgagtcgatggaggaaattctctgccaagcgggcagtgttggcatttacgacggggacctcaaacaggtcgaagcaatggactaccatatgatttatttgaatttanaaacaattgtgcatttaagtcgtcgttcgaacagggcaccgcttcactgacttatcagcgaatcatttgggccgattcgactgatccggtgggaagagagagaccggttttgagtttcgacccccaaattanaggattgtcgccttgttcttcaccattcgatggtccacaaaatagaaaaacagcacaaaacaatgtttggacgtggcggcaaatcattgtgacggtaaacccgtgacgcctggccacgcgcaagggcccatcgcgcgagcggcacaaatt

SEQ ID NO: 57373 - DNA, 1338 bp, Heterodera glycines
  Genomic contig location: Contig_ID=SeqID_5231; Location=1087..2424; Strand=+
  SCN-specific regions: Sequence locations=1-750,773-1059,1081 -1100,1122-1228,1251-1338
  Gene Ontology: Mol. function=zinc ion binding; Cellular component =cytoplasm; Biological process=negative regulation of transcription
atggacgaagaacaatcgacaagcaaaatactagtatgtcacatcaccactatgaatgccacaaaatcaccgtccaaagactctgatgagaaggtgcacggagacgactggtgggacgactattgctacgtgtgctcccagggctgtgatgaaacgacgggctcattgggttgttgtgacacatgccctaaggtgtttcacgccaaatgccatgtgccgatgatcaaaaagactatggaggaattgccgtaattattgtctttcttgtttacatgggttgcacttttcttattttagtaatggttggcaatgcacactttgtttgccatgcgatcctctttcgcaaataagtcaatcgtttggagagcgtgaaaaattggtatacttttaagaatatgtaaataattttgactttgtaagtgcttcttgctcttttagctttgctccaaggtctatttggcatgttttgtggacttttctaatgtcgaacactttctgaacgccgtatcaactgccgaatccgattactattcggttatcaaagaaccgatttggttcaacaaaatagcgacgaaaatttcttcagacgaatacaaaatgatttctgaggtgctttttgaactttagagaatctgatttaacaacaatcaattacagtttgttgaagatatgaatcttttgttccgcaattgttcaacgtttaatctggtgattttttttctacgataattatttacttaaccaaaaaatattttcaaatgaattttataatttttccaacggcacctattgataatatggaaagttatctagttagataaaaacctttttgatggatttggaaattgcaatgaaatgccatttcagtgtgtatttaaactgggcattctcacttacaattagtattgaaacgggtgaccccatagggccctcgacaatgggaaatgagcgaaactgagttgttcgattggttaaaattggtgtggcttcaaatctgtccactgcctgtctgtgcaattatttttccaatccccccacccctgccgattagtcttaaaagcttttatttaagcccacaaatcctttgtcaaactctgggaagaaggtttacacattatatatgaaagcgatgcgcgaatttttgccggcttatgagaaacaaatttggatttatgtgtctttatataacggaagggtttctgttgcgagttcggtgagtctacaaaaattactattttcattcaacttttatgattatttcagaatgacgaagaatctgtgcgaaggcgtggcggcaaacgtggaggtcagaaagcaaagtcacaaacgccgtgttga

SEQ ID NO: 57374 - DNA, 1066 bp, Heterodera glycines
  Genomic contig location: Contig_ID=SeqID_5232; Location=1..1066; Strand=+
  SCN-specific regions: Sequence locations=1-96,119-279,317-360,382 -528,550-699,721-723,745-1066
tggctgaacaacaccaacggacacatgaacacatcagcgtcgcgggcatggatcagggtgataagtaggggaattaacaaaaagttttgaaaacatatatttaacagcattgaatagagtttgcaaattctctattccgaaatggacatcttttaaggcttttgaagacatgagcaaactgatggagcaggccagggaaatggtcgtgttgtcgaagaatatcaccgaaagattgcgacaaaaaaagggcgaaataacggaggacgaggcaatcaatgcatttttacttattattatttttcaataatataaatttgacattgtcatctctttaggccgaataataggagcaaactcattaatacctaattgtttttcagactgtccaacttaagtcttatttgctctcgttgggtgttaatgaccccgtcacaaagtcatctttcggctggagttcagtgttcttcgacaaattggcagctgaactcacttccgttttattggagccgataaaagttcgcatttccaatgcaattcaacagtaacaacattaaaacccattcttaggaaagtgggggaacgatgacactccccgaagcattctgccgaatgaatcgggcacgcggaatggaaatgatttcacccgaagatttattgaatgcatgccaaaggctggacaaaatcaattctccgataaggtttttgccagaaaattcaaattgaaaatgtaccttgatgtaacatttctttcttccgttaagtctcttcaactttgacaatggcgtctccgttctccaacttcgctctctcaacgcccttcaaatttccgacgagattctccaaatggtcgagtccgccggtgcaatggatgcttcacaactgtccaaagcatcgggcgtccccttggttttggctgcagaaaggtgtggttgtcttttcaggttgaattggtaattgggttttcgttttatttaggctccgttatgccgaggaacagggaaagctgtgcagggatgacacaatcgaaggattgttcttctacccaaacaaatttcttgacattgat

SEQ ID NO: 57375 - DNA, 2337 bp, Heterodera glycines
  Genomic contig location: Contig_ID=SeqID_5232; Location=2935..5271; Strand=+
  SCN-specific regions: Sequence locations=1-527,549-791,819-827,856 -890,914-921,943-1080,1102-1702,1726-2280,2302-2337
atgcacagttcttatcacaaaagaaattacattgtaagcggcggaggtgggggtggttaatcgttaattgcattttaagtgtgaatatcaccccgaccgatacgcggaccttttgaaagtgcaagaaaaaagcgccaagaacaaacagtcgttgcttgagcaagaggccatcgttgacacgttgctggaggccaaaggattgctgtccccagatgtttatgtgctgaacggacgaagtcaagaatgggccttccaaaaactcggtctcagtagcgaaccgcgcaaagatccattcatcgcagaggaagtgacggacaatcacaaaatcgcactttgttatgtgagtggcattaaagttttaaatttttttaaaattccaaggtttgtggtgagacgttcatttcgttttcaaaagaggaggagttccgcgatgcgtggttttcccatttgtcaacgagcattcaccagcgctgcaaagcaatgcaaattttggttcatgaaggttctttttttgggactttattttgtattgtttgttattctcattgtgcagataatctggtggaatgcgaaggggtccccgctgaatgtgaacttcgaacaaactccgaatttcgacgcatcgacgactcgagcgacgatgaagcgaattatggacctacggtcggactcgactatttgatcatctacaacggttggccataatttcgcctataattctgcaacaattttattctcttcgaatgatggttcatcagtttatctccgactacgaaataaatttagtctgcaaaaaaattaatttttaattaaaaataccgctgtgtattgagaaatgcttttgtattattttttactctcatcggtccctttgctttttctattgccacatttgtaattgttaatttttatttgataatgtttttccatttcattgtcattcccttttctgcgtttgtttccccatttccattcgaaaatttaggcaccgattgcttttgcactctttgcttcaccattcttcccaagtcttcaataaccaatcatttctcatctgagtatcacatagagcgtttttttgtatgttttatttctttaattcattatatttcctgttttgattcagaaaagagatgacccgggcaaacttctgaatacgcaatacttaagtgtgtcggaacggcatggaattctcgaattttgctacggagagttaaaattgtcttcgcataaatatttccgctcgacttcacaaattccgattttgttgcaaaaatatgcgcttcaacaaaggaatgctttggtcaaatacaatttggaggaagttgacttcggccacaatttgaaagctgtttggtgtgaggttgtgttaatcaattgttggttcagtaagtgatccacatccaccattctcacaggagtgcaaagagtatgtgaatacggtgggcgatgagaacgcgtggagcattcacattttcgacgacgcgcacttcgagagagcagcgagaagagcactttatcactatggtcacttcgtttccaagcagtgttttctttttttgaaaatggttttgttttagaaaggtcggtcgtgacacggagttgtgatgtgctggacaatttcgcccattcgtaccctccaatttgggacgaacaattctccgtctcactcggcgtgctttccatccaaagtcgatgtgaatttggcttggagttcatcattcgggacacactcagctccaaattgtactgcacctgctgctttgtgcaatgcgatgacaacgacacgcaaatgttttccaaacacgcgcggtcgctcgaacacatcactcgcgcaatggttcttatttcctcttttgcgcttatttatgccttttaagctttttcattactatacttttttgaggcctttaaacgttgttttcattttcagcactcaatgaacaaaagaaatatgatcacattgagctggcgctttccgaatgcaaatgaccgaaaaccgttggtcatggactacttggtgaactgccggaagaaactgcggcaggaaaaacatggcatttctgtgtacaatccagcattggtctacaaaatgaactgctcgtcagccttgccgaaacgattgtttaagttggctaaaatagcgccgaacgaccggatcactttcattgcggaacacaaaaaaaagagacagcctcgcataggtaagtgggatatttagcaacaaatgccgaatattgactcaaatttacagtccctttaaataatgctttgaatgaattctgcagaattgaggtgaagctggagaagaaagaagtgattgtctgccattgtgag

SEQ ID NO: 57376 - DNA, 1145 bp, Heterodera glycines
  Genomic contig location: Contig_ID=SeqID_26620; Location=374..1518; Strand=+
  SCN-specific regions: Sequence locations=1-192,216-358,380-1145
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcgggggggactgcccccgaaaacaaaaaaaatcgatttttttcaagtgtccgttttggggtactcaaacaaattatgggggagcaaaaatccaacgcagaattaaagtacagactatagggaagctattccggaggattcggtctccccattaatctgggcgcatcggtccggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaagaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaac

SEQ ID NO: 57377 - DNA, 1487 bp, Heterodera glycines
  Genomic contig location: Contig_ID=SeqID_26621; Location=99..1585; Strand=+
  SCN-specific regions: Sequence locations=1-207,268-269,291-345,374 -382,414-422,453-480,502-670,728-729,752-885,919-928,950-973,1003 -1006,1038-1078,1137-1372,1394-1461
  Gene Ontology: Mol. function=structural constituent of epidermis; Cellular component=intermediate filament; Biological process =epidermal differentiation
atgccaatgggcagtggcatgggcggtgacaatggcggcatgggcggtggaggaatgagcggcggtatgccaggcggaatgaatggtggaatgggtggcatgggcggaggcggcgacatgggaggtaagcaaatccttgttgaatccctgatctgatctataaaattacaaaaaaagatcatcacgcattcatgatttaatcctatgaaattaattttctataaattaaatttaattaaaataattaaaattttaatgatttttatagcaaaaatactttattgagaaattttttcggaagattttttgtggtgagagggtttgatgatgtcagggttagcgccgaaaatttttaagattttttataatattagttagcatcgcctggctaaattttgaaattttttaaaaatcaattcgagaatttttataaattatacatttttaattttggttctcttaattttaattgctagaatgattttttaatttcaaggctacggctccaatcagggcggcggtggtttttcaaacggaggcccaagcggttttggaagcgcaggtggagcctccggtaagacaaacgatccgctgatgggtcccgcaattgttgtgccaaaatttgaagacaaataagaatatttccaccaaaaatgtcattttaggaatgttaattatttatttattattgtaaattttgaacgaaatttatataaaaaaattttttggaaaatttcgaaaaaatttaggcaaagaccgagtcccatcggatctgaagaaggttgaagcttccatttctcgcatttttcctggctattttccttcatatagcggctataattcaccctctgaaaattaattactcttgacaatgcaccaaaattgttaatttattatttaaaataaaattaaaaataagaatttgtatttaaattaaattaaattaaataggacaaacgctgtaaaattcacaaaaaccaaaatttttcttaaaaaatttcccgccaaaaaaattaaaataaaatgaataaatattaggtgtaagaataattttggacttctaaattggtgctaaaagatatatttaaaaaataaaattactaaaaaatttattttttattttatttttttaatttccaaattttagggatgatggaaagcgcgcgctacgtgcaaagcgcgcaaggcttaccacccattcaaattccgccatattcggcggaggaggacgggcctgggtcggctggccacaaaaatgcaatgccgccaattcaaattcctccgtacagtgcggaggagagtgatgataagaatgtgaagtcgatcattaagccgttgttgccgggcaattagtgggactaattagcccttctttaaataggcaacaaaacaatggattggattaacgggttaagtgaaaagatgttttgttaaaagcggttttttgagggtagaataacgaaaatatttaatatatttattaaaaa

SEQ ID NO: 57378 - DNA, 786 bp, Heterodera glycines
  Genomic contig location: Contig_ID=SeqID_26624; Location=556..1341; Strand=+
  SCN-specific regions: Sequence locations=1-95,129-171,194-232,272 -279,301-340,362-528,550-786
atgaaaaaagatgaaaaaagtgagcgatttttggcacaaatcataaaattagcttggaccaaaacccaagtaaaaattcagacaaatttattgaactcagatgaaaaattatttttaaatattctgattgattgggtgtggggtgataagtaagcaagctaacaataagccgtaaatatttaaaacattttaacacagaaaaagtgttgcaataactataattgttagtccatttattttttaattaagttaataaatcttttctgaaattgccatcggattggctttatttgtcacttggaccaatgctctttgaacatcgtttggaagaagctgctttcttaaaaaataaattctcagcagaatttgatgaaaaaattaaacaaatttgtgataaacggaataaatatttggagagttacgaggacatgagcattcttttacccaatgtcgacgaaaaatcggtacaattgcgcatattaatgttaattatgagtaattgcacttaattaaccaaattattacataggattaatcactttttcaaagatggagctgatcattgaacacacattggacgtggcggaagacgggaaaagaaatgacaaaaataaactcaagaccatcattgaatggttcaaaaatggagcatggactttagaaaaggagggggattatgattatggattagcttatagccaagacaaacaaaaagcacttaaacgagttagagtcgtagtttgttgaaaatttttggcatcgcgataatttattaattattcccaa

SEQ ID NO: 57379 - DNA, 146 bp, Heterodera glycines
  Genomic contig location: Contig_ID=SeqID_26628; Location=285..430; Strand=+
  SCN-specific regions: Sequence locations=1-71,93-146
atggattgtattgtaactttatcaaattcaacatatgttatggcagaaactgtacttatttcaacttttctaaattgaccaaattttttcaaattttccaggcaaatagagaaaagattggctatcgaatgattcctagaatgtaa

SEQ ID NO: 57380 - DNA, 1008 bp, Heterodera glycines
  misc_feature (1007)..(1007): n is a, c, g, or t
  Genomic contig location: Contig_ID=SeqID_26628; Location=484..1491; Strand=+
  SCN-specific regions: Sequence locations=1-305,350-661,683-705,727 -855,884-1008
atggtggattttacgaaacgacccagcacgatttcatatcacagaatctgtacaaaaatttataatattttaggctttgtttctgtgtgtgccaaaaagccaattccaaaaagtggcattttctactttgaagtaaatgatctaaatgggtttgcatcattgtaagtaattctgattgaacgtatttatatttgctaaagacgccaaatatgtgaatacatatttgcaaccccccccccccccaaatattcgcaaaaaaattccaaaaaggccaaaatatttgtcagaaattgaacaaaaattgctaaaaaataaattaattaatttctcaaaaaagtctcatttttattcatttcgctagcacaatgctaatcaattcaatgttttttgcagtaaatctttttctcgctctctatgattgactaattttttggaattttcttcgccaaaattccaactttggattaaaaagtgaatagtcatgaaaaaggtcaaaaaaataaaattttgtacaattttgggcattttggccaagaatttgggtgctaaaaagctattttttcaaaaaaaaaccgctaaattattattaaaaacctcataagtccaaaatattttttatatgtgcaaaaaatttgagcttttcatgcgctaaaatgttcgcaaaaaacatttaaaaatatataaatccgttccccgtaaatatcccttaaaagttttggaatgcttaatgtttttcagtgcagccgttggcttggcaccaaaagaattgccattgggcgaacgtgccgtatattttgacggcacaaacactgaccagcaaaacaattcatacgaatacagtctgcacagtgttggttttgcttcatcatttttcccaattttcaaaaatttaccatcgcttgaacctggcgatgtgatcggatgcggcgtgaatttgaacactcgcgagatcatttacacaaagaatggaaaacgcataagtgggaaaatgaagcaaaacaaataana

SEQ ID NO: 57381 - DNA, 856 bp, Heterodera glycines
  Genomic contig location: Contig_ID=SeqID_5233; Location=935..1790; Strand=+
  SCN-specific regions: Sequence locations=1-574,596-728,750-856
atgttcatttattactgttgccgaacaactgaaaaatgtacatagcaacttcgcagtcttacaatggaatatcgggcgagcccagtgagttatattttccacttccaaaatccaagacattaaattgtgatggccatggatttgacatttcatgaacctatgaaaaaattcaattggtatgacggtcctgccactacggatgccaatccatggccacagagacccaaaaatgccacaaagttacgaatttttaaacagaatttcctcaaaaaatgtgtcggggatgaatggcatcaaatgttggcacattccttatctttttcaccccattttcccaggttcgtcctctccgccggtcaattggcgttccggcgcattgcgcggtggtcgaaaagtgaccaaagagccggcctacgccttcattttgcccaacttggagcagtacccggccgacttccgccactttttggagcgggacatcatcgaaatcagcacactgagggtcaaacttctgcatttatttgccatttgccctatttttggcgtaaatatgaaatttgagtgccacaattgtcactcttttttccttacagttctccgctgttgctctgttttgatcagtcgcatttcattgcgcttgtcgcaatgcgtcgtcagttaatcaccatcactttgcagggtaaagccatggcggggtcacccgtcaattttccccataattaattgcaccctttttgctttttcagtgattccgatgaccgacaaaaaccgcaatttgccgcccgtccatttctcagtcaattctggcgccgatttcacttggttcaacgcatctaatacggatgattgtcgatga

SEQ ID NO: 57382 - DNA, 1226 bp, Heterodera glycines
  Genomic contig location: Contig_ID=SeqID_5234; Location=2373..3598; Strand=+
  SCN-specific regions: Sequence locations=1-191,213-535,566-970,1026 -1226
  Gene Ontology: Mol. function=ubiquitin C-terminal hydrolase activity; Cellular component=cytoplasm; Biological process=protein deubiquitination
atgtacatagcaacttcaaagtcttgcaatggaatatcgggcgagcccagtgagttatattttccacttccaaaatccacgacattaaattgtgatggccatggatttgacatttcatgaacctatgaaaaaattcaattggtatgacggtcctgccactacggatgccaatccatgaccacagagacccaaaaatgccacaaagttatgaatttttaaaacagaatttcctcaaaaaatgtgtcggggatgaatggcatcaaatgttggcacattccttatctttttcaccccattttcccaggttcgtcctctccgccggtcaattggcgttccggcgcattgcgcggtggtcgaaaagtgaccaaagagccggcctacgccttcattttgcccaacttggagcagtacccggccgacttccgccactttttggagcgggacatcatcgaaatcagcacactgaggcgtctggagaattcgggtcagtgtacagttctcagaatgtctgataggagaaagcatattccccatgattatttaaccaaaattttctagaactattgattggcatcattcagttttataccgaccgttaattacgcttttgttttcaaacgattacaaaaattttattttgtttctgaattttggcgatgtttccaccttcgttgcccaataacttttgatttttccgcaattttctccactttttctaatttgttgcatccaaatcgctcaatttcccctttttgcaggacatttgaattggtggtgtcaacatgacagcaaccaacggctgtggcccctggtgacaaccggcgatggcaattgtctgctccatgccgcgtcgcttggttggtggacgggaaacaaaaaggggggggggcaaatagaataatcttcgaccataactggatggatttttcccgattatcaaatttattgacaagactgccaagaaattcccaaatatttttattccttttttggcattatgttaaacaaaattaaggcatttggggtgtccacgaccggcagctgaactggcgcaacacgctgcacgatgtgctgaaattcgggagccgaaaacatgccatctaccggcgttggcgttggcacgagtccaagaacaatttggcgtcgggtttggtgctgtcggaggaggaatggcgccgggaatggaacgccgtgttggagttggcatcgccgacaccgcgcccaaa

SEQ ID NO: 57383 - DNA, 339 bp, Heterodera glycines
  Genomic contig location: Contig_ID=SeqID_26630; Location=568..906; Strand=-
  SCN-specific regions: Sequence locations=1-75,109-173,195-266,297-339
atgactataacaattggtcaacggaacaagagaagcatggggaggagaatgggtgaagtgaggtgagatgacgacatttaataatttatctatattaaataaaaattagtgtaggagaagtaataaaaaatgaatatttattttgtaccgaagagtgaatcgatttaaaaaactgaaattatggccaaatgtccgaaaaaagttatatttttgaaattttcaggttttttttttgtaacttagcaaatcaaactgtgacatgatccaattttaaaagtattaattttttttaatttccccaccttttcgaatcactgcaggcgaacactgaaaaataaa

SEQ ID NO: 57384 - DNA, 1033 bp, Heterodera glycines
  Genomic contig location: Contig_ID=SeqID_26632; Location=1..1033; Strand=+
  SCN-specific regions: Sequence locations=1-358,383-386,469-493,543 -551,721-989,1018-1033
tacaacagtgattagaagaggtacaacagtgattagaagaggtacaacagtgattagaagaggtacaacagtgattagaagaggtacaacagtgattagaagaggtacaacagtgattagaagaggtacaacagtgattagaagaggtacaacagtgattagaagaggtacaacagtgattagaagaggtacaactgcaattagaagagtgattagaagtggtacaacagtgattagaagaggtacaacagtgattaaaagaggtacaaaagtgattaaaagaggtacaacagtgattaggagaggtacaaaaattgttggaatggtacaacaatggttaaaaagggtacaatcatggtattaaaattaaataattaaggaaatcgtttattaaaaagtaagattaaaaattgaatgtaattaataaatttttaaaaataaaataaatttccttttattaattaaaaagagtgtttgaaaagtacaaggattgaatatttatttaaattgaaattaatattacaaattctaatttaaaaatacaggagttctttaataaaagtaaataaattattattttaatttaaaagatttttcacaaaaaaaataatttaatttaaattaaaaaattttattttttatagattaaacaaaactatttatatttattaaaatgaaaattaataatataatatttatttaatttgaaatgaaattaaacatgtaaaagtaatcaaaaaatgcacagaaaaataatgtacaccggccggattcgaacctgccgccccccccccataagatgactcagaatccccaatcacacagggattctgagggcttaacgatgtaataactgaaatctgatgtcagattagtgatcagcaccctcaaatagccctaatgacatgtttttgaagatttttgtgaaaaaaaatttctcaactcaaaaatcatgtgctcccccctttggtccagaatcccaaaatcacttttatttttataacattttttaaaaatgtgatagaaatgccaa

SEQ ID NO: 57385 - DNA, 319 bp, Heterodera glycines
  Genomic contig location: Contig_ID=SeqID_26634; Location=805..1123; Strand=+
  SCN-specific regions: Sequence locations=1-319
atgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaatatcgtaagattgtttgatagggccagacaagagaaggcatctgttgttaccaagtttgcggtaaaaaaatgagaaaaaagagatagctattttttggtcaagaattttttttgtttgcgtttcaaatatcgtaa

SEQ ID NO: 57386 - DNA, 513 bp, Heterodera glycines
  Genomic contig location: Contig_ID=SeqID_26635; Location=842..1354; Strand=+
  SCN-specific regions: Sequence locations=1-137,204-264,331-372,394-513
atgtactcaaaattctatttatcccccatgggggataaatggagactgggtgattattttttaaactcctcagaaaggggggataattggagactgcggtattaatagagactgggctataattagagcatatacggtatattaaattacaatttatttttataaaatttagaatatttttaaaataatattatctattattacagttgcttttttatcatatattgagttatgacactttcttaattatataatcgcttgttgtttaattatttaaaaaagtttttaatcataaagaatttaaaattttttcttaaaaaaagataatttctattgtaagaataccgtattttctctaattaaggcccccggggggattatttttcaacctcttcagaaatgtggacataattggagacagggcctttaatggagacggggggattatttttcaacaaatttttaatgactagggccgcgacttttagtgatgaaaaatctcgaaaataatta

SEQ ID NO: 57387 - DNA, 129 bp, Heterodera glycines
  Genomic contig location: Contig_ID=SeqID_26635; Location=1183..1311; Strand=-
  SCN-specific regions: Sequence locations=1-77,99-129
gtcattaaaaatttgttgaaaaataatccccccgtctccattaaaggccctgtctccaattatgtccacatttctgaagaggttgaaaaataatccccccgggggccttaattagagaaaatacggtat

SEQ ID NO: 57388 - DNA, 529 bp, Heterodera glycines
  Genomic contig location: Contig_ID=SeqID_26636; Location=767..1295; Strand=-
  SCN-specific regions: Sequence locations=1-216,238-478,521-529
ataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaatgattcggtctccccataaatctgggcgcatcggttcggggggactgccccgaaaacccaaaaaaaattttttggataaaaattatttaaatgaactgactagataatatttaaaataggttatttctcttcctttcagtatccctgcaaagtttggtgcgcttctgatcagtttctgaaaaaaaagctaagcctaaactttttggcctgtttaaaaaggaattaaaaatttttaacaattttattcatctccctttttgatagaaaaagcatcagagtgcctaaactaacatgtaaataaaatttggtgcgtttcagaaccctttctgaaaaaatatttatgaattaattttgcaaaaaataaataaaaacgaaagact

SEQ ID NO: 57389 - DNA, 512 bp, Heterodera glycines
  Genomic contig location: Contig_ID=SeqID_26638; Location=440..951; Strand=-
  SCN-specific regions: Sequence locations=1-20,57-512
atgagccccgctgacttttaccaacaacaaaagtcaatacatacgaagcaaatgctgcagcaatcgccgatagcgcagcagtttcacccttcttcaacttcgaattcagtttttccccaactctccgattttgtggaggatgggctcgttgatgatctcgtggtgccaagtatatccaatgaaggtgaattatgtcagagtatttcaaactcttaaaacattgattttaaatggattctttaaattaaatacttaacaagtctttcttgattcacaaaccgattttctggtatataaatggtaaaacggacagacagctatattttgtcttccctcacctgatcatctcactgtcagaaagatagttaaaatgcacctttgttttttaattgtaagactcatatttttcagacgatttcgatttggatttaattgagccaatgcgttgcggggatcaccagcagcaagggtaccaccagcagaatcagcaccagcaacagaatataattgag

SEQ ID NO: 57390 - DNA, 1252 bp, Heterodera glycines
  Genomic contig location: Contig_ID=SeqID_5235; Location=26..1277; Strand=+
  SCN-specific regions: Sequence locations=1-112,134-288,311-340,364 -384,408-442,464-584,615-1111,1133-1252
atggcaggccaccattctgacgccgatgtggaagaattgatggcaaaacacaaggccgtccttgagcgtgaacagcgagcgctggctgagcagcagtattggcgagactttgcgttccagccatcaggtaaccggacgaagcaaataactgtttaaatttctaaaatttataggagagtcaatcgcagagcaggctttacacccgacaggactagaaatggagatccagcgctacaattttgagcaccaacaacaggagagaaggcttcaacaggaacggatttggaaggagcagagggaagcagaaatgcttgagaaaaagatgcgccggatccagctcgaacaacaaaaaagccaacaacatcaggcaaaggactcaacacggaagcgcacacaacaacaagcgcaaatttctacaccaacaaaggctgaaacaaaaagtaaaaatgacatataattttttgtgattatttcgtattatttgaagattgtggcaaaaatggaactctgtcgtcaccagggaacgctcggaagcaaccacaacatgcagttagtcggctttactttagcgaagccaatgccggtaaaaaaaaagttataataattaaaaaatactaattgcaataaatcagaacctgagcatgctgcgccagcgtcagctgtgttgacgactgagcaacccatcgccatcatccagcccgaccctgaggcaatccgggcccgagagatcatcgaccagcggctcaacatccaagaggcagattttgtggaagatgtccattgcggcagtgacgataagggtaataaacttaacagaaaatatttatgaaaataaaactttcagcgcctggtccgcaccccaactttaatgctgtgcacatggagatcgtgagcagtaaaaaagaaggaagttggcgagacaacaacgagacgtgcggtgtctgcactgaaccactgcttcgcggagacctcgtcactcagctgccctgtgacgccaatgtcaagcatatcttccacaccatctgcctacgccgttcgttgacaatcaaccggacatgcccgaagtgccgccgtcccgtcaacatcccagacgacatatggtgaaaattataaaaaatataggcataaaaggtttgcttaggccgaccaaagactcgcatagtcagtcttataaagactactttgctgagcaaagtcaaagcgcaacatcagcccgacctccggacgatgactttgtgatccgagcttggta

SEQ ID NO: 57391 - DNA, 1073 bp, Heterodera glycines
  Genomic contig location: Contig_ID=SeqID_5237; Location=53..1125; Strand=-
  SCN-specific regions: Sequence locations=1-181,203-809,832-1073
atggcaccgaaatgtttgggtgggaagcacaacgaatgtcatgtcgttccatcattggcactttcgccttccttttcagctgggtgtacggtgccgccaattcgaaacggaagactcgaccaattcgagcagggcgaagcggtgccgcacggaacagaggcaaattcaaacaaaaaaaaaattagttaaaaaataaaagtaggccagcattttgtgtgacccgaaacacgactcgaaggcattggcatcggctaggtgtgccaatggcacttggtcccacatgccgcagtgttcgccaagtgaaattgataagtcaaaatttgaaagaacactcttctttttgccgcagttcgttgtgtccattggccggccaaagtgtccaattcgcgaattgtcttcacaaagtcaacacatggctcgagtttgtcatattagaccatttggacaactaattacccattaattagtggccaaattccgctgtctgcacggctttcgtccgtcgtcgccgaacaattccatgaaatgtctctacggcaaatgggtcagagacggaccgccgttccgatgcttagcgagtaaaataaaagcatggcaaaggcactcaaaaaagggtttttgacttaaaagggtcttgtgagcatccgacaaaagcttttggcactttaatcggtggccacattatgctggagggccaaatgggcgcttacgattattccgattacataagccgagtgccggaagggcgatcaatcgcatttcgctgcgaaaagggcaattttctcgttggtcagacaaatcgattaaacattaattaattaatttcattaactcaatttattaatttgtggaagtaatttaggaccacctaaggcaacatgtcaggtgacaacaacaaataaacaaaatactgtggaattatttcaattttttgttttaattttaagcgtggcgattggagtcccggactgaagccggaatgtgtgccgcaagtccatccggcagttgagggccaaattctgtggagtcggccgggccgacggcgccgaagacgccgccatctgctgagtgga

SEQ ID NO: 57392 - DNA, 1369 bp, Heterodera glycines
  Genomic contig location: Contig_ID=SeqID_5238; Location=1307..2675; Strand=+
  SCN-specific regions: Sequence locations=1-77,130-355,377-691,713 -1196,1218-1342,1365-1369
atgctcgttgtcatcatccatccagaacaatggaacggcggctccgaccgatgcacaatcggtgggccaaatacacctaattaataactaattaattaatatttattcattgatatttaatgattttttcaaagtgacttttgccattcgttgtaaaaatgcaaaattacggcaatgcttattccttttaaggattgctccgacactttgtccaagccggtcataaggtgttctggctgaccacaatgattgacacttattgggcatccgaggatttccacggcgttggcacgttaatttaatgaattgaaaactaattaaaaaatgaatcggaaaatctttcatagaaatcatcggcccatctctgttcgcccatatgcccctccatccgggcgattggttcgcttttactttttttgttatctttttaaatttattccccccgccccaccgttcgtccaggtacacacagaacaccgccttggccctttactatctgttctccaagcgtggcatgggctcgcccgatttggtggtggtcgaccattccgcctcgtgcgtccccctgctcaaatggttcttcccgcgctgccgcgtccttttctactgccatttcccccaacaactcgtaaatttgggattttcaatattatttattttcaaaatacccataaatttcgaaaaaaaatctaaataaaaatgattaattattgcgaattagtcattgttcataagttaaatgtttccggatttgaataaattaaatctttgtcccgcccaaattgagtatttgccaatttccccttatttgttaggtcactccgtcccgctttttcctctaccgttggtacgcttatctgatgggtttggtggagggtcgtctgttcgaatacgtggacattgtgttggtgaacagcgaattcactggtcagcaaaaagagagagcattgcaacgtaaaaagttcccaaaattcaatttaggtcgccaatttcgccaagtaatgccaaccgtttcgaatgccaaaatccgcgtcgtttacccgccgtgcgacgtcgactcgctgcgttgcgggtgggtgcgtccgattagtcgtgcggaccgtccgcccaacgaacgataccttttcctgtcaatgaaccgtttttggcctgagaagcggctggaaattattatagaggcggctggtaataacccacaaacttttttggcatttcatttccattttcagctgagttaaaacgccgcgggctgcggccgcgcattcaaatggccggctctgtgatgccgcacattcccgagtctcgaatatactaccaagagaggcaaagtcactgcaaacagttggagctggacgacctggagaggtga

SEQ ID NO: 57393 - DNA, 758 bp, Heterodera glycines
  Genomic contig location: Contig_ID=SeqID_5239; Location=249..1006; Strand=-
  SCN-specific regions: Sequence locations=1-52,98-583,606-686,708-735
atgggggtgggagcagatgaaagttgggagtaatgggacaaattgcaaagtcaaaaaaaaaaattttttttttaatttaaaaatttaaaatattttagggcccgaaaacttatgaagtaactgaggaaagtctcaagcaattagtgaattttcaaatgaatatttgtgggagtgttcattcatataaattatgaattatccaggaaataattaattggcataattagttttgctagttaccccgttgatgtgcacgtgcacagtttcattttgctggggacgcctttccgccattatttgcgccatttcctccgtcggcggatggtccaccgaaaataattcggcaattgcttcgtccacgcgtcgtccgaatcccttccaactaaatttttcatcgaagcgaatgcgctaaaagagggcaattagccatttaaattggcttaattaattcgctttgtttgcctgtttcgcgtaaagttcgtccttgtcgagttggggccattctttgcggcccatgtgcgatgccattgcattggccagcaaaacaccgcaagtgtcggcaatctgatcagcaggtgatttgatttttaaattattaatttttagttttgtatcaaaaaccaaacaaagggttcgatcggttttttcaatataaaccctaaaaaatcgagaaatacacattctgttggtttgtaatttgtaataattagttattttagtatccctatgaccccctttaattatttaataataataaa

SEQ ID NO: 57394 - DNA, 710 bp, Heterodera glycines
  Genomic contig location: Contig_ID=SeqID_26640; Location=399..1108; Strand=+
  SCN-specific regions: Sequence locations=1-359,381-500,551-710
atggacattgctgcggacactttactgcatcccatcgctctgttactgctccgtctccactcgcgacgcgtgagcgagacgagcagcgaggtggaggacattgtcgtcgcggaactcacttcgtccaataaagtgttgagcggaagtgcggtgcgcaagttccacgacctgtgggtgttctgtcggagtgccgtcattgaggaggtgtacgccggcattctgctcaagccgatgaacaggtgatgccacggagagagtgcgctaagggttttgtgttgttgggacatagtttctaaccccaatgaacacagttaaatatgtagttgaatagaaagccatggtgccgataccgtccagtctgggaaattaaattattatgtcgtctcataattattaacaccccttaaaaagtagcctatttattaaaaaaaacaaaaaaagaaattgaatcgaaaatcgaactatttttcatttttttgttggtcacagtcttgcactttctctggaggctttccaattcaccacctcaattttcttctagggttgtgatggttctgctcagttttatcgccgatgacaagctcagtgcggaacaggtggagctgaaggcgttggcctacgcctggtttttggactgtgcccatcacaacgaactgcacaaaattgttcaaatgctcacgcttatgttgctgaacccagtgacggcacgg

SEQ ID NO: 57395 - DNA, 457 bp, Heterodera glycines
  Genomic contig location: Contig_ID=SeqID_26642; Location=112..568; Strand=+
  SCN-specific regions: Sequence locations=1-408,449-457
  Gene Ontology: Mol. function=fucosyltransferase activity; Cellular component=membrane fraction; Biological process=carbohydrate metabolism
aatcccactttttctattttgctttcgagaatgccgtctgtccaaattatgtgacggagaaattttggaaggcattgcgcaatttggtggtgccaattgtgttgagtcgaaaagtgatggaagaagttggcattccgaatggcactttcattgcggtggacgactttaacagtgtgaaagcattggcagaatatttgaaggaattgcaaagggacaaggacaaatacatgaggtaataggggtaattatggaaattgattgctcaacaaggtgtagttaggaaattgattgccctatagggggtaattagagggaaatgattgtaagtgagggtaattaatggggtgaggaaaattggacaaatggtgctacatcgaccgacgaaaaatgcaaaattgggcaagtgacgaaaacattcaaaaatcatttttaaattttcaatcatttttatttaaaa

SEQ ID NO: 57396 - DNA, 386 bp, Heterodera glycines
  Genomic contig location: Contig_ID=SeqID_26643; Location=760..1145; Strand=-
  SCN-specific regions: Sequence locations=1-61,89-182,204-386
atggttagattttgatgaaaaataaattcagttcaggaaatactcagaaatgaaaccgcacatttaatttaaataatatttaattattctgcctcctttcttaaaatgttcacatttgggatcaaaagaccaaaaaatttagcatcagagtttaaatttcttgataaaatagtgacattatgccacaaaatttcaaaattataagtatatttaagaaatcagcacaattttcatcgctactccaaaatcagagcattcttataaataaaaacaaatggaagccctggtttaaaggccagcttctaacgaaatcagattattaaactgacaaaaaggaagatttacgagaatttaaaaagaaaaaatggttttttcattaaaataaa

SEQ ID NO: 57397 - DNA, 304 bp, Heterodera glycines; identical to SEQ ID NO: 51570
  Genomic contig location: Contig_ID=SeqID_26645; Location=421..724; Strand=+
  SCN-specific regions: Sequence locations=1-304

SEQ ID NO: 57398 - DNA, 141 bp, Heterodera glycines
  Genomic contig location: Contig_ID=SeqID_26645; Location=927..1067; Strand=+
  SCN-specific regions: Sequence locations=1-113,135-141
aaaattccctcaaaaataaaaggtctattgcgcaccgccctccctatcatgctcgagagcatttgtatgtgtataaaattatcaaaaaagagatagccatttttctgggatacctctaatataaaatcctctgtgaataaa

SEQ ID NO: 57399 - DNA, 512 bp, Heterodera glycines
  Genomic contig location: Contig_ID=SeqID_26647; Location=697..1208; Strand=+
  SCN-specific regions: Sequence locations=1-177,200-512
atgaccatgaaaagaagccaaccaagtggacaaaagccggttgcttcttcttctgatgacgtcttacagcagcaaaacggcggcatcgccaaaagaaaaggtaaagccgcactttaacaaaaaaaaagatgatgatggcaatttggcattatttggcacatttaaaaacggcaaatctttggcattatgtatgtattatggtgacttcataggtgagcataccccggtcggccaccaaggccaaaaattacattccatgcactttttttgaaaataaaaattgccaatcgcctaattttagtattaaaaatggcacaaattttattttaccatattcttgcactaatgatatgcctactgtagcaggtaattaattagtgaaaagaaaacgcatcacgcttaacaaagagtggcgccgcttaattgtttttttttgaaagctatggcctacagtagaacaacctatttaagttcctacgatacttttacgccgtgctgaaaactgataaaca

SEQ ID NO: 57400 - DNA, 840 bp, Heterodera glycines
  Genomic contig location: Contig_ID=SeqID_26648; Location=147..986; Strand=-
  SCN-specific regions: Sequence locations=1-384,406-545,572-673,705 -707,730-840
atgacgcttaccagaattttcagaacaattctgacatttaccagaatttacataaccattctgacgcttaccagaatttttcagaacgattctggtgtttactagaattttcagaaccattctgacgtttaccagaatttttcagaactattctggtgtttaccagaattttcagaaccattctgacgtttaccagaatttttataactattctggtgtttaacagaattttcagaacaattctgatgtttacaagaatttacagaacattctgacgtttaccagaattttcagaacaatgacgcttacatccctattgaaatttattttcacttacaaaactttctaacataaataatacatcgttaaatgatatcccgaacatttttctaaaacattttatttaaatccaaccacttttacatattttctggtttttctatgatgtctatccaatttcattatatatggaaaaactcaattatatgccctattctaaaaatccctaactcgaaaatcaattgactttcgcccaataataagaaatttatttatgttgtttattttcactgggcgaaagcttttgacccaattccgaataatctcctcctcctaagctttcttgtattggtataaataattccttattaatatgatacacaaatttttaagctatatataattattataatttttttttaaatcgaacattctttgttaaaaatgttccaattttccagacgagtatccatgcctaatggcgtaaggctcaggaccattattgtttcttatttacatttatgattaccaaatttcgcgaaatagaaaaggtgaaataaa

SEQ ID NO: 57401 - DNA, 511 bp, Heterodera glycines
  Genomic contig location: Contig_ID=SeqID_26649; Location=1111..1621; Strand=-
  SCN-specific regions: Sequence locations=1-250,272-293,315-511
atgtcctgggtttttagattcgacctgaattgggtaaaagttactttttggaatttcatttaagaacgcagaaaatttttaacttacaaaattagtatgacatttctcaaaagtaagcctaaaaaaatttgaaaatttcagattttaaagggaggaaatttggcgaaaattttcaatccatctccatttcaggacaagtttctggaaactcttaggaccttcaaattgcctttctccaattcaggacaaatgtatttccatcctgaattcaggaaaaatctaaaaatccagggctttgttttatattgtatttcggaaatgtaaaccgatttattggtcaaaaaattcaagcgatttaaatggtgaagaaaaatcagcgaaatattgaaaatggattataaaaaacacaaaagaaaaaaaaatcattttttaggtgccgggtcgttactcaaaaaactatcaaatggaaaatttttgacagaaaattactcataacttcgcccaaaataaa

SEQ ID NO: 57402 - DNA, 387 bp, Heterodera glycines
  Genomic contig location: Contig_ID=SeqID_5240; Location=1464..1850; Strand=-
  SCN-specific regions: Sequence locations=1-88,110-188,210-387
atggcgatgaaatgctttacatatatatttcttggagccaaaacaaaagcacgtcaaactaaatgtttctatttatttatccattctctcggcttttttcccttcatcatatatttctcgtcaacatctcttcttcactatcataatccgttcataggtaattccatcctttaattgtccttggtcttcttcttttttaagcttcctctgattttccacataattacagtaattgttgtttctctttccgtgccgtacagtctctctctccatttgttcagagacgacgacgaagaccaataatcggtcggcataattaatgtacgcaacaccaaatgcaaaaatgatcggattctcgattcttgaaaaaatggatccgagaataaa

SEQ ID NO: 57403 - DNA, 863 bp, Heterodera glycines
  Genomic contig location: Contig_ID=SeqID_5240; Location=1983..2845; Strand=-
  SCN-specific regions: Sequence locations=1-339,362-610,650-863
atgatgattttggcgaacggagcggacccgaacgcgactgacagcgctgccatgtcgccattggcacatgtgttggaggttcgttagcgggcaaaaaacaaattgcccgaggggctaataattaatttgtgtccgttttttgcatttttactgtgaattctttgaatttttgttggggtccggatttagttaggggtgcagaatgactattgagtgaatcgtattcagcaattactaaaaccccttaatgcgtttccatgatttttttgactttttgaaaatcgtggtagagttttcccaattaaaatatcaccaaataagtattatttggtaaaattgagaaagttttaccaaaaattatattttcacacattaaggatgaaacaggcaaattccaaattgccaagttgttgctttgcttccatgcaaagttgaatgtgccggccggaaagagagacaaaatgtattttaattcttatttttgattgttaacattgaatactttagcaatgaaaaggcattggcgaagcttgtggccaaactgaacaaacaaaaggtctcagagatttttgtttcatattttccacttagaaaatttttttttttttgcttaatttatttaaacattttttgtttagaagaaaaagacgggcacaaaatcggaagagtcgaccgttaaaaagccagagtgtgtggatgttgaggaagcaatttggaaggagtggcagcaaatggcactgaaaacgagaagaaatgaacaaaggaaaaccccgagacgcaagggcacgggcgtcctagaaccaagcaagcataagcctaggcctagccgaaagcttaggcctaagcctaagcttaaagcttaa

SEQ ID NO: 57404 - DNA, 3312 bp, Heterodera glycines
  Genomic contig location: Contig_ID=SeqID_5240; Location=3368..6679; Strand=-
  SCN-specific regions: Sequence locations=1-340,363-614,655-865,890 -1079,1101-1225,1247-1444,1466-1548,1570-1930,1955-2041,2063 -2191,2213-2502,2575-3058,3081-3312
  Gene Ontology: Mol. function=transcription factor activity; Biological process=regulation of transcription, DNA-dependent
atgatgattttggcgaacggagcgggcccgaacgcgactgacagcgctgccatgtcgccattggcacatgtgttggaggttcgttagcgggcaaaaaacaaattgcctgaggggctaataattaatttgtgtccgttttttgcatttttacagtgaattctttgaatttttgttggggtccggatttagttaggggtgcagaatgactaattgagtgaatcgtattcagcaattactaaaaccccttaatgcgtttccatgatttttttgactttttgaaaatcgtggtagagttttcccaattaaaatatcaccaaataagtattatttggtaaaattgagaaagttttaccaaaaattatattttcacacattaaggatgaaacaggcaaattccaaattgccaagttgttgctttgcttccatgcaaagttgaatgtgccggccggaaagagagacaaaatgtattttaattcttatttttgattgttaacattgaatactttagcaatgaaaaggcattggcgaagctcgtggccaaactgaacaaacaaaaggtctcagagatttttgtttcatattttccacttggaaaattctttttttttttttgcttttatttatttaaacattttttgtttagaagaaaaagacgggcacaaaatcggaagagtcgaccgttaaaaagccagagtgtgtggatgttgaggaagcaatttggaaggagtggcagcaaatggcactgaaaacgagaagaaataaacaaaggaaaaccccgagacgcaagggcacgggcgttcgagcactttcactggacggtggcggaattcgaggcattgtattagtgcaggttttgattcgggactttttaattaaaaattaaatttttcgattaacaatttgcgacttaaataattttttcctgcaaatgaaaaattggggtttactttcttgacaaacagttaaaaaaaacttccataaaaaccatattttttaaagaagcatccaaaataaacaccaatatcattcaaaaaagtcattgcccgaaaacctcaaaaaaaaaaattttatctaagcattttgtttataaattttccgaaacagagaatattctttaaaattttgcatcctaatagagttatcgaataatataaagaatgtttaatttgagtgtttctttaaaaagttgtgatttacttcatttgcaaaattatttattggccgtgtcttttttatggtcatgtcaatgcaatagagcggcttaccaccatatttttcgctatgcttatcccttatcgaatttgcagatgttaattgaaatggagtcgctgatgtacggcgagggtttgcaagcgggtggccatgaaaaaaacttcgtacaaaagaacttcaattggattatcgggacgagcaccggagcggtgagagcaaaaattaaaattatcagttttaacttgctaagtatcatatttgtgcaattttgggtctgatttcaaaaaaatgcaaacattggagggggggggggggtggcggtgaagagaaattttcgaaaatttgttaatgcattttccaattaaaaaaattatttgaactgatcaattaaagatgttggacattgcgaatttcagatcgttgcgttggcacttgtctcgggcatctcactgatcgacgcactccgactttacttgcgcctgaaggattcggtgtttggcgcccgggcgcagctgatcggttacaacgcgcaaaatttggaaacattcctccaagcgcagtttggcgaaaacaaaaaaatggccgaattatcgcgtggaaacattaagtgagtttttgggaaatccattttaaaattggatagtcgcagaagagccatttatagttttttgaactttttgaaaaattaattttttttttgtttttgagtgatggtcatcagtgaaatttttaaaatattgatgactcagaacatttgttattggtctctgccaaactgaatattttttcagagggctgaaaattgggtaagcccgtccgtttgttagcctttaaattgggaaaaaattttgctattagaaaattttcaatttttttggttttgctttaatgaattttcaaaaaaaaaattgcagattgtttactaccgcaacatacgttggccaaaaacctccccgactggtcaaatttcgcaacttcatttcggcgctcaacgaatacgacccgtacaaaaccaacatttggctagcggcgcgctattcaactgcggcgccaacgtactttgaaagtcgggacaaattcatggatggaggtaggcaaaaatagaaactattcaattagtataaataattaactatcgatgcatgaaaaatgataaaaatcacaaaatttgatcattttttagtgaaaatctgtcaacaaattttaatcaaattttcaaattttttcccggcgccgcctgccccctcttcccaacaagttttttttgaaaaagcgcgcctcaaaaaagcgttttattgatttttaaatttggaataaaattttaaaaaatgatttttgctttatgattttaattattaaaaagtggtagaaaaaatttcgcattttcgcatattttagcttttcgcatttcgctttttttcatttcgcatttttcagtttcgcaaatttcgctttttatttttcaatttggcccatccctgctaaaaagtaataccgtttttgcacccaaacttcccccctcccattcactattgatagtgaatataaaatatgattttgaggtctgctcgcaaacaatccaagcctggaactgttggatgaaataagcaaggaaaatgcattggcaaaacaacacaatgtatgcagcagttgaccagttttatttagtttttttcaatttttacattttcaggaacctcagtatgagctggagtgttttgtttcgcttggtactggcaaggcaccgactgaaccggttggcacaacatcgttggagattgggattattggagcaattaagaatctggcggggattttgatggatcaggtacacacacacacacactatatatatatgtgtgtgtaaagcaaatcattttaaaagtaatttcaagctggggttgtatatttccccttcctcacaattgtttctgaaataattgtttttttggaattagactcaaaattttcaatcgaaaaaatttaagtgcgtttcaggcctcccacagtccaggaaaaaatatggatttccatataattggaatccctaattatgacccctcgaaaatggtagaactttgggcgccatggtgccgatag

SEQ ID NO: 57405 - DNA, 1030 bp, Heterodera glycines
  Genomic contig location: Contig_ID=SeqID_5240; Location=6778..7807; Strand=-
  SCN-specific regions: Sequence locations=1-340,363-582,604-770,792 -1030
atgatgattttggcgaacggagcggatccgaacggaactgacagcgctgccatgtcgccattggcacatgtgttggaggttcgttagcgggcaaaaaacaaattgcctgaggggctaataattaatttgtgtccgttttttgcatttttactatgaattctttgaatttttgttggggtccggatttagttaggggtgcagaatgactaattgagtgaatcgtattcagcaattactaaaaccccttaatgcgtttccatgatttttttgactttttgaaaatcgtggtagagttttcccaattaaaatatcaccaaataagtattatttggtaaaattgagaaagttttaccaaaaattatattttcacacattaaggatgaaacaggcaaattccaaattgccaagttgttgctttgcttccatgcaaagttgaatgtgccggccggaaagagagacaaaatgtattttaattcttaattttgattgttaacattgaatactttagcaatgaaaaggcattggcgaagctcgtggccaaactgaacaaacaaaaggtctcagagatttttgtttcatattttccacttggaaaattcttttcgatgccagaaaattttgattttcattgaatttagttaagaaaatgttgcacgcactttgaagtcataaaacgaaattttttgcgatttttcaagaaaaaatttgtttgttttttgaaatttttaaattttttggtagcagttttgcataaaaatggccagattagatcattttaacaatcattctcatacatatgttttccttttttcacataaaattctcttcttatttcggttttgattttagcttacaaattttctacaaaaaattttcatggatttggacgcatttcttcgtttcttcgctggggtttgcaatttattttaatgtttgtcttaaacttttttttgtccagccgcagcagcagccggcaccaatgagtatttacgaacgctttaacaaggaagtttgcgaaaaaaacccttga

SEQ ID NO: 57406 - DNA, 787 bp, Heterodera glycines
  Genomic contig location: Contig_ID=SeqID_26651; Location=195..981; Strand=-
  SCN-specific regions: Sequence locations=1-252,296-384,406-463,485 -616,638-638,660-787
atgacaaacttggtatccttccaaattcaacatcggcttgcaaaacatatggacagagagcattttgaaaaagtcttggccttaattttctgggaaaaagcagacccagaaaaagccatgctgccaaaaagacctttggacctgggcccaggaaaacgaggccaagttctaacggtacttgttaattatctgtgggcagatatcaaaaaaatttatcttttggctataacatttctttggcatccacatgcaatttgcgaaaaagtcaaaaattgaaatgttttcctaataaaattttttacaggctctaaatctttttgttttttgtaaagcttatagagcatctgaagagctttcgaatgttaccaacaatgttggatttggaaccaagtttgttgtttttgttgactatcagaaagtttgagggcggcaaaaactctggcaccgagacataatgggtctattacaaatttatgagttcaaatcacaaatgacattcctggctctcgtgaaattggactcataaaatgtaatagtaacccacaattttttgcaagttttggtcataaatgtcgtggacaacaaacttttccatctcaattagtgcgcttttgtttttgaaattgaaataatttttgtttagaacaaattcatttgaacaagcgatgcttcagcaggcgctcaaagcggtcaaggaggaccagtacgacttcgacgcgtggactcggctactcaaaattgtggaaaaagtggtcagtggcaacctacacacacacacacaaataaa

SEQ ID NO: 57407 - DNA, 742 bp, Heterodera glycines
  Genomic contig location: Contig_ID=SeqID_26652; Location=275..1016; Strand=+
  SCN-specific regions: Sequence locations=1-24,46-504,526-592,634-742
atgcatccatttgtcttacgtaattttctttctgagaatgattggccgccacttcgcctttggacagatgattatttgacagaaaaattagggaaaggacaatgtttaaatgtacgaattggtgaaaagagacattttcgtggaaaggtttggttgaaatttccaaaaactataaaatataaatgaaaacgttaggttctgcacgagcatcaatgtgatcgacatacttttgagaatagtgcttcaatgctcaaatggatgaaaagtgctaatttcggccctgtcaatggaaatgaagagacttcatcggcatacccaaacccgaacacacactgggcctacttggattatcgggacgtacttgaactgttagaacaagacgaagctcaatatgttgattggtcattgttggggatgaaaaacgcaacaggggagggcgaaaactggcgtaattccactgtttggatcggtaagaggcgcagattaccaaagcaattggtaattctgtagcttgtgtctcaaaacaagtttcatgtggttttctgggtcgcgatcattaagtcggcatcaatttcgaccaatcccggacacgaatttaaataaaagatgaaaaaaaataaaaatttaaaaaaagtattcaaaaacttctttctagggctctttggggtcgctggtcgcgaatctgacattcatttctatcaagtccgaaccccagacccgaattcgaacagaaattagaaaa

SEQ ID NO: 57408 - DNA, 617 bp, Heterodera glycines
  Genomic contig location: Contig_ID=SeqID_26653; Location=54..670; Strand=-
  SCN-specific regions: Sequence locations=1-101,144-509,601-617
atggaaggaaaccattggcgacgggagcaacttttccattttgcagaaattgttcgcctcgatttgatgaaaaccgtatgaaaataatatgttttgaaaagaatttattataaattatatcttaacattagaataatttttatctgttttagaccgttattgccacacaatgcgcaaatatttcgtcagctggtaaagctgaaaaaattcagaaagaaatgcacgctattggaattatgctacaagaaatctcttcgcacgtggccacatggattgaaaaaaagcttgtaagaaaacttgtttatctaatttttccctatcacaaataataattctaggaaaatataaaaaagtgacttggactattcaactagggttgcaaccccgaagtcggggttggaaaattcggggttgtcggggttggaatcgtcggggttcgggggtggggttgccaaatcgttcggggtcgggtttttcaatttttgccttaagccatatagccaaaaaactttataaaattttttcttgaacatatttatttttcataataataatttatgtgctttttttaaattattttatcatatgtaaattatttttgtagagaattgattaaa

SEQ ID NO: 57409 - DNA, 839 bp, Heterodera glycines
  Genomic contig location: Contig_ID=SeqID_26657; Location=125..963; Strand=+
  SCN-specific regions: Sequence locations=1-140,162-267,289-529,551 -561,608-839
atgattgaaacacctcaaaagtttacggacaaagtcactgaagaagaagggaatataagcgcagcagagatgaaaaagatgcgaagaaaagcgaacaaagtgaaggcggtcgaagaaaaggcgaagcaaaacggacaaattcaggggaaacaggtgaaacaattgggaaatcacaaaggatggaaacaattggaattggtaatttagaagagacggactgacggtgaattggatgtgatagagcccgaaccattggatccgaaaaagttggccaagcccaaaaatccgctagatgaagcagcaaaattcatccggcccatcttacaaatgccgtgcaaagacgtggatttatgggtggtcgcattccgggtttatttccacaagaacaaagtgaccgacctattttaacattttgaagaagcaattggacttctgttttcagctgctggtcatgttgcaatgccttaacaaaatcgtcactttggatccgtcaaatgagaacacaaaaaagctttttggcaaatatatggaaaaatgtttgttttttgtcgatgattctgtattttaaacccccgggaaaaacttcaaaaattttaatgtcaaaatctgaattgatcggagtgaatgtcacattcgtgacatgttcttccttaaaaaaattaagttccattaatttttttagataaaactgcctctggcgatcgtgcgacggatcagctggtcaaagaattaacccggtctttttccgcaaggattggttttattgccgacagtgaaattgacagataggaaaagcctgctcaccgacatttattatgcttgttttgttttaaatgcaa

SEQ ID NO: 57410 - DNA, 697 bp, Heterodera glycines
  Genomic contig location: Contig_ID=SeqID_26657; Location=1155..1851; Strand=+
  SCN-specific regions: Sequence locations=1-10,32-498,523-618,640-697
  Gene Ontology: Mol. function=phosphorylase kinase, intrinsic catalyst activity; Biological process=embryonic morphogenesis
attcggggtgacttgtcaaatggtgaccattcaaaaaataatgtgcttttttaaggggcagggcaacagccgagcggtttttaccgtatgtatgagccaaaagaggtgagtgtgtgcaaatcgtaacgaatccgatttgattacaacatggaattgttattgaattggccattgtcaggtgatcggccggggactcgcttcggttgtgaggcgttgtgtggagaaaggtgatttagggagaactgctgaaagcacatcgaaacgatgccatttttattttgaagagtcgaggaaggaatacgcggtcaaaatcgtcgatctgagcaccgaacgacagtccgaaagggaagcgaagcgcctaagcgaagagactttttcggaggttcgcctcctcaaattgttgtcgggccatccgtccataagtacgttcttacgccttcgtaaatttcctctgatttttctgcgtttttcagtttgtttgcatgagttctttataacgacaacatttgtatttgccattttcgagttggcacgctgcgaattgttcgaagcgttgaacaaatcggtgacattcagcgaaaaacggacgcgactcgtcatgcgacaactgtttgtattgttttatatgaagttgaaaatgttattacgtttaggttcgacggtgtccattatttgcactcggttagttatttacaaa

SEQ ID NO: 57411 - DNA, 80 bp, Heterodera glycines; identical to SEQ ID NO: 51817
  Genomic contig location: Contig_ID=SeqID_26658; Location=551..630; Strand=+
  SCN-specific regions: Sequence locations=69-80

SEQ ID NO: 57412 - DNA, 838 bp, Heterodera glycines
  Genomic contig location: Contig_ID=SeqID_26659; Location=92..929; Strand=+
  SCN-specific regions: Sequence locations=1-362,384-589,611-800,822-838
atggacaaggccggcggattcattggctatatgttcgtgccggtcttaggcgagaaaggaatcatccataaaaacctttccgaactgcttgttgaggctggccttgccagtgtgcatttcactgctgatcggtcttcctattacaatcatttgttggcagcggaaaaaagcgcaaaaggcgcgaaattgggcatttggaagcattttgacgaaacaacgggcggtaacacaacgacaaatcacgaggaggagcgacgaaagcaggacaacgatgcgtcagaacgcaaattgcagtttaagaaagtgctggccaccgaaatataccctggcttccggtttgctgctcagtactttgacgatggttagtttttggggggaggggtaacaaaacatggacatttgtttattcaaggaccaaccattgaaaaactgatgcaagctcttcaaattgagatgaaaggcgtgccgactggccaatttgttcccaaacgacaacagatttgtgccgccaaatacactgacggcgacctttggcaccgagccaaagttgaggctcaaaagggcgacaaaattgacgtgtaagaaatagtctttaaaaatttattttccactgcttttcagttattacattgactttggcaatgtgagttctgagcattgtttcttttactgttcgactgagaattgacttttcagagagaagccctttcactcgaacgaattgcacctcttccaccccaattccattctcagcctccactggtcaaagaatttcaattggctcttattgcaggtgttaattaacataaaaataattaaaaatgatttttggtggata

SEQ ID NO: 57413 - DNA, 943 bp, Heterodera glycines
  Genomic contig location: Contig_ID=SeqID_5241; Location=467..1409; Strand=-
  SCN-specific regions: Sequence locations=1-919
atgagtgccaacaactacagcgctgtccgtaacaacggtccggcccaagcaaaccgcgggcgcaaaagagcacaacctgctgaccttgagctcgagcgactgcgcgaagaaaagcggcgaaggcggcagcgcagaaaggaagaagaagtacagcgccaacgggcgctaattcggctgcgcactgactaccgtaatgcccgaaacgctgttatggcaggtcaataccggatgtcggtgacagcaacaacaacttttttggcaattccccaaatcgtaagtcaattgtatttttcaccattaaaatataatgcttaaaatcatagacgcaagtgcgtggccaaccgtctgttccattcacatccgtgatcaactatgagccaaatgtaccgattgtggtgccgccgccgcttcttggccaacaaacgattgtgcctcatcttcctgctcctgttcctttgctaccacgctccgacgacgctgtctccaacgttactgctgctctcaactctaatacgcaatttggtactgccgttcgaccatcaacataatcttttttattttttactgatgagctagctatttaggtcctattcttcaccggactcttgccacttcgcctacgaatccgcagccagtcccgctttttcatcgaattgttactcgtcctaccgatccgcgtttgggttttcaagctgctcatcaaccatctgctgttccgccgatggcgttgctgtcgcaaattcctcccccaccactgccgccatttctacaaaagccatcgacctccgcccgaccatgtgctgctacgtcggcaaagtcacgcaaaaaggcttatagttcagacgacagcacatggtcgggcgggagcgaagcctgcactttgccaaaacgtcggcttgtcatttgctcagaggatgacggggaagaaaagaagaaagaatga

SEQ ID NO: 57414 - DNA, 473 bp, Heterodera glycines
  Genomic contig location: Contig_ID=SeqID_5243; Location=1571..2043; Strand=+
  SCN-specific regions: Sequence locations=1-299,321-375,398-473
atgtattgcgagagttgcgcacatcatgtcaagaaggcaagcatcagtctctacatgaaattagagctccgtgattgtgaagacccggaaataagccaaattgcgactgttttttccgttgtcgcggaacattacatgaaccttaaggtggagcaatttgccaatatggtagatgagcatccagaacagctggaagcgttgctcaaatctaaaattgagcagactgtcattgtcaaactcaatataaaggtatccaaaattctctatatgcttgctaaaaatattgccattttgagtttaaggcaaaaggagagctcgagacacttgactggatcatttcgtccatacagcaggagaacggggaggaggggatgccacaagaaggaaaaaagtccaccgacgcaaataccgaagatggagaaataatcgagatagacggcccgctaaaaaaacgtgtagcaaaaaagaactga

SEQ ID NO: 57415 - DNA, 1005 bp, Heterodera glycines
  Genomic contig location: Contig_ID=SeqID_5243; Location=2384..3388; Strand=+
  SCN-specific regions: Sequence locations=1-241,263-352,375-1005
atggcacactttgaggcaccgaaggcggatgagaaacagcctcagcagcgaacaccattgtttgagcaaaaacagcactatgtgcaccgagtggagcggttcgctctgcagcgtcatgtcaccgagtttgtgctcaatggtcagtacgatgaaccggaagaagcgcttctccgcgcttttgagcatatcattgctcgtgcagtccggaacgcagaagactcccagcagcagacagatggggcaggaatatcagcgggtgacggtgcacgtcgtcaacagcgagtcaccagacttggaattttgcttaacggccgaggtgggaccgatcgggagtgtaatgcgctcttttgttaatggaaaattttctatgcaaacaccagggctaactgacccaattgtgctgcctattcgcccgccggagcaaaacactgcggaagtgcttatggctgagttggacaagcttggccagtcggatggcgatgaggaagtgcatggaggaggaataagcaaacgttcgctgttgctcagcgaaccaatagaagtggtcatcacatgtatagcacctccggttggtgcagcaccacggttctatcagtatcagcattggggctatgacgatcggcaaatgatccgtgtgacaaacctggatgacaacttttgtctattccacgcgctgattgccacccgtgcttacacagaccaagaatttttaaagacgacttcacaacgacaatcggcaaccgatgcagatcatgggcatcaatcgaatgccgtgccagctgagattgcacgaagagtcatgacgagaacggacttttgtgctggatatgaagcactgaaccgtctggtgtccaaccgtgaacggatgaacgctgcagtgacggagctgatgcgtgctgcagacattccagcagaccaagaggcgtatggactggagcatctcgaccaaatacagcaattatgggtcagttgttggtgttggaaatgaagctgaacggaagtgca

SEQ ID NO: 57416 - DNA, 1406 bp, Heterodera glycines
  Genomic contig location: Contig_ID=SeqID_26661; Location=246..1651; Strand=+
  SCN-specific regions: Sequence locations=1-1406
atgtgccatctccagctggacttttggttacgcaggatgcttcaaaactggtactgtttagtcgatgatatgaaaagcaatcacaatcttaaggtaattaaaagggcacggcacgaagtcaatgcaccacctgcggttccacaaagcgttgaccagctgattgttcctcccgcttaccagacgtacgagtcaactgacggcgaagtggagcagtttctgttggctgactctggtgtgtattacgaggccggaaacgaaaacccgcagaggtaatttttttttaaaactataatccattttaactatttttttcaaggattctgctgtttggacgtgaatctttcgggcgatgggctgatcgaatgaaagactgcttcggggacggcacattctcattggcacctccgatgttctatcaaatctacacaattttggccaagtgctgttttaatttgatttcacgtgaaaattgttttaaggcgtgggtcgtgggttatcgtcgtgtgccattgcttgctgacgtccaagtcgcaagcgtcctacgagaggatgtttggacttctccgtcaagcgtggccgacattctcgcctgcctcgttcaacatggacttcgagacagctgcgcgcaacgccgctgttgccacgtttcctgcatgcgaaatcaaattttgcttcttccatttcgtgcggaatttgcaaaaaaaaatcaaggaacaaaatctctggcaggtcagtaagcatattcagtttgtttttgtaattttcgtgtctattcagagatactgtactgacagtgttggctgagaatctgaggatgctcacttctgtcgcgtttctaccgctgagtgacatcaggacagctgtcatcgcattagacacggagtttgggaacgtcgcggcactccgaccgctcattgactggttggtctcatcattatcagaagtgtacttcaatttttgtgcaatttttaggttgctcaacaattacattggacaaccgcggccaaatggaacttggtctcaaccactcttcccaccagaacaatggaacgtctcgaactctgaatggagaagcaaggacgaacaactacgcagaggcagaacaccaccgtcttcaaggcgccttcaattgccgtcatccatcgatctggcacttcattgacgttctccgccgtgagcagaagggcaccgatgggaagtatgcgtcatttattgctggacttgagccaccgaagaaagctaagaaataccaagcggctgacgagcgcatctttaatttggtgcagaattataatccggtgaatccaaactatgacaatgatcacaattaccacataaatcaaaatcatcatatcattttggaatttcttcgtggcatttcgcgcaattatcatatgaacccctga

SEQ ID NO: 57417 - DNA, 828 bp, Heterodera glycines
  Genomic contig location: Contig_ID=SeqID_26662; Location=229..1056; Strand=-
  SCN-specific regions: Sequence locations=1-192,216-828
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagctctttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgatttttt

SEQ ID NO: 57418 - DNA, 670 bp, Heterodera glycines
  Genomic contig location: Contig_ID=SeqID_26665; Location=168..837; Strand=+
  SCN-specific regions: Sequence locations=1-133,155-163,185-626,648-670
atgttggatttggtttacaaagaaaaaagttatagccaaaaacatgctggcgccgaaacgggagcgccgaaacgcagtggacccggtaagtgaatatcataccatttagcacaaatttaatgctttttggttcaaaaaatttattaaataatatggcatagtgtttattttttaaatttaatttcagtgacgaaaggttcagtgacgaaaagttcggcgctacttgtaaatagtacttttttgaattttatcaaaaacaaaagggggaccctttcgttttgcaaaatttttttgtgataaaaaaccatgaaaatttgttatccggggtcttagaggtcgctgattatgaatctacgcataaactgtacttgagcccttatttcttatccccttttcatttctttcctatcaaaggtatgcgcaccaagcaaaatgtgcgggaaaaagttatcaaatcactccttcatggtgacgggacaccccaaaatacagtgaaaatcgggcaaattttagaagaagaaaaaaaattcccatgggtttttttgaaattaaatagacccattggaaagagcacaaattctctacaggattgccttttgagaatggtggttctatgacttaaacctacaaaacttgcattttctgtggagaatttgtgctcgtttcaata

SEQ ID NO: 57419 - DNA, 140 bp, Heterodera glycines
  Genomic contig location: Contig_ID=SeqID_26666; Location=747..886; Strand=-
  SCN-specific regions: Sequence locations=1-44,66-140
atggagcgtttcgttcaatggctaaacgagcagctgcagaaacatgacattggcagtggacaaaaaagggactggatggagctggctgcccatgcgcattatgcaatcgtaaggcaaatgactaatttgtatggaatggg

SEQ ID NO: 57420 - DNA, 166 bp, Heterodera glycines
  Genomic contig location: Contig_ID=SeqID_26666; Location=1041..1206; Strand=-
  SCN-specific regions: Sequence locations=1-69,92-135,164-166
atgatgtaccgtatccgaggaccagtttattatgaagaatttatttttttaaatagtgagctttgttaaaacactttctttgactttaaaagaattccttaaattttcagcccacacaatgcttgactttttataaccttaaaaaattcctttaaagggaaataaa

SEQ ID NO: 57421 - DNA, 522 bp, Heterodera glycines
  Genomic contig location: Contig_ID=SeqID_26667; Location=581..1102; Strand=-
  SCN-specific regions: Sequence locations=1-241,267-271,299-397,420 -495,521-522
atgacggttattagttgtgaaatgaagcatataatgacggttattagttgtgaaatgaagcatataatgacggttattagttgtgaaatgaagcatataatgacggttataagttgtatactttttttttctttgcatttaaaaagtgattttttgtgtttaaattatttggtttggttaaagtttttgtccgtataaatccattagagctcgacattttgaaaaaagcctggacctggacctggatttcatgaacaaaaacccagaatatttattattattattattattgtttttaaatatatttaatctttttgataacttgccataaaagtggtactcaaaaaaacaaattcgaaaatattatccaggaaacccagagttggacttgctttttctggataaaaacccaggaaaatccaggcccatgacaaacccagtttgccgaaaaatagcctggacctggaactaagcctaatacaccgcctaagaattgaatttttggaatttttaaaaaataaa

SEQ ID NO: 57422 - DNA, 925 bp, Heterodera glycines
  Genomic contig location: Contig_ID=SeqID_26668; Location=1..925; Strand=-
  SCN-specific regions: Sequence locations=1-925
  Gene Ontology: Biological process=carbohydrate metabolism
gcgttgtccgctgaatgtttccctgcaaatgttctgatcaccggcggatgcggcttcatcggctccaattttgtgaatttcgcttttgacagatggccccaagcaaagtgtggcccattttattttcctttaatcattttcaaaaataaaggttcgtgaatttggacaaaatggcaccgggcgcctcggaagaacgcatcgaaaagaaatgtcgaaattcggaccgctatttattcgtaaaaggaaatctgacggaagcgacactcgtccgaaacattttaaccagaaaccgggtcagtttcagctgccgatcacaccgaactgatcagagagagagcgcggcacttcactcttttcagatcgacacaattgtccatttcgccgctttgacccacgtggacgaatcgtacgcgaacccaaccgaatacatgcaggaaaatacggtagcgatgaccgtactgctggaagcggcgaaagaccacggacagttggccaaattagtgcacattagcacaggcgcaattacgcaatttgaaatgacaaaaaaacatccattgttttaaaactgcagatgaagtgtatggcgactgtctgaacgccgaagagccgaaaagggagcaaagtccgatggagccgaccaatccgtacgctgtcagcaaagccgcgtgtgaactgctcttgcgcagctattggatttaaccgaccgttcaaaaccacttttgggggatcattgcttccgtttgattaagcattcctacaaagtgccttatgttatggtccgaatgaacaatgtctacgggccaagacagttcaggaacaaattagtgccaaaatttgtccgattggcaatggaaaagcgaccgtttacattggcaggaggcggaacaccaaaaaggtggaatttagaaaattaataatttgaaat

SEQ ID NO: 57423 - DNA, 1005 bp, Heterodera glycines
  Genomic contig location: Contig_ID=SeqID_26668; Location=1368..2372; Strand=-
  SCN-specific regions: Sequence locations=1-259,282-312,387-554,576 -676,698-702,757-798,820-871,895-1005
  Gene Ontology: Mol. function=coumarin 7-hydroxylase activity; Cellular component=microsome; Biological process=electron transport
aatttaattaaattatagaaatgcgaagtgcatgccatgaaaatgcaatttgactgatgccaaattcggaaatgccttaggaaacgagcagtacaatcatcgcctggggcatggcgcacttgctgaacaacccgcagagtttgacgcgagtgtacgacgaattggacaaagtgatgggcgacgaacggcgactgatcaacgcgggggacaaagcgcggctgccttacacaaacgcaacgataaatgtgacggaaatgacaaaaataaataaataaatattacagcaaaaatatttaaaaagggaaaggaagcaaaaataaataattaatttaaaatgaaaaaataaaataattattattttatttgtttaagccaaactgtgccattcccttttaggagtttctgcgcatttccaacatgatcgtgcagaatgcctaccgacgtgtattcgtcgacgtgaccattggcaactttcaaattcccaagggcacttgcattttgccacaaatttcggtggttttggccgatgacgaagtaacagaaagacaaaaatcatttaaaattttaaaaatttaggtatttgataacccgaaaatgttccgacccgaaagatttttggacgaaaatggcaattttgtgacatgcgaaaaactgattccattttcagttggacggcggtaagaaaatttgaaaaattcaatgaataattaaaattacaataattaaaatttaaaaaaatcattaattaattttattgctttgtatggtttggaattttagaaaatgttttgccgaatcaatggccaaaatggaaattttcctgttcactgcaaatattctcaatcagtacagagtgcgtttaacaaccaaagaaaaatattaaaatttaattgcatttattttcagctttcggttggcaaagttttgccctcaatcaaacgcgaaatgggcataacaattcattgtccgaaattcgagtgccgagttgagaaaagaatagggcat

SEQ ID NO: 57424 - DNA, 58 bp, Heterodera glycines; identical to SEQ ID NO: 50987
  Genomic contig location: Contig_ID=SeqID_26669; Location=546..603; Strand=-
  SCN-specific regions: Sequence locations=1-58

SEQ ID NO: 57425 - DNA, 1788 bp, Heterodera glycines
  Genomic contig location: Contig_ID=SeqID_5244; Location=617..2404; Strand=-
  SCN-specific regions: Sequence locations=1-139,161-163,185-363,388 -534,655-655,680-850,877-893,921-972,994-1450,1681-1752,1782-1788
  Gene Ontology: Mol. function=myosin light chain kinase activity; Biological process=N-linked glycosylation
atggcatataaaaagagtatatacggtaagcgaatttttacttttttatagtttggaaaattttttcactctaaaattgttttctctctttctgtcagagttatttatcataatttaaaaaaatttccaacccctattacagaattttttctacataaaattgagttatttatgtaaaatgtttggggcattaattttgtacggcaaaaaattggacaaaacagttgactttccaatgggttaatctcttggatatgtatgtgaaaagaagagtcctccgccccggaaaaagaaaaaaattaaagaaatgtcgtgatgccgatggtcggattctgtgtctcattcacgttgtcaatacttgaagttgttaatcttttaaaaatgaggacgctttcgagtaaataaaagcaaaaaattgtttgaaatcgggtttgggattcgaaataggtcgaaatgtatgttcggcacacatccgaccaatttcagtcctaataggcactcacgcgaaaacgtccccaaaacggtcctggcccctataaaaatatatttaaaatgtgtaaattttatttcgaaaaattgaatttgtttaattttcttgaaataattataattttaatcattgtaaattttttacattaaaaattaatttatttacagaaacaaaacataataaaagatataatgatgaagaaagagttcaaataatcgaaaactatgctcaaaccagcaaaataattaacacaaaattcgcaaattattcaaaagaacaacgggcagaaatgatttcgaaaattatcggagttaacattggcacaattacaaaatggaaacgacgcttttcattacaaagttttattttatttaaataattttaatgctatcattttatgggctaaaaaaatattaaatttaaaattttaggaaaacgactaaacgatgtgcaaagagaggaaatcatggccgaatattataaattgaaaaatggagaagaaaaactttcggatgttgcaatagcaaaacaattagatatttcaattaacaatttgaagctattgaaaaagacatgcggtaaaatcaattaaaaaacgagcattaattacagagcattttatctgaagattaaaatatgtttgtggctaggccttggtccaggcttggattttcggaaccggaatttttctgggttttttcctcaaaaaatcaggtccaaatctagcataaaaacaacaccgttgaccagcagcaggcaggcctagggttttcaaaaaatatggattatgttttcatttttagggcatatccaaaatggcactaacaataaaaaggaagaggcaacaaagaaagagaaattaccaaatggtaaaaagaaaaaagaaattataaaaaagaaaaaacaaattaatgacagacaaaacggagaagaattaagcaaaagtagtaatgcatcaacagaagaagaaattccgaagaaaaagaagacacaaaaagaagtcaaaaaagggcaaaaagaaagcaaaagtggagaaaagataattaaaacagagcaaaaagaaaataaaagtggacaaaaagtaatcaaagaggagcaaaaagaaagccaaagtggtgaaaaaataatcaaagagaagcaaaaagaaagccaaagaggtcaaaaaataatcaaagagaagcaaaaagaaagccaaaatgatgaaaagatatttaaagaggagctaaaagaaatcaagacagagccaattgaaattaaacaagaataaatattaattaatttttcaaaatttcaataaa

SEQ ID NO: 57426 - DNA, 1270 bp, Heterodera glycines
  Genomic contig location: Contig_ID=SeqID_5245; Location=2083..3352; Strand=-
  SCN-specific regions: Sequence locations=1-2,24-371,397-493,555 -673,704-706,728-831,853-1270
atggaaatggaattgaaaatggccaaattggaactcgaaaatgtaagtttttgtttaaaaaatatagtaaaaactattaaaaaacattggccaacatttttttttaatttagaaggaacaaaagttaaagcagcagcaggaactgattggagaacagaacgcattgaaggaaaaattggccaaaattgaacaggaaaagaagaacattggtaaataaataagtaaaggaattagtaaattattttatggaattatttatttgaataatttggtaaaattaataaattaccatttacggacgcaaaatgtttgactgactgatacagtatcacaattgagttgtttgattaatatgatatttagtccatatgaaataaataatttattatattttaagctgttgaggaacaattcacaaaaatgcaaaatgttcagaggattcttttggaaaaaatcagtgaattggagaagcagcaaaaaaaggcaggagaagaaattaaaaataaaaataattttatttaattaaattaattgcctttttaaaattaattttagcaacttcggaccaattctcagaaatgcaaaatgaccggaagattcttttgaaaaaaatcagtcaattgaagaaagaaccgaagcagagaaaggtgaattaatttgtaagggtaaaaacaaaatttttatactattttatttattttaaggcacttttaaatttcaaacaaaattattgggttgccaatgattgtgatgagaaactcgaaatcattggcgacaaaaaactcattgtccattataagggagattataaaggtatttttcataatttacttacaaattaagttatacatatgtatatttctccttaaaaggttggcgttccgtcttcgctcaacatgaaatttggctgggcaataatttttccgacattttttactacgaaatttcaatcgaaaaaatgaatgagtatgcgatttatttattttgttttttattgctattcctttatttttaattttacagttatctcatcagctttggattcgccattatacagcagacagatgaatcgtatcaatcagtgcgacatgaaaaggacacttatgcatatgaaagtaatggctgtgtttggattaacggagaaagaaagggatcaattgccgaatattcctacggtgttggcgataccgtaggaattggtgttaattccatcacgcgacagatctttttcacgaggaatggacttcgtttgggttggcaaataattaaa

SEQ ID NO: 57427 - DNA, 828 bp, Heterodera glycines
  Genomic contig location: Contig_ID=SeqID_26670; Location=925..1752; Strand=+
  SCN-specific regions: Sequence locations=1-29,52-271,298-511,533 -640,712-828
atgatcgaaacccagttcaatgcatttctcaacaaagaacagcagcgcgcatttgaatttaaaattaaattgagcggacggacgtgcactttgagtataaatggtgtcaaattgtccaacaatcagtttcggcaacttccagcttgggccacaaattacattcgggtgggtgtgtatgtacagctgttggccaattccaattagatgttttcggaagccaaaaaaaattccgaaatttaagcatccaaattagggtggcaacaacccttgcgcggagggggagggggaaggagacagacggcattctcgaaattttgcccacgtaaacaaagttttacccttttttgccgacccaggtcggttacgaaaaactggtggcactggcgaaattttcaaataaaattttcaccgcttttttccgaatattttttgaaaaaatcgctctaaaatttgaaattattctttcttcgaattttttttttcttggcggtgtttcgggcattttggggttcatcgttatattcattccttattaatttacaatttatttagctcgagggaaatgtgtcaacattggattaccttgaatattattataaagatgaggcacgctataaaactgataagaaaataaattctgttttaaattgttattttaaaacaattaattaataatggctattaaatataattttttttttaaattttaaacatacttaaacatttagctgaaaggcggatggaaacggcacgagaagaaggccaagattgatcctaatgcggtaaaaataatatacaaagcaatgtaaaaaaaaaaaaatgtcaaaa

SEQ ID NO: 57428 - DNA, 733 bp, Heterodera glycines
  Genomic contig location: Contig_ID=SeqID_26671; Location=444..1176; Strand=-
  SCN-specific regions: Sequence locations=1-96,118-206,232-331,438 -472,494-607,631-633,664-733
atgagaaaacacgaaattcagcttttcaagtatataggttatatgcccttgataaatattttttgtgtgcaggaatgattttataattaattattgtcagaatcacataaataaaatggtcaatgaacgacgaattctgtatcaaaaagccaattatttttacaaaattgataaatatgatgaggcggcaaggacgataaatttggtaatttaataaattaaaattttaatcaagaatttgtttgtaaatttaataaacccttatatattatttgccaatttttaattttttttgttatgcttttttcataaatttgaatttaattcgctctttattatcaaaatttattaaaaaaataaaataacaaaagtatgtttaaaattaataaaacaatttaaatagatataaatttctgaataattattttcattattttcagtccattgtccaatcaggtacaaaaaatgaggaaataaataaaatggaggctgacctttttgcaaatgccaacaaaaaagatgtcaagcaacgattggagtttataaagagacttgaagttcttcgcagtcttgaaagattggatgaagaaaaagaaacggtctttaatcaatgtttaaaaaagaataaattgcttattaattatataaatatattttttatatgatttaggcattaaatgaatgcctttggaacctgcaagacgacttattgaagacatgccgtgacgtatgg

SEQ ID NO: 57429 - DNA, 446 bp, Heterodera glycines
  misc_feature (38)..(38): n is a, c, g, or t
  Genomic contig location: Contig_ID=SeqID_26672; Location=781..1226; Strand=-
  SCN-specific regions: Sequence locations=1-202,273-392,431-446
atggaaattgatcatttgttggttggtgcccacccttnttctgaatgccaatgttttgttcttcgccctcaaaaacactgaaagtgatccctacacaattcttgtccaatcgtcctttggtgacaatgtgaaatgcgtttacgactacaaaaattcatccgcttatgtaaatatattattgtattaaacattgaaaatttaatttattttaatttattatttttgttttagtttttgttttattggccccgattaatttttacttttgttttgccggttacaattattctgattgccaacctggcaattgccttcaaagttcgctctctgaacatcattcaaggtcagtgtgagcaaattgaaacactttgaaactttcaatcaattaatccttattaattaagatttatttttattcactaattgttaatagatgaattaataaa

SEQ ID NO: 57430 - DNA, 849 bp, Heterodera glycines
  Genomic contig location: Contig_ID=SeqID_26673; Location=69..917; Strand=-
  SCN-specific regions: Sequence locations=1-59,81-181,203-322,344 -575,615-849
atgaccaattctggtggtaattacacgccgccggcgcagacacagccaaattactcatgtcaggtgagagaaagagagaacatgagacacgaactgatcagaacattcatctgatcaattgttacatcccagcaaagaaacaaaaaaaagttgagcatttgctcggcaattttttttttatcattaaaattgttcaactgttcacaccgaatccaattaattcgggtctgatcaaattggtcagaacaagcgatctttcacttctatttttggcctcctctgatctgtccattttatcgctctttttaatctgatcagtccatttaacatttgcataataaacttaattcttccagcaccaatcgccctatttggcacactctcagcgcctttccgcccatccgtcgcccgccccttccgtccgccccctctcccaaacgccgtcttccgtccattcgatgaacaacgccaccatccaacaacaacagcagcaacaaacgcaattcaaccaaacagcaacacattcttatgagcaacaccagcgatttttggccgaccaaaggcaaaggttggccaagaaaaccaaacggaggaaaggaggggagaggagggcattctgtgccatttttagcaatttcgaacaagtgaccaatcaaaaacacggattccattgacttttgatttggcatttacatattaatttgtctcttcagaatgctcgacttccaacaacagcagcaattcgtcgcttcccatcagtccgtctccgtttcgacctttcagcagagaaagccccgtgaaatgcattcgattactttccacaaaggctcccatggacttggcatccgc

SEQ ID NO: 57431 - DNA, 324 bp, Heterodera glycines
  Genomic contig location: Contig_ID=SeqID_26674; Location=993..1316; Strand=+
  SCN-specific regions: Sequence locations=1-107,137-324
atgacttatgttttttggtgattaagacgtaatacacggggaatattgtaaatttgcacaaaaatatagttcaagattataaaatttatttcataaagaaggtatagataattttaaattatagtttttatattatccttgcaataaatttatacattttccgtctagtgaatcgtgatcagatagctaaactatggagttattctcaaactaaaatcgaaaattttaatcaaacaatctaatattttgagaataattccagaatttttcagtctgattccgagtcactagaagcataatatatataacaatttgaaggataaa

SEQ ID NO: 57432 - DNA, 131 bp, Heterodera glycines
  Genomic contig location: Contig_ID=SeqID_26674; Location=185..315; Strand=-
  SCN-specific regions: Sequence locations=1-131
aattgtatgtttattttatccttcaaattgttatatatattatgcttctagtgactcggaatcagactgaaaaattctggaattattctcaagatattagattgtttgattaaaattttcgattttagttt

SEQ ID NO: 57433 - DNA, 131 bp, Heterodera glycines
  Genomic contig location: Contig_ID=SeqID_26674; Location=1200..1330; Strand=-
  SCN-specific regions: Sequence locations=1-131
aattgtatgtttattttatccttcaaattgttatatatattatgcttctagtgactcggaatcagactgaaaaattctggaattattctcaaaatattagattgtttgattaaaattttcgattttagttt

SEQ ID NO: 57434 - DNA, 886 bp, Heterodera glycines
  misc_feature (18)..(18): n is a, c, g, or t
  Genomic contig location: Contig_ID=SeqID_26675; Location=77..962; Strand=+
  SCN-specific regions: Sequence locations=1-26,57-221,253-323,365 -514,543-549,586-886
atgctgatgaatggattngagacgggtaaattttatttttttaaaagttattaattgggcataattcccttaattgaggcttattgtccattaacggcgcagttttctgcacttatcctgacttgatttacacatccggatcagttggtttatgtaagaatttttggttaaatttcgatttttaaaaaattaaattcttttttagccctttggtacgcaggtatttaaaaatttaaataataatttttatttcgaaacttattttttgaaaccggagctgaacttttgctggctatcaaccgttgtctggagcttcttgctccaaaataaaaaactttattttaatttttatgaaatatataaacttttggcgaaaatccgtatttttctttcattttaggttttttaattcaacaaatcacacaaaaaatgcaaattgaaaactaaaaatattttgttcaaatgtgtgtcccagagaattcccaatttttatgcatttttgacgacttttttgattaaaaaaaaattattagaataatttagtggtccttataatgaattatttataattattttaatatttttcaaagcttaactttccgtttcaaaacaaaaatgaattaattatcttaattacctaattaattacccattttgaggcaatcgcacttggttgctgtgcattgtgccgaccgtttatgccattattttgtcattgtatacgacgcccattctgttctctgggctgtacatgtcgtggttcttcaacccatacgtcggttacgtggacgattttggcaaaattgtaaagattttcaacatattttccatttatcataccgtatcactttcgcaattacagtaccacagcccaatgcacacgtag

SEQ ID NO: 57435 - DNA, 707 bp, Heterodera glycines
  Genomic contig location: Contig_ID=SeqID_26675; Location=1079..1785; Strand=+
  SCN-specific regions: Sequence locations=1-216,238-273,313-469,511 -528,552-707
atgttcgtcatcttcggcttgtccgccatttacataacattttccgttttgcttatcatccagacacaatcctacaacaatgtacattaccaggccactctcgcccaaaaattggtcgaatttacgatttaaaaaatatgacaggcatttttagatgcttaaaatcccaaaaaattcaaaatatgcaaaaaccaaaaataccaaactaatattttagaaaatcattaaaactgtttttccacgcaattttcaaataaatttttcatcgattgcattttttaaatattttttaatttcttctaaaattttatagactttcctccaagttgtgctgatcagcttcttcaacggaatggctgctggcatttacatttacatgcagtcagtgcgtatcagcgatgcactgatcatcgccggaacatacgcatggcttttggcacacggtactcaaatggcagcttttcatttcttaaattaatattcaaaatgaaattaattaaataattttaagttaaaggaaggatacaatttttaaaaagaataatttttcctgaaggaatttctattacttcaaaataatttttttgccactatatttcccggttcgtgccaatagctctcactgagaccgaaaatcaaagaataggattagactagtcaaaattagcatatgagtagtgaaatttttttggtctaatttggactaa

SEQ ID NO: 57436 - DNA, 600 bp, Heterodera glycines
  Genomic contig location: Contig_ID=SeqID_26677; Location=403..1002; Strand=+
  SCN-specific regions: Sequence locations=1-334,357-600
atggcattcgttcgctccttccgacggtacaacgattattatcgcattggcatggaccaactgatcggatgggttttggtgtcggaggattcatttgtccgaagggtcgtcctccaagaaaacctcgctgctcaagtaataagttcttaattagtttactaacttttcacatttctattacctcttgcttcagatgtccatcatcttcaaacatgactgtgtgcgtggcttcaattgggtggccgtctcggtgaacgaacgtcgtcaggaagggacggaatgttacagaaaggcgtgacttttcattgatttttcatagaatttcaaattcgtaaatgttgtaacaattttatttgttagcacagatcgatttcgacaattcttaattacaataatttatcttttcgacaattttatttgtttcagcttgagcttttgccccgttttatggacgacaatgcttcaatgcattacaactcccgcgaaaagcaattcgccacacgttaccaattgcaaaatccgctgccttcaatatttgtcgcggaatacggagattgtccgacaatgaaaaaagtagcaaaattgggcaatgtgcactaa

SEQ ID NO: 57437 - DNA, 594 bp, Heterodera glycines
  Genomic contig location: Contig_ID=SeqID_26678; Location=633..1226; Strand=+
  SCN-specific regions: Sequence locations=1-92,534-535,558-594
atgagacgccggctgcagaagcgcttcaaatattatgagaagaagcaaaagttggaagagacggcggcacggaaaaaagcgacggcagcagagaaaagagcaagggaaacggaagaggagaagccggacgagacgaaaaaggttggaaaagagagaggaaagggagagtgtgggagagaaaaagaggaaatgggagggaaaaaggaagagggaaaggaaaagaaaaagagtaaatgggaaaaagggagaaaaaacggctaggaaaatgtgagggagggaaacgaaaaactagagggaaaacgaaaaagagagaggaaagggagagaaaaagaggaaatgccagggaaaaaggaagagggaaaggaaaagaaaaagagtaaatgggaaaaagggagaaaaaacggctaggaaaatgtgagggagggaaacgaaaaagagagaggaaaacgaaaaagagagaggaaagggagagaaaaagaggaaatgtcagggaaaaaggaagagggaaaggaaaagaaaaggaggtgaagggaggagatggaaagaagagaaagtaatgggaaataatttggactccaaaaaggagaaaaggaa

SEQ ID NO: 57438 - DNA, 290 bp, Heterodera glycines
  Genomic contig location: Contig_ID=SeqID_26678; Location=342..631; Strand=-
  SCN-specific regions: Sequence locations=1-242,265-290
gcgcggaaatcctcaaaaattcttcaaattgccaaaagcgtcgcaattccccgccaaaccctctccgagtcgacgtcatcgaaggccaattgccaaagttgttctctgctgcacaacatgcgcatcttcaggtactgctccacaaggcgcggatcagcgacggtttcgcattggcgctgaacaaaaggaaatgtgcgaatggattggcaaggaaaagaagtgaatgttgtttgatgcggttattaatttcatttaatttttagctttttgggactgaaaaacggccgatt

SEQ ID NO: 57439 - DNA, 2109 bp, Heterodera glycines
  Genomic contig location: Contig_ID=SeqID_5246; Location=5526..7634; Strand=+
  SCN-specific regions: Sequence locations=1-23,45-266,289-452,474 -1078,1100-1162,1200-1431,1461-1906,1930-2109
atgtcatcagacaaccaaaatgaagcagaggcgaagatggcaaacgcgatgtaaaattaaatgccaatttcaatttttaattttgttttcccttttttcagctttatctccgccgattgttggctttgtgtcttcgatttgcttgcgccttctcaacttggcctcggaattgcgctgatcagccaccgttttgacttttacgtcgacgaacatttcaaaacgcgaaaatggacattggcatttattcgaatttggcacaaaattggagaaaatggcacaaagaaaatggaaattgtcaattttaaatggaaagcattgccaattccgcaaattcaaatgtcacgaaaagtcatcggattcaaacggatctacatccagtaaaattgacactaataattagaatttaggcaatatttccattttcacagatacatcgaccaaaatgtcatcgcttttctccaccgttttcgccaacttttcgccgcctgtcaaatcaatttgaacatccaaacggacaatgatcgcatttcggagttcattttgcgcaacatttggccaatgctcgggaaaaacattcatggcattgaaacgtccgcctcatttttccatcttttgcgacaaatggcgccatcaattcttagcgactgtccatcacttcgttttgtcattttttatgctggtgatttgttcgccgaatttccgcccgatgacagtgccgcggcatcggatggacaatctgtggccaaatggcttttcactccacgtccagacgatgtgccaaaagtgttcaaatgctggttgttccccaaaaacttacatttatgcaacaaaactagagctgacaaatgagcgggaccgggacctgaacacggacaactgagtaccaaagtcccgggtttttcccggttttcccagccaacaattcccgggttttcaacccgaaaaggtcccgggtttgcccaaaattcccggtcccgctcaactaaacaaaaccaatataaatgcactacttccctgagtttgtttggcgccaatgctttggtgatcgcaaaaatgttataattttttggtggcatgcataaaaatgaattttgaaaaattgggtattttcgattttccggggttcggaatcatcggatgtcagattcgtgcaacggcgtcgaaaacttttaaaaattgttttattatttttcaaaattccacaaaaaaaaatcagaaaagtacggtattattttgatggacagttgtgatcggcggcaatattttagcctccatttttttcatcaaaaattcgtataaaagacagtgaaaaaaggcaatgaccgtcatttttttgtacaaatattttggccaccattcatactgcggtggccatgcaaatgctttttaatgcccttttggaagccatggtttaaaaaggaatctccggactccataatttgtatttcatttttactaagctattttcaaatccgtcgaaaactatctttaaaatcttgccaccaacaaaatgtcagaccgccgaaaagaagcggaggaaaaaatggaaaaagcaatgtaaaattaaaatttaaaatgccaattttcaatttttaattttgtttccctttttcttcagtttcatctctgccgactgttggctttcggtgttcgatttgctctctccgcgtaaacttggccttggcattgcgatgatcagtcaccgatttgacttttacgtcgatgaacacttcaaaacgcgcaaatgggctctgaaatttattgaaattcgaagcaaaattggaaagaatggcaccaaggaaatggaaattgtcaattacgataaagaaacattgccaattccgcaaattcaaatgccacgcaaagtcatcggattcaaatggatcaacatctagtaaaattggccaatgtcaaaattttttgccaacagttcccatccatttttacagttacatcgaccgaaatgtcatcgcttttctccatcgttttcgtcaacttttcgccgcttgcccaattaatttggacatcgatatgaggagtgatcgcatttcggagttcattttgcacaacatttggccattgctcggaaaaaacattcttgtcttgtaa

SEQ ID NO: 57440 - DNA, 851 bp, Heterodera glycines
  Genomic contig location: Contig_ID=SeqID_5246; Location=7830..8680; Strand=+
  SCN-specific regions: Sequence locations=1-88,112-851
atgttcaactgctggttgactttggatgacgggaatttggcgtcgagaattgaacacttcaaagcggtgcttattatttatttagtactcattctgtggttgtcatttactacttaaccaatttttccacattttaggcatttgccaatgcttcatctcctgccaatttcattgccatcatttcgtttccgttgccttttgctgattccgttgtgccatttgcgctgaccaacgaattgactcgcgaacaattggcattgaaagtgattgacaatagccatcgttttctgtttgtccgttgtccaattgcgcgagacgaaagcaaatggaccaaatgggaagaagaagcgatttattggcgaatttgtgatcagtggaaccaaacagaaattcgaatttgcgacgggtaagcgaatgcttgatcacaaattcaaattttttttgttttttctttttttagctttctcgacgaaattcccggcccaattgatcagcaacagaagtgaatgaatgaatgatttgttgagaagtgatcgatcaatttgaattgagaaattggagaatgaatttgagactattttgacgtgctcataaaaatgatcttttttttgttgggaagagatcagtagggccgcgacttttagtgacgaaaaatatcaaaaaagttaactaaaatagtgagtaaaaatgccaaaatagtgactaaataatgacaaaaggccgaaatagtgacataattttcagcaaaaataatttttattcactgattgcagttgcaaatgaggtacatttcttttctaatattttcttagtaaatattgacaatttttaaatcaaaattttgccaagaa

SEQ ID NO: 57441 - DNA, 1549 bp, Heterodera glycines
  misc_feature (537)..(537): n is a, c, g, or t
  Genomic contig location: Contig_ID=SeqID_26680; Location=262..1810; Strand=+
  SCN-specific regions: Sequence locations=1-197,220-1067,1089 -1358,1381-1416,1506-1549
  Gene Ontology: Mol. function=ammonium transporter activity; Cellular component=plasma membrane; Biological process=ammonium transport
ttccgttcgcccattcgcgacaatcaaaatgcctttttcctcactttcatggctttgcttattttccgttcgtcccctccctcaaatttgcccattttgctcccatttccttcagttatgcagtgcggcttcgcctttctcgaggcgggcgcagtgcgtgccaaaaatgtgacgaatattttgacgaaagtgcgcactttgccaaaataaaaattaaaattcggcatttcccacttaatttggcccaaagaatgtgctcgactctctgatcaccatcgtctcctattggtctctcggctgggctttggcctacggtgccaaccccgtgaccattctcagccctttctttggcgcttcgcaattctttggccaacaaatctccgactttggccgtttcttcttccaatacgttttcgctgctcgcgcctccacaattatttctggcgctgttgctgagcgtgccgaattcactacctttttcgtgtattcactgctcgtcccaggtgacactttcttttgctaattaatgactaattntcgttccattttgccccccccccctcccccaggctttgctttccccgtccttgcccattggggttggtcttcggttggatggcttcacaaaggaataaccgttggtgaacacaattcattccatacaacttatctggtgatcccatagtaaaccaaccaaaatggcactttcccttaggacctcgccggtgccggcgttgtgcacctttgcggcggcacaatttcgctgatcgccgcttggatgatgggaccgcgaatcggacgcttttcgagtgagggacaaccatgcaaaatggaaggacattcagtaccggtgagcaaagagtgcaaattgacggaaaatgagtgccatggcattgccaatgccaatccaatggttcagttggcttcactcggcggcttcattctgatgctcggctttttggccttcaacggcggttcggtggcggacatttctctgccgggaaatggcctattggtggccaaggcgatgatcaacacgctgctttgtggtgcatttgccgcaatttgcactttgattatccacaaaattcgcaatgggaaatggacagttttgctgacgatgaacgcgtgtttggcggggatggtgggccgggggggggggaaagcatcgaataaatgccaaagccattggtcgaatgaatggcatccaaatgacccggcacttacggtcagaactgacacgaggaaacattgttcagattgccgcatgtgcaggatgcaatcagatggacgcgtggggcacaattgtgacgggggtcggcgccgggcttatttacatggcactttcaggacttatgctaaggcaagtaaatgcaaaaacatcaaaataatgactttttatatctctttgctccgtctctctctctctctctctctctcttttctccctctctctttccctttctctcattatctctcttttttctcttgcttttctctctctcatttttacactttgtctcttttttcattcattgtccgctcagat

SEQ ID NO: 57442 - DNA, 1557 bp, Heterodera glycines
  misc_feature (732)..(732): n is a, c, g, or t
  Genomic contig location: Contig_ID=SeqID_26683; Location=168..1724; Strand=-
  SCN-specific regions: Sequence locations=1-7,82-599,621-894,933 -955,977-1225,1247-1275,1298-1458,1482-1557
atgcaccaacaaaaacaaagacagaagaaggagaagaaaaagaagcaacaacaacaaaatgtaaaaataataacaacagcagcagcgatgcatttgacgacagctcatttcactgcccgtacattttgacgatggatttcaaatcgctcggttcgtttcagaagaatgccacacaatttttttttttcaaatttgttatgtgtacccttttttcttacaattatttagatccgtcgttggcacttgggtttttgacacgcgacttggcggagtacgaggacctagtgcatcggcttaaggtaatgccgccgccgtcccaattgttaagaaagagggaattggtttcgaacatacatgtgcaaggggtgtctcagcccaagggccatacgacggacgattgggactgggggggggtgtctcgggaccgatttttcatacgaaggtggtccattttttctccggcgattaccttttttcgttgcttaactactttttttttgcggcgcgttttttccaaaaaactttgaaaggggggtggggccggcggtgccgataggcgccgccgggaaattttttgaattttttttatgaaaattgatcaaattttaaatttttcccccgtcgtcgacgacttccccgttcccacgacggccccctccctcttttacagccgcccccttacgacgaacgaagagggggggggggggtgtcgagacaccccttgcacatgtnatggtttcgaatatgcgaatatgactaattctttgtgctggtaccgtgctttgtcggaaattctgtagcccccatttaaagaaatggaatgggcattttcggggtcgccttgatcacgaatctgacaccgaccgattcccaaccttggcccgaattcaaaccaaaaattgaaaaaaaaaaatttttttttcaattaattaggtaatttaaatttctttgagggatcaatttgtggtgccatttctcaaaaaatgcgatttgcaaatttacatcatcctttccttttaagacggtcgttctgccaagctcatccccgccactgttcgagattctcgactcccgtcctaagggttggcctaaattcacaccgtttgagagcgcattttttctcgacaattcactcgacataaaaggtagtttttgctcaagagcatagccaagggaagggctgccaatgagggggctatagcctccaaaaatgaaatttttagtgaaaaatataaatatttttataccgggttttcctatgaaattttaataaaattcccaaaattttcaaaatttgacaccagaaatcgccttttttcgtgaaaaatcagccagaaatccaaaaatgccccttcgtttttttttatttttgaaattttctaattttcaaaaaaaaactagaaagttttttcaagtctggctacacccttggttttactcatttgttttttcgctacatttaaacaaacaaataaaattctgtttagattttaactttttcagactatgacttcaattgtgacagcgatgaaaactttgaaatactcgaatgaatga

SEQ ID NO: 57443 - DNA, 368 bp, Heterodera glycines
  Genomic contig location: Contig_ID=SeqID_26685; Location=51..418; Strand=+
  SCN-specific regions: Sequence locations=1-368
cggagtaggacaaaacgtcgtcgaacgaatttttcgaccataacttttttctttctcaaccaaattaaacattcttggtattattcgaaagcattcgaaaaatgctattatcctgcaaattttcaaaaatttttatttatgcacaaaaaaatcagagcaaaaaaagttcgaattactgggtttttgagttccttctggccataacttttttgaaacttaacgaaaatttttgagattttgcaaattaataataaacacatagagctatcgaacaacaccaacaattcttaatttgattgacagtgaacaaagttatggttcaaaaagtcttccgacgacgtttcggccgacgacgttttggggtgcac

SEQ ID NO: 57444 - DNA, 364 bp, Heterodera glycines
  Genomic contig location: Contig_ID=SeqID_26686; Location=56..419; Strand=-
  SCN-specific regions: Sequence locations=1-112,136-364
atgacgattggcatggtgggaagcgtggcaatgagcccacgggcagccgaagtgcaccggcaaatgctgcaaaagttggggatggacgcgtcgaatgtgccgccgaatcgggcagtaaatacaatggcacggggacttttcaatggatggtaagggaataaataaagaaaattcaatggaaaaataaaagataattaattacaggctcagatttggtgacgcggatgctttggtcgttttcatcgtttcccccgaggacaaattccgattcgatgagcgcgcaattgaaaacgaacttcagcagatttccgatggacaaattgaagttgagcgaatgacgtcagaagaggccttttgtcagtga

SEQ ID NO: 57445 - DNA, 329 bp, Heterodera glycines
  Genomic contig location: Contig_ID=SeqID_26687; Location=300..628; Strand=-
  SCN-specific regions: Sequence locations=1-329
atgacttatgttttttggtgattaagacgtaatacacggggaatattgtaaatttgcacaaaaatatagttcaagattataaaatttatttcataaagaaggtatagataattttaaattatagcttttatattatccttgcaataaatttatacattttccgtctagtgaatcgtgatcagatagctaaactatggagttattctcaaactaaaatcgaaaattttaatcaaacaatctaatatcttgagaataattccagaatttttcagtctgattccgagtcactagaagcataatatatataacaatttgaaggataaaataaa

SEQ ID NO: 57446 - DNA, 131 bp, Heterodera glycines; identical to SEQ ID NO: 57432
  Genomic contig location: Contig_ID=SeqID_26687; Location=291..421; Strand=+
  SCN-specific regions: Sequence locations=1-131

SEQ ID NO: 57447 - DNA, 578 bp, Heterodera glycines
  Genomic contig location: Contig_ID=SeqID_26687; Location=933..1510; Strand=+
  SCN-specific regions: Sequence locations=1-175,199-399,422-549,572-578
atggagcactctgtgaaaaatgtgagaaattactaaaacataggcaaaaaaatatctatattatttcaacaaagtttagacaatttcgaatcaatttgttgagttatcccacaaattgctttctatattagtcactctgatccatcggaaagacaaacgcaatttggggcggttcttaaaaataaaagattgaaaaatcactcaagaattatagtaaatttttaaatggtttcaaatatttttttacttaacgcattgtttttattttttgtttaattaatcgtacttctctgagaacaaatagggaaatgtcctaaaattctgataaatatttagatttttatttttgaaaattttacctcgtgtttttaaattgtatgtttattttatccttcaaattgttaaatatattatgcttctagtgactcggaatcagaaataaaaattctggaattattctaaagatattagattgtttgattaaaattatccgattttagtttcagaataactccataatttggctatctgatcacgattcactagacgaaaagtgtataaatttattgcaaggataa

SEQ ID NO: 57448 - DNA, 1648 bp, Heterodera glycines
  misc_feature (673)..(673): n is a, c, g, or t
  misc_feature (715)..(716): n is a, c, g, or t
  Genomic contig location: Contig_ID=SeqID_26688; Location=208..1855; Strand=-
  SCN-specific regions: Sequence locations=1-55,77-138,160-175,208 -243,328-464,486-930,952-1154,1176-1422,1445-1648
tttgcgcatccaagtgaacccggaaaacaaggtcgaattccccaacatttctcccgagagggcctttgccgatttcatcttcgcccatgtaattctccatttggtggtcgtcaactttatcggataaaccaatgtgaaaggatgggaatataaaagtcattctaaatttaactgaccgtttattcgtttttctgttaatttattttcgtttaataatgttttgcataaatgggtttcgttggctcttttcttctctgtttttctgttttctttcagtttattttttacccatttctctgcataattctatttttattttatttttttgccatgtgtttgtcacttatttattcattttttcgctcagtttggcgctttttctgcactttaatcaaccgaattttcgccaaccaaaaattggaagacattgtgagttggacaaactttcattttttgaccatactaattttaagttgactgaaaagaagccttccaaggcatctcgcaatcagaaaattgaacaaattctgcgcacttatccgaacgaactcgtccaatcgtttagttgggacaccggtgggtgcattagcaaagggacaggggtttgctcaggcaagtgtacgaggagttgtatcccatcctccaaatgagacaaaccaagaaaaattggatngaagactttcacagcgggtgccccgcaaccacaaatcttaanngcagcaatggaatgaaaggcaaataatattacaacagacaaaggcactccctttttagtgtctattgaacgtgttcatttgttcaggggatgaaactgaggcggcggaggccattttggaggaatcggtcgccgaggacgacaaacgttgggactatcgaagacattggcccattccttgccgcagatcaaaggctatcaaaagctttgtgtgaaggtggaggagcgacggctggagagttactgcgccaactgttcggaacacgagtgggagctgctgagactgtggaagttgctgaagccggaagaggcgctggagggccgaataacggaccaatggcaacagatcggcttccagggggacgacccggcggtaaaagcgcaattccctcactttaaatggtcttcaaaatccattatttatgaaaaccctcgtttttggttcaattttgggacattgccttcaaaatttgaaaattttaatccataaaattcctttttgaggacgatttatacatataattccgaaatgctttatttatttgtgttgttgagaaagacggacttccgtggcatgggtatgctcggccttgaccaattggtattcttcgcccagttcgatttggacaattgtcagcgcgtcctttcgttgtccaaccacccgatcattgggttggttgttcggctgttactcaagtaatgaaaataaattcaaattttaattaatagatttccatttgcaatttgtggcattaccatcacagcgttgtgcaaggtgaaagaagaagaaaaagcaaatattatgagttaaaacatatgtgataaataagcttttacttaggaattacttttcgacgatttgctcaaaaaccatttttacaatgccttggaccaaccgtccctaagtgaggaccatttccatcaagtctactg

SEQ ID NO: 57449 - DNA, 1116 bp, Heterodera glycines
  Genomic contig location: Contig_ID=SeqID_26689; Location=33..1148; Strand=+
  SCN-specific regions: Sequence locations=1-97,120-448,470-633,656 -786,808-1116
atgaacgccctgtccgcagttttcccagccacaaacatcctttgctgcatgttccactacggacaaaacctctaccgcaaaatgaaggggctcaaactggtgcaaatgtatggggaacagtctgtgcgtggtgaagcggtccgacactcattcaggtaacaattctaaaaattgacccaacatcccaaatttttcagaaatgtcctatctttgccattgttgccaccaacttacgtcagacgagcattcagcgtcattgccggcacagcccctatggagatggcgcagtttcttctttactttgcgaggaactacatcggaatgacgcagcgccagctgcttgacggcgccaacgcgttcggagttcgtcctggtggcatttctccacgtttttcgtgttttttttacatttactctttttattttcttttatttgcatttaagcattcgcggggacatcattttcttctgttgaatccgaccacacatactcacggcagcccttgaaatttggctttgactcgcccgccccctcaacactatcatgccttcaacagtggagcaaaactcgccgttggtgcagtactcattgagtccatcgtcaacgactacatttcagccaggcacaccaaaacacaaaattattcatgtcaaaacattttaagcccgtccttgggaagaacccgtagtccgtcgcgcactatttccaattccattttggaacgtgcactctcatgcggcttccgccctcgcaaggaccaacaacggactcgaagcaacacaccttcatttctctgtatttattacttataaaacccccaatttaaataattttagaagggtctttgtcatcacccagccctttccgatttcatttctgaagtcagcggaagcatcgacagacaagttgacgcagcgaggtcagctcggaacttcatacacaaacgctacgtgctgcaggacgcagtcatcatgagaattttggcggatgcaacatacaacgacgatgccgaaattcacgatgttatgacggctcttggtctgcaggtcgaaggatatgcaggaaaattgaaggactacgaaaacacggaagattcaatcatgaatttcgcttag

SEQ ID NO: 57450 - DNA, 1844 bp, Heterodera glycines
  Genomic contig location: Contig_ID=SeqID_5247; Location=1531..3374; Strand=+
  SCN-specific regions: Sequence locations=1-289,312-1084,1107 -1749,1771-1844
  Gene Ontology: Mol. function=transcription factor activity; Cellular component=DNA-directed RNA polymerase II, core complex; Biological process=intracellular signaling cascade
atgggctttggtggacaattcggtgttcaatcggaccgacaggacaaatcggcggccggttgggacgagagggaaaaggcagcaaagcatgagagtcagactggtaatagcaattctctgattgttctttctaattgcttaaaccttccatttcagattacaaaaaaggatttggcggacaattcggcgtccaatcggacagaaaagataaatcggcgctcggatggaacgaagttgagaaggtgaagccacacgaaagccaaacaggtgcaggaaacatcaatgttttactcaaaccattaatttaaattaagactacaaaaagggctttggagggcaatttggggtccaatcggacagacaggacaaatcggcactcggatgggaagaacgagaaaagctacagtcacatgagagtcagacaggtcgaagagaggcatttgtttgtttggtgtgcaattttaaattttagattacaaaaaaggatttggcggacaattcggcatccaatcggaccgaaaagacaaaacggcgcacggatgggaagagcacgaaaaggtggaaaagcatgaaagtcaaacgggtaagtgcttgattgtcgtctcatatgttgttcaatttcaaaaatagacttttctcccgttcattgacagattataaaaagggatttggcggacagttcggagttcaatcagacagacaggacaaagcagcgcacggatggaacgaaaaagcgagggaagaaggagacggagcagccaaaacggcagcagagacgcagaaaaatggggcacaaaggcagcaaaagtccgatgggccgacccacggggcggccaaaagtctgcgcagaaaattcgaacagatggcctcgcaaggggagcaacaggtgacaacaatgggacaatattgtgaaaacaatcaaataattgacagaatttggaccgagttcgtgaggagagagagcgccgaaagcgcgaggatgagcaattgcgagaacgacgaggggaggaggaacgccaacgacagcagagattggaggagcaatgggcgaagcaaagcgaagagggagaaaaaggcgaagagcaacagcagaaagtacaacaacagccgaaacaacggccgaccatcggtcggacagcgaatggggggggggggaattgtgcctaacaatataaatattgaccagaaacatacattccccaatcacacgcatattttgaacaatttcgataattgttttactgttgaaatgtattttactaattctcatcaacttgaaggtgttcgtttgccatacgctgctgccccagtcccagaacaacaacagcagagaaatagtcgcctcgtcgaagaaaattcggccgaaattgcgtcggaacattcggttgccgagactgaagtggaagaaccacaacctccgccggtgaaggtccgtttactggttccactcacaatcaacgcactcaacgaaaaatttatcatttaattcaaaaaatgactgtttaaatgttttactcaatttgaaaagatttttaaaggttttgccatctgtcgctgacattgcgcagcacaaaatgtttatgggcgctgtttctcacgacgaattgaaaaagcacgcgaatttggacaccaaaggcgaggaagagaaactgagagacagcggagaatgggcggatgagccgaagaattcgatgccaaaagaaacggacgaagagcaaaaggaaagggcacagcaacaacaggtggggagggaaaagcaaagagaaaacagcaaaaataaggaaccaaagataaaaccaaagctgtacttaaatggcagatgataacggagtaaagggaaaaaa

SEQ ID NO: 57451 - DNA, 1380 bp, Heterodera glycines
  Genomic contig location: Contig_ID=SeqID_5248; Location=251..1630; Strand=+
  SCN-specific regions: Sequence locations=1-175,197-263,285-339,361 -664,686-1007,1029-1043,1065-1223,1245-1248,1271-1325,1347-1380
  Gene Ontology: Mol. function=transcription factor activity; Cellular component=DNA-directed RNA polymerase II, core complex; Biological process=intracellular signaling cascade
atgtttatgggcgctgtttctcacgacgaattgaaaaagcacgcgaatttggacaccaaaggcgaggaagagaaactgagagacagcggagaatgggcggatgagccgaagaattcgatgccaaaagaaacggacgaagagcaaaaggaaagggcacagcaacaacaggtggggagggaaaagcaaagagaaaacagcaaaaataaggaaccaaagataaaaccaaagctgtacttaaatggcagatgataacggagtaaagggaaaaaatttcaaagtttgaaaaattctaacaataagttttgattttttttaaattttcgaggcgaaatttgtcttgttcccaatggtgttcccccatttaaacaagtatcaccaaaaaaaaaaaaacaaagaagcataaaaggaaaaaaaggtcgtctaccgggaaaggagggatttgaaatgatccaccgaatgaaaaattcattgccgaatgactctttgctaatgcgtatgcctcaaattagcttaattagttttaaactgggaattggaatttgtttcaaccgtttatccatcctaatcatggccaccttcctacagcatcaccagtacgaattgcctccgattgtctacgacgaattgccagatgttgtcacctcttctgctattactcctgctgatgctgcactttccaaccactcggaaaatgatcagaatgtgccgccccccgccgacccgacgccggcggtgaaggaggaaccatcggcgggggaaagcaccgccgcccctttggacacttcggcgggagcaactgcaatcgcactgtttgagtacgagcgacaggacgacgacgaaatcggattcgaagtgaacgacataatcaccgacattgaacaggtaataacattttaattgatgaatttgagtcacaaatagtccgagagtacaagagtggtccaatgactttttccctcgtgccattaaattttccaaaatttgccgtccgttttcagatcgatgttggctggtggcgtggcgtgtgcaaaggtcgctacgggctgttcccggccaattacgtgcagctgaccgagcgaaagtgaagcgaacggaaaaggcaaaagcttgtgcaaaaagacgactaacggaggatatgctttgatgtttaaatcttcgcactttcgcaaattcaccctttttgagtgaatgtttccattttttttatcaaatcagtcacgtaattaattaatgggttataaatggaaatattttttcccctcccttcccatatcagttcagataatgcctttttttattctaattgtccagctttgacaggtgcttatttttcctttttctcctttcgacttacccaaaatatttttttcatattaaata

SEQ ID NO: 57452 - DNA, 396 bp, Heterodera glycines
  Genomic contig location: Contig_ID=SeqID_5249; Location=738..1133; Strand=+
  SCN-specific regions: Sequence locations=1-156,178-199,332-340,362-396
atgatcagacagggatggtcagttggccaaacggatgcaaatttaaacgaagacattcaaattacagcgcaccgatcgagacgatacatttgctgagagagttcggactccgatcaacggacgaaattcagagggaacggctgatcgaagcgggcaaagggctgaaaatgttggaaattgaggcccgtgaaatagcacgggaagatgagagtgtggaaagggaggaggagggaaaagacgcaagggaagaggagagagtggcagagaaagagagagacattggaagaaaagaaggaaagagggaagagagtgctgcaaaggaggagaaagacgctggcagaaaacagcaacaaaaagccaattgaggctaattacagtgaacttttttatgtgtaa

SEQ ID NO: 57453 - DNA, 613 bp, Heterodera glycines
  Genomic contig location: Contig_ID=SeqID_5249; Location=45..657; Strand=+
  SCN-specific regions: Sequence locations=1-510,532-613
gtactgtgaccaaactgtgcccgatgagtttctccacctcatttaccccggccccgtcactttgctgttcaatcgcaccgatgccgtcccgtccgacttcaaccccggctgcagcaccgtcggcgtccgtgtgccgcaggcgaagttcgtgcgcgacttgtgccgtcgcatgcccttccgactgctcgcgcagacgagcgccaacgtcagcggaggaccgaatccattgtgcatccgagtgggtgtggtgaggggaaatcactttgaacaacgaatgcacttcattacggtttcccgaaaacttaaaaatttaataagtccaaaaattccaaaattccaaagaatatggaaaaacaggaaaaaattaaaactattcccaaaaaacctataaaaatttagtaaatttttcaaaattgatatttaatgttttcgggcgggaatgagctaaccattaagcaaaactcgcggctctattttcggatcatgcttttgcttgcaaaatttttttcaggattttgaagagatttgggacgacatcgatttgatcgttgacgcgggcgaaatcatcgaaaacaatggggcggacgagggaagcacaggtggacggacataa

SEQ ID NO: 57454 - DNA, 128 bp, Heterodera glycines
  Genomic contig location: Contig_ID=SeqID_5250; Location=352..479; Strand=-
  SCN-specific regions: Sequence locations=1-128
atgaaccaattcccgtggggccttcgcatgaccaaatacgaggagcagctgggcgctgatctgatcgagcacggcctggccggacacaacatcgccaaatattccatcgagaagaagctgaacgtgag

SEQ ID NO: 57455 - DNA, 66 bp, Heterodera glycines; identical to SEQ ID NO: 53774
  Genomic contig location: Contig_ID=SeqID_26690; Location=731..796; Strand=+
  SCN-specific regions: Sequence locations=1-66

SEQ ID NO: 57456 - DNA, 162 bp, Heterodera glycines
  misc_feature (60)..(60): n is a, c, g, or t
  Genomic contig location: Contig_ID=SeqID_26691; Location=66..227; Strand=-
  SCN-specific regions: Sequence locations=1-6,44-162
gatctcacttgaatatttgctactaccaccaagatctgcactggtggaagctccggccgngcccacgcccaaagccttcaacgcaaccaccacgaccctcctacacgtcatgggcagactacgcgacaagcacgtgtacaagccaatggacgtggagtatag

SEQ ID NO: 57457 - DNA, 828 bp, Heterodera glycines
  Genomic contig location: Contig_ID=SeqID_26691; Location=843..1670; Strand=+
  SCN-specific regions: Sequence locations=1-187,220-828
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgatttttt

SEQ ID NO: 57458 - DNA, 703 bp, Heterodera glycines
  Genomic contig location: Contig_ID=SeqID_26692; Location=178..880; Strand=-
  SCN-specific regions: Sequence locations=1-86,108-703
aatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaac

SEQ ID NO: 57459 - DNA, 1176 bp, Heterodera glycines
  Genomic contig location: Contig_ID=SeqID_26693; Location=98..1273; Strand=+
  SCN-specific regions: Sequence locations=1-354,376-939,990-1117,1138 -1176
atgcacctttatcgtgggcatgagcaaaaaattgttaagaaatttttggccaacgcaaacagaccaatgtttgactatatgaccgagcgtttatacatatctgataagtacgaacgtcagatcagtgaaattgaactaagctatctcgagcggttgtggacaaataagaatccgacaaattttacgttgctaaagctgaattttgtatgcatgttaccacaggataaaactgatttcataataatagataacaaggtgtatctgattcgatcggaccgtcgtatttacaaatatggaattaatgacggtcaaatcaacccaaaatttgtgtccaacatcagtgacactaaatttaactttttattatttaaagaatatcgcgacgatgtaattaatatacttcaagccagctcgccaacgcctcaaatcaaattattgttatggtctgcttatacatttgacgtactgctggtcgtcatttgcgcatatgtaataagacaaattcgtcgtaccagcagaagcagtaaaacttcatccgaagatgttggcatgtttgaccaaatggaactggaaatgttttcggataatccgaaagatttagtgtacaggccaacaacggtcagagagaggagtatttaaggcgactattctatccatttgacttcattcttacacaaaccgtatatgcagcgagcaataaaatattttattgactattatgcgctaaatgatataactcagctgtacgctctcctaaaatccgaaatagactctgaaccgtccaactattatccaaatcctttgcaatcagttccttgtgtacaccttgtgaacgaagagtacgaaaatcagcctgttgttgtagaaggaacacttgatctgataggcgatctgttcttttcaacatgttatcccaagaagagacaggggatcgattggtaaaaattttaattattatttaaatgttgatttaattctttttatttattcaggagcgaacctctgtatgcggaattgaaggatctgatggtttgtccgggcgatttgcggaaatgtctgtcacacttcggacatcggaaggatcagcgcaacttggtcgtcgacgagctggattggcacgacgacgacgacgacgacataacagaaggagcttggtgaaagagctatgcttgttta

SEQ ID NO: 57460 - DNA, 778 bp, Heterodera glycines
  Genomic contig location: Contig_ID=SeqID_26696; Location=305..1082; Strand=+
  SCN-specific regions: Sequence locations=1-355,378-382,405-778
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatgcacgcgttttgctttagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaa

SEQ ID NO: 57461 - DNA, 58 bp, Heterodera glycines
  Genomic contig location: Contig_ID=SeqID_26697; Location=1026..1083; Strand=-
  SCN-specific regions: Sequence locations=1-58
tcgccctaccgggacctggacctgagcttttcaaaatccgggaccgggaaccgggacc

SEQ ID NO: 57462 - DNA, 1718 bp, Heterodera glycines
  Genomic contig location: Contig_ID=SeqID_26698; Location=101..1818; Strand=-
  SCN-specific regions: Sequence locations=1-8,31-122,152-302,325 -393,416-575,597-741,767-1095,1117-1330,1352-1406,1428-1645,1674-1718
ctagttcaattgtgactccattgagtgaaactcatgattgtccatacagtaaagggtactgtattttgtccgacaaatcagtcttgatttggcaaatagactttgaaagaaagtgtaattttattccaattggaaataaaaatgggaaaatgatggacaaaatttggttatctgatgatggtgagctgggtctatccttcgggaatcaaacgaatttaattgattgtgggcaaaacataacagtgtctgatcagggtattggctcaatcattttggaagataaaactcgcagaaggaaaaggagtaagaaagaaaccaaaaatcgggtagtggatgggattgtgacttcttctcagttagcttctcaattgacttatttggatgcagaattaactcaaacaatgagttttgcattttctcaatcacttaggacattttgtgagttcattgaggagaatagaagatgggttgaagcctcattcttttcaaatccaacggatttggctagatttactttctctaatccattcatttatgctaaaagagcagcccaaacacttttaaaaatttggccatgcgttcctttggaccaaaaagattatgaatttagaccaaccaaacttcaaaatcaatgtttcgaattcataccaattaatttgaagacgcagggtagggaacattttgctttcattgacccaaagtcaatgataatctctccatcatcaagaaaaggttcctgtgaggaatttagaaaaattataattcaaattgaaggccaaattttagaaattgaccaaatagaaggaaaaattacttcggtaagcccaaataaactgattcatcatgaaataaaatttgggctaaacaatttgcttcctcaaatagaagcacatgcttttcacaaattggttctactaaatctgacagacataaaagatcatgcttttgtgagtaatatggtaaaattgagtcaaatgacttatcagattcatgaaaaggacaccaaaatcacagctacaatttctcaagaatgggaagaggttgaaagccaaatgatcaaagcagtgattggtgattacagaaaaatgtggttaataattatgtctctaattattaccattctgtcaattgacttggcgataagattgacaattggtttaagtgaaatttatgcagggaatgggcgcttaggcaatttattatttggtacaacaattcagaaagctgggagcagagtaagaaaattgagggagactaaaattcaacaaggagaaatttatgaagaaccaattaatcagattaattggccaccaagaattagaagggcaggaaattcatttaaaaaatctttcaccagacctttcaaaagaaataggcatggaccaaatccaacacaaatgagcactcattttgaattaaattctttgatgggacagcttgggtcgttaaataataatacaatgacagggaccacttttgtctctcttaataatttccaaatgaaatgtttagtggaaactggctcaagcacctcagttgcaccaaaagcgttagccgattacttaggtattaaaacatttaaatcagaggcacatttaatgagtgcttccggtcatccagtgcatgtcaaagaagctgctcgtgtgactttaaaaataggaaatgaatatgtggacataattgtcgtcttttcgatgatgaactttcatggacaatga

SEQ ID NO: 57463 - DNA, 91 bp, Heterodera glycines
  Genomic contig location: Contig_ID=SeqID_26700; Location=1011..1101; Strand=+
  SCN-specific regions: Sequence locations=1-91
aaaagagcgcaccccatctgatattcccatttttccgttccacaactggccaaaggcgactgtgctcattgacacgtcgttgtccaataag

SEQ ID NO: 57464 - DNA, 1054 bp, Heterodera glycines
  Genomic contig location: Contig_ID=SeqID_5251; Location=1656..2709; Strand=-
  SCN-specific regions: Sequence locations=1-111,219-236,258-382,404 -581,603-745,787-1054
atgaatttgttcgtgaacggcaaaaagacgacggagcatgtgtatggacggcaggaatgggaaaacggcaccgtgtacacttatgccagcctggcattcagaccggggtaaaaaagaaaaaatggaattattaaaaataaaaataaggcaggaataaaaaagaaaattggaattaaaaattaaataagataagggtaaaaaagaataaattaaaaatatcagggtaaaagcgtatgaaaattaattttcagaaaaattcaccataaaaaagtgatttcctgcgaagcgcagcacccggaaacgaacacaaacttacgcgactcgatcactttggatgttttctgtgagtttggcctaattgttatgatgatcggataattggtgattgcaaataaatgaactacaaatgtattttgagggttgcggtataattggatggggcggaaattttaaggatggcgggatgagttttgtgaaaggtcggtcggtcgaacaaggagttcattttcaagtttttacaggctaaaaatattaactgatcaaaaatctgaaattaaaaaaatccaaattaaataaattcgagttctgaattatgaaatcagcgaatatttttagccccggaaagtctgaaaaaatgtcgactccttccttgttcgacttttctcaaaaaacttttcagcagaaaaagaaattcttcgatttttcgaaagagaaaaatttacagttaaatttagatttttgatacatttttttaaaataattttgtaaaataaataaataaattttcggctgccaatcttttcaaatttgctctttttcgtctcttctcttgccgtccaaccatgtttctctgttcaattttacagattcgtctgatcggccaaagatcgacttgatcagtgcgtctgctgccggcacggcgcttaaggcgggccaaaacgtgacacttttgtgcaccgccgaggggggaaatccgccgccgcagctgacatggtccaaccaaaacggacgcatccacgaggaggacgactacagctacgacacgggcactcag

SEQ ID NO: 57465 - DNA, 650 bp, Heterodera glycines
  Genomic contig location: Contig_ID=SeqID_5251; Location=3708..4357; Strand=+
  SCN-specific regions: Sequence locations=1-432,497-538,562-607,629-650
atgttggatttggttcagaatgatgcctcggtttgtcctccactgcatatggaacggctcacttgtgccatggtggtgggcaattgagcagcgcagtgacagatcagagcctggggcaaatagcataattaacgtttacaatagagaaggcaaaataacaataatttgaaaatttacgaatttttttctcaaagggatattttgttattgagtttgttttacaatttagaaaaccgaacaaatctcaaaaattattaaagctaattttgattattttttgagattttgctcgctttctccaagatgtctcggtttaaatttgcgtgtcccttcgcagaaaattttttaagcatatcattttgccttccttttctcttgttagtttcttagttggtattttatgaattgctactaacagtaaaaatttctttcaattttatttttttcaattattttgaattttttcttttttttattttaagttttcaaaaattatggaaatgccacaccaattaggatggattggttcgtcgggtgctccttgaaatgcaatttttcagcaacaacggcacttgtccaaaacaatgacgagagaaggaaaagcagcgaagaaaagtgaaggaaaaagccaccaattcttagcagcgtaa

SEQ ID NO: 57466 - DNA, 218 bp, Heterodera glycines
  Genomic contig location: Contig_ID=SeqID_26702; Location=309..526; Strand=+
  SCN-specific regions: Sequence locations=1-218
atgcgttcttcaattacgccatcaacatttttgcaaagtgtgttccggcttaacaaatggaaaagccacaactacagggacaaagaattatgggttatcaatcgcgatgaaagaaatccaaagttgaataaaatgttgacaaattggttgtggaatgatcatttgccgaatgagaacgcattttttatccgtgcaaatcttaaatatggtgcatcgag

SEQ ID NO: 57467 - DNA, 737 bp, Heterodera glycines
  Genomic contig location: Contig_ID=SeqID_26706; Location=190..926; Strand=-
  SCN-specific regions: Sequence locations=1-184,229-282,305-437,460 -488,511-615,637-737
atgctgaacttcagtccagacgatgacgaatgtgaggaaggatttgtaatcaaaaaatctttcgggtaaataattaagaacgactagaagcttcacactaggcccatgtttcttaccactgtttaatctcaaaaccaagaaaccttcgaaattatgccgagcttaaaaatttttcaacactttgttaaataaaaatttaataaatacttttcaattttttttttttttgcaaatttttgcccttttttaacaattgctgtgcagcaacatttgaaattctcacatttttgtacatatttgaaagggagaataaatttataaattgtacttaagtagtaattcacatttgttcagtttagaattcccacaaataaatttatgaaaagttgccaaattgggcaatggaaaacattgcaaccgcttttagagaaattcaaattaattgtaataattatcagtgaacggatattatgtgctaaaaattctgcaatatataattaaaaaatatatgctagaaaaccaaaaaatgccaaaataattggaaaatcaagtgtatttatatcaaatacttttcgaggtgttgggactaaaatcagtttattttagggggtgcatttttcatttcttgtattttcaaaaatatgtacaaaaagtggtcctaatatgtacataaatatgtatgaaaaatcccaaatatgtataaaaacccaaaatatgtacgaaaatatgtaaataaa

SEQ ID NO: 57468 - DNA, 221 bp, Heterodera glycines
  Genomic contig location: Contig_ID=SeqID_26706; Location=1333..1553; Strand=+
  SCN-specific regions: Sequence locations=1-221
atggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaa

SEQ ID NO: 57469 - DNA, 104 bp, Heterodera glycines
  Genomic contig location: Contig_ID=SeqID_26710; Location=2095..2198; Strand=-
  SCN-specific regions: Sequence locations=1-104
ttcgctggcacgggatttgaagtggtcaagcaaaaggtcggcatctttgcgcagcatttggcccgactcactgaagtcctggaaaattggaaaattaaaaaaaa

SEQ ID NO: 57470 - DNA, 1066 bp, Heterodera glycines
  Genomic contig location: Contig_ID=SeqID_5255; Location=132..1197; Strand=+
  SCN-specific regions: Sequence locations=1-63,298-696,724-768,809 -1025,1054-1066
atggcaccgacggcacttatggaggatggcggaacgtcaacggtgacaagcgccagttccaggtaaaattaattaaatattaataaatgaaaatttgtttggtttcgttaataaaatacattcatattgaaattttttatttaataaatattatataattaataatattttaattttaaaaatctttcagtaagaagtggaaatttagaaaccaaaaaataataattaaactgaaaatgtttataaatttaggaatttaaaaattaaaaattttgtttattttttatttttttttttctaggagggcgggtggttggatctgtcgttatttgtaaaaatttgtttcaacaaatttctcaactaaattttttttcaggtccacccggtcttccacaggttcttcttctggctcatgctgttcatcatgtggcggggagcactgctcacagtgctgtgacgaaacatcgtcattcatatcatcgacaggtgtcacattcatgtcatattatttctttcaatattttaaatcaattaagcatatgcctttggaccttcgtcaagcagtgcacgacggggaggaccctcgcatggtggtggtgttcagtgcccgggggatgccgaatatgtgcagcaacgaaaaatgccaatcatggggccaaattttggttggtttttcgatgaataaattattttggcaattattataattttttttaaaattttgttggatcatcacaacgcactgctgataccgccaatttccatcaacttcatcatcatcaacaacaacagcagcagcagcaaaggggacaaccttcgtcgtcaagaggcacaacatcgcaaccgtatcaaaaaagtgagctttttaatatgttttctattagagtttggaattttgaagaaaaaaaatatagattcgggttttgtgaatcaggccgagtttaatgtggaatatttaaggaaaatttggcaaaaaaaattttctggcggtgtaaaaatattcgaaaaatgtacaagtgaattgaaaaattatttaaaattcttaagcttttccgttttcagcaaa

SEQ ID NO: 57471 - DNA, 570 bp, Heterodera glycines
  Genomic contig location: Contig_ID=SeqID_5256; Location=61..630; Strand=+
  SCN-specific regions: Sequence locations=1-164,191-541,564-570
atggtaaaaagacgagattcgtttttgtacaattaatttttgaccctgattcgtttctataagcccaattcatttttattgttcaaatttgtttttaaccccattttttattaccacattttttgggttgcaacgcgaaaagcgatgtcatatcgatgaaatttcaaatatttttaaattattttcagcatgtaactaaaataggtaggtcaaggaaaatttttgaaatttcattcgcgtttcaagcataaaaacgaattcgagtaataaaaactgaatcgagacaaaacgaattggccaaaaggcaccgccgggcctctctttccaaaaattcaaaagcaaaaaaacaaaaacaggaatcctggttcttctaacatccaataaattaaataagcatttgacgaattttgtttttttttaaatttttggcattatgtacccatgacacttttacaggcaatgccggtgatccgcgcacagcccggacacattccgctaagcgattcggaagaagatgaacagctgatgaggagatcaacaggaatgatcaaaaatgaaactccacaatga

SEQ ID NO: 57472 - DNA, 676 bp, Heterodera glycines
  Genomic contig location: Contig_ID=SeqID_5256; Location=751..1426; Strand=+
  SCN-specific regions: Sequence locations=1-173,259-293,406-676
atggcagaatttaatacagtaatacacggttcgtctgccttcgttggatggcagtgttggtggacatcggctttcgcctcggcacagtctatacgctgctgcactttattggtgtggaattttttaaactaaagttcaaagacttgcttaatgtgaggatcgaacttgtcatttctctctctgtctgtttatcaatctctcttttctctctctctctctctctctctctctctgtctgtctgtctctctttttctctccattcaattagtgtataatgttaattagctggctatctctttctttctactctttcgttttctatctctctcttcatctcactctcttctctgtctattcctttttcgcactctctctctctttctctccctcttcctcattctctcataatttcctttgcatgtctttttgaattatattttttccccatcaaatttctttaaatatttatctttgtttagctctcgcattggtcgtgcaattggaatagagcgtgatcctttcctatacgagttgcagtgtcaaattgttgccgaatttggcgattgcttatctccaagagttatgttcgcgatgttggcactacatcaaaaggtagtgcgcccgataggactcggacccattggcttgtctctgtacccaaattcggcaatttaa

SEQ ID NO: 57473 - DNA, 2059 bp, Heterodera glycines
  Genomic contig location: Contig_ID=SeqID_5257; Location=678..2736; Strand=-
  SCN-specific regions: Sequence locations=1-40,63-118,140-146,194 -261,283-445,468-1669,1692-1780,1802-1851,1873-1978,2005-2059
atggcgagtaaaagtatattcacgaattttttttttcttaaaaaactgcaaaacaaaagggtcccccctatagtttttgataaaattcaaaatttgtcactttttaattagcgtcaaatttcttttaaaaattatttatgcgtaccatatattaaaaaaacaaattctatattaaaataaataaaaaaaaaatcgaccaaaaaaaagtgcaaaaaaaaatttaaaaaggtcctctttttaaatagcgccgcggtcccatattttaccattttttgaaaatttcacccaaatatggcaaatatggtcatttaaaatagtgacaaatagcgactaatatctttcgttgaaaaatattgcaacactagagaaaaatatttggcccaaagagaaaaaaaaatttcggaggccaccttccgattttttttttatatggaaacggatctggtacagtaaaacaaacaaacaaagttcgatcgtttatccatttttcaaaaaaaaaaaaatttcaagtatttggtttttcccacttttatctcaatttctcatcttcattcaaaaaaaaatgtttataattaattattcaaaatgatgaccgaccgcttgtaaccaatcgtcgaaggcaaagccaagtgccgacggacagagatgggcagtgaccaactccagcgagggcgagtggcaacaacagagtgtcaggacgcaaataggcacgcaaatgttgccaacaggaaacctttttagagagggggggggggggagtcatggaaaagacaaagtttacatgtttggaaagcgtccttcttcccatctttctcctctctcagacaacgcatcaaaaaaatctacctctgactacccatacaccgctcttagtgaccaacttgcggcaatttcccaacaaatggacaacaacagtgtcgaccccatcactaaacaacttttgaaaatttgtgtcgaacttttacagcatgtccagcaacaacaggccgtcatctccgaacaagaccttcaactccaacatttcaaacaacagaaaatgatggaagaagccattcaagaccatgagcgtcggcgaagcgtcgtcgtaatgggtctccctgaatcgcagaaacaaaagccgtccgagcgagtcgctgaggaccgaactgccatctcaggcgttctcaatgagcttggcatcgagagcccaatcactgtgtacagaatgggttccccagaccaagcaaaggcaggtcaaaaccgcccgaggttgatgaaagtaattttcgggtgctccaaacatcagaaacaaaccttggcacagtggaacaaagggcgcgcgcaaatcaatcagaaattggggatgagcaacatccgaattcgccctttactcagccaagaggaactcaaggcccgacgtgtgctgcaagaagagtgtagcaggaaaagaaaggaagatggcggcgagtgggtggtgtacgcggacaaagtgatgctgaggtcagacattgcggcatttaaaaataacaccaattgacttgctgttttaccaaatcacactcataaaacatttataaattcgcacttttccggtcttaagcatgttaagcccaataaccccaaaaccaaaataggggaagttaaagcatgcttagttaatattagatcactttacaacaaaattgatgaaatatctttaaatttagtaaataataacatagaaatttgcctgttaactgaaacgtggacaaaggagggaaacccaatcctctttagtccatggataatcgaaaattataaatttgttttttgtcatagaaaatctcaaaaattaacacgtgggggtggttgcggtgttttaattaagaaagaaattgagttttttgttaaattttctgaaacaaaatataattgcgaaatcttggtttttcaattacaaaaactaaaatcaattagatttgtgcttgtttatcgaccacccaagacaacatatagacaaaccaaggaacttttaaaatttttagaaacattctatagccataattgtgttgtgttgggtgattttaattttccgaataaa

SEQ ID NO: 57474 - DNA, 138 bp, Heterodera glycines
  Genomic contig location: Contig_ID=SeqID_5257; Location=2002..2139; Strand=+
  SCN-specific regions: Sequence locations=1-138
aggtttcctgttggcaacatttgcgtgcctatttgcgtcctgacactctgttgttgccactcgccctcgctggagttggtcactgcccatctctgtccgtcggcacttggctttgccttcgacgattggttacaagcg

SEQ ID NO: 57475 - DNA, 503 bp, Heterodera glycines
  misc_feature (17)..(17): n is a, c, g, or t
  misc_feature (26)..(27): n is a, c, g, or t
  Genomic contig location: Contig_ID=SeqID_26712; Location=742..1244; Strand=-
  SCN-specific regions: Sequence locations=1-126,155-295,317-425,447-503
caaaagttttttacaancacatatgnncaatctaatttcttgcagatttaaacctatccatgctgccggggttctcggcacagcaaagcactaatagtgtgtttgactcacttcaaataataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattgcctatctaatttcttgcagattgaaagccatccattgcctgccggttctcggcacagcaaagcactaatagggtgtttgattcacttcaaaaaataattccttacacaagttttttacaaccaaatattgccaatctaatttcttgcagattgaaagccatccattgcctgccggttctcggcacagcaaagcactaatacggtgtttgactc

SEQ ID NO: 57476 - DNA, 1065 bp, Heterodera glycines
  Genomic contig location: Contig_ID=SeqID_26715; Location=222..1286; Strand=+
  SCN-specific regions: Sequence locations=1-231,328-431,487-527,554 -972,997-1065
atggcttcttcttcggcttctgctgtcggggataacaatggttggtcgccagaagcgaagaaacggcgcacaattattggcactttgctgcgccggggcgacattttggagacgaacgatggcgacgacaaaaccgtggaacgcaatgatcaaaccgcagcagatgatgacgaaactgatcaaacccattcaaatcgacagtaagaccgggggacgtgacaaattttcgccaaaaaaaaataaataaaataaacttacaattcgaaattttttaagaaattttttttaattttaaaagaaaatttttaaaaaattagaaaaatttttcagccattttttcctgaaatttatgatgaattagtaagttttttatgaaattttttccaaaaatcactaaagaaaatttcaaaaatttttcccttggaattttcatataaaaaaatttctaatatttttttcttgaaatttgaaaaaaaaaattttaatcggcgcaattttggggtgcactcactctcagtccgtggattagggcatttattttttaaaaaacaaaccccccccccccttagcaacggtttttcggtcgaaacgcaacaaagtgtggacttgagttgcatgacgtttgccaatgctggactggaaatggacgaagctgagcagacgatgatgaacaacgaagacgaacaaaattgtagcgatcaacccattgttcaacggacaactcaagacgaatacgtcgtctctgaggattggccaaatgccaacaatgttggcacaaaaaaggcacgaaaaagcgaaacaacaacaacaacaagaaggacaagcgtgaaattgactgctggccaaaaggcattggaggtggtggcgagagttaattgagttatgccatgacaaacagaaattgtctcgagagcagctctcccccgccccgcctatcatttccaccctaaaagcggcttaaaaggggaactgaaattttttataaaaaaatttaatgaaaaaacgagttgaaaatttttcagcgattttttggacaaatttttgaaaaaatttagcatttaatta

SEQ ID NO: 57477 - DNA, 49 bp, Heterodera glycines
  Genomic contig location: Contig_ID=SeqID_26717; Location=845..893; Strand=-
  SCN-specific regions: Sequence locations=1-49
ggaagctactcccgaaggattcggtctccccataaatctgggcgcatcg

SEQ ID NO: 57478 - DNA, 728 bp, Heterodera glycines
  Genomic contig location: Contig_ID=SeqID_26719; Location=301..1028; Strand=+
  SCN-specific regions: Sequence locations=1-271,322-639,661-688,710-728
atgggcgcaaatgtctctctgagcaccaccggtgcgtcgtgcgcaagcccagcgatcaccgtgggcagcacgtaattgcccttcgactcctccaacactttgccaccgcacagaatccgaccgccctaaatacagatggacatgaaacaaatgtgcggagcagctcatccaccccactcccccccccccttctcacaatcactgtgtccccgatcaattctatttatttaaaaccgcaaatttttttcaaaaaacccaaacaaatagtatcaataaaaaatttttaaatttggtttttttttctaaaattaaaattattatgttgttttcttacagtggcaatggcctcggcaatcgccgttttgtatttgagcaccgactcgcgactgtgcaaagggccgatcaaagtgcgctcatccaactgaaagttgtggaaaaggaagataagaaaatgtaaaatttagctgagggaaggcacccataaaatcaaaaaagtgccaaaaaaataataggaaaataagaggtatctcattcaatgtcaaagggttggccaatccgttccccattaaaaccgggtctccgatgcgcgtgtccatcagctgtttgtacgcgctgaccacccgttccaacaccacgtcgtacactttttcgtgaataatcagtcgccgtgtgctcgtacagcgctgccctaaaaagaggaaaaaatgggtaatttcatttgcaaaaga

SEQ ID NO: 57479 - DNA, 1052 bp, Heterodera glycines
  Genomic contig location: Contig_ID=SeqID_26719; Location=55..1106; Strand=-
  SCN-specific regions: Sequence locations=1-97,119-146,168-485,536 -893,915-1052
  Gene Ontology: Mol. function=aldehyde dehydrogenase (NAD+) activity; Biological process=aldehyde metabolism
atggacgacgccgacttgagtttggttgtgcccgccgtcactttctcttccgttggcactgctggtaatattttttattcttttgcaaatgaaattacccattttttcctctttttagggcagcgctgtacgagcacacggcgactgattattcacgaaaaagtgtacgacgtggtgttggaacgggtggtcagcgcgtacaaacagctgatggacacgcgcatcggagacccggttttaatggggaacggattggccaaccctttgacattgaatgagatacctcttattttcctattatttttttggcacttttttgattttatgggtgccttccctcagctaaattttacattttcttatcttccttttccacaactttcagttggatgagcgcactttgatcggccctttgcacagtcgcgagtcggtgctcaaatacaaaacggcgattgccgaggccattgccactgtaagaaaacaacataataattttaattttagaaaaaaaaaccaaatttaaaaattttttattgatactatttgtttgggttttttgaaaaaaatttgcggttttaaataaatagaattgatcggggacacagtgattgtgagaagggggggggggagtggggtggatgagctgctccgcacatttgtttcatgtccatctgtatttagggcggtcggattctgtgcggtggcaaagtgttggaggagtcgaagggcaattacgtgctgcccacggtgatcgctgggcttgcgcacgacgcaccggtggtgctcagagagacatttgcgcccattgtttacgcagtgaaagtggccgattttgaggtgccacgagaattaaattaccaagatttgctcatttttgcttccatcccgacaattaatttttctcatttctttccccgtgtcaattgtttttcgttttttgttgttgtaaattcgctcttttaggaggccgttgcggtgaacaacgaggccagccagggcttgtccagcagtttgttcacccaaaatgtgtcgcttctgtccgaatggattgg

SEQ ID NO: 57480 - DNA, 936 bp, Heterodera glycines
  Genomic contig location: Contig_ID=SeqID_26720; Location=123..1058; Strand=-
  SCN-specific regions: Sequence locations=1-120,143-157,190-908
atgatgctttcattgaccattgtggtgtcatttcatggcacttttgtcacacgttcggaccgtgcctatcgctgcatgtgcttcttccgtaacatcaaaacattgacaaatgcaattgacgtgaacctggcggccaccacggaattgttaggtaggcaattttaaaaaaaaattttaaatttttaaaatggcgcgctttggcattttgcagacactgccaagacaccgtcctgcttgtactccatccatgcccagtcgccggaagggccaccagtacagtaagttttcgggtgctatgccgctcattacggtagccattaagcatacagtatgagaaaaattttaataccgtacttataataaaaaaagttatgaatagtacagtaatttttgtgtcttacgccgctcattacagtatccattaagcatacagcatgagatgtataccgtagttataattaaaatagtctgagttttacgttatttaaaataggcttggcaaggtgggagacaaaattttccatgtgtggcaatgcgatgacccggcctacgaattcctggtccattcctgtgccgtcgatgatggacggggttccaaatttgatttggtaaaaatttaaaaatttccaattaaaacttgaaattttttcaagttggacatcgatgggtgtgccattgaccctgtcattcaaccggatgtggcttacatccgtgaaaagaaacttgtgagtttggtgtttaaaaaatggtaaaaacaaaaaatttataacattgaaattaattgaaattaaatgaaaagcgaaaaaaactttatttctcattacaataggctagaaaattaattttgaaaatctttaactttttttatgttcatataaaatttgattaatttgaaagggaccaatctcaaaatttaaaaaaattttcaaaaataaa

SEQ ID NO: 57481 - DNA, 761 bp, Heterodera glycines
  misc_feature (732)..(732): n is a, c, g, or t
  Genomic contig location: Contig_ID=SeqID_26721; Location=652..1412; Strand=+
  SCN-specific regions: Sequence locations=1-59,81-151,175-624,648-761
atgactttcaaactgatggaaaaggcggggataaatggggaggaaaaaacttttggtctccaacatcttgaaatgatccaaatcttttgggacaaggaattccctgacatgtttcgcattgtggcctttgatatggtaaaaaaactacatactttgaaaaattttttattttccagagaacgggaatcaaaccaattttcaagggagagggaattcgtaaaaacgaagtatgcgtgataaaagaaggagaccactgggatgggatcaaatcagtgacgcagttcttgtgtgttagaaattattgtgccagctgtgaagtgacttgcgaaaggccggagagacatcgattggaatgtaaggaaagatgcaagaagtgctgtagaatggggttcgggtttccatgtgcggatgtgtgtgctgggatttattgcgcggagtgtaatcgcaacttctacaatacggaatgttttgagtctcacaagaagactgcttgtagggagtacaaaaaatgcgaaaagtgtggagagacacacaacacaaggaacaaacacacatgtggggagaaattctgccgaatttgtaaaatttatcatccaaagcggggctgtttcatccagaagttaaaaattcgttcaacgaggaaatacagaattgttgcatatgaccttgagacaacattgtataacggagtccatgcaccgaatctcgtttgcgcggcgttgacatgcagtngagtgcgtggaagagaaaaggaaatgtga

SEQ ID NO: 57482 - DNA, 438 bp, Heterodera glycines
  Genomic contig location: Contig_ID=SeqID_606; Location=972..1409; Strand=-
  SCN-specific regions: Sequence locations=1-32,54-438
aaaatggtctaagtaaaaatcgtaattacgctcaaaaagcttctcaatcaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaaatttagcgcttccaattccttctacaatcgcctttatacatcccattatgagcgctaaaattatcagagtgccgaaaatcgcatttgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgc

SEQ ID NO: 57483 - DNA, 1647 bp, Heterodera glycines
  Genomic contig location: Contig_ID=SeqID_607; Location=752..2398; Strand=-
  SCN-specific regions: Sequence locations=1-323,349-1303,1326 -1369,1403-1500,1523-1647
atgggcatgggtcggccgaacaaagtgagtaaattagtggtagaaaaacggtcggctaatttttatgaaaattgaaacgaaagtcgagcggggcccaccccttcctaaggcagaatttgttagtatttttattcttacagaaagtttgtccggctcttcggcttcctccaccggaggagtccatcccatccgaaggcacacgacagtgcccgccgggggccatcacgtggaaagttcggaggaagaggacggagaaatggacaacgaaatccggaaacttccggtgggaatgaaagaggcggatgatccgtttgtctcagaatggcattttatctatttttaaaatacgaaaaattaaaaaatcaaagagtagagagtgcaaaacgaatgttaccgaaagagagtcattaacataatgaatggaaacttattaatttagcaaaaaatgaatccaatctcgagaaaagccgcgactgagatcattcgggacaatgttcggctccgttcgcagaacgaccggctgaagaaggaatcggcactgtaaggacataattgtcaaaaccaatcgaactgacaatggttccactctctcttttcagcaaagacttgcaattggtcagtttacgttcgcgcaaaagtccgtcgggggaaacgcccgaaagattggaatcattgcgacaaaaacaggaggaattacaagcggaaaagaaagcatttctgacagagtgcaagcggagggaagaggaattccgagcgaaatgtgcggggagagagacgaaactgcggacgatggaagacgagctgagggaacgggcggacgaattcgcccggatgagagcggagttggagaaactgaagcgcgaaagagaagcggcggtagaacgaagcgcaaagtaccaaccgaaggaggcggaggacgacccacagacagtgcggacaccgccgacaaaagcgacgacgaacagtccgatgtgtgtggagggagaggggggggggagggttgggattatgggatgggaggattgatgacacccgtgacagaactcatccacccacaatttcaaggcgtatcagcaatacctattgcggcgccggccccatcccgcgcccttctgccgacctgccgcaacagcggcagcaaaactgttccggagccgagtgttccttccgttcgcagatgccccaattggcggagagacgcgcgatcagtcagatggaattgccacgtcatttggtggtgaagacggagacaaaacaggcggataaagtgcgtaagatgagaaagaattaatcgttgcctttcgctgatcatctaccttctttctgtattcccatgatacgataataacacaccggtaccatccgttaatgttttgctgttctttctttctcattctttcattttacttccattccattcgcagtcatttgcctctatttcggattttgatttgctccattcgtcacttttcttcagttcacttaattatttgtgccacatttttattcacattaattttatggatgccatccatttcattttgttcatagtattcgctcacattggcttcgttttttacgctctttctcatcatgcgcaatcaatcaaaaaatacttaaaagtgtaccttacgataagacaataaa

SEQ ID NO: 57484 - DNA, 1482 bp, Heterodera glycines
  Genomic contig location: Contig_ID=SeqID_610; Location=213..1694; Strand=-
  SCN-specific regions: Sequence locations=1-10,35-993,1017-1482
ctcaaaagttaaccaacaacaacagcaacaacgccatgagaggaaaacgaaaagcaattgtaagcgcaggaactcttccgtgtcaacactttccgcgccatgtgcacattcaattcccacgtcatccaacgttttattgaatttggtcgatcgattcgtcacaaaaaggcaatattccgacagcaacctgctcaagcataatatgaataagtcgacgtttggtgaaaatttctgccggaggagctttaaatggaatttattttggggacggaaagatgagaacagcgataagtgcacggaaaagaatgatttggttgacgaactccaaagttcaaggaggaaaagcgaagaagacaaagatgaagcaatgagagactatcggaaaaagagtgttcagcagagaaagagcttacggctgggcacactaatggaagagatgggggaggacagggacaagaagaagcgacagttcgggaacggagcccagccaaaggcagttttgtctgtgcacgaagaagaaacacacagcaatacgcagacagtgcgaattcggaacaacaattcgctgggatcgggacaagaggccgaaagaagctatcccatcaaaagcccaactgtccccaaaattgtcgcaacacagcgcttttctctgattggagcatgcgatttgaccaagttggaagaggctgcggaaggagagatggccacgtctggtggagtgagaagaacgacatcgctgaaggagaagtacagagtcagggaggaggacagtctgaagttggacatgttcttgaaagaaaaacgaatgtcaaggacagttgaacagcaggaagacggggaacaaagtgacgacgtccaattgcacttgggcaacaatttggatgcgcttcatttcgtatcaatcacaagtggagaaggccctcaaaatcagcagcaaaatttgcataatttatcccaaaactccaaaaaagtgatctcatcgcaattgaatatcataaaaacaacatcaacaacattgactatgcccagaaaaaagaatcattgcaatataccgcgtaaatcttcgattagtttccaaaccaacggaactttaaagcgaaaaaaaggcattggaaaggcacaattagcccggagaagaagctcatatgtgacaaaagctcaaattcttatggcgaaaagcaaaatgcagcaggacggtgagcaaaagaatggaaacacaaaagatgaagcgaaagagaagggagtgacgaagaaaaacggcaatggaaaaagacaatcggacattgccaaaacggaaacggtgacactgagagaaggtgccaaacttttggccaaacagcgtggggcgagtgtgagcagctcatctctaaggcaattgctggttggaagcgaacgcaaggccagtagggggagcaaagtggcaccgaagacgaacgacaacaccgacaacggtccgaaggatgcgaatgccgaaaaggaaag

SEQ ID NO: 57485 - DNA, 1337 bp, Heterodera glycines
  Genomic contig location: Contig_ID=SeqID_611; Location=199..1535; Strand=-
  SCN-specific regions: Sequence locations=1-152,186-988,1012-1278,1300- 1337
tttctgcaagagaatcgacgagtttctcggtcttcgttggatcatttcacggagtatgagcagcaaactttgtttgatttgaaggggagagcgtacacagtcagtggattggaggaaggaaaggaatctgaagagagagaaggtgggaaaggaattgaggagcaaagggaaaaggaaaaccaaagcccagttaaaaaacagacgccaaacattccaacgttctcacaaaacaccgcaccctttttattggaaaatgcatttcttctttgtcgatgaatttatccccaaaccatccatcttttagcactcattaggaaatagatttttgattatagtattcccttataattagtcattcaaattttcgttttttaggcggagaggacaaaatgataatatcgacgagtgacgcggctgaatgtcaaccgaccaaagaacccacaccgagtgacaatacttcgggaaattcgacaccgcgccagcgtagaaaaaggcgatccgccgcagagagacgggaaagtcatcggcgacgatcgagtgccgttgtgaaggacgcggttcatttggccaaagtgttgaacggtgggtcgagagaatgcctgttgatcaacgccttttgattttaactctaatagctttttcaggtttgccacaacaaaaacagaaacatgaaaacgacaaaagcttggacccgtgccttgttcattgtcaacctttttcgcccattcccgactactcggagactgaaaacgacgaggccaatttacacgaacccccagaaccatccgtacatgccccgggcgatgaagacgaagttgacgagtgcgtgggttttccgctcttttgtaataatgtaaaagcattttcagagagtttgattttataagtcggctgaatggggaaacggcggagaaattttatggaagaaggacagaagcgaacttagataaagtcagttcaaccggcaataactgatttgtccatcttttcttcttcagaatgcacttcttcaaaattccttggaacaccgtcgttcaatttcggcggaccatcttttgcatggcattggtttgaggagagaaatgcttttgctggacaccgatcaagcggagtttgccgatgcgattcaaataaaagtgatggataaaaatggagttgtgcatattgtacctgatctgtttgttttaagatgcgtagcccttctccacatgccgttcctgtcgacgacaatacaattggacagcaacggcacattgaggtggagaaagtcgcaggagaggaggaatgggggaagaaaggcggacgggacttaccggacgcgtctcatttggccaaac

SEQ ID NO: 57486 - DNA, 1225 bp, Heterodera glycines
  Genomic contig location: Contig_ID=SeqID_614; Location=143..1367; Strand=-
  SCN-specific regions: Sequence locations=1-235,262-805,827-935,958 -961,983-1225
atggacagtgacgacgaatcggaagtgatggcagagactgaaaacggatcaatgtgtgttttgtctggctacaaccctcggttgtagcaaaaatccatcattcttttccaggatcaacatctatgacccgtgtgttaagtcagccatcggtgacagggatactgtaactgaccgtttctctaccgacagtaactctcgtgtcgtcaaaacggtgctcagggtggcaaatcgttaacagttttctttaacactcagttgataattttgaaggacattcctcggttacggaatgctttttcattttttcagagtccgtcttcagtcgaccatcaaattgtgtcttccccttcctcatctctctcttctactgacaatgtcgccgacccacagattcgcgtgtcatcctctgcgtcttatgaatccgccattgaaaacagcgcaaaagacaaatgaacgcattgagataccattttataacaccgaaacgactccgacccgacgaataggcactatgcgaaacttctttgaaatcagagtggaattcctaacagattctgcccaaaaatgagtaaattttgcagcttttgagtcaaacttaggatccagcggagatagtcatccccggaaaaacagtaggcgaaatgtttgtacccagataattcgattttgaatccgaggtaatttgagatccgcaccccgggatttttctgtccgcgaaccagccctggtaccatcggaagtgtcatgacaactcgtacaattgcttaggttgggcctaggctttaggctaggcctaagcttaggcttatgattcagctttattttaaaatacgagttgccttttgtacgggtgccattgacccgggaaccgcctaactcgccgcggccaactcgccgccaaatttaaagagcaatcatgtcgatcattggtcccgaaattttttttttaaattttttctgggaattctttaacaagtttctttgggtattttgaggtgctgagcactagagaccggcgcgggacgggatcccccgcgggattttgcgggatcccagtccgcaatcacacattttttgcaaaatgcgggattaatcccgcgggatcccgtcccgcaaagaattttgagttccaatcccgcagcgggatctgcaaatttgaaatttccggtctctactgagcactccatttcaacctatttataataccggcctgaattcgaataaa

SEQ ID NO: 57487 - DNA, 432 bp, Heterodera glycines
  Genomic contig location: Contig_ID=SeqID_5258; Location=194..625; Strand=-
  SCN-specific regions: Sequence locations=1-130,159-296,318-432
atccgtcttatcctccattacaaaggcattccgtttgaagacgtcactttcagctcaactcttgccgatgagtcatcgcgagaaaaatggctgaagcagaaacaaagtgagtgaaagaagcaaaacattcaataataattaattaaatcatttataatcgacctgattagcttcggtttcagaccattaattaacttcccaatttcaagtacctattatataattacttgttttaattggattattcattcctaattaatttctaaatcaaatcataaaatgtagctcctaatttggaaaccattaattaattaattcctcattcagactatctttacggccaattgcccaacctcgaatgggacgagggaactgagcacaaagttttggcccagtctcaaacaatttgtcgttatttgggcaataaatatg

SEQ ID NO: 57488 - DNA, 743 bp, Heterodera glycines
  Genomic contig location: Contig_ID=SeqID_5258; Location=648..1390; Strand=+
  SCN-specific regions: Sequence locations=1-93,119-382,424-743
atggaaatgtgttcgaatttgctcttacgggttccgcaattcctctcgacgaaaaataagtgagtttataattttttgtttccgcgtccatccgtaaatttaaattgtaaaaatttaatgttgaaaaccaaactttaaaaacaaaattgcgaattatatataatgagtgttgtgcattattgaaattatttgatgataaacaaattgcagaacaaacacagcaaaatgagaagtggcgattgattttatgtatttattatttttcgtttttcctctccctttttctcccatccccaaattggataaatgaaatgcataaacaaaaacaaaacgaaaataaaacaacagcagaaatgtgaatttgtacattctgtaaggggcgataataattaataaaaaaattacaaatacaaaatataaattcataaactaaatggtaaatattgatcataggccccaaactcaaaaatgcttaaaaacagtcagaatcgatgtaaaaaggtttgaaatgggttggaaaaatagaattaggggcgcgcttgccctttttcaggatgaaaagtgccgaaaatggagtgccaaactcagctgggactcaagtgaccgtgctatataaagcactcaaaagacattataaataatttttctagggtaaattgtggcgctgaacacgaatatgacctttaatttgcaaaattccgaaccccgaacccaaatttcgaacaaaaactcaaaatttataa

SEQ ID NO: 57489 - DNA, 193 bp, Heterodera glycines
  Genomic contig location: Contig_ID=SeqID_5258; Location=1083..1275; Strand=-
  SCN-specific regions: Sequence locations=1-193
cttttgagtgctttatatagcacggtcacttgagtcccagctgagtttggcactccattttcggcacttttcatcctgaaaaagggcaagcgcgcccctaattctatttttccaacccatttcaaacctttttacatcgattctgactgtttttaagcatttttgagtttggggcctatgatcaatatttacc

SEQ ID NO: 57490 - DNA, 193 bp, Heterodera glycines
  Genomic contig location: Contig_ID=SeqID_5259; Location=682..874; Strand=+
  SCN-specific regions: Sequence locations=1-167,189-193
gcaacatccaccagtccatctgccttggagacaagacaaaaagccgaagttgaagtaaatgaatatttacgggatccaaaaattaaatccagggccgatccatcattatactgggaagtcaattcacaaaaatggccaatgattggtgacgttgtacggaaatttctttctccacctgcaacaagttcagaaa

SEQ ID NO: 57491 - DNA, 71 bp, Heterodera glycines
  Genomic contig location: Contig_ID=SeqID_5259; Location=37..107; Strand=-
  SCN-specific regions: Sequence locations=1-26,57-71
cgcagtatccctgtctggcaggttaaacttacacatgcatggcttaatctttgaaatgaacacatcagttc

SEQ ID NO: 57492 - DNA, 457 bp, Heterodera glycines
  Genomic contig location: Contig_ID=SeqID_5260; Location=1973..2429; Strand=+
  SCN-specific regions: Sequence locations=1-21,301-301,353-457
atggcttaccaattgacgccgatcattatgttgcgttggttgttcgttgggcttgtcctctcctcgcatcaacagatggcacaaatgggtcgaatggaaggggatcaaatgcgcggcatggaaatgggccaaatgcgtggcatggaaatgggccaaatgcgtggcatggaaatgggccaaatgagcggaatggaaatgggccaaatgcgcgggatggaaaggggccaaaagcccggcatggtcatgacacaaaaatcagaaatggatatggcacaaatgcgcggcatggacggcgatgatggccagatgcgtgcttcatgggcagcatcgcaaaaattgttacgcgcagaggaaaaggaaaaagggccgaaatcgcaaaaaaatgaaactgaaaaggtgaagaagacatgcgaaatgagatgagtttggtaaaacggaggacaatttcaattttaaa

SEQ ID NO: 57493 - DNA, 362 bp, Heterodera glycines
  Genomic contig location: Contig_ID=SeqID_5260; Location=1096..1457; Strand=+
  SCN-specific regions: Sequence locations=1-1,24-246,278-362
ccaaaatcattcattaactaatcaatcaattggtcagtccctctcacaatgctcttctccactccaatgccactctttctcgtctcttctgtctttctcttcgtttttcttctcgtcgccatgtttttggccaatccgtccgatgcgcggcctcaatttggctcatttgccgattcgatgaccagcggaacgattttgagtaatatgtggggaaaaaagcgatgagaagcggccaacagcagacggagaaagaaagaaaattaaagaaaactgaagagaacaattggaaataatcaacaattaataaataattgttaattttgtataatcaatcatcaattataaatggttggtaattaaat

SEQ ID NO: 57494 - DNA, 122 bp, Heterodera glycines
  Genomic contig location: Contig_ID=SeqID_5260; Location=2626..2747; Strand=+
  SCN-specific regions: Sequence locations=1-122
atgctacgcacactcggagtgtggcgcaaggagcaaatgcgaaccggcgacgctggacaggaagaagaaggtgggcacgtgcgactgcggcgtgtgcgggggattccaactgttattgctgt

SEQ ID NO: 57495 - DNA, 87 bp, Heterodera glycines
  Genomic contig location: Contig_ID=SeqID_5261; Location=320..406; Strand=+
  SCN-specific regions: Sequence locations=1-87
aaatggctaacccaattgcaaccaaaaaacaaaaagtaaaattgaactctaatgcactttatgagtccaatcaattgacaatccatg

SEQ ID NO: 57496 - DNA, 482 bp, Heterodera glycines
  Genomic contig location: Contig_ID=SeqID_26722; Location=271..752; Strand=+
  SCN-specific regions: Sequence locations=1-107,159-331,353-448,471-482
aactgttctcagattaacgacgaaaatgttggagaagctggtgcatacaaggaaaagcataacgaaagttcggatattttctcaaaagtttatggaattgctgtaagtttattttaataaaattaatataatttaattgataaaatttttctttttaaggatcaaaaattcaaggaccttttcaaggacaatgcatttcctactctggaaaaattgttcggagatgcaaaagctttgttcgtcaacacaacgcctttattggattatgacattggcagtttgccaaaacgcgtcaaattcattggtggcattgatctgatgcagcccgatcacaaggatgtaataccattcagtagtaaaacagtatacacagattaagaaaatcccatatgaaacatttgaaaaattgaaatccgagtctattccttatttctcttaaattaaaagcaaataatttttaagaaattgaaaacagtctcata

SEQ ID NO: 57497 - DNA, 518 bp, Heterodera glycines
  Genomic contig location: Contig_ID=SeqID_26722; Location=937..1454; Strand=+
  SCN-specific regions: Sequence locations=1-108,131-138,184-518
atgccattggacaaatttgagacggttattcaaggacttggaatgtgtaaagaaaaggaagtgaaaaaatgccacggcatggttgggctaatccaccacggcccaagcaaaattcaaaaatttggaatttaaatttaccatttttattggcaaatttaatgaaaaatttcaaaaaattttccgatgggcttgggccaaccgattctttacgttttttcagtttttagcccccccccccacccccccgtaaaatacagtatggctggcctctgtctacggtatcatattgtaaaagtgtgccaccattttcaggcaatgaaaagacggaattggtgatcagcgaatgcgatattcgtatcgtaatggatgcgttaagcagtggaaaagcattgctttgtctgccgaacagttttatgtgtcggaaaagctgcgacgcatgggcgctgcggttgtgcttgatccgcgcagtgacagtttcaccaaggaggggattttcaaaagtatcggcgaagcattga

SEQ ID NO: 57498 - DNA, 688 bp, Heterodera glycines
  Genomic contig location: Contig_ID=SeqID_26723; Location=194..881; Strand=-
  SCN-specific regions: Sequence locations=1-306,328-515,537-688
ggaaccggagcagaatctgaactgtgctgacttgatggccaaattcaacacgcaaaatcaaaaagtcgaaccgatggatgtggagggcgcaccctcccaggacgaagtcgaagagattttgggggcagcgcggatgaatagcgaaatgttcgttataaaaaaaagccttagagaaaatacggctctattgcacttgaggcgtccagtcaatgaccattttcgtttcttaagttcaacctttttccttgatgaatgtctatcttgatatcaaacgatagctcaaagtctcggaatttgtaaatgcgaaaaatgattaaatattgacattaagaaaaatacaatgagacgaaattctgcttttttgtccaggaacaattttttgtttattatttttagcgcagtatttatattaaaaactatagaccaagctttttaggcatgattaagtatgaaaaaagtttggcttaattgtaaaaatgggatggtcattggatgcctgaagtgcactacggccgaaaatattcaaaagaatttttcaaaaatctcgatttcctattgattccattttcagcttctatctcgtcaagttgaagggcgattccttggctcagttcttctcgtcccgaatcgcctctgaaaaattccccaaattggtcatagatttctacgagcagcgtgctgacatgca

SEQ ID NO: 57499 - DNA, 348 bp, Heterodera glycines
  Genomic contig location: Contig_ID=SeqID_26724; Location=463..810; Strand=+
  SCN-specific regions: Sequence locations=1-77,107-316,338-348
atgttttgttcacatccgaccctcatttatttgcttggcattttaggagtgggtatgtgggagaacaaagttttttcatattatttaaattaattattttaattttgcttgaaacgtaatgcaaatttaatcaattttcagcattttggtttgccgaaagcagtgcaaatatggtaaaaattgttttaattagtaaattattttttgtcgaaagtcagcttttggctattaatcgttgttttgaaacaatttcgcctaatatttgtaaaatgatccaattttggctgttcctggtctgtttgtacagtatctactgggttttcttccagaagccttgtttgttcaacg

SEQ ID NO: 57500 - DNA, 442 bp, Heterodera glycines
  Genomic contig location: Contig_ID=SeqID_26725; Location=61..502; Strand=+
  SCN-specific regions: Sequence locations=1-165,189-204,226-442
atggcaattgcgtcttttgcactgtccatcgcgtgtccaggaccggccctcaccgcacagcagcggattgtccgtacacattttgtgcatgtgttcaggtgaatgcagaaaactaacaaaaattgggcacttgtaaaaaagagcgaaagtcgtcgttttgaaagcattttattttatttattttttttgttttcctatttaattatcattttttgcagtgttttgtggctgagaagtgtcctttgcttcggggtaatcaatggcgaattttaaagtttttacaaaaccaattttccaatttctcagattaggcaatgcgacactttgtgccgatggattggccaacgaagcaattcgtgccctgcaaaattattgccccttttcattatttatttacaactggcaaacaattttttcttaaattttttttcatttattttga

SEQ ID NO: 57501 - DNA, 399 bp, Heterodera glycines
  Genomic contig location: Contig_ID=SeqID_26726; Location=1..399; Strand=+
  SCN-specific regions: Sequence locations=1-158,180-336,358-372,394-399
  Gene Ontology: Mol. function=structural constituent of cuticle; Cellular component=extracellular; Biological process=cuticle biosynthesis (sensu Nematoda)
atatttcacagggacctgccggatccgacggacagcccggaaaccccggggagaacggacagccaggatcgcccggacagctcagccagggcccgcccgtcgttggtccacccggcccatcaggaccccctggccagcccggacagcccggcgagaacggacagcccggccagcctggcaaccccggcccgcaaggacagcccggcgacaacggaggccccggacagcccggcagccccggaggcaacggcgagcccggacagcccggcgggcagggagccggcggacagtgcggtcagtggggcttacaattgcgaaaattcattttgaattaaattttgaattttacgcaaaatttcagatcactgcccaccgccccgtaccgcccccggctactga

SEQ ID NO: 57502 - DNA, 98 bp, Heterodera glycines
  Genomic contig location: Contig_ID=SeqID_26729; Location=1..98; Strand=+
  SCN-specific regions: Sequence locations=1-98
ttccgagtcccgaaaaaaaatcgaggtcccggtcccggcttctcaggtcccggcaagtcccggtcccggttttgcccaaaattcccggtcccggcttc

SEQ ID NO: 57503 - DNA, 724 bp, Heterodera glycines
  Genomic contig location: Contig_ID=SeqID_26731; Location=74..797; Strand=-
  SCN-specific regions: Sequence locations=1-62,124-230,270-400,464-550
ttcgttcagcacttctgctttcgcagtcgcgcacaaaacaagtagaacggttcacatggaagttttttaggtgtggtaatgatccttccgcaggttcacctacggaaaccttgttacgacttcaccttcctctaaatggcgaggttaaaaaaagttcccacgaattcattcgcaatgaagcaaacgagttcacagtcccaatttttcaccgagtcattcaatcggtaggtgcgacgggcggtgtgtacaaagggcagggacgtaatcaatgcaagctgatgacttgcgtttactaggaattcctcgttcaagattgaaaattgcaacaatctatccctagcacgatgcgcattcaaaagattacccagacctatcgatcaaggttgtaaactcgttgaacgcatcagtgtagcgcgcgtgcagccccggacatctaagggcatcacagacctgttattgcctccaacttcctttggtttgattacccaaaagtccctctaagaagtctcaaaacctacaaaaaattgtaagcgagactatttagcacgcggaggtctcgttcgttaacggaattaaccagacaaatcactccaccaactaagaacggccatgcaccaccacccatagaatcaagaaagagctctcaatctgtcaatccttactatgtctggacctggtaagtttccccgtgttgagtcaaattaagccgcaggctccactcctg

SEQ ID NO: 57504 - DNA, 743 bp, Heterodera glycines
  Genomic contig location: Contig_ID=SeqID_5262; Location=2102..2844; Strand=-
  SCN-specific regions: Sequence locations=1-344,367-743
atgccttttaagacggtcgccgagcgagaggccaacacaacatataattttacaaatgtgacgctgcgaccgtttctcccacggaatcgtactcatcacgatttgggcgctttatttgcctcattcatttttggcggattcagcccgaatttgtttttcggtacggacgtcgacgatggaaggatttgcgtggtctcgttaagagttgatgaccagatgcaggtgaatacgtaaaaaataagagatttttacatcttactgagaacatttttgtcatatttgcttaaaaaatgggcgaaaaaattaaaacccatgcaaaaatatgttttaaaaaggttgggtaatttgaaattcaatttactttttattgcccatgacaagagaatccccaaatccttgttttttgatcatcaaatgacaatttattatttcagcgactcagtgttcgtcaattcttcgccgttaattcagtgaagtttaatcagaagtatttgtgtgagatccaactccttccaataaacgcattggtaaagaaaattttgaatgattaaaaataaaatgaaagaatctttcggggtttacaattttcataaaatcggaaaaccgaatttcgtggggtaatgaattgcttattcaactaaacaacacttaaggaatgggatgttgtcaagattaaaatcttcgctaattccatgaacaaatggcgcggaatgatgtccagaattgagcggattcttttaagg

SEQ ID NO: 57505 - DNA, 1243 bp, Heterodera glycines
  Genomic contig location: Contig_ID=SeqID_5263; Location=1542..2784; Strand=+
  SCN-specific regions: Sequence locations=1-756,780-861,884-926,1002 -1243
atgttcgaggagggccggaccaagatcaagcaggtcaacgacgagtccgccaccgtttgctacgccttcaaacacttcctggagttgccgcgcgtggacgacgcgacggcacggcgccaacgcattgaccgactcgtcaaatttttcattgacgaagcgctggagaagaagcgcatggaggtaaaaattgaattcaaatttgatggaaaatgtctgaattcgtgtaatcaacaaaatttttctaaaaaatatgcgtattttctgcgagcaaaaattcaaaggaattttttaaaaaattttttggtctgttttaaaactaaaaattgaatctttcttaaaaaatcttgaattttccactaggaaatttcaaacacatgcaacggtaaaaaatggcaaaaattagacctattttttgggaaaaaccgctacaaattccttcttttactctccctgggggctgaaaatttataaaaccattgagaaaatttttttttttttgtaattttgctccgaacagtaaacaggaaaaggccttcgggttccgctaatccgaaagtttctggctacaagtttgttctgaatttgatttattccggccaagataaactttttgaaaatcactactttttgtcgtctgtccattttttttatcttttcagcagggcaaacagcagcaggtgtccgtgtccaacaattggtcaacaaatggacaaccacaaaacaaaaagagtccgatcaaggtttgtttgtttaaacaaaaaaaaaaaatttttttttttggggggggggtcagtttttcccagagggggagccctaattaaatggggctaatagcctccggccgggtcacaaaattgtatgaattttgtaaaataagttttgattggcaaccaagcaatgtaatggacagcccatccatttaccggaaattttttaaacataaaaattaatcgaaaacttttagaaattaaaaaaaaatgttttttttttttgttttttttggtttttattttcaaattcggatttttttcagaaaaacgggaatatggtgttcatcgggagagggatttaggcccaacaaaaccatgcgaaatgcaaaataattagcctaacaaatgtgaaatattttcagcgaaaattgccggcaaactcgcgcaaggcactccgcaagttgccgaccatgggcctgaactttgacgacgtaattgaggaggatcagcaacggttgcgcgacatgcacccg

SEQ ID NO: 57506 - DNA, 775 bp, Heterodera glycines
  misc_feature (747)..(747): n is a, c, g, or t
  Genomic contig location: Contig_ID=SeqID_26732; Location=83..857; Strand=+
  SCN-specific regions: Sequence locations=1-425,454-665,701-709,738-775
atgcattcaaaatttggcgtttgctttatcctcctttttgtcatcgcttgggcaattgctgctccgaaaaagggctcacaagttgaaaacacatggcgtagaggtgtaactgcaaagaaaacatcagcaaaaagtgccagcgaaatgtccgaccgacgacgggcggcgaatgcgccagcagaaacgtctcgtaggccaacagaaaatgatgacaccgcttcaaagcagcggctggcgggcaaaagtgccagtcagcgagcagcggctaacagttttatgagtttatccgaggaaagggatgaagccgaacagagtgggcaccaatcgcagacgccgagcaaaaggcaacgcttggtcaaagcggtgaataagcagcagaaacaaccgaagaagccggagacgccacgccggaagctgatactttacagcagcgatgaggaggacgagcagatgccgcagaggacactttctgctacagggagcacaccaaacaatttgtcatccgccgccaatgcttcggtgccgttgtcttcccgtcgcatggacaactcatcgtcggcacaaaaggaggaccagcagcaaatgggagatgatcatattaggttgttgaatatgttctgtggtagtgactaaaaactttacatataaaatcataactattaaagtaataataatcattattaataataataataataatttaatttgtcagattatttttaaaaatatttctctatcttttcgcanagttaccagtttcttctcatagttgcca

SEQ ID NO: 57507 - DNA, 337 bp, Heterodera glycines
  Genomic contig location: Contig_ID=SeqID_26735; Location=310..646; Strand=+
  SCN-specific regions: Sequence locations=1-58,83-200,225-311,333-337
  Gene Ontology: Mol. function=MAP kinase kinase activity; Cellular component=cytoplasm; Biological process=signal transduction
atgcatcgcgacgtgaagccgtccaacattctgttggactggctgggaaacgtcaaactgtgcgactttggcatcagtggcaaactgatcgagtcaaaaggtagggaacatttttgttcgtcattccccgccatcacttttctccaaattctttctttagcatctacaaagacaggctgtaccggctatttggcggtgcgtttattttttttaatttaaaaaatcatctaatttaagcccgaacgtgtgaacatctacagcgactcgtccggccaatacgatgtgcgggccgatgtttggtcagttggttgattgaaacaacagaattatgctccta

SEQ ID NO: 57508 - DNA, 53 bp, Heterodera glycines
  Genomic contig location: Contig_ID=SeqID_26736; Location=609..661; Strand=-
  SCN-specific regions: Sequence locations=1-53
cagttgactaacgtggtcaccttcgccatcggcgccttaacaccaacccccgg

SEQ ID NO: 57509 - DNA, 968 bp, Heterodera glycines
  Genomic contig location: Contig_ID=SeqID_26737; Location=98..1065; Strand=+
  SCN-specific regions: Sequence locations=1-67,105-175,254-670,739 -853,897-909,931-968
atggacactttcattggactgatcgacgcagtggcaagcgtaaaacggcacattgagaacgagacgaagcagcaacagcaacaacagcagcacaaacagaagcaatcggtggtcaccaaatccaattcgaacgcatccaaagagagcagcagcttaagcgtggtaaaagcggcgcaaaatttaattaaaaaatatttaaatttttattttaaaaaactttaaaaattatttaatttaaaagatttattttaaagtaattagaaatgcacagtaaaaacattttattttcaactgataataataaaaagatgaattttttttttctcgaattttagactttaaatatttttttttggtttttactttttatcaacaaattttcgactttcgactaattgtatattttttcaagttttaatcgctcaatatctttagactaaacatacatacataagagatacgaaaaaaagacaataaaaactaaagccaaataaattttactcccatttgagaattttttgtaattttgtttaaatttgccaaaaaaatattagtaaaataatcgaatcttttcctcttgcatattatcttatctatcctattgtttagtgtgcttatgttcactttaaaaagaattattgtattttatatacagatacatattttggtgattaaaatttgttaaaaaataaacaaaaatatttaattaatgtaggaaaaatttaaaaaattaaaaatggcaattttcaaaaacagttaaaaatgtttcagtccagcgacacttcaaaaagggatcggacacaatcggcgaacagtgaaaatgggtggacaaagaaattgcgatttgaatcgcacaacaacaacgagaacaacaacaaggaacagaaacaacaacagcgccagtcctccgcctcttcttcatgttcatcgacggaagggtgggaaaaatgaatggaaattattgaaaa

SEQ ID NO: 57510 - DNA, 872 bp, Heterodera glycines
  Genomic contig location: Contig_ID=SeqID_26738; Location=1..872; Strand=-
  SCN-specific regions: Sequence locations=1-135,157-188,210-469,512 -573,600-831,853-872
cgctgcgctggacgggcgtgacctgaagtggatcaaagtggccgagaccaggggatgccatttgctttgttggggtgggtgttgtttattgccaagaaaattgatttaaaatcatttaattgtaagccacattggaaagtgatgctttgatttgataaatatttcggtttatccagatccctccatgtcttggttccctcccccctctcaaaaatgatcggtccacggggacccggtatcgtcgtccatgggcggagcaggacgttccttcccccacccccacccccacatcgttttcctctgagaattcattataaaaacaccaaaactaatgaatttttcagaaaaggggacttaaggattttttatctaacccaaaaaatctaaaatttttcaaaaactcagaaaaaccctagaaattattaaaaaacagtaaaatcactattttctcttcatatgatttcaaatcttataattcttttaaaatctttaaaaaaatatttattattttcttctatgttcgcgggaccttgtcacaaactttgaaagtctcgcgtttttcgcgtaattagcaaatttaattttttaaattaaattatgccaattcgcgcaggacgcggccattcgccgagcaccgcgccgcatggagcacagcttggccaacactactttgcctgtgccatcctcaaaagtgtgatggtgttccaaatcaatcggaaagagcgacgtcacaaaccgctgcgcgagatggcaatgccgggccaaccgcaatgcttgaagattgccggcgggcgtctgtttgtcggctacccgagcagctttcgggtgtgggacaagcgggacaacagccaaatctgtacgttactgttgcg

SEQ ID NO: 57511 - DNA, 149 bp, Heterodera glycines
  Genomic contig location: Contig_ID=SeqID_5264; Location=1087..1235; Strand=+
  SCN-specific regions: Sequence locations=1-61,84-149
gtttcgcatttcgctttttggcgcgaaacgcgacttttacacccctaagaattggattaaattcccataaaatttttcaaaatcttacctataaattgactaattttcagtgaaaacctgtttataaatgatcaaaatttccaattttt

SEQ ID NO: 57512 - DNA, 4516 bp, Heterodera glycines
  Genomic contig location: Contig_ID=SeqID_5265; Location=367..4882; Strand=+
  SCN-specific regions: Sequence locations=1-73,95-222,245-499,521 -524,546-599,622-1127,1205-1212,1240-1460,1494-1665,1716-1845,1867 -3056,3078-3125,3147-3178,3200-3353,3428-3675,3711-3931,3994-4516
atgcttcgcaaccaaattttctggattgctttactgttgtcacttcttcgggtggcacaattagctccatctcacggtggcgccgcctacaatggttacaacgaaagcgaaaccgagggggacgaaggtcattagtcattcaaattagtgcttgaacggttttattgcgctaccatggcaattttttggcacaagatttgttataactttcttcagggatttaagtaaaaatatgtaaataaaactcacccctggcactttttttttgttggcacatgccaaaacctgaccgtacaattttaccaactcgaaatcctacccaaactttttttttcggttgaccgtcctgaactccctatccgagttttttcggcccgcaattttcttgggatacagaaagaaaacttcgttaatttttgtataataagtaattttttggttatgccaaatcattgttccgcgccttttggaaatatgttctctatttcaacgcctcaatcaactaatggaggtattttaattagcaaattttacatggaaattttgattttcaagcattcaaattaactctcatgttttaatacctatgactcgaaatccttgtttgtttgtttttatcttcatcagaaattcggctcgtcttttttctgtcgacacgccccgaaacccggtccgactttgttttcaacccgaaaccagacaataacactttagtcttttccattttttcttaatattgagctaaattccttaaaaaacatgattttttggaccaaaaactgttagcgaactgtgctaaaatttacaacagtccccccacccccccccctaccgccgtcccattcaaacatttttagacccgaaagccgaagcccggttttgtgggctcgaaaactgtcccgaacttttttaggcgtcacgaagcctataacccgaccctacatttttcccaaactcgaaatcctatccgaaatttttaatttatggacctgccaactcatggtttcatgatttaacaggaaatattttctctggttcaacacatcaaccaactgatgaagaaggtatcttaattaggaaattctaatcaaaattttgatttttaattatgcaaagaatttaagtacttattttaattttttttttaataaaaatgatttcgttattaaaaaattaaaataattatatttaaacaaaaatattacacagtttttcataatgatgatgatgatgaggagttaaagcaactcaaagatcgcacacgtgccgaatatgatcagcaacaaattgcgaaagccatggaaaagtctatggaagaaattggaaatgatccatatcgtcaagagatggaagcaatcaaacaactgtcattaaaagaacagaaaaaaagggagaaagaactgattaaattggccatacaacaatctatagaggtactgtaataccgtattaccgaaatttcttttttgtttatctttgtatttgtctcggagcgcagagttggggtttttctcctattttcaaggtgttatgcgaagggctcaaaattatatgggtttatagcaggggtgcgatcgaaaatttttcaaaatcagaacatcgggctcaaaaaatcagattttggggtcaaaaatcagaacattttgcaaaattgcttcaaatcagttatttttataatttatttaatcaaaaatgtattaaaaaattatatttttcgcctccgattatcatctttaaaaattttggtgaggaaattagcaaattgaaaatttcagtgcactcgggatgaaaaattagactttttagaattttttttcggcggattttccaaaacttttgggaaatgggcgaggggagagggtccggcggtgccgataggcgccgccggaaaattttttttataatttcgttttgatttgttaacagattttcaccaaaaaaaccgctttttgcaattaaaagctaagcgacgacttttccttgcgttccaaatgttgccacaaatcttatattttcttgacaaaaaagtaacattatgccacaaaatttcaaaaatatgagtttatctaagaaatcagaatcagaacaaattttggtcgctaccccaaaatcagaacatttctgacaaatcagaacatttttattttatcagatttggaccctccaaatcagaacatttctgacaaatcagaacatttttattttatcagatttggaccctccaaatcagaacatttctgacaaatcagaacatttttattttatcagatttggaccctccaaatcagaacatttctgacaaatcagaacagatcgcacccctggtttatacatatttttctgggcatacatatgctatgaagaaaggggctcaaaaaaacgcatttctgcgttaaaattttcttttttggtgaatgtttttaatgtgtagaaatgtatttttttttggggggggggttccgagaataaatgcatatttcgccatttttgcgtttttagtccctatttatgcaaaattttcacaagaaaaatgcaaaaaaaaaaaagaagcgaaaaataacatcactaaggatcgagtttagaaataaaaaaaatacaccccccaaaaaggagaatttttttgaatattggcaaatttttggggtactttgttagtgtccgaaaatgtttgctgacatcaaaatgaaattattacaaaaaatttttttgagatgtattagatttgaatgtgataacatttggcattcttaaggtttaaatccatttttaatagtttattttttaagtttatttgagcaattttgaatatatacacatttttgtaacttttgtgggttttaaactatatatatatattggcagtttttagtccgtattttggtacatatttggtcatttttgagcttttagtccatatttcgaattttagtcctatttgatacgctcataagcaactaaatttttaatttttgatgtctttcgcgagccctagatattctctattagccagtaaaatttcaagaaatttcgttgagtttcaaaaaaaattatgatcaaaagtttcaaaatttttatttgggtcttggtcatgaaatttttttaccccattcttttttttttagtccaataatttgtaattttttaattcaacagcaaaagccaagacaacaggcaattgaagaaaaatctgaacatgaaaaactgtttcatgatcttaatgccgtggaatcagaagcgctgcaactttatatgctcggcttggtaggccaagcgaaggcactgcttagtgaaagtgcgcaaagtagaagagctaaagtgaaagaaagatataaattatgggaaatgcaaaacgctggtggtggtaatggtggtagtgttggcaccggtaacactggtgccgttattggtagtgccggatacggtggtgccgaaactgatagaccgtatctaaacagcaggccggagagcagtaaagcagcggcgcagcgtggaaaagctgtggatcaaccaaatgaagtaaaagcaaaaatttatcatttttgtgatttctcaatatttttgaaaattttatgaaaaattttgaaatttcgtaattttcgaaaattcatgaaaattttacaaaatatttgttttggtaaaatccgttatcggttaatgtccaaattggtcaccgagaaaattttttaaaagaaattaaaaattcaaattttccttaaccgacctattgataattagggtgatggtttatacgggctaaaatattgcataaataactatgatttttgcaataggctttttccaaaaaaaaacagaacttaatttgattacaaaagcttaggacagacttataaaaaccaatttgttctctctacattcaattttaaatccacaaaaaacgcttgccctactgaaaacttttaatagtttaagctaattaaaaaataatttttaattagatttattcgaaagctaattaaaaaaaaaaaaatttaaggcatcggctggtgatgaaggattgaatgaagctgaaaaaactgtttttaagaatggacttaacatgggaacaaatgaacgcgaactatccctttttcagctttctgataatgaaagcaaagataaagtgttcaatgcttggcttaagcaagatataaaggaacaaaaataccgtaaattgttggacaaggacaacgatactagaagggaagtgaagagatagagagagcgagagagtgtagggggatgagtttagtaatgatgtacaaaacggaaattttgccgagaactcaagaccacgactaaaaaaataccccaacttttgtcgagaccaaactctcggaagtgttacttactaatacaggagtgttcttgactggaaagcgagaattgaaaattgaccaagagggctgagactgtgagcagccaaaagatttctcgaaaccctaacatatttcagacccgcagaggtggtccaggtggagcagttcacgcagttttcgcacaatgggatgtcgactga

SEQ ID NO: 57513 - DNA, 474 bp, Heterodera glycines
  Genomic contig location: Contig_ID=SeqID_5266; Location=191..664; Strand=+
  SCN-specific regions: Sequence locations=1-177,200-474
atgaaagaaaataaaaaagaaattgaaaataattcttgttttgctggatttcatttgaagattttggtggtttgttaaaaatacgacagatcgaataatcaaggacgacatttaaatgattaaaggacccataaagatctatgttcaaacaaattcactgctataatttaatatcaggaagaagatgatgatgatactgtatcgcatatagggcacaatacagatgaagaagaggacgatgctaccgtattgcatacgaggcgtaaccgcgaccgggaagaggatgttgctacagtattgcatacggggcgtaaccgtgatcgagaagagggtgttgctactgtattgaacacaaggcataatactgatcacaatgcttacagtgacattgtatcgcattcggagcaaagtgatagtaatagtgaccagtacgaggtacagtaccatgataaaattgatttaggcaatgtagag

SEQ ID NO: 57514 - DNA, 641 bp, Heterodera glycines
  misc_feature (21)..(21): n is a, c, g, or t
  Genomic contig location: Contig_ID=SeqID_26744; Location=31..671; Strand=-
  SCN-specific regions: Sequence locations=1-296,318-415,439-495,519 -559,610-641
cgctgagcgtcgttctcctcncggcggagccagccgcgctcgcactgtctcgaagacatctgccagcgtgaaaataaaatgcttaatttacatattaaactggagtttaagcccgctgagcgtcgttctcctcccggcggagccagccgcgctcgcactgtctcggagaaatccgccagcgtgaaaataaaatgcttaatttacgtatgtaaactggagtttaagcccgctgagcgtcgttctcctcccggcggagccagccgcgctcgcactgtctcgaagaaatctgctggcgtaaaaataaaatgcttaatttacgtatgtaaactggagtttaagcccgccgcacgtcgttcttctcccggcgataccagccgcgctcgcactgtctcgaagacatctgccgtcgtaaacaacaaaaaattttaattttgcaaatataaattgaagtttaagaccgccgaaagcagtacttctcgcttctcgctgcctcagttatttggaaagaaaaagaaaagcggcaagggaaaaccgaaaccgcaatagaaagtggacgggtcaaaagatggaagcaaaaagaacaaattggaaaaaatttgatggaaaattgtttttttagcttatatacacaataaagactt

SEQ ID NO: 57515 - DNA, 576 bp, Heterodera glycines
  Genomic contig location: Contig_ID=SeqID_26747; Location=13..588; Strand=-
  SCN-specific regions: Sequence locations=1-309,338-500,523-576
tgccaattgcttttgcggtccatttctcatcgcggacaaagtgcgcgcgctccccgccttttacgcgtcctctccgttgccgcatgcgatcagtacgctggtcaaggacttgctcgcgtgcgcggccggcctcggcacgcgtggcgtccgcgagttgatcaacctgttggtgggcgccgatcggaacagcaaagtgccgctgcagatgctgctcaaattcaaatataccaaccgacgggtgcgcttcagtgtggaggcatgcgaacgtgccgcgcaattcccaggatggctgagaacggtgcggcacagaaaattaaaaaatattaaatgttttcaacaaatttgcttttagaaagggtctcacatagcattattatacagcagattgttgacaattgaaaagcatcatttcagttgcttattcggctggacgcgtgtccaaatttgctgtcactggagaagcgggacaaatgcccgttggactgctcggccagcctcgcctcgtcgctttatttgtgccatggcggacatgtgaacaccgccagtgcacagtcgtcacaacagcagacgaacaag

SEQ ID NO: 57516 - DNA, 789 bp, Heterodera glycines
  Genomic contig location: Contig_ID=SeqID_26748; Location=54..842; Strand=+
  SCN-specific regions: Sequence locations=1-152,177-371,394-463,486 -613,635-642,691-789
atgttgatgaatccggttgcagccacaagcagtgaaaatagcaaaactgcggttggcttcaaacggaatcaaaaaaccacacaaatttcaaggcattgtcaaaaggatgcaaaacaacgaaatttaacgctgatgagaataaatgtaatgacaaagatggagagcaaaacaacgattacggtagtgaagcggaaaaaggcggtgatactgtagaggaaaatcaaatcgaaacggaacaacaaattgaaaatgacgatgacaaacagcagcaaatggaagcagtaaatggagaacatattgcaacacaagtgtgtgttgaatgcgttgggaaaatcctaaattatttttgtcttaccatgtaaatttgttcgaaaaatatttaagaaaaaattttgtttgcaagcattatgatgggatgaaaattgaaaaagctttgacattaacgaaaaaaaatcttacagagtcctcctcctcctcctcctcctggtgttgatgaaaatacacccgaacctccacaaatcgacccaagtgattgtgccaaaaattatgatggcatttcactctcagaacaatttggggagcagaatggtggacaaatggaaaaggaaaatggtgagtgagctttaacatttataaccaaacaaaaaatatttatgttttaaattctaattacaattattatatttaatagtccagtcaacgtcgtcacctacaactagcagccatccacaacgtacaaatgaagttgattcattaacaataatcgatgatggacaatttattgcattg

SEQ ID NO: 57517 - DNA, 337 bp, Heterodera glycines
  Genomic contig location: Contig_ID=SeqID_5268; Location=2088..2424; Strand=-
  SCN-specific regions: Sequence locations=1-78,100-337
atgacaacgaacctttggctgtgcaacagagacgagtacactttgggccccaccaacaatgaactgcatatcggtaagggcatcctaaaaaagcaatctgtgcttattttcagtgtggccaaatctaacagcagcggacctggagcaatgtgtgtgcatcttcgacaatgtcttccggtttatggtgaatgaacaccactttaaagtcgcatccgatctcagcccaatcatccgccatcagcgtaagaaagtcgcttgattacaactcgcagcaacaaaacaaatccgatgttaacactaaaagcaattgctttctttcaatcaaaaaaaaaataaa

SEQ ID NO: 57518 - DNA, 1168 bp, Heterodera glycines
  Genomic contig location: Contig_ID=SeqID_5268; Location=2187..3354; Strand=+
  SCN-specific regions: Sequence locations=1-139,161-595,621-685,707 -1035,1057-1168
atggcggatgattgggctgagatcggatgcgactttaaagtggtgttcattcaccataaaccggaagacattgtcgaagatgcacacacattgctccaggtccgctgctgttagatttggccacactgaaaataagcacagattgcttttttaggatgcccttaccgatatgcagttcattgttggtggggcccaaagtgtactcgtctctgttgcacagccaaaggttcgttgtcattttcgatggcaatcttaaaactgatttcgtttagtctttcaactccatggataacggaacggacgtggaagagttggagccgcgcattgagttttacattggactcatcgagaagttcaaatccgtcggatgtattttcgtgttggatcatttgatgcaatgtttgcgccattaccaaatgcaaaaccgtcgtctgctttacttgcgctatcgtgtggaattccgtccaccgattggcattgatttgccgcccttcaaaaggcacttgagcgccgcggactcggcacaattgggccgcattttgctaggcaatgttatctggcacaatcagttgtacgtgcgtagagtggtcaagccgaacaggaagaagatggaggagatattgggcaaagacattcggcacgtacagataccaaagtctgtttggaattagccacacttaattagcccaaataaataacgttttaaagtgtgccattgaatcaacaacggaaaggcagcataaacagcggaggacggggcatcgatggccaagtactaagtggagagacgccattggaaaagtcggacagaattgtgaattccgctaaatcgtcgattgaaagtgacaaattctcgatggagaatggacaaagtccgaatgacagaaagcgaaaccatgaggaccgcaaaaagtcattggcaacagacagaacaactacaccggaagagaatggattgacagaaaaagcgcctccccaaatgggacaacaccaaggggtaagtcaataaacatttaattattcattttgtcatcctcctttggatttaaattgcatttattttttcttattacttgcagcgtggtcttaatcgcaacggagacagcggggtggagttagtgaacggaaatgcgcgcgatttcgacgagattgacggcattgtgccctg

SEQ ID NO: 57519 - DNA, 917 bp, Heterodera glycines
  Genomic contig location: Contig_ID=SeqID_26755; Location=203..1119; Strand=+
  SCN-specific regions: Sequence locations=1-137,172-208,230-305,328 -603,625-641,663-809,831-879,903-917
atggtggagcacgaatttgtggagcccgattctgcagtggacaaccggaggaaaagggcgttggatgccgccagaaagattgtgtgtgttgagaagggcggtgtggcgtggaaaatggtagatgaaggcaaggaagagagtgaggagaaggaagaggaaaagcagcagcaggaaaaggatgagaatggatggccaactgaaaacaggacatgggagcagcagcatgccgtgttgggtaaagtgtcaatctggcgcgactacttccgcaacggcacgaacagcacgtccgccttcgtctatggtgccggacagcaaatcaaccaacaagatgggtcccttcgcagcagaatggccaaatttttgatgcgagacaaccaaagttggggcagtgatggtgcttttgaccgcgaaggacgtgatgcccacggcaggagacgcacacacctgcgccgcaaaaacgttgttagcacacttgagcgtcgatttgacaaaggggtgagcaatctatggcgttgaaaaaattgcatttgataaaaaaacaaaaactgaaaataaactggatgaaaaatccgaaaaattgtcctaagattttcatactatcaaaaaatgtaagtttttaaaaattcagtgaaaacagcgacttttcatctaaattttgatttaagcaaaaaataaatgtaaaataaccgttaaaaaatgcaattaaacactggaaatgagaggactaattgaatgtctaattttagagttggtcaagcaatatggaaaaagggaggcgattagagacactgtggacgagctcaagtaactgttttgcagagtttttggcaaagtcctatgaggaggacccagtacttctacagcgggtattggaagaaaatgaggaggacgaagaggaagcaattgagggaatttga

SEQ ID NO: 57520 - DNA, 172 bp, Heterodera glycines
  Genomic contig location: Contig_ID=SeqID_26756; Location=64..235; Strand=+
  SCN-specific regions: Sequence locations=1-100,164-172
gtgagtctcgcgacgatgaagacgaattgttggttgacaatgaagaaacggaggatgagcctgagaagtgcttttgttgtgatctgtcgaacaatttaccttaaaaagaatattatttttttttatttaatattttatacaaaaatttgtttaattatttttaggtgaaata

SEQ ID NO: 57521 - DNA, 192 bp, Heterodera glycines
  Genomic contig location: Contig_ID=SeqID_26756; Location=273..464; Strand=-
  SCN-specific regions: Sequence locations=1-68,98-100,124-192
atgaatttggcaacgggtcgctgtgcaatcggtgtgattgtcccgggttggacctgcacttttggcggttggaaaaacaattttttacaaattatgccttaaaattgttttttagaaaaatttgtaaaaattgttcatgtcggcttgatgaacatgacatacttctaccaaatgagcaagaccatggcataa

SEQ ID NO: 57522 - DNA, 1195 bp, Heterodera glycines
  misc_feature (1178)..(1178): n is a, c, g, or t
  misc_feature (1188)..(1188): n is a, c, g, or t
  Genomic contig location: Contig_ID=SeqID_26757; Location=131..1325; Strand=+
  SCN-specific regions: Sequence locations=1-80,123-521,545-1195
atgaacaggtaagcaacattgagcgagtaatcacccaagagtggtcatagtttatcgtgttcatcaatgcgatggtaaacttaaaaatgaaataatttaaaatatttttaacaatttaaaaaggtacggttcatttcaatagggcttttgactcaaagcttctaaagcattggtccattctaatgtgaattgtattttcaaatttttttcttttgaattttgcgccgcatttagtgactaccgtaactcaatttgtgtttgcgagcaaaaatcgggacttttatggggtttttctacatatttacatatttcgagatttttttacatatttgtacatattttggacttttttcttgtatattttcatttttttttacatattttgaggattttttactatttttggaaatcctcaaaaaaaattcaaaatttcagcaaattttttgttcatattttcattttttttacatatttgagaagtgaaaaaataatttttttttttgtttgaaaatgtacccctgaaaaatagcaaaaagtaattttttaaatactaaagggtgggtgacctatttaagtcactttttaaggcattttgttccctatttcactttacgaggaatttttttttccaaaaaataaccatttttaaaaattttatttacatatttggggttttttgtacatatttatgtacatattttgaccacattttgtacatatttttggcagccctatttatatgaatttgacaccgttttatattagttaagtttagtcaaacaataacggaacctaccgtaatgccaaaccaagataaattgaaaaacacagagaaatttccatgtgaatttttgcgtactgtcgcaataaatcgttcgatgatcagcgcatgtccaagcaatcgacgaaatattgcagaaaaaagaacagtagactatgagtgaaaaaattcatattgccttgggcaaatatgtccttggaaaagaatttctggacaagcatcactgatcggactactaaataaagcacaaagagcatactttgagtgatcagaatgcttttcaggttggcatgcagcagtttggtgggcacaattatggccaaattcagaaaagtaatgaacaaagcagttaaatcggagatcagttcgaacgaagagaagatatgtgagcaaaaangggggacaantgtctga

SEQ ID NO: 57523 - DNA, 840 bp, Heterodera glycines
  Genomic contig location: Contig_ID=SeqID_5270; Location=89..928; Strand=-
  SCN-specific regions: Sequence locations=1-223,246-419,441-455,477 -542,564-565,587-814,837-840
cattcaatcactgggactcaattcttctgcatttcaatcactgggactcaattctcctgcgtttcaatcactgggactcaaccctcaagcatttcaatcaacgggactcaatccaccagcattcaatcactgggactcaattcttctgcatttcaattactgggactcaattctccgacatttcaatcaccggaactcaacctcagcaacggaatacagaactatttaaaaggaatccagaaattgaaatataacccataaatcaaaacactatggtgtataattaatgcccccaccccataaattcaaattaaaactgacctgtttaaaactttccacctaaatttgatcccgcaagtggcacgtcaatatcccaattgcatataaatattccactcgaacacaggcaaaacatgagatgtagcatttatattgctttttctatccatcaaaggctttttctttcattttttattactatcataacatgctttttattcaaaacaaatatcaaaaaccaaatcagattcttttcatattataagcaaggaaaagtacaaaaaacttttttaaataacaaacctttttcattcaaacaaattctaatgcatttttttaaccaaacaattctccattatcgtttacataagcaaaacaaaagcttccacatcaaaatcaaatcaattaacaaaaacaaaatttagacaaaaaaataatgataaacagcaaaaccacaaattttttcttacacacaaaaacagaaccttcatataccggattttccactcaaacaaacacaaaaatgtgctcattcttttgttaaatattttatacaataaa

SEQ ID NO: 57524 - DNA, 733 bp, Heterodera glycines
  Genomic contig location: Contig_ID=SeqID_5272; Location=161..893; Strand=+
  SCN-specific regions: Sequence locations=1-50,219-361,534-733
aaggaacatgccgcagtgccagccgaatcggtacaactgcttgacggcaatgtggttgttgtgctgctgctagtgctggtcagtgttgtctcagttgtactttctgtagttggagttgtggatgtacttgttgaacttgttgtggtggatggcgttgtagacgtacttgttgaacttgttgtggtggttggagttgtggaagtagttgtcgaagttgtgctcgtcgacgaactgcttgagcttgttgtcggtgttgtggaagtacttgttgaacttgtcgtcgtcggagtcgtagtgcttgagcttgttgtcggtgttgtacttgttgagcttgtcatggtaggagtcgtagtgcttgagcttgttgtcggtgctgtggcagtactggttgaacttgttgtagagctggatgtagtaggtgttaaagttgtgcttgttgatgtactgcttgaacttgatgtggttggtgttgttgatgtactgcttgaacttgatgtggttggtgttgttgatgtacttgttgaagttgtcgtggagcttgtactagtagatgttgaagttgtgcctgtcggtgtactagttgaacttgtcgtagtcgaagttgtggatgtactcgatgacgatgtggacgaagtgctcgtcgtttcttcttccgatgaatgagaagagaaccagtgggatgaaaccagtgttgtacccaaagacagcaacaaaactaacacggttttacaaa

SEQ ID NO: 57525 - DNA, 996 bp, Heterodera glycines
  misc_feature (38)..(38): n is a, c, g, or t
  Genomic contig location: Contig_ID=SeqID_5274; Location=3..998; Strand=+
  SCN-specific regions: Sequence locations=1-159,181-423,453-996
atggattcccaccataaatacagtaccatattttttantatgctttgtgatgacgaaatgagattggtacgaaattaattgagtgtggtggtacacgccgtcattaatgtttttaatttcgtgatatttctataatgagttttttttgtagaggttttagctcctccctttatttatttaaatgccatggaatgccgaatttttcattttatatttccttgatttaattttttgacataatttttcttaactgaaagacttctgtcacgctttttcgtgacaaagtgcacaatgttgtgctttgttgtccgatcggtgattggggaggagtgcgctgggattggagtttcccggaaacgatcaaagaacaaataaaattatttattcaccgcacaattggacaaatcactgatggggaaatgcaattggaaaatggaaatggaaatgcgaatttgggttcatttggggccatttaaatattaacaaaattacataaaaaattgaaaaagtggacagaaattgggcgaaaaatgagctgatcgaacggggggcaataattggagaaatggtgaaaaaatgggaaatttcgatcacaaatgtgggggaggtaaacggagtactttgatcactcaaatttcggtttttaccgcacaaatgaacgaaggagggcaattagtgacaaacaattttacggcggttggacgggaggaacggggcaaaaatagtaatgaaattgggtgaagaaaagttgcgatttgatgaattgtcgcttaatttgtgcgcggggaggggaaaggaacacaaaaacaattgacaatttggaggaaaaggggggcagcgggctgaaacggcgaaaacatgttgtccggggggggggaggaggcccctcccgatcgtagccgatcaatttgatcggctgtcggaacacagcaaagttccgacacttcgcataaacaaaaaaaaatagaatcatttcaatggtcttgagaaaaaata

SEQ ID NO: 57526 - DNA, 473 bp, Heterodera glycines
  Genomic contig location: Contig_ID=SeqID_26764; Location=152..624; Strand=+
  SCN-specific regions: Sequence locations=1-89,111-473
  Gene Ontology: Biological process=endosome transport
atggccaaactccgttccgagttggacattgtgcaggtcaatttgacggtgctgcgtgaattggtggcgcaaatgaaaccgacgaacgacggcggcgtcactgaagcgccggaggactttcattttgtcagagtaaggagaaaaccgcggacatttcccaccgatggccaaccgacaaatttatttatccatttatagggatgagtagcaaagaaacaaaagggtaattaatcaaaatacacaaaggcccctataaatttagtattatccattttagtaaacttttgccatccaactaaacccaacttcattaataataaatgcttagatttgataatctaaataaaaacaacgacaatttgagcatgaaattctaacggtggtggcatttcaggaattgcactcgacttgcaaagagatgcaaaagcgcattttggagctgattccgtccgtctccaacgaggaagtgactt

SEQ ID NO: 57527 - DNA, 805 bp, Heterodera glycines
  Genomic contig location: Contig_ID=SeqID_26766; Location=268..1072; Strand=-
  SCN-specific regions: Sequence locations=1-686,710-712,735-765
atgctgtgcgcattggttccgaatttggtggccatttgtcgtcattgtcgtacaatgccaacaataaacccattgaatttgtggcattccgtagcccggacaacaagcagcttgtcatggtgttgttctcgtccgtcactcagacaaccaaagtgaaaatccatgacgggaagcggacaattccgctgacaataccagcccaaggcattgtcacggtgttgtgggacaaataatttgaattaaaccatgccaagaaaataatttttttttctttttttgtaaaaaattggtgtcagataattaattaataattcaataatgtaatttgcaaatcaatgcgaatatggttttattgtttaaaaatgttttttttcatcttggataaatgtcaataaatgatttgaatattttacataatgcgattttcttgattaattcatacatttaaatggagttagcattttgttaaaaaataacgtaaataaatgctgaaaaaactaataaaaaagtatcaaacaaatcaaagtctttgatcaccaaaatcataaataaacattaaaaaaattatgatggaaatattaaaatgattttgtaattgtcaggagtaaaatttacagggccctaaacttatgaaaattccgttctccaccttttcagtgttgcagtttcgattcacaatttcttagcaattattttattgttaatttttggatttccttctttaattttgaaatattgtttcagctttgctaatttttcatcattggaatatttattttgtgtttaaatataaaatgtaaataaa

SEQ ID NO: 57528 - DNA, 474 bp, Heterodera glycines
  Genomic contig location: Contig_ID=SeqID_26771; Location=229..702; Strand=+
  SCN-specific regions: Sequence locations=1-263,288-297,349-376,398-474
atgcctttaggcgttaattttaatttcaacgtgtcacaggtgatgataggaggcgacagaaaaattttgaacatttattagcattttgcatgaatttgaaagccaaaaaggaactttcaaaaaaattttttttaatcgccaagtagtgacaaaaactgccaaaacccaaaatatttttatgagctaaaaaatcgctctgattgaaaagcaaaacaggtaaaaatgctatttgtgagcttttcatgtgataatctattcgcaacaaataatttaaaacataaaatttcgttcctgacgataataaaatataaaattatttaaaacatatacataataaatcaaaattttcagttttatcaacaaaccgagaacagagaaaaaacattttgcaatttttgacattggaccatgtcaaaattttgttcaagaagcttgacattaaattttataacaaagattttttagaaaaaaata

SEQ ID NO: 57529 - DNA, 644 bp, Heterodera glycines
  Genomic contig location: Contig_ID=SeqID_5275; Location=1287..1930; Strand=-
  SCN-specific regions: Sequence locations=1-186,208-644
atgtacgcgacggcgcatttagcgccccaattactcattcgccatttgtcattttgtctttgcgcaacggtggcttctgcctttgtgtacggtagtagaggtggtggcgcatatggtgacggactaagaggatacggtggtgagtttactcacatagtataaaaaatgttcacgtacaatccttttgtaattatacatacaagtacccaataggtgccgtatacggtagcggtggacactacggcgactgggatgaggacggtgacttattaatttgaattttgtgctgtttttgttctacatttaccttgcacagcacaggtccctaccgaccgcccgtctaccgtagaccgatgtacaaaccagtgcccggcccgctgtacggctacaataagcgtcccccagtatatggcggtggcagtggcaacaattactactacccggcacccgcaccaaaaccgccaactccgtgcccaccggcggaaaaggtgcgtgaccgaaaaatgcgtcagtgatagatagttttcataatatggggtcgtatgtagggctgctcaagttctcgactcgaaaaaaggtcggatgggttgtgctctagattttatgcctcgtttttgtgttggttcagttccgctccaaataaa

SEQ ID NO: 57530 - DNA, 697 bp, Heterodera glycines
  Genomic contig location: Contig_ID=SeqID_5276; Location=1635..2331; Strand=-
  SCN-specific regions: Sequence locations=1-432,456-588,610-629,651-697
ttacattgatcaaattgtcattggcttctttcacaacattcgtcatctcttacaaaaagtggaaattactgtgcttttttgcaacaatcgtcggtcttacgatgttttacaacaaatcgcaaagcatttttggccattcctttcggaaggaattgttgcaattgtccatctgaatggaaatgaattgagtcaactgatgaagctgacatccccatccgtttttcgggagtgtgccaaactccgatgcatttattgttcccaagtttttcccgagagtccctcctacgacggcaccggcgcatccgtaggccaagcactgtccaagtggcttcacactccacgcgctgacggacgcccaaaagttctcaaatgcgtgggcctttcacacattgaaaagcatttggaagacttaaaaatggtgtttaaataagccaaattttgaattttcttttttgcctttaggcgttcatcagtgctgaatcgcccgtcagttatgtcatttgtctgaattttggaattggttttaaatacggtggacaaccatttgaatgggacaatgcgcggacacgagaacggatgacttttcgttatataaaatatatttgctttggcggagtgtggctattgcgaaggggcccaattggttgggatgaaagcgaatggtcggagagtgaaaaaagagctcaaagaggcggag

SEQ ID NO: 57531 - DNA, 403 bp, Heterodera glycines
  Genomic contig location: Contig_ID=SeqID_5276; Location=2030..2432; Strand=+
  SCN-specific regions: Sequence locations=1-342,391-403
atgcgccggtgccgtcgtaggagggactctcgggaaaaacttgggaacaataaatgcatcggagtttggcacactcccgaaaaacggatggggatgtcagcttcatcagttgactcaattcatttccattcagatggacaattgcaacaattccttccgaaaggaatggccaaaaatgctttgcgatttgttgtaaaacatcgtaagaccgacgattgttgcaaaaaagcacagtaatttccactttttgtaagagatgacgaatgttgtgaaagaagccaatgacaatttgatcaatgtaactggaaggaagggaaagaccaatttgttttccggcaattcaaaaaaaatttcaaaaattaaaaaaaaaaattttaaattaatatttttgccatccctagta

SEQ ID NO: 57532 - DNA, 475 bp, Heterodera glycines
  Genomic contig location: Contig_ID=SeqID_5276; Location=2567..3041; Strand=-
  SCN-specific regions: Sequence locations=1-2,51-475
cctattaaatatttttttaaaaatttattatattttttttttgaaaaattccgacttccgacatttttggggtcggaattccgacttccgaaaatttttggggcatcggaattccgacttccgaaaatttttggggcatcggaattccgacttccgaaaatttttggggcatcggaattccgacttccgaaaatttttggggcatcggaattccgacttccgaaaatttttggggcatcggaattccgacttccgaaaatttttggggcatcggaattccgacttccgaaaatttttggggcatctgaattccgacttccgaaaatttttggggcatcggaattccgacttccgaaaatttttagtgcctcggaactccatccctgattcaaagcctatttatatggcattttgtgcctattttccgctatttcaccatttactagtaattttttccaaaaaaataaccattaaa

SEQ ID NO: 57533 - DNA, 1783 bp, Heterodera glycines
  Genomic contig location: Contig_ID=SeqID_5277; Location=434..2216; Strand=-
  SCN-specific regions: Sequence locations=1-362,385-427,449-627,650 -1369,1391-1394,1417-1462,1517-1715,1737-1783
atgaggttcttatacaattttttcaatgacgaagaatgttttaattattttaaatttgaacgccgggaaaatttgggcgaaaacggatcctagccaaaaattgtgggaatttcggaatctctctgagctcgaatctgacaccaattttgaccaatccctaatccaaactcgaaaaagtcgaaatatttttagaatttcaattttttgttcaaattgggaaagtgatttggaattgattcaaatattaatcaacgacttcaaaatttctgcaaacaaattttcactatttattatggacaaaaaaattttgaaaaaaggctgagaaaatttccaaaaaataattaacccattcgaaagcgcataaaattttaaagccataaaatacatttcttaatgagatggtcgtgaaaaatttaaagttatccagtaataaaataattgctaaaaacccaacaacccgtaaatattatatttcttggtgttccttttttgtagcatttaagccgaaattaaagcatttgtccatagaaatacgaaaaacaatgtttgattgtgcatgacgcattagtgaagctgccagcaccgacgactatgtccgatcatccgcgtgaagctgagcgcagtttaataagaatgtgacaatgttttaccacttaatttttgaaatgtttaatacttttcagccatctttgtgacgacgtttggcacaatgttttcgattgttttgtgcgtcccgaactcggccacaaaattgcgattgtctgtgcccgttttgatgcattagtggaacgacatttgaggaccaaaaaatggacacttcgcgcccttgggttttaccaaaagaaggaagaaaagagcacagaaatgcgaggagtttggcaaaggaaaaggcaaaagtggatcgaaaagcttatgctaacggataaaaatggtcagatggtaagggcaccgattttggatgtgccacctcctcccaatttggtcggtttcaggaccattctcgtgaggtaaacacgtaagaatttggcaattgttttcattttatttttaattttgatggaaatattaaaaaataaaagtgatataaaaaatcaaacggatggcgccgggtaaaaaattggattttaaaatacggtttgttgaccatttaaaaaaaacgaacatttattagcagggatcatttttttatgtaaatacattttcctggattctccatgctctaattagtaggaaaacactttcttttttgtttttgcgaacaaaagttgggacttttatttacggattttcctacatattacatatgtacatatttttatacatattttggaccttttgcattttttttgtacatattttgcaatttttgatggtttcttagcgaaatttttctgaaatgccccctaaaatccaaaattcgcaatttttcgtacatattttcatttttttacatattttgaggattttatgaatttttatagaaattttttgtgaaaaataaaattttttaaaaaatctatccctaaaaatcgattttttttttcaaaaaatgagctatcaaaaattaatttaaaatacaaaaaagtgattcaaagcagggatggcacggaattccgagttccgacttccgacatttttggggtcggaattccgacttccgaaaatttttggggcctcggaattccgacttccgaaatttttgatgaaaagtcggaatttttcggaatttttctgagttttttttcaaaaaattagcaatttttgtacaatttatgttaataaa

SEQ ID NO: 57534 - DNA, 697 bp, Heterodera glycines
  Genomic contig location: Contig_ID=SeqID_26773; Location=206..902; Strand=-
  SCN-specific regions: Sequence locations=1-43,106-127,156-319,341 -543,566-570,659-697
atgttttatgagataaagtaatttctaatattagatttctacgttttataattttttgttcaattttttcattaatataatcttttaaaataaatttatttaaatcttcaatatttattcttctcccacttttcaaacctttaatttttataatttcactatcatctaaacatttaagtccatatatttttggagcgataaagattcatcagtatataatttttcatctcatttaatggaaacacctatgaaattatctaatattttaatagaattatcattacttccaaaaaataatgaatcagtgtcacaatataagatttcaacatcattattatttaaagcatacattatactttcgtataatattgtacgaccatatctagtaatcattgacgctaatgaaatattaattgtagttccatcatttaatattttaatatccttatcaattctacaaaaataaaaatcacccacattttgaataacatgtttaatttttgtatttataaagtcttcagaatttaaaatatttacatatgaatcataattttttctaccaaatttaccatataatgaattattcaataatttaaatatattagtcattgataaatcttcttttattttataaaaatctttttgtattaaattataagtggtatacttatctaaaacttctgatttattaaataaa

SEQ ID NO: 57535 - DNA, 1143 bp, Heterodera glycines
  Genomic contig location: Contig_ID=SeqID_26775; Location=143..1285; Strand=+
  SCN-specific regions: Sequence locations=1-128,169-261,289-441,463 -721,744-1143
atgggtccaaaacagtttcttgtgctgtccattttcattattatggcaactttttctacaattttggccaacaaaaatacaaatcggcgacaaaaacgaatggacaattcccaggaaaacaatgtgccaatttaaataattaataataataataattttaaattaaaaccatttaaacacagagtacggtagtccgaaaaaggaagacgaccgtgactacaaatagcggtggtgaaaatgccggtgaaaatgttgctgtgaattaccaccaccagcagcagcaacaattaggcaagtaaattgaggagaggcggaaaaatgagacactaattagtctattaatcattttctcacacttttttggtaataagcattgatttcctcgttaaaatcagttttcaaatcgctttttctatttttttcatatgtaatctaattcgctgaaataatttaaaaaattgtgccagagttcttcgagccagcaaaagcctttggtaaatcagcggctacggcactttcggccaaaaccgtgccaaagcgcaaaacacagccacaacaaatgggcacgtcactgaattcgaaacgaaacgtggaagaagccggtcaaaaccaacagcagtcaccgaagtatgctgttactttggatggcatcaaagaaatgctaatgagcattaattgggctgctacttcacgcccattaacggatgatcatgatcagttgggggcccaacatatgggagaacaacaaatggacaacaatgttcagcaaaatttgaatgatgcagatgaccaatttggtctttcaaatattggaatgcaaccgattgatgtcatcggcatgctcatggaagatgaacccgacaaagaaaatgttgaaatatttgtcaaacttttaaatcagtgccatttaattttggccatagcaacggaacacattcagcacaaaagcaccaatgtgccgaacctaccaatggtattgtgggacgaaaattgggaggcgatgtccaattttattcaacaaaatggtggacatgtggtcggatgtgcgttgttaaacaatgcaaacgatttgacacgtgaagttgcggatgttatcgaaaatggtaaaacataaaattgaaaaatatattttgaattgtgaca

SEQ ID NO: 57536 - DNA, 378 bp, Heterodera glycines
  Genomic contig location: Contig_ID=SeqID_26776; Location=86..463; Strand=+
  SCN-specific regions: Sequence locations=1-207,244-378
atgcgtgcgttgatcgcctcgctaagcaccgacaaattggtcaatttgctgaacattgaatacgcgccggaaggcacggagaaacagctgacgccgctgatgctcgccacggtgttgggagacgcgcaaatggcccatatttttgtgagttaattcaacggcattctccgccaatttatccattgctacaaagctcattgtcggcagaaattaatttttaaatgtttaaaatttaaataaaatccatttttatttcagctggagaaaggggccgacccccacagaatgtgcctaaggaaaatcaacaccgatgacaatttgatcagtgagttgagagaggaaaagccaaaaatgaaaaaagtgacatttgaaaaataa

SEQ ID NO: 57537 - DNA, 488 bp, Heterodera glycines
  misc_feature (486)..(486): n is a, c, g, or t
  Genomic contig location: Contig_ID=SeqID_26777; Location=8..495; Strand=-
  SCN-specific regions: Sequence locations=1-117,146-284,306-488
atgctcgcggcattttgttcgacaggttcggctgctggcaaccgaattttaataaatgcaccaatttttcgtcgattgaatgtgagtgagaaaaaaaacgatttttagggaaaaatgttttttataataaattttattaaaatttgcaaaatttcccacttgtaattttaagtcaaaaaaccccaaatattcattttttggcgaaaaacactaaaagccaattttctcgaattttttttattcctttttaaaatagcgaaaaaatatttttttttccgtccctctaaaatttcccattttttaaatttcaggcccattgtttggcgagcactttggtgttggcggagcacaatgaacaaaagttgagccagatcacgctgaatgcggtgacggccgccaaaaaattgggccaccaaatttcgctgctcgtggccggaaaaaatgccgaggcagtggccaatggggcagccaaaatccctgacgtanag

SEQ ID NO: 57538 - DNA, 606 bp, Heterodera glycines
  Genomic contig location: Contig_ID=SeqID_26778; Location=278..883; Strand=-
  SCN-specific regions: Sequence locations=1-581,603-606
atgaattgtgctctcgcttcatcgttttcgccagtcgggaaacatttcgctgcagtggtcgcggacaagaaaggaatgaggcctgatttgtacgtcaatggcgaagaattggtagaacgtcttggttcatgcgttaagaacacacagatcgaacttcaaaatttttttgtgaaagttgaaggtaattgtaattgttggcattacctttggttttaatttgagttttcaagtttttttattatcatagatgaatgccttcagctccattgcgagatttcatccgtcaaaattggtgctgggcgcgttaatcttgaggcgattttgacgacaccaattaaacgtcgtagttcggaaactttggagccaattaagaagtcgcaaaaaaatgggtagtatttcgtttgttgtccgttgcttggatttgatttgtgactcataccttttcgattacgtattttatgtttgatttttgatattttgtttgttattgttatttaattatatttgtgatcctcacacattatcaaatacggatataattttcattttgtaattgcgctttaaaattgttgatttgtcagaaaaatgttgaatttattaaataaa

SEQ ID NO: 57539 - DNA, 498 bp, Heterodera glycines
  Genomic contig location: Contig_ID=SeqID_26781; Location=295..792; Strand=-
  SCN-specific regions: Sequence locations=1-498
  Gene Ontology: Mol. function=microtubule binding; Cellular component =spectrosome; Biological process=neuromuscular synaptic transmission
tttacccacttttacccaagatggacaaacttggcacggagaccaaccgattgtgccaattgtacccggaaaagtcggaagatattgcagcgaaggtggacgaagcacgcggccggtgggaggcgctaaagctgagcgtggagcagcgcaagcggggtcttgaccgatcttacaaccggcaccgcttcatggccgactaccgcgagttggtcgagtggaccaatggccaggtgatcgggcacagtccgtgccaaatttgatttttaccgcaggattttatggtttttggataaaaatggcataatgtaaagtaatttgttgagcgatatatttggcttaaaaaatgcaattattatgatctgcttcttacaaaaaaaaagtttaaatttttcaaaataatttgttctgttcaaaaggcactcattcaatcgtcggagttggccaaagatgttgcgggcgccgaagcgctgttggaacagcaccaggagcacaagggcg

SEQ ID NO: 57540 - DNA, 1344 bp, Heterodera glycines
  Genomic contig location: Contig_ID=SeqID_5278; Location=4066..5409; Strand=+
  SCN-specific regions: Sequence locations=1-173,196-214,241-1000,1022 -1150,1174-1344
atgccgggattccgacaactgaaccggaatacgatgcagaaatatacatccatcaagtgcaagggttatggaacgtcaaatatcccggtgagtacaaaattttcatatttaacgattaccagatacgaccaatcaccaaatctgatgtcaccgactaccaattccccattcttctctaccacaacaacaaccactttgacggcatcaaaactatctccaaattcttcaataaaaattattattgcctctcttgtgaaacttttttcagtaacaaaccccaacattcaatgaattgctcttcactctgtcatggatgtcgggaggtgggcgttgactacccatgcgagccacaacagggatacttcaaaaaatgtttgcactgcaacaactatttctataacaacgactgctatgaacgccacctccacaaggatttgtgcaccaaatttcagcgctgcgaagattgtggggtaatttataatgtaaagtatcacggaaatgtaggtcaccaatgcggagaaaggttttgtcgtctatgtaagcagtttcatttaaaagaggaagatggcgagaacccctgcaaaagctgcttcatccaacccctaaaaccccataaacttaaaccatacaggatcatcgcttatgattttgaagcgacacaggataaaaaagtaggtaataaattcgaacacgaggtaaactttgcagcggctaccatcatttgtaccgattgcatcaatggaaattggaaggactcacttaaaggatcctcttgcaaaatttgtggaccccaccgcacaatcaccttcgcaccattcgacttctcaaacacgatagtggaccaaaaagtcaccactcaacaaccgctacgcgaattcgtccagtggctactctttgaccacaacaaaaagtttccaacagtcgcctttgcacattttgggggccgctacgacatgacgatgatcatcaaggaagttttggcacaaggaattcacaatccggacatcataaagcaaggaaatcgccactacgagctcaaaatcaaggacaatgaacattgcccactcacaattctacacgacagctacaaccttatgcccatcaaattatctggtctcatcaaatcctttggtctcaaaattcaagttagttttatttattgttttaattatttcataaatttggttttaggacaaacaacattttccacacatgttcaagaaatcatcaaactatgacaacattctctcccatcttcctccacgtgaagaatactgtcctgatcaaatgaaaatccccgatcaacagaaatttgacaattggtacaataataattacaactaa

SEQ ID NO: 57541 - DNA, 847 bp, Heterodera glycines
  Genomic contig location: Contig_ID=SeqID_5278; Location=475..1321; Strand=+
  SCN-specific regions: Sequence locations=1-119,141-195,236-261,303 -353,384-406,428-550,572-632,661-684,706-769,791-823,846-847
ttgaggcgatcagagaccatataaatatattggtcaagttgaactttttggagaatgacaaaggctttaaaaaggacgcaaaaaacatggaaaatttggtatgcaaaagtgtcaatatgttttaaaaaataaacaaataattatagttaaagtaaaaattgatggctaatggatagggctgggaattaaattcacaaatataaacttaaaatataatttttttagatattttaaaggtggattttttgacattttcttttgaaaaaaaaaatttttatgttataatttttttttaattttttgtattttcataagaaagtagtttcttactttttagagcatgtcgaatccagaaaaaatatatattatatatatatttaaatgaaattcccaacattgtctaataaatataaaatttttgtatgtatccaaatattgtaactcgaaaattacagaatgcacttgagaatcagcttatcgccaataaggcatgcttaatcaaggaagatgaggttttttgaataaccatttaaatattaatttttaagctttccacgactaattaagattgtgcaaacctatcacaatgaacgcgctgaattggagcgaaaaatgaagcggtttccaataaacttttctattaaaaatattttctgaaaatttcaaaaaaacgaacaattttagatcattaaatttttcttgattgcttccttttaaaaaattatactttcatttctaagttttctttaattcaatctaaaatttactcattcggaagattaattttccacgtaaatcaaaattttttaagaaacgaaggcaacgaaactcttgatgaatatgacca

SEQ ID NO: 57542 - DNA, 1473 bp, Heterodera glycines
  misc_feature (899)..(899): n is a, c, g, or t
  Genomic contig location: Contig_ID=SeqID_5278; Location=5557..7029; Strand=+
  SCN-specific regions: Sequence locations=1-440,462-736,758-936,958 -976,999-1231,1253-1473
atgacaatcgccagcgcgtgcgtcaagaactttgcactcaatcatttgaagcccaactcgctcgccatcgtcccggagaaaggctacactcctcaacagaaccaaagtgcactggccatcaaatacctcaactggtactcccacatcaacaatgtcaacattcaaactgcacactcccgctatggtgaatatgtctttaaacgtgagggtcaggtgtatcaagtggatggttatataaaagggactaatgggaagagggataaaattattgaggtaaatggttgtctgtggcatgggtgtggggagtgttttgtggacttggacgacgaaacgaaaatgccgaacggaaagacgctaggacaattaagagagagggaggtaaggaagcacgagattcttcgccggtacgtcgacttggaggttatttgggaacacgaaatcaatgagcagctgaagaaggacaagcaaatgagggagtttttcgacaactggaaggaccactcaccaatcaaaatcagagacgcatttcatggaggaagaacaggaccgatgaaactccttcacacagcaaagccgggacaaaaaatcagctacaaggacttcaccagcctctacccgtggaccaatttctctacaagttatccactcggtcacccaaaaattatcagctttagattaaatgagcaaactgtcaactggcgagctccatccgacaatccatacaagggacttttaaaagtattacttttacccccaaacaggaatatcaatgtgaccgtaatgcccataaaatttgatgagcgactcctctttccactctgcgaaaaatgtgccaaacacatcaccaatgaacacccgaatggcctcaaagacgacaactactcgtgtccacacttcantcccgatgaccgtgcctttgtctctacctgcactcaccttgaattgaatgctgccttggaggtaggctacaccgtcagaaaactcttccatgtcctgcaatacgaccaatggagcgacaacatcttcaaatcttacgttagcgaaatgatggccctgaagatccacgcaaccggcttcccttcatggtgcagcaacgaagaggagaagaaggaatacattgaggagaaccgtcagcgatttggaattttgttagacaacgaaaagatgaaggctgaaccggggaagcggtacatcgccaagctttgtctcaactcactctggggccgcttctccatgcggaacctcctctccaaagcaataatcaacaacgacgaaagcctgattcgccaatataccgacgacaagaaaatcgaattagtggacttggaaatgatcgacgacgacaacgacgtattcatgctcacctacaagccgaaagaggagtttgtcgacgaaaataaatactccaatgttgtcatctccctcttcacgacatctgcagctcgcctctacctctacgatgccctcaaaaaa

SEQ ID NO: 57543 - DNA, 629 bp, Heterodera glycines; identical to SEQ ID NO: 26783
  Genomic contig location: Contig_ID=SeqID_26783; Location=1..629; Strand=+
  SCN-specific regions: Sequence locations=1-99,121-398,483-525,547-629
  Gene Ontology: Biological process=sulfur amino acid metabolism

SEQ ID NO: 57544 - DNA, 1143 bp, Heterodera glycines
  Genomic contig location: Contig_ID=SeqID_26787; Location=175..1317; Strand=-
  SCN-specific regions: Sequence locations=1-402,431-451,474-711,748 -1099,1121-1122
atgacaattaccgtttttattgccttctccacgtctcctcaaagttctcgaccgctaacaaatgtaatcacgatagtcattcaattggtggttggaatcgtggagtttgccatgttttaccagttgtgccaatataactcaaaaatctatcagaaaattatgcaaaaacaggggtaccatagcctgtcattgcgatatcaggtattattttaaattgacataaattttttggtacggttgctaggtagtagtgaccagcatgaaaaatattttgattctagttttaaaatagctaagctttattataaatgttaataaattacatgaggtttttgcgcacaattggaagcttatgcctccagttttttaaatttgttctaaatactagtggatgatattcacataaaaataataataataaaaaattatagttcgggtttttataaaatcaaaaaatatgaagaaaattgtggcaatgtttcttcaaaattaatttttttaaacaatgacattcatttttagctttctgaaaacatacgcattggaaaacagcttgtccctccgttattgctccatttgctaacaatagttacctctactgtgattatctcgtggagctattttcagtggccgcattactatcagatgtacaatttgttatcaactttgaacgcggtcaccggttttctgatcgaactgttcataatcacgtaaaaatttattttatacaattttgtttttttaattggccatccaattaagatgccacccatttttgaggagagatatgtgccaaatttggaataattttggaaaaatgtttctgctgtgccccaacaatcgcagaattgctgatcaaactgcaactgccgttgctaatttcgataatagaatagttgctgcttcaaataaaaatactgctgctgttgggattgctcagagggatttgatcagcggcaaggcactgatcattgatcaaccaaaatcggacgaacattttgctatgctgctgcaagcgtgggaaagtcatataaaattgcgatgaatacattttgatcactgcaaaatttaaatggcgtcatttaactttaattgattgtttcacaaacaaaaatggttttaattgatggaatttgaaataaa

SEQ ID NO: 57545 - DNA, 452 bp, Heterodera glycines
  Genomic contig location: Contig_ID=SeqID_5281; Location=1232..1683; Strand=+
  SCN-specific regions: Sequence locations=1-31,67-147,219-220,244 -274,297-411,433-452
atgtcatttttggctggattgcctccgatggtaaaaaaaaagttaattaaatttttttatatttttcattaagatgggtgtttacactgttttttgtgccacattgttttatatgttctttggtacttcaaaatattcatttttgggtataaatttattttcataattatagaaaatttatttttttaaactaatcaattaaataataattaatttaaggaacaaatttggtcatttgttttttgttgcgcaatatcgttgaaagaggtgccgaaagtttgaatgaaattcagtcggaaaaccggtacgatgatgaacatgtgcaaattgcagtgaccgtcacatttttggccgcaataattcaggcaaaattttattaatatgatttgcattaataattaaacgttggcacaaaaggcaaaaattaaagttaaggaacttttttaaacgca

SEQ ID NO: 57546 - DNA, 1437 bp, Heterodera glycines
  Genomic contig location: Contig_ID=SeqID_5281; Location=2191..3627; Strand=+
  SCN-specific regions: Sequence locations=1-131,208-256,279-529,621 -755,777-861,889-1100,1149-1149,1171-1437
atggccgatgaccaggtgttggccggcttttctgccggcattggcctgcgcattatgttcactcaactcggcaacattattcactttcggtccaatcggatatgtgccgttgatttgccaataaaggcaagtttaaaaaaatttgaaattatttttttctaattttgttatttaattaataattagagctattttaaaaataattttggttttattgcatccaaatgtagcatatattgggcataaaaatgctcctataaataatattaacaattttaggatgcttcttcttccgcttcacaatccatgcctgccaattttggctcattcccctgtgtcatttgggcttattatcgacgattgaatgggcatcgaaaggtaaaaaaactatgacttttttcgataacgtgttttttagcccggaggctacgcaacccttcagtcactgtcgtcaaatattgtacaaaaattgaatacatccgtggctgaacaagctaattcagcgcatattgtggagacaaatgttgcgaaaattattttaaattgaaaaataatattcgaaaaattaattattaaaaacttaaattgaaatatatttcagaaaaaataaaattaattaagtgtttgccctcattttgggagtgtttcgacgccataaatttaaatacactggcgatttcggtaaatttttttatatgattttttacgtttcactacttaaagcatgggtaagctcctataaatttttgaggttgcttgtgttctgctgttggtgttcacccgtcaatgcatcggtccactcactcgttttcgtcttcgttcagctgtgtcctcggaatttttagtggtcagaaaaacttgttttataaatatatttataattaaattctaaaatgatattcgctatagaatacattttttttttggaatattttcagattttattagccggttttttgtcacgatggcttaatgctgagagactttggcaattagagacaatcaagtttggaaacggaaggttaaaaatgctaatgaattaattgttaaatttctacataaaattcatttcaaaaaaggatttaaattattagtatctctaaattttaattttttattatttaaagttaaaagatataattatattacttgaagatttatttacttttaatttgtgtttagtgcttttatgattacagtacctcatctatcgctgataagttcacggtatgtttaaattcttattttaatgaaggataagaaaaatatattgagaaattttcataattttttttcttcatattgttatattttagcttcctgtcccagacgctgctgcttgatgcatttgcgcttgcactgctcgtgcacacactgcacatacgcgctgcgagcgcgcttgcacgcacgcacaaatatcgcttctacgaaaagcag

SEQ ID NO: 57547 - DNA, 95 bp, Heterodera glycines
  Genomic contig location: Contig_ID=SeqID_26793; Location=148..242; Strand=-
  SCN-specific regions: Sequence locations=1-95
tcgacgatttggcttcacaatggcgaaatttgaaggatatattctacaagaggctcaaggaaatgaaccgacgcattcaaatgggcgaagtcaac

SEQ ID NO: 57548 - DNA, 589 bp, Heterodera glycines
  Genomic contig location: Contig_ID=SeqID_26794; Location=583..1171; Strand=-
  SCN-specific regions: Sequence locations=1-344,366-589
  Gene Ontology: Biological process=regulation of protein activity, epigenetic
ggtttattatcctccttcacctccccgactcccgctcccgcctcgtgcgaaagcaaaaattgaaccaccaccgcgtcctaccgccaagagagagcctcagaagccaacaaagttggaactaaaaccatcaaaatttgagcccgattcacgaccaaaagtcgcgctgcctcggtcgaaaaaagaacctgaattcccgcttgaccctcggccatccacatccaggcaggccggatacttgcctccacccaaaattataccaaaacccgagccgacaaagaggcctgtaccataccgtatcccgaaaagagagccaaaaattgttgaacaacagccacagccgctgcaacaaccccttcctgcttctgccgtcgaagaagaaatgcccactattcctccgcctaggcgggggaccaaacgccactaccccgtaaacggtgagaatggggaaaacagcgggggaggtgcgcgagcgcgacgccaaacgtctggaatttctgcggcggcaagtgaaccgcgtggacgtacactgggaatgcgatatccatcggatgctggagcggagcagagaaatgcgcaagtcgtttgctga

SEQ ID NO: 57549 - DNA, 653 bp, Heterodera glycines
  Genomic contig location: Contig_ID=SeqID_26795; Location=178..830; Strand=-
  SCN-specific regions: Sequence locations=1-328,356-653
atgccgaactcaacaaggcgctgcagctcggctatgtggtcactgacctttttgaggtagtcactttttaaaatttttttgcacaaaataccaattaggtttgggactacgacgagtgggacggcacgctgttcagctcgtacgtcaacacatttgtcggtctcaaagtgcaggcgacgggctggcctgaaggatgtgtcacggacgagcagcgtcaatttgtggaagactttgagcgcaccgagggcatccagctggaccctgccaaaatggaattcaaccccggcctgcgccttatcgccaaaaccttggcaaactcactttggtcttattaatattaaaatttatttttaaacgaaaaatttacaggggaaagctcgcgcagcgtgtgggccgaaccgaaattcgctacacgcggacgccggctgaattccacgagctgcttgaagacccgtcgctggacaagttggattttgtccacgtgtccgagcacatggaccgctgtgtcgtgcggaagcgggcggaatttgccaaggccccgctgaccaactgtcttccggtcgcttcgttcgtcacttcatatgcccgcctccatctgtatgactacattgagcaggtgttagcgattgacggagcggagctgctctactgcg

SEQ ID NO: 57550 - DNA, 634 bp, Heterodera glycines
  Genomic contig location: Contig_ID=SeqID_26796; Location=44..677; Strand=-
  SCN-specific regions: Sequence locations=1-28,54-57,93-142,164 -176,207-336,381-447,478-634
atgaccggcctcataagagatcggtctcgttatttctcgtcactacctcctcgcgttgagagtgggtaatttgcgcgcctgctgccatccttagacgtaggggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagcgtgcgcatgggcagcgaaggagacagagcaagtg

SEQ ID NO: 57551 - DNA, 1633 bp, Heterodera glycines; identical to SEQ ID NO: 26796
  Genomic contig location: Contig_ID=SeqID_26796; Location=1..1633; Strand=+
  SCN-specific regions: Sequence locations=1-200,231-297,342-471,502 -514,536-585,621-624,650-685,707-717,764-785,811-1070,1103-1108,1192 -1192,1222-1273,1396-1398,1426-1433,1509-1580

SEQ ID NO: 57552 - DNA, 605 bp, Heterodera glycines
  Genomic contig location: Contig_ID=SeqID_26798; Location=171..775; Strand=-
  SCN-specific regions: Sequence locations=1-102,155-240,307-390,458-605
  Gene Ontology: Mol. function=structural molecule activity; Cellular component=intermediate filament; Biological process=epidermal differentiation
gcggatgcggcggagggtgcggtgctcctccaccaagcggtggcggtgccatcaaactgacgctcggatgcgaagggcctccgcctcaagcgcctgccccatgcggatgcggcggaggatgcggcggcggttgcggtggcggatacggcggaggatgtggtgcccctccgccaagcggtggcggtgcgatcaaactgactctcggatgcgaagggcctccgcctcaagcgcctgctccatgcggatgcggtagtggatgcggtggcggatgcggcggcggttgcggatgcggcggagggtgcggtgctcctccaccaagcggtggcggtgccatcaaactgacgctcggatgcgaagggcctccgcctcaagcgcctgctccatccggatgcggtggtggatgcggcggaggatgcggtggtggatgcggcggaggatgcggtggcggatgtggcggacgtcgcaagcgcatggctttgatccgccgttgccgtgcccttcagggctccgttgttcggcgcaactgagcacaaatttcccaaaagcattcagcgatagattagctgaacaaatcaatcgattgatcacatttttaggacaattag

SEQ ID NO: 57553 - DNA, 2527 bp, Heterodera glycines
  Genomic contig location: Contig_ID=SeqID_5282; Location=216..2742; Strand=-
  SCN-specific regions: Sequence locations=1-11,38-625,648-786,815 -1201,1228-1429,1556-1714,1787-1933,1955-2473,2495-2527
  Gene Ontology: Mol. function=thyroid hormone receptor binding; Cellular component=transcription factor complex; Biological process =regulation of protein activity, epigenetic
atggcgaacaatgcacctgctgctgctggtggaggaggcggcacagaaatgacgtaattcaaacaatagagagggaggaatgcattatttcttaatccctttaggaggggggggggctttattgaaggtagaaagtgaagaactattcgaagaaatatggtaaatatatgcaactcgtatccaaaatacggtatactgcatattggtcaacagagctcttaatcaagctgggttggttggacttttcagccgattcaatggaaaaacgtacactgacaaaaggccttgtctaagtctaggcaacctgcctaagtcttaatttcgaaaaaatataatttgtacgttgtgccttttatacattttgtcattacacctcccctccccagtcacccttgaaatgaattttttttttaatcctggtattttaaaaatgttttttttttttgattaaatcgctatgcttttgaaggtatcgagccggcgctgggtcccaatcgcaactgtactttgttgacggtaacgcaccaagcatggatttgtcatcaccgcaagctgctgctgggacaattcagcagcaccaccaccaccaccatcggacggcaaagtcgtgcgattttgacatgctcggcggcggtggtggtggtactgatgcaacagctacaacaaccgcaacaatgttgggcaacagccacatcatgattgatggtgagaacagtgcccatcctcaacaacaacaaatgggcacacaattttttggcaactatccaaccatcaccggctattttccagcaacacaacaccaacaacagcaatacattgagtatgtgaatgaatgggtccttccttatgcagcatgtgccccaaatgatggggaggagaaataccggctgataccttgaaaaaaatcagtatcccggctttttccgaatcctctttaaatcctagcttgtgactggatgaaaaaaaaatgccgagcgggatgccatacagctggtgaaaattgggttctacatttatcccatttccaaaatggtatcattgtgccaaaatctttgctggtttcccaatctctatttggttacgaatataccgtattccctaaaacagagccacccccccccccccctaaattagatcccacccctgttgagaggagttaaaaaatagaataccatggctctattttaggaaatacggtacgcttataaaagaaatttaatttagccctgctaagcagttgaactcgtcatcatccgtggcttattgggccggtgcgcgtggcaagagtcaaagtttggacccgatacgttttgcggaacaaacggcacagctgtcgccgttgtcgtcgtccgcccagcagttcaccacacctcatttgtccagcccgcatgtggcctctggcgcatctccatgcgatgccacaaagtaccaacaacagcagcatcagcaacatgtccagccgcaacaacaacagcaatcacaacaaatgccattccagcaacaacaacaagcgcaccaacaacagaacccagcaaagcagcaacaacaacaacaatccaacattgtgagtgagaaagagcgggtcttactgtattttgtgagaaattgtgcaaaaagtactgtatttttatgagaaattgtgaaaattcgcatatttttttgatcatgttttggtttggcattttgttggccacatggcatttgcttgctccagaaatttttttgatttcttaataaaacaatatgtttttttatatataaaaaaaaagttcaaaaatttaaatttgtaccaggagctggtagatcccggtgacggacttggcccattgccaaaaggatggaatattgtatgttcaaatattttataatgtgccaaaaaagtaattattccccctcccccccattaaagggcttcgcttccaatggtgaggcatatttcattgaccacaacaataagacgacgacttggttcgacccacgagtgccaaatgccgaacaaactgagctggtggcacgtaaaattcaacaacgccagaagcagcaacagcatcaccaacagttcaacggtgtcacatttcaggcaatttttctgatggtttttgatcacttttgtttcattaacagtcaaaactatgggatggttaccttccaaaggggagggtgtgggatttacctggaccttttgaggcttaaagtctatttttaaactttttaatgaccttttatggtcattttgccaattcctatttatgcctatggctttatacaatttctatatatatgaaaatttctatgatggaatacagtatttcatcatttctggaactgtaccacaaaagtaataataattttttagcaaggaccgtatggggcattgccaaataatgaaacacccgacaataatggttcaacagcagtaaacagttcgccaagctcgacaaccattggcggtatggaccgtcgtgttcagcagttaaagcatgaacaacagtgcatgcaagaaaagcgtgaacaaatggtgcgacag

SEQ ID NO: 57554 - DNA, 272 bp, Heterodera glycines
  Genomic contig location: Contig_ID=SeqID_5283; Location=1556..1827; Strand=+
  SCN-specific regions: Sequence locations=1-69,92-272
atggtgggtggatgatgatggtctgataataggtgtggccaaaatatgtatgacgaattttttttcccgttttttgatttattcagcatcacctccaccatcagaaaaaatggtggggaatgaatgtatccatggcaatgatcaaaaaggtggtgatgaaaaagatggctaacaacaaatatggcccgggcgtgcggccccgggacaatgacgaatatgagcagcacaacggattggacgcggataaggggccaaaataaatatggcatcaa

SEQ ID NO: 57555 - DNA, 1376 bp, Heterodera glycines
  Genomic contig location: Contig_ID=SeqID_26802; Location=1..1376; Strand=-
  SCN-specific regions: Sequence locations=1-52,83-205,238-507,530 -967,989-1220,1242-1376
  Gene Ontology: Biological process=reproduction
accttgagcatagggaccttcaggaatgtgtttcgcgcacaaaaaaggtgggatttaataatataatttaaaatgtaattttgataagtccaaacaattggactactctcggttttttgggttataatcctttatgctttaaattatacttgaaaatatctaaaaggtctagacttaaaattttgattgatactaatttgggttttgaaaatgaaaaaatattttattttttgttgattggacttgtaaaataagaacccaatttctccagaataaacggttctggaagatcagagatgttcgcttcaaaaaatggctcagaggtgaaacgccacacattttcgaaccattggctgactatttgaaatcggttcatggtgctccgacttcctatccgactggtcatcgtgtgaagaaatgattagattagatatatcgtgagattctggtttttaataggagtcacatatgcatatgtatatttctgcgcgataaaatgcttttgttctgaagttttcctctttaagtgtttgacactgtcagttattatttccctttgtttgaataagattttttttaaacattcatttaagtaatgcgtttgcttatttgtggtgcttcgccttttattcaaaattcaattttggtttcctctttgaggtattatacgtctaatttgtatcacaaccgaagttggagagaaggatttttcaagtatggaaagtttgttcgccatctccccgagggcgttaaaccgacgcacatcgttgtgggcgcaggctcagcaggctgtgttttggtgggaaggtaccaacaaatagaaagaatagtttacctaacaattaggccaatcgtctcactgagaatccggacaatcgcgttttgctcgtcgaggccggtccccaagataattggtggaattggaaggtgaattctgatttgtgagaggttagcactgacaaataaacaaaatacactcagattcatatgccagcggcactgatgtataatttatgcaacgacaaatacaattggttgggagtcgctgcattttgagcttggagtttgttgattccacattccaggatgtatttcacgatgcctcaggagaacatgaacggacgagtgctttactggccgagaggacgagtttggggtggttcaagttcgctgaatgcaatggtttacatccgtgggcatccgaaagattacgaccgatgggagagagagggggcgaagggctgggcacacaagtgaacaaagtcatcccagtattggtccgagcctttaaataccttcaggaactgtcttccttatttcaaaaaggctcaagcgcatgaattcgccatcggtcccgacgacccttacaggggaca

SEQ ID NO: 57556 - DNA, 797 bp, Heterodera glycines
  Genomic contig location: Contig_ID=SeqID_26805; Location=631..1427; Strand=-
  SCN-specific regions: Sequence locations=1-274,296-353,381-764,786-797
tgttggcaatgcctttcttgatgaggtcatccgaaattacatgcccaaaccgcacgcaccgatccaatgcattgctatggaggatgcgcattttgccctgaacacaacgccaatctcttcgaacagtccgtccaaatcgccagtcagaagtaaaaaaaatggggagaaacaaaacgaaatgacaaccacagtttcttggtaagtgtctccaatttcagcgggaaatgatcgccttttggaggaaagcatcgctttgatgatgccgcatccgaacagaaaaagggaaggaaaagcatttgcaaggccaaaagatcaacaaaaattcggacaaaaaatggacgaccttttgacagcggatgaagaagaagaagaagcagttttggaacagcagcagaaagtcactgccgaactgcccgcggacgtgaatgcggaattcgctgcccattggatggtcgtggagtgtgggacgaccaaaagtcctaaaacggacgacgaggaacgaaggtgcgaggggagggggagggggtcaaaagcatttgtggcactcatttatgtgctttagtcgcttctccctgaagaagaccccctcacagtcgtcgatccctcggccgtccgttgcgccttcggaccgcagtccaaagacagcgacaacgactgccgatttgacggacactgccgccacttctcttctcaaaaggccggcggcacgttcatcgaccctcagcagaacacaacagaaggcgccgccattggcgccgaagccgaacattgccaaattgggaaaggtcctcgcataa

SEQ ID NO: 57557 - DNA, 216 bp, Heterodera glycines
  Genomic contig location: Contig_ID=SeqID_26808; Location=1..216; Strand=+
  SCN-specific regions: Sequence locations=1-216
aaacgggcgcgaagcgcccgttatgaggccgcgaagcggccgaatgttctaaaaaaacgggcgcgaagcgcccgtcatgaggccgcgaagcggccgaatgtccccaaaaaaattaaaaaacgggcgcgaagcgcccgtcctgaggcttaacagccggccgcgaagcggccgaatgaccccataaaattatgaaatgggcgcgaagcgctcgtcctg

SEQ ID NO: 57558 - DNA, 403 bp, Heterodera glycines
  Genomic contig location: Contig_ID=SeqID_26810; Location=348..750; Strand=-
  SCN-specific regions: Sequence locations=1-170,192-403
agattccatgtgctggcccaattggaacatcttcagtcaaaatacacaggcacgggccatgccgacagttctcgctgggattggatcaccaaccgtaagcattaacgatggcattaattagcggttaaatgtttggcttctaatctactgtcaatgcttttgcacttcaaagtgttaattgaatttgtttctcagagcatcgtgacactttcgcttcaatcattggccatcccgaccatttgaggtgtccgttcgtctgatttcatttacattcctttccttttattacagtatgatggccatttgtgagaatgagacgcgtgctcgaacgaagtacaacatgctctgtcggatggttcagccgtgtggtccgcccccggaaaaatcagctttagacgatctt

SEQ ID NO: 57559 - DNA, 2354 bp, Heterodera glycines
  Genomic contig location: Contig_ID=SeqID_5286; Location=266..2619; Strand=+
  SCN-specific regions: Sequence locations=1-241,318-392,414-456,478 -554,577-867,889-968,990-1299,1321-2354
atggacaaggacaaggacaataaggacaaaattgagcccaaaggacgaagcgatcatccaaatcggccatgccactccgctggtacaaaacgggatggagtcggcacaaaaaacgggattctcccactcttcgaatccaaagcaacggcggctacagtttcggcccgcacacgatacacgccacagttcaagactttcgatgtcttaattgtttaacttgctttaattaataacaatttaattttcctctttttcctctctctcttttcttatttttctctttttttttcctctcttcccttccatgtttttcttttggccggcagaaggaaaactttggcctgtctcatttgcctatggtcgctaccgtatacccgtaccacaagttccatccctcccactccttgttttgcccatcccgccattctgtgaattttgttgcctattgcctaacagctgccccaattcccttccccctcctacgaccaggcagggccccatccctggacgtttggagttttgatcagcgctcattaattaattaatcacaggggaaaaagggttggggaaaagaaatttcagctaacaaatgccagtcccgggacaagacaaaaataaacacaaatggcaaatcacgagaaaagactaacaattaacgaaacaaaaatgcgaaaacgaattcgaagaaacaaaatgaggcaacaactgacgggaaaaatgaagaaaaattgggaaaaacagaaaatggacaattaattaattgtcttcggagggaacgaaaatggacacaaaaatgcacatcaaagagggacggtagacgatcacattgcgatcacattggcaatcatcatccaatcaacgacgaccaattgtttcattatttttattacaccaatcgacgaacaattctttaattacttcatcacttcattttcaaatcaacaattactggagttcaacaaatcttttatttttctgagacacttcgacgacataatttctttaaattttaaatttctcgactacaatcaacaaaattctggatttattttctaaattctggtgttaatcagcgaaacatattccgacaattccatcaaaaacggccgacacgcggagaagaccgaattctttagaggaagatggactaaacgaaggacaaaccgaaagggataaaaggctttggctcatccatcaaaaaaggcagttgcgtaatatggatttagacgccctgcggcgtcgaattgttactctcgagcaagagatgcgtgaaattggtggaactcgctctgggctcccgatgccgaccacctttgacgggacgactgatttgcaggattatttgaagtcctttaatttaatcgcgaccgcccacaattggacacccgcgcgatgtgtgcaagttctcccgctgttcctcagaggatcggcaagggcaatttacgagagcatcgaaccggatattaaagataattggcgaagtctaattgatgccatggcggataagttgaaacaaatgtctccgagtctgacagcaagacagaaattggcacaacggaaacaacagactggagaatcgctggaagaattcgcgcaagcgatccggaacctcgtcttacgtgcttatcccgacaattctctcgagatggactttggaaatttggtgctcggtgctttggaaaatgatgtgaaacaagcaaacgaagtccgacttcgacaattccgttcggaaattgcgcgagatttttttcgggcaaatatggcaccacgactgaaggaaagagtgatgtacatggaagaaccgcaaacgctcgaggaagcagtggcccaggcaaggcgtgttgaacaagttcaaggaaatttggccgatgacatgtggaaaaatacacaagatgcaaaagccgaagttgctttagctgaagttaatgcagtgcgaaccgaattaaatgaaattcgtgaacaacaaaggagccgagagaatccaggacgagatcaacgagaatggcaaaatcaaagcaattcttggagaggaaacaacgccgaaggacaaaatcaatctaatttttggaggggcaatcccgaatttcggccaattcgccgagggaatttcacgccaaggggattcacaggatatcccaggggactcaacacataccgaggaggatttaatccgcgcggcgctaacgcaaacttcacaccgcttggcaacaacttccaaggaacaaacaacaatggaaatttccaaccgaacttcaaccaaaaccaaaattggccaagaggacgtggaccaacaggtcccaacagaggacgcggaggaagtgatgccaatcgaggacggactggctggcgcgtga

SEQ ID NO: 57560 - DNA, 350 bp, Heterodera glycines
  Genomic contig location: Contig_ID=SeqID_5286; Location=119..468; Strand=-
  SCN-specific regions: Sequence locations=1-350
acatcgaaagtcttgaactgtggcgtgtatcgtgtgcgggccgaaactgtagccgccgttgctttggattcgaagagtgggagaatcccgttttttgtgccgactccatcccgttttgtaccagcggagtggcatggccgatttggatgatcgcttcgtcctttgggctcaattttgtccttattgtccttgtccttgtccatttggctgtggtccgtgtccgccgagacttgccatttgcctcaattggggtctgtgaccaatgtcagcgccgtgttagtgttttgtccagtcgtattgtctcctcaatgtaatttcgggttaatcgttggcacggccttaacacatca

SEQ ID NO: 57561 - DNA, 3640 bp, Heterodera glycines
  Genomic contig location: Contig_ID=SeqID_5286; Location=5545..9184; Strand=+
  SCN-specific regions: Sequence locations=1-853,876-902,924-1864,1886 -1924,1946-2245,2267-2618,2641-3223,3245-3489,3520-3640
atgaatggagtgaaaacaaaggccttattcgacacaggagccgacatcacgtacattggccactcaacggcacaaagatgctttatgatggtccgaaaaggggactatccacaagcaagagcagcgaactcaactcccattcgttttatcggatcggcactcgccaacataaaactgggagattttgaaggcaaatttccaattctcgtcagcgaggatgatagctgtccgtgcacagccataattggaacggatttgatggatttcatcagtgaacagggcgaagaagaaatcggattgaacttcaaaagaggactcgtacgtgttggaaacatgcatctgccaatgatcgccgctgtcaacatcgagaaacaaccgattgaagcacaacttattgagacgcaaacattaccgccgctatctgattcactcgtttggggaaaaattaaccgaagtttgggaccagacgaagtcttcatcaccgctgagcgagatcatgaatatttcccgctgcgagttggaaaatgtctaataagtccaggctcaacgcgaattgtgccactaagattgcttaatttcggaaacagcgtaataaaagtgcatgagggatcgcgacttgcgtggctggaaccaatagctgatggcactgaaattaatgcacagaaggaagatgagaaagaaaacccggaaatgataatgactgacgaggtgtggatgaaattcaaattagaaagtgataaaatttcgccagaggcggactggacggaccagactttggaatttcaaaagaaggaagaagcagtcgcgccaatactggaaagaattcgattaaacgacaccattctgagtcgagacggaattgaaaaacttaaaaacatcatccgacaaaacgagaacgcttttgtgaaacctggagaagtcggactcttcaaaggacaaacgatacaccgcatcgacctaatcgatggcgcacggccggtccaacagaggccctatcgttatcctgtcgcacttcaacccgaaatagagcgtcaagtcaaggagttgctgcgtcaaaatgtcattcgaccatccacttcggcatgggcatctccaattgtgcttgtccgaaagcctgatgcctcctatcgattttgtgttgaataccggaagctcaaccaattgacgaagcgatcgacatattatttaccgaggattcaatcgatccttgatgaagtctcgaggaaaaaatatttctcagtggcggactgttcaagcgggttttttcacatcaaactcgcaaaaggacacgaagaaaggagcgcatttatctgccacatgggactgttcgaatggctacgttgtcccttcggattggcgggagcaccaacaaccttccaacgagccatggaagaagtccgacaaatgtgctcagcgacatttcttgtgtatttggacgattgcataatcggctcaatgactgaagaggaacatcttcgggacatcaatacttttctaagaacgatgactgaagttggattcagactgaaaccagagaaatgcagatttgcattgggagagattcgctatttgggacatttaatttcggctaatggcgttcggatagatccaaaggatttggagccaattcacaaattgaggaaaccgaaaaatatcaccgaactccgatccttgattggaatgctgtcatattttcgaaaattcgtctacggatttgcagaaatacttcaacccatttatgagttgacaaaaaatgaaagcacgacagaatggggaccaccacatgagaaagccttggaggaattgaagacaaagctgatgactgctccagttttggctccaccaaaattcggacaaccattcgttgtggaaacagatgccagcataaaagcaattgccggatgtcttctacaagaaaaccgtgaaggcgaagtccatccgatttgttacttcagccgagtgctaacaaaacatgaaaagcgctattcggtggtcgaattagaagccttagcaatttgtgcttccctcaagaattttcgaccatatttggaaggagctggaaaatcaacagtgatcacggacaattcggctttgacatcattattccggcggaaggacttggaagggcgactcagtcgataccaattggctatcatggcattcgatgttgaaatcattcatcgccctggaaagcggaaccaattttgtgaccatctttcacgatacttggacgacaacgacacacaaattaattggctgaaaattgaaccaaaaatttcacaaagtgaaatgcgcgaggctcaaaaacaggagacggacacacaaaagagacgggaaactttgaagaaggatcaaaattcagaggagccaaatgaatttactggaaaatggagaattactgaagatcttttgtgtgcaatggaccgaggcgaatggaaaatttatgtgccaagcagtcttagacaaagagtgatgaaggaatatcactccgacccattccaaggaggtcacctgggcgagaagcggacaaaagacaaaatccgacgaaatttgtactgggaaggaatggaaaaggacattcaaaaatttgtgagaacctgcgacgcgtgccaaaaacggaaaataattgggaaccaaatgagctctgagcccatttgtccaattgtaccagcgtcacagccatgtgaaagacttcacttggatttgatgggaccattgaagacggcaaaaggcggatttcaatacatcttgatgataatcgattcattttcaaaatatatgacggcactaccactgagggaacaatctgcgacgacggtgacaacagcattcgttgacaaatttctatgccaatttggaattccaaaaatcgttgtgacggactgtggaacacaattcctcagttcgacatttgagtcacttgctaaaacttggggattcaaacaccaaacgaccgtgccataccaccaatcagcgaatggacaagtggaacgattcaaccgaacacttgcggacatgctagtcaccacgactggcggaaaagattgggctgccgcgcttccgatgctttgctttgcatataatacttcgattaactcacaaataaatcattcgcccttctttgtgcttcatagatttgatccacggcttcccagtaagatgctactcgaaaaagacggcgaagagtacaatgacatggccatatacgtccaagagctgaccaaaaggatggaagaagcaaaatctcggatcagagaaagtctgaagaagtgtgctaatcggatgacccagcaacaaaagggcacgaaagaagtccgatggacggaaggaatgcttgttttgagacgcagaaatgacaaaaagaataaattggaaccaaattatgaagggccatttcgcgtcatcaaaatcgagaagccaaatttgcaaatccgagaacttgaccccgatggacagccatttacagtgcacatggaccaatgcaagccgtatttcacagatgaggaagcaagacaggacacagaaacatccgagaatgagaaatcaaaacataagaatgggaacaaaaagatgggagattcaaaattggaagaatcggacgaagaaatgcatgatggggaaacaattgtggcatgtataa

SEQ ID NO: 57562 - DNA, 166 bp, Heterodera glycines
  Genomic contig location: Contig_ID=SeqID_26812; Location=458..623; Strand=+
  SCN-specific regions: Sequence locations=1-61,83-166
atgccaaagaaagacaaaacgaaagccaaagtaattaatgaagcaattaaagcaaatgacatttattctgtttcctctttatacggtctgaataaacaaatgtataaatgtgttcaaccaaatcacagtgaaaaggcaaaacaaatgccatcgttttgctcaagcg

SEQ ID NO: 57563 - DNA, 251 bp, Heterodera glycines
  Genomic contig location: Contig_ID=SeqID_26813; Location=47..297; Strand=-
  SCN-specific regions: Sequence locations=1-50,72-251
  Gene Ontology: Mol. function=intracellular transporter activity; Cellular component=extrinsic to membrane; Biological process=Golgi to endosome transport
atggtatttgaatcagttgtcgcggatcttcttaatcgctttttgggcacttatgtggacaatttaaatgcgtcccagctgaacattggcatttggggaggcgatgtaaaacttaatcatttggagatcaaagatacagcgcttgatgaattggatttgccggtcaagctgagttttggttatgttcaaagtttggtgcttaaaataccatggaaaaatttgtacgtcgagccgacaatcgtggagattag

SEQ ID NO: 57564 - DNA, 72 bp, Heterodera glycines
  Genomic contig location: Contig_ID=SeqID_26815; Location=448..519; Strand=-
  SCN-specific regions: Sequence locations=1-72
atgccttgccaaccaggaaaaggagaaaaaggcccgggggttccgatttgggtcccgacaagccaacaaatg

SEQ ID NO: 57565 - DNA, 284 bp, Heterodera glycines
  Genomic contig location: Contig_ID=SeqID_26817; Location=157..440; Strand=-
  SCN-specific regions: Sequence locations=1-284
atttcggactctaaattatactgatgcttttatttacaagatctgggatgctgatcagctcaagtcggtggaaaaatttgcattcgagcagcccatttccagctttcattggttcgttccgtgcgattgcaactcttcgcttatttccattgccacttcctcgtcaaatgtcgttttgttggacccgcggtatccatcgtttcgttccattcacattccgctcattcttcctaaagattgggtaacactgcacaacaaattcgctgtttgcagcaacgcatttg

SEQ ID NO: 57566 - DNA, 76 bp, Heterodera glycines; identical to SEQ ID NO: 51235
  Genomic contig location: Contig_ID=SeqID_26819; Location=1083..1158; Strand=+
  SCN-specific regions: Sequence locations=1-76

SEQ ID NO: 57567 - DNA, 456 bp, Heterodera glycines
  Genomic contig location: Contig_ID=SeqID_26820; Location=265..720; Strand=-
  SCN-specific regions: Sequence locations=1-397,419-456
atgaattctgaaaaatcagaaaaagctaattccatattattggaagctgcaaaaaaagagacagaaagagcatggcgggatgtagctgcgctaacggatgaagtaagcgattttgccaaatcttctcgcgaaacacttaatcgtgcaataaaatctagagaaaaggctccttacgctaatggtattcgagaattatatcttaaaatgtccgattcaatttgggaaatcttcacaatcctggacaaaatcaatttggagtcagaaaaagccgaatctacgtggcgtgatttcgagagatgcaaaacttttgaccaggcaacaaagctcgaggaacaatcgcaaaattcattaatggaagcccgaagattacatttcgagtcccggagggtgcagagccaaatgttaaattatgaaaataggctccaaacaattgtttgggagcatatgggtatataa

SEQ ID NO: 57568 - DNA, 296 bp, Heterodera glycines
  Genomic contig location: Contig_ID=SeqID_58; Location=4564..4859; Strand=-
  SCN-specific regions: Sequence locations=1-9,34-190,212-296
atgggttagttattataaaattttttatattatctttcatttgtaaggattaaaaaaaatcagccgaataaacattttaaaaatctatatatctacagtcagggaaaaaaaatgtgcaagccctgcctatataacaaatatgctcattgtaaatgtcaaaaaacgcacagcacatgcagggctgttgaacaatgtaaaaataaaggaaaacgttgaatctatgctctggctttgtgctagctagacagctgtaagaaaattaaaaaactagaaagaaagagatagtgaaaaataaa

SEQ ID NO: 57569 - DNA, 680 bp, Heterodera glycines
  Genomic contig location: Contig_ID=SeqID_616; Location=138..817; Strand=+
  SCN-specific regions: Sequence locations=1-101,129-270,292-542,564-680
atggactacggcagcggccagagtgcacttcaattggtctacaggcagcaagatctggttcagcgctacgacacgcgcattttatacatggtaagagtgtgcaattaaaatgttcataataaaatattcgtttttcaggacaccgacagtatcttctatgacttcaagactgcactgggagacccgctgaagggtggcaaccagcttggggagctcgcggacgagtaccccaaccataccatcgtcgagttcatctgtggtaaggactttgtccaaaataatttgaataaatttctaatcggttttcagctggacccaaggcctacgccctttggcttcggaacaacgcaaccggcgaggacgagtacaagctgaagctgcgaggcatcacgctggactcgaacgcctgcacccgcatcaactttgagaagatgaaagaaatggtgctggagaagtggggcacgcccggcaaccatgtgcggttcgactaccctacgaagaacttccgcatcacgaagcagggcgacattctaactgtgccaatcaccaagcagttcaaccccaccgtgaataagggggtgctccgggaccgtggacttaaggttgtcccctttgggtatagctcatgggagtactgtaaggcccataaccccaacgaatgtcgctgtaagaaagaataa

SEQ ID NO: 57570 - DNA, 735 bp, Heterodera glycines
  Genomic contig location: Contig_ID=SeqID_616; Location=836..1570; Strand=-
  SCN-specific regions: Sequence locations=1-625,647-735
atgccaaaacttccggaaacactgtacacggaccgagggctggagtttgtggccaaacccatgcaggagttcttcgcagaaaatggcattaagaagtatgagaccagctcaaagaagaaggctgccgtcgcagagagagctattcgcacgctgaagactcggctgtacaaatatttctctgccaagaatacctctgcgtgggtggatgtcttgcccaagtttttgtctgcgatcaataactctgtgtgccgtgcgacgggacttaggcctaacgaaatcagtgacgtcaatgcgagggaggtgtggaagagggtctatggcgaaggtcttgtaccagcggaaaaaagaccaaagatcaaagcgggggaaacggtcagaatcccagagcccaagcacatattcgagaaaggtacagagactcctccattttttttctgtatttttatttgtgcttaaggttatattcccaactactctgaccatgtgtacaccgttgatgaggctcggtcaaccaacccccagcactatttgctcaaggactattatggcacaaagttgaagagaaaattttatttgccagagttaacaaaagtacaaattgatgaaaacacaatgtataggatcgagaaaaagtacaaagaacgaatgagggatggaaaaaaggaaatattggtgaaattcattggttttccagaaaaaaaatattgggtcacagatgaggattttgaaaaataa

SEQ ID NO: 57571 - DNA, 1817 bp, Heterodera glycines
  Genomic contig location: Contig_ID=SeqID_617; Location=207..2023; Strand=+
  SCN-specific regions: Sequence locations=1-825,847-871,897-1178,1200 -1363,1385-1428,1461-1675,1697-1720,1742-1817
atgagttcgccaatattggatataattcaagggctagtcaatcgattagaggttgagttaaccaaagaaattccgataaatcctggtcaaaatgccaccccaaatacaatccaaagacatttgtacagagcaaaaaatgcttgtgatgagttaagcgaaattttggaagaaattcagagaaagcgcgtagaaatggcagaaagtttgcaaaaaattgcagttgcagcgcgcgaaaataaggaaagagtttatgtagacttttgtacgcatcttgacattgaggcaaaaattaatcgagcagtaattaagaaaaatgaatggcaaaacaaaaaagaacaattggaagatatttttgacataaaccctcaaaattcgctaaatagcacaattcttactccaagaaatcagcccatcaaaagagtgaaaattccacaaatacaattgaaaaaatttgatgggtcagttgaaaaatggataccattttgggagacattcagagtacatgtccacgaggatgattcggttaccaaaattgaaaagcataatttattagagtcaaatttagaaggggaagctaaggagctaattgagggaataccaatttcggaagatggttatcaaattgcaattgatttacttttggaaaaatacggtaaaagtaccaaactaataagggcactcaatcaagaaattaatttattcccaccaagcacgagtcataaagaagtaaatcacaacaaatatgagtcagaggcaacaatgaattttgcagtaaaatttagagaggaatggaaaaaagtacaaaacgaacaaaaacacaaaaattttggaagcaaaaacgatcaaagacggaggtttagctcctccccagaatattcagtggatcataaaaattctcaaaattcaaataatcaaagattttcgagaccacaaaacagatgggaaagagggaagaaaaaagggtccccatacccaaacaaatttcgttcaagctcaaatagctcaaattattccaacggctcaaattattcaaataagagtcctcctaaatttccacgtcatttttgtgaacaaattcactcaccagtattttgcaaaacatatcagacagctgagaaaagaaaggaacaagcaataaagaaaaaattgtgtttaagatgtttaagaaggggtcattttgccaaagaatgcttttcaaaaaagagaaattgcttattttgcaaaagcgcaaatcatcactcggctttatgccgatggtcaaaaatgaatgattcaagcccaaaacgaaaagattttgttaatgcaagtacaaaagaagtaaatgatgaagttttggcttcaaaaataattgaaagtattaatgcagcatcatgcttaattacccaaccaaataaaatatcagtgttaaaatgtcgatatgtcacaatttataatccattaaataaaaaacttagaaaaagggttttagcatttttcgacgatggcagtcaaaaaacttatattgaagaagaattagcaagaagccttaaattaacagtgattggaagacaaaaattagaactttctggtttaggtggagcaaatttgggaaaattcgaaagcccagtagttgaatttggcttaaaagcgagagattttaatatgttaatgattggaagagcaattaaaaaagtcttaaaagaaattcccgttttggactatcaggaaataaataatgatgaattaaagaaaaacaatatttcagttccatatttactcgatgaaccaaaaattaccatcgggaagcgatttttacaattattttgacattcgaccca

SEQ ID NO: 57572 - DNA, 2317 bp, Heterodera glycines
  Genomic contig location: Contig_ID=SeqID_618; Location=49..2365; Strand=+
  SCN-specific regions: Sequence locations=1-229,251-732,754-848,870 -1070,1092-1144,1166-1349,1380-1523,1545-1608,1630-1682,1705 -1792,1814-1899,1922-2118,2140-2317
atgattaaaaatatttctttcaatggcaaaaggtaccaatcaaaattactttggatagaagaagaagccgaaaaattgcccacaaattttgcaatggcttacagtcaattaaaatcaaatttgaaacggttacgcacaaacccaaaattactccaattatatcataacacaattttggaacagattaatgaccaaggatcagtggaaataactaatccgttggtggacccaaaccaaaaaggacaaaaaattcattatttaccccatcatggcgtagtgaaagaaactagtgaacacactaaattaaggattgtttacaatgcaagtgctaaaagcggtaaaaacccagctttaaatgaatgcatagaaaagggcacgaatgaatacaatgatttaaccggtattcaattacgcacgaggttaaaaaatatattgattggctctgatattgctaaagcatttcatcaaattgaattagcacctgaagaccgaaattgtgtacgttttttgtgggtggaagatccattcgacccaaacagtccattaattcattaccgttttaaaagagtgacttttggtgtcatttgtagccctgcccaattggcattaaccattaaattgcatttagaaaaatataaccaccccattattaagcaattggctcaaaatatttacgttgataatttactagtgggaattaaccataaaaaagattttcaaatggtttacgaattgattaaaaaggtgtttgctaaagcaggtatgaatgtgcgtgagtttgtgtcgaatgaattaagtgagcttcaaaaactcccaaaggaagaccgaatcgaaaaagaaactgtcaaattgttgggaatttggtggaatgtaaaaaatgacgaatattttataaaaatgccaaaattcgaaccaaataatgctgtaacaagaagaaaagtactatctcaaatagctaaaacatttgatccatgtgggatgacatctccaataatcttagctgctaaactttttcgtcaagaaatcgaaaatggaaaaaacctaaaatgggacagtaaattatccgattcagaagaacaaaaatggaaagaactcatgcttacatgggaaaataaagagatcaaatatccacgaaaattatttcaaaataatctttcagaacatactaaatttcaattacacgcttttactgatgcgtgttcaaaagcctttggcgcagcaatttatcttcgaattgaaaatgaccaacaaatttattgtaatttagtttttgctaaaagcttagtggtgcctgctaatatgccaaaaggcaaaaggacaattccaaatttagaattacatgcaacaatgctatgtggaaaatatttaaattttgtaaaaatcgaattcgaaaaagaaattaagattcaaaattgcactatttggtctgattcaaccgacgttctcgattttgtaagaagtgaacgcaaatttgacaaattcattagaaatagggtacaaaatataaaaaaatggcatttgaaacatattaatggcaaaaataatccagctgatttagcgtcaagaggaacatcagtggaagaattacaaaaaagtgaaatatggtggaaaggccccaattttctttcagaaagtgaaaactcttggcccaaaacaatacgggaatatgacccaataaatccaccagaaataaaggaaaaacaaaatgttatttttgagataaattcagcaattaaagaaaaggatttttgtgaatttgaaaaatatttcgaaagattttcaaaatgggaccgtttaaaaaattcaattgcttatgcacttcgagcctttaaaaaagaggaccaaaagaaagtttcccaaaatatggaaaaaatttcggatatcaaaaataaaaaaaatggaaatgacataacaaaagaaattattaaattaatcaggcctttagaggctaaagaaatccttaaagctgaaaagctaattttcaaattaatccaaacaaattcgtctccaaccaaatctattataagaaatttggatttgttcaaagatgacgatgatttatggcgcacaaaaggaagaattttaaaaagtggtttaaattatgacactattaatccaattttcattccaaataattcatatattgcgactttattgattagagatgcacatttgaagacaatgcatggcggtcgcgaattggtgaatagcaaattgagagaaaatttttggattcctaaaagcagaaggaaaatttatgaaatattaaaaagaaaaaacaaataaaaatgcgggatttgtgcaaaatttacaaata

SEQ ID NO: 57573 - DNA, 950 bp, Heterodera glycines
  Genomic contig location: Contig_ID=SeqID_618; Location=2493..3442; Strand=+
  SCN-specific regions: Sequence locations=1-569,591-596,635-654,676 -908,945-950
atgttggggagcaatatttacatgtttaattgtaagagcaattcatttggagttagtttccgatgtaagtgccgaaaaatttcttttagcatttcggcgattcattaaaagaagaagagtgccaaaattaattatttccgataatggtacaaattttgtattagcaagtaaagcattaaaacaaatagcacttgaagaaaataaacaaaatagaatatggtcagaaatttatcgtgatcctatgatacaaaatttttcatcaaatttgggaattgattggcaatttaattcgccatatgcgagttggcgcgggggagcttacgagagaatgataggacttgttaagacacatttaattcggagtttaggaaaacggttattgagttttgaagaattaatgacatatttaatcgaagtcgagaggattgtaaacgaacgccctttaagctatataacccaagatgaagtgattgaaccattaaggccaatcgatatattaaatccgacggatggagaacctttctcattgaaattagatccgacatttgatcgggaagacataaatgaatattttgaaaagaaaactaaaagagaagaattatttgaaatttacaaaaaggcaatttttaaaagtgaaatattttggaaggaatggagtgaaaaatacttattatcgttaagagaaaagcacattaacaaaaataaagatggaaataaatacccaaaaatcggacaagtagtaatcgtgagagaccaggataattatccatgatcaatgtggaaattaggaaaaattttcgaaattctttctgatagaactgttaaattaaaaataggaaaccgaatggcggaaagacccacaaaattattatatcccttagaaatagaggatgaaggcgaagaatagctataattttagataatttaattaaatattatataatctatta

SEQ ID NO: 57574 - DNA, 5019 bp, Heterodera glycines
  Genomic contig location: Contig_ID=SeqID_618; Location=3556..8574; Strand=+
  SCN-specific regions: Sequence locations=1-217,240-360,382-612,634 -783,805-823,861-978,1003-1138,1160-1703,1726-1974,1996-2349,2374 -2384,2406-2454,2476-2700,2726-3210,3232-3321,3345-3405,3427 -3784,3807-4076,4099-4265,...
  SCN-specific regions: Sequence locations=...4289-4418,4440-4878,4905 -5019
atgagcgacagccaaagcagtgatgatgaactgatgtattcggcggatgagaatttcgagatgaaagtctcggttcaaagcagcaaaaataatgacaaaatttcggaagccaaaaaacattcaaattgccaaaaagatccgttggaggatccaccaaatttcgaaaatttattagataacagtccaaattgccaaaaagatccgttggaggatcaacaaaattttggaaaagattcgttggaggatcagcaaaatttgctgaaaaatccgttggaggatgaacaaaattttggaaaaaatccgttggaggaaaaaagtaaaaaattcaaaattcctgaggatttgttggtggattctcaaaaaccaaaaattcggaattatgtgccagaaaacattccaaaagtggtggcacggtcaattttggtttttattgtggataatcaagtggaaatcgaactgaggcaaataatgaggaagaaggaaatgaaggcgatggtttttcgaccgagaaagtgggacaaaaatacaattggcacagaaatcgaaattggcacgattactcaatgcatagtgatatggagagaaaccatggacgctgaactgttggcagttctaacaaaagttgaagaaatatgttacgaactgctatgcatttggattgtccccaaaggagtgccaattcatgttatgaagaaaaggtttccggcaattgttcgagtaccggaagaagaaaatatcaacaatttattaacgaagttggagcaaattggaatgccaattgagaaaaggggcgaacaaaaatggcacgagacagtggcaacaaacgcacagaaagtgaattggaaccaattggggaatggacgcagagagaaggccgcgggaagccattcccacaattcatttgtgccgccacatttttcatcatatttgccaacaactaccaaaatgttcttcccaactccggaaatgccgaaaaaaggtgaaaattttggaaaaatccaatcagaaaattttgatccctttgtggtattgggagtaaaacgaaagtctcaatctccagaatcaaattatgaatatgaagacatttttgaaggccctttgtgcacaaaacgaacaaaattttgggtaaactcaaaatgtgaaactacaaaaacagaaccgttggaggttaaaacatttttcaaaaacgaaaataaggaaatttatcagcctcattggaagccaattgttttaagttcaccttcaggcaaaaaaggagctttctttttcgggaaaaattttgttttttcaaattttcatccgtcttcttttatgatggatggctttaaatgggacaatgtggaacaaaaatactgctttgaaaaggcctcgtattttggctattttaatttggcaaaaaaaattaaattcaaagatggaattactgaaccaagtgaatttaaaaagattactgacaaagagatggaccaatataagtcctttgaagaaaatcccaaattttttgatcagtatgaatggaatagggttcgagaaaatgtcattcgcccaattttatgggcaaaattcacacaaaatgaaaaatttggtcaaatgttgttggaaactggaaaccttccactgtatgaggcctcagtcaattttagctggggcatcggaattgacattagagaaagacagctaattttttcaaacatggaccaaggatttaaaggcaaaaatatgtgcggtcgtctgttagaagacattcgcgaaaaacttaacccaatgaatacaggaaaccaaaaagggcaaacaaacccaaaaaatgaaaaagatttagaccaaattttgaaaaagattgaaaacgacaggaaaatctgtgttttcaaaactgaaagtattttgagacaatgtactcggattaaagaagttgtcaaagaaaattgggacatgaatgtatttatccaagggagcatatacaatggccttggaagaaaagaaagtgatttggatttagttatgataaactcaaaaggaataccgaatgattggacaaaagatgacagttgccaattttttgacaaattgcgaaaaaagttaagagattctggaatggcattaacccggactctgataatcccttcccgaaatgtctccattttggaaatcacaattaattctgatgaccaagaaataaatgctcaaattagttgcaataatttgattggattgattaattcgaaatggtggcatgttgtgtacagttggatgtacgatttaaaactttatattttgccattttggaatgggctgacttttttgaaattcaccaaagtgctaatggaggcggcactttaaattcttatggttggacatcacttttaattttttatttgatgaaaattcctaaccccgttttaccaaatttgatcaaaattttaccagaaatttttgaaattcgaaatgttacatacacaaagaaacaaatttttgaagtactgaaacaaaaacttatttgggagacaaccaattcccagagcatttcttcactattcattggattttttgaattttatacaaaaatcaatttagaagagagccggttgaatatgaaagaaggaaaaacgatttttgggagaaaagtactcaggaaatgaaaatgcatttattcattttagagccgtttggggctttcaatgtcgcaaggagtgtgacacaaaatggatttatcaaaattaaaaatgcatttcatgtaacttgggaaaaattaaaattcggtattcataatccaaaaaagctgttagaagcaataaaaggaaaggaaaatgacgaaattatcgaagaaaaattgaatttgaacagaattttaatatctgatcaggaattagtccaaggacaagaggcaaacacaccaatggacagtgcgagtaagtcaagaaaatgggttcttaattcacaaaaatatttcttcaacgctttaatgattatcaatataataaatttctgtgtagccacccaaccaatgatttgccataatagagcccaaacaaaattggtccaattcaaaagggatacctcttcgtgcggaaaaatcagtagatttcttgaacaacccacccgagctttaatgctagatttatttcggccaaacccagacaattttcaatttgaggcctggagatgcataaaaactagacaaacacaaaaatacagaactgatttatttgggtacaaaattgaagaaatccctgatcaaattcttttaccaaccacttttgaagattgtcatcaaatggcaatttacaaaaaatgtgagtttggtgttttgtcaggagaaattggccaaaaacacaccaacaaaaaattaatcattgaacaatcatggtggaaaattgggttccaaaaaaccgagtccgaaaattgttttttgtcaaaaatcactttgtttggaaccccagggtcagacataatacattcaccagcagatgatacaaagaattgtaaatactcagatggacaatgccagttagaaaatggtgtttatcttttatgggagattaagaaaaacattaaaaatctttttgatgaaaaaacttgtgtttataaaagggaagaaaaaatcaatggcacttatgtcccaggtatttggatgtcaaatgataacaatcgggctttagtttttgatcaaaattcaaaaaaggtagagtcatgtggtgaaagattgcgtgttagtgcgcaaggatttgcaataattgaggaacaatttaaggaattaatgaaaaatgagaaaaattcgtttgatcaaaacataagaaacaaaagaaaaagattcaaacgttggaatactcctttctcaagtgaaatagagaatactcccttggacggagaagttcgagcaagccaattggcaatgcaattacaagccggtgctttttaccaaaacaaagaaattaagtcctctttccataaattaattgaaatggtttgtaaaacattggatgataatattttcaatgggtattctcatttaaacccttcattgtttataagacaaaaaactggtcaaacttttttagaagggcattggatttccgatgaaattttggaattttggggttgttcggcaattaatttctcctttgtcccgtctttagatggaaaatgttatgaatttattccattaaatttttctttagaccataccgaaaaacttttgataggatttttggatccaataacaatgattgtcaaagaaaatagtaaaatccaaacatgcactgagggacaatttaaaacaattttactgaacaataagctcataaaaataaaccaattaacaggcaaatatacttttattggagaaccaactatttataacatcaatcaaaaaatatggggtgaggaaaatttgcctatttttccggtacaaattttcaaacaattaattttaactaatttaacaaacaaacaaattgacatgttggaaatgcttcatgcattccgtactagccgaattattgataatagaccaaatgaagaccgaaaaatttggaattcaaaccaatttcgagcatttacctttcaaaatttaatcactgaaattgattggtggaaatatgtaattcgatcagtcattttagtcgttataattaattgggtctataaaatttataaatggaaacaaaaaatgctgatcagaaaagaaattaataagaggaatagtcaaaactttcagcaacaaactggtgccattcaaattccactggccgccctgaaacaacgtttcgttgggggagtgtcggcgcccacgaccgacgaagccgagatgccagagaatgccgaaagaattaaatgccaaaaacggaagagacggagaaaataatttttgaacaaatttgcatttaattatttattaatttaaatttcatttcatttctctattttattattcatccatatctttcatcctttgcttttgcgatcactttataagtcgttggagacaagaagaaaataagcgatagggaatttcacagttta

SEQ ID NO: 57575 - DNA, 491 bp, Heterodera glycines
  Genomic contig location: Contig_ID=SeqID_618; Location=9099..9589; Strand=+
  SCN-specific regions: Sequence locations=1-491
atgagttcgccaatattggatataattcaagggctagtcaatcgattagaggttgagttaaccaaagaaattccgataaatcctggtcaaaatgccaccccaaatacaatccaaagacatttgtacagagcaaaaaatgcttgtgatgagttaagcgaaattttggaagaaattcagagaaagcgcgtagaaatggcagaaagtttgcaaaaaattgcagttgcagcgcgcgaaaataaggaaagagtttatgtagacttttgtacgcatcttgacattgaggcaaaaattaatcgagcagtaattaataaaaatgaatggcaaaacaaaaaagaacaattggaagatatttttgacataaaccctcaaaattcgctaaatagcacaattcttactccaagaatcagcccatcaaaagagtgaaaattccacaaatacaattgaaaaaatttgatgggtcagttgaaaaatggataccattttgggagaca

SEQ ID NO: 57576 - DNA, 712 bp, Heterodera glycines
  Genomic contig location: Contig_ID=SeqID_619; Location=293..1004; Strand=+
  SCN-specific regions: Sequence locations=1-422,449-649,671-673,696-712
atgttggaaatgcttcatgcattccgtactagccgaattattgacaatagaccaaatgaagaccgaaaaatttggaattcaaaccaatttcgagcatttacctttcaaaatttaatcactgaaattgattggtggaaatatgtaattcgatcagtcattttagtcgttataattaattgggtctacaaaatttataaatggaaacaaaaaatgctgatcagaaaagaaattaataagaggaatagtcaaaactttcagcaacaaactggtgccattcaaattccactggccgccctgaaacaacgtttcgttgggggagtgtcggcgcccacgaccgacgaagccgagatgccagagaatgccgaaagaattaaatgccaaaaacggaagagacggagaaaataatttttgaacaaatttgcatttaattatttattaatttaaatttcatttcatttctctattttattattcatccatatctttcatcctttgcttttgcgatcactttataagtcgttggagacaagaagaaaataagcgatagggaatttcacagtttaacaaaaagcggaaaatgtccgtgagcggaaaaaagggggaaagatggaaaaattaaaaatctgttctcattcgcttaactttttaatccgttcaacatcttctctctccgattaaaaattatttattaatttcgaattttcgcaccgta

SEQ ID NO: 57577 - DNA, 767 bp, Heterodera glycines
  Genomic contig location: Contig_ID=SeqID_619; Location=1575..2341; Strand=+
  SCN-specific regions: Sequence locations=1-496,533-535,576-767
atggcagaaagtttgcaaaaaattgcagttgctgcgcgcgaaaataaggaaagagtttatgtagacttttgtacgcatcttgacattgaggcaaaaattaatcgagcagtaattaagaaaaatgaatggcaaaacaaaaaagaacaattggaagatatttttgacataaaccctcaaaattcgctaaatagcacaattcttactccaagaaatcagcccatcaaaagagtgaaaattccacaaatacaattgaaaaaatttgatgggtcagttgaaaaatggataccattttgggagacattcagagtacatgtccacgaggatgattcggttaccaaaattgaaaaaaacataatttattagagtcaaatttagaaggggaagctaaggagctaattgagggaataccaatttcggaagatggttatcaaattgcaattgatttacttttggaaaaatacggtaaaagtaccaaactaataagggcactcaatcaagaaattaatttattcccacaaagtgacactgtggaagaagatgaaaaattgtacattaaatttgaaaaaatttgcagacaattgtcaagtttaaatcaagacatggatctatcccctcattatttatcgctagaagggaaattatcaactttagttctggacaagtattttgttataaaagatgccgaagataatcaaaattggaatactacaaaatttagaaatgctctatcgagagcaattgagcaaattaaaaaaggcaagaagtga

SEQ ID NO: 57578 - DNA, 650 bp, Heterodera glycines
  Genomic contig location: Contig_ID=SeqID_5287; Location=125..774; Strand=-
  SCN-specific regions: Sequence locations=1-100,122-130,152-234,256-650
atgggccgtgagcatcgttctgaccgcaaacgagactatgagaaagtttgtttcgccagttgttggctttttcaatttgtttaccactcaatgctttgttttttccatgtttggttccactaagttactcaaaaattagtttttgacatttgaatttgtgtctaatttttcgttgaactcttcccattgttttttaggagcacagtccgttggcggacgaatcgtcgagtggcagcagaaagaggacaaaaagggagaagaaccgaagtgtgagcccggcgcgttctcgttcccacacttacaggttcagtttttctactaaactctaaatttccctacattttgtctgtctccgtgttctgaccgactttatgaaaaatctgagtttggattatccgaatattggatgtcttacaacacatttggcaggcacttttgtagtttagtggtcccgataggaaaaaagccatatggatttttttacaatttaatttctgcagaaagagtggtcctccccctattctatcgggcccactggactataaaagtgtccacatttttcatcggtgtatatgccatgcaatttttaacactgaaatttccagtccgtcaccacgccgagaaatttcgccaaagcgccgcgctcgaag

SEQ ID NO: 57579 - DNA, 1385 bp, Heterodera glycines
  Genomic contig location: Contig_ID=SeqID_5288; Location=71..1455; Strand=+
  SCN-specific regions: Sequence locations=1-23,45-45,67-378,400 -1173,1196-1385
atgtcgcacaatccgaaggaagcaaagaaagaaatggaaaaagcgatgtgatattctaaatttgaatttccatggtaatcattttgcttttccttttcagcttcatcgctgccgactgttggctcaaagtgttcgatttgcttccacgctcacagcttggccttggaatttcgatgataagccgccgatttgactatttcgttgacgaacacttcaaaatccgcaaatggacatttgacaaattggaaattcgaagcaaaatcggagagaatggcgcaaaggaaatggaaattgtcaattccgatggaaaagaattgccaatcccacaaaattcgttgccgaacaaattcatcggattcggatgcattttgatcaagtgaaaattcaatttagaaatgatttgtaaccatttctggttttcagctacatcgaccaaaatgtgctcatttttctccgccgttttcaccgttttttcgccacatttgaaacaaaaattcacattggcactgtgaatgttcgcatttcgaagttcgctatgctcaccatttggccaatgttcaaggacaccattcgtgtgatgtatttcaattccatcactcttcgtcaaatgcgccaatttgctccgtcaatgctcaacgattcgccatcccttcgcgttgttgctttcgatgatggcatttcccccgaatttccgcctgacgacagtgccaatgcgacggatggccaagcggtggccaaatggctgttctcacctcgccatgacaatttgacgaaggcgctcagccttgaaaatttagcagtggagcaacaatggttggcaaccatggaacaaatcaaagcggtgattattacccattaattttctattttttttttgcctttaggcattttccgctgcttcttctcctgtcaatttcgtcatttctgttggcttttcgtcgtcctctccgattgattccgttgtgccatttgaactgaccaacgaattcactcaagagaaattgacactgtcaccggaattggttaacgtttataggcttactcgtcgttcaattgcagcagatgatgagggaaaatggatgaaggaaatgaatgaattgatgagaggacaaaagaacaacaaaattggcattttcatcggagacgacggaatcgataatgagtgaacatttaaaaatctgctaattttctcatttcattttgttttttttttattcagtcttctcgacgatttgccggggccgagtggtgatcattgatcagaaacagcaaaaaatgaattgattggatgattttgactgatgcgattatatgtgtcctaaatattgagatcattgttatttaaatgttgttgttgtatttgatttttgctcattcacaaatca

SEQ ID NO: 57580 - DNA, 963 bp, Heterodera glycines
  Genomic contig location: Contig_ID=SeqID_5289; Location=998..1960; Strand=+
  SCN-specific regions: Sequence locations=1-963
atgggcagattggaaattcgaggcaaaatcggagagaatggcgcaattgaaatggaaattgtcaattccgatggaaaagaattgccaattccgcaaaatccgttgccaaaaaaagtcatcggattcggaagcattgagatcgagtaaaaaatgaattgaatttgtacatgatttgtttccatcacattttctgattttcagcttcatcgaccaacatgtgctcacttttctcggccattttcatcggtttttctccgtttgttcgacaaagttgtacatttccactggaactgttcgcattgcggagttcgttgtgcttaccattttgccgatgttcaaggacaccattcgtctgttgtatttggacatcactgatcttcgtcatatgcgccaattggctccgtccattctcttcaattgtccgtctctccaagttgtcactacctttttcgattttttgcccgaatttccgcctgacgacagtgccaatgcgtcggatggccaagcgctgaccaaatggctgttcacgcctcatcccgacaatttgccaaaactgttttttgtccacatttgggaggatacggggaaacaatggtcgacaatcgtgggacaaatcaaagcggtgatttgttctaaatttgttttttcttattttttgtcttttaggcattttccgctgctgcttctcccgtttctttcaacattactgttgcctttatgccgttttatacgcttcctgatgttgtgccatttgaaatgaccaacgaattgactggggagaatttgaaaatgacaaaatcaattggaactgaggacgatgaagatatttttgagatcatccgttgttcagttgaagaagggagtgagcaaaaattggaaaaggcattgaatgaattggtttatggacgaaagaacaacaaaattgatttttccatcaaataccgcggagtcgacgaaaggtga

SEQ ID NO: 57581 - DNA, 845 bp, Heterodera glycines
  Genomic contig location: Contig_ID=SeqID_5290; Location=16..860; Strand=+
  SCN-specific regions: Sequence locations=1-283,305-380,402-416,438-845
atgtctgacaatccgaaagaagcggagaaagaaatggaaaaagcgatgtaacaattaatctaaattataatttccatgctaattatttgtttttttagctttatctccgccgactgttggcttgaagtgttcgatttgcttccgccctttcagcttggccttggcattgcgttgatcagtcgccgctttgactattacgtcgacgaacactttaaaactcgcaaatggacattggacaaaatggaaattcaaatcaatggagaaattggacagaatggtgcaatggaaatgaaaattgtcaatgccaatttggattcgctgccaatcccacaacatccgttgccgaaaaaagtcatcggattcagatcaattacgatccagtataaaatgatttgtgatttgatacacacattctgattttttgtttcagtttcttcgatcaaaatgtgatcacttttcttggccattttcaccgttttttcgccaaatgcgcaacaaatttgtcaattgagacagagaatgttcgtatttcgaagttcattatgctcaacatttggccaaagttcaataacaccattcgtctgatatattttcactccatcgcttttggtcaaatgcgccaattggccccgtcaatgctcaacgattgtccatcccttggaattgtcagtttccgtgacggaattttccccgaatttccgcctgatgacagtgccaatgcgtcggatggccaaatggtggcaaaatggctgttctcgccacgtcctgacaatttgccgaagtcactcagaattatgaattcattggttgaccaatggttggcaatcgttgagcaaattagatcg

SEQ ID NO: 57582 - DNA, 636 bp, Heterodera glycines
  Genomic contig location: Contig_ID=SeqID_26826; Location=26..661; Strand=-
  SCN-specific regions: Sequence locations=1-147,188-329,351-355,380 -431,553-605,627-636
  Gene Ontology: Biological process=EGF receptor signaling pathway
ttggccgccgctgctgccacactgttgctcaaccaacaaaacaatggggcctccaccaccatcgccggtggtcagcaccacctttaccaccaccatgacagtggcacttcgtcaaacagtagtagcagcttggtcgctgctgcccatcaccagcatcaacagcagcagttgctgttcgctgcacttgccgcgggggttggcggcggcgatcagaaaccatcagcgactgtactgcaccaattgttggcagcgagcggcgtcactggcggcgacttccagcaacagttggcaacactcgccgcgctcggaaacggcggtgccgacgccgcaaattcgctggccgccgttgcggcactccaacagcaacaacaacagcagctcgtccaacagttacttcagcaacagcatgcactgcttggtgctgccggtgctcataatggtggtggtggtggagcagcaaatgcggcggcacaacaccaacagcagcagcagcaacaattgttgtccgcgttggcggtcgcgcagcaacagcaacaacaccagcaacagcagttgagcaatggctatggtggtggtggtcatggcggacattcaacgtacggatttgaatatatttataggtgtaatcaaaattaa

SEQ ID NO: 57583 - DNA, 539 bp, Heterodera glycines
  Genomic contig location: Contig_ID=SeqID_26830; Location=147..685; Strand=+
  SCN-specific regions: Sequence locations=1-101,193-195,220-539
atgggccgcagaagtcaatgtgaagtcgctgccatggcttttctggcacttcccatgggtgtagagggttaaaatgattccaattttatttttatacttgcaaatttttttatatcttttaattatgttgttcttttatattttatttttttgtaatgaataaacatttttaaatgcttaatattaatatttcgataaacttttaattcattaaataaatcttttccccaatttcttatagaataaactttttgaaaaatttcatggctaatcctcgttttttttcttcgaagatgttgtatttatttgagaattaaaataattaatcatctttaaaattaatgagtttaggtttattgtatttttttgcaacaagcatctttcttttgattgttccattggtaatcattgggatttttattgatattgttagatcatcattttctatgttccattttattaaagaagcttgttaatttttggcatttttcagagctctcaattttctgaatatcattcttagaatttcatgattagaa

SEQ ID NO: 57584 - DNA, 1797 bp, Heterodera glycines
  Genomic contig location: Contig_ID=SeqID_5292; Location=140..1936; Strand=-
  SCN-specific regions: Sequence locations=1-150,172-354,377-510,532 -998,1020-1222,1249-1523,1548-1797
  Gene Ontology: Mol. function=damaged DNA binding; Biological process =mismatch repair
atggctttggttagcacaatgctttctgccgtttcaaaggaagcattgctgccaaaacgtcagtttttaagtgccgaaacaacactaacaacagtgagtgggtggcatttggtagtgccaaaaagggaataatggaagaaatgccaacaaaacaaataatttaaataataaggcaatttttttaagctttgcgatgacaattattttggtgcccatttggatgattggcctgagactgtccgtcaaatgttggcttcgcccgacgtggcaatccccgcgccctcagaatgtcacagactttgtttgtcctccttgggagccgttctttggttcgtttttttctttggattccactttcatttatactttttcattttcttgattttaggtaccttaagcattgccttgtagacgtggacactgtcaccatgcgtcgcttttccgcgtacattccgccgtacattgaaagcaaagaaattgtgaaaggagcgaaaaatggcatggaggacgaggcattctgggaaggaaaacatatgtgagtaaaaaggcaaaaatcttatcgggaagggtcacgagaatgctttttaggggaatgggaatgaaaagttcgttttcttggaattggcatttatcttcctaaattacataattagggtgttggacggcgtctctctctccaatttgcacattatcccttctctttccgtctccggcctttcctccgcttcttcgtcctttgctgcatcctctttccgaatgaataatgcaaatttttcgctgtataacactataaaccgatgccaaactccctttggaaaacgtttgcttcgacaatggatctgtgcgccgattagcgatcggaaatcgcttttgggcagacaaaagtctgtcgagtggcttttatccgacgaaaggcgtccaaatttgacaaaaatgaccgacttattgaggaaaattccggacttggaacgccttttccaaaggtaacatcacaaaagttttaatttaaaacattgaattttcagaattcacacaattggtcttaaataccggatggattcgagcaacggacacccggactctcgggcaaatctcttcgaagctgacaaatataacaaacgcaaaatcaaagatttgctcattgtcctcgatggtctggaagacactcggaaactaatgcttttattcgaagagataaactcgcagggcgaatcgaagttcgtttttaaaaatgaaaaattaatttattggtgtacttttttacgtattaatttcagtgcaccgcctcttttaaacgaatgtttgagtgccaattacaaagaaatggtggaagatttgggcttctttaaggtcattatttggtttggcattttaataacaaattggcaaaagcttttttttctcatttaagcgttgcctgttggaaatatttattggaaattttggcacagagcaaaaaaaaaacttcccccccccctcccctccgaattttctgcttgtgagactgattgtgagcactgcatcacttttcattttcagggtgcatttgaccgtgagaatgccctcgagcgtggcgttattttgcctcgacggggcgttgactcggaatacgacgggacatgtcgagaaattgaacattgcaaagaacagttggaggcgtatttgggctgggcaagcaaaaagttgaaatgcacgccgaaattcgtgggcacaggcagaaattcacaccaattggaaatccccgagtcggcatgtcacaatttgacggacgatttccaattcacgtcccaacgaaaa

SEQ ID NO: 57585 - DNA, 532 bp, Heterodera glycines
  Genomic contig location: Contig_ID=SeqID_5293; Location=295..826; Strand=-
  SCN-specific regions: Sequence locations=1-209,231-503,525-532
atggacatttgcgaattgattgccagcattgccttcgacactcatgtccagggacactctcttgctgcgtgtcacctttacgcattggcaaaggttagaaaaaacatttaatttactaatcacaataaaccgtttctgatttagtgtcacgaaaaagccataaaattggcaaattgccaactctccatgtgcgtgtccaatccaatggccaaagaaacttgtgagatggtcgaatgtgccaaatggttggcccaacaattcggacaaccaaacatgaacgaagagaatgcttccttttccacgctgatcctccttttaaaattgcacaattttttccgattggctgtagaagaaagacacggagaagccatagaactgatgaaatccgaaaaaatgtatggaaccggacgatgtgcaacccaatgtcagccaattccacgaagtgccaattgaggtgaacccaaagacatcaatcccgtaaattgtttcttgttttttatccgtaattttttgtattcatttgacgattaaa

SEQ ID NO: 57586 - DNA, 1865 bp, Heterodera glycines
  Genomic contig location: Contig_ID=SeqID_5294; Location=605..2469; Strand=-
  SCN-specific regions: Sequence locations=1-48,71-308,345-459,503 -1314,1338-1592,1614-1865
atggagatcagctcgcggcacattccaaccatttggttcaccagtcccaacattgcggaagcccatggaggcgcatcggtaagatgctccatgtggaattgttcaattgctgaggcggaattgtccaattggtgcacaattcgctgttttttggagttaattggggggatagtgacggagggtctgcggcgggaaattgaatttagattttgcatttagggcttaattggacaattacttatcaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaacccaggcgaaaaattatgaaaggtagaaagtttaaccactacaccacatgtgcatgttaaaaaaaaaaaaaaaaatttggaacgcttcacgaatttgcgtgtcatccatgcgccgctgctttgttggacgctggtttagacgatgtattcagacgcagtgaagagatttggtcgagaaaacagtcactgcggccgacggccgtcggaatgggcgcttcgctaaagaccaaccaggacttagttggtggaactgttcattcactgtttaaagattaattcaaaataatcattcagagtcagctttcatccacccgtctccccatatcaaaaattgccgaaaagcctccgtcggctgatgcttctgaccgttacgaggatataaacactgatgttttgaatgaacgatttacggatgcagaaacaaacaaatttgtgcaacgtacgattgaacgagctcagattgaggcggagcggaccttcctcaaccagcaaattttggagcgacgctttgcacccggggaaagtttgtttggccccgtgaacaaaagggcaatgggctcggcacaaccggacagaacagcaagtggtggaataaagcgtttcataaatcttccgaatgcgccactgtcccacgaacagagcgtatttgcacaaaaggttaatgaccattcatcccattgtaattctttctcgtaaattgtcaggttaacgaaacccttacatccaacgcctcggctttaattctacttgccgtgaaagaatcactgagcaatttgaaatcgaaggaagccgattatatttggtctaaagcttgggccatgtttccgtcatcaattggtgaaaattggcacgagaaaagatcgtcacataattggatgggacatataatcgacaatagcaccaaatttctgcaaaatgagtgagcatatattttttattattgtttcattgataacatttcatccgctgtttagatttatttctcacaccgaagccaccatcgaagcgaatttggaaaaggcacgccgtggaggcattcccggcactttgtcaaggattcttgcttatttgaacgtgaaaatgccttcccgtgacccattcgaggttcaattcgttgtcattttcatttttccaaatttccattggataggacggactgttcgaacgataccctatttggacattgctattctattgccttcgtgtgggcgacatggctgaggctggccgagttgccaaggaggccaaagagttgtcaaacaatccgcactgtgcatcgcttgtcgggattctgaaaactttgccgaaatcgtatttttaggaacctttgcccaaaaaacgaattctctttagcgatttgttaaacgacgagcgacgcctgaaattgcgcgcggaatggaacgcccagaattgccaagacatgcacaaaaaggccatctacggactgtttctcggctttgactgtcctgaaataaa

SEQ ID NO: 57587 - DNA, 419 bp, Heterodera glycines
  Genomic contig location: Contig_ID=SeqID_26832; Location=226..644; Strand=-
  SCN-specific regions: Sequence locations=1-114,160-336,371-378,401-419
atgaaagaaaaaatcgaagagtttgctgatcctgatttgtatgcgaatgtggtaatcttacatacatggatgttctttaaaaaagcgaccgtaattacatacggtataaaagacaaatatatttaatttattattttaaaagacaaatattttttaattcccgtgagatttctaggctacacgtggacttatgtgcgtgcggtccaaacccaacaaggaatgaatagtttggttaacccgccagttacagatgccgaagcatttcacacacatcttttcctttgaagatgcgacccaatatgcaaagcaaatttttttttaattggtgctttaaataatcatcatgaaaaatttcatttttatttttaatgccattttaatggcataacaccaaatttaaataatttcatattaataaa

SEQ ID NO: 57588 - DNA, 72 bp, Heterodera glycines
  Genomic contig location: Contig_ID=SeqID_26833; Location=1063..1134; Strand=-
  SCN-specific regions: Sequence locations=1-72
gacgaacactcatcactagtcatgcccaaaaattgtgtgcataaactgacaattaaaaaaagagaattgtaa

SEQ ID NO: 57589 - DNA, 411 bp, Heterodera glycines
  Genomic contig location: Contig_ID=SeqID_26836; Location=222..632; Strand=+
  SCN-specific regions: Sequence locations=1-141,179-268,292-357,379-411
atgggcggttccctgtatgtttacgcagtcttacggtaatttatatggatgctgatgaccgggtgttcaatcggctcccggtcatttggacagggtaagtcattcgggcagaagcggacaattggacagtggacattacgacagtgaatgaatttatttttactttttaatggttttagcggtgtcatggcaattcgtacaaaggcttagactaaatttaggcttaagcctaggcttaggcttacttgagcttaggccaaagcttaggctttattttgtaaactttttattgtatgaattgctattgacccggttttagcaatgaaaaaacaatttgttttttttaatttcttgggacatttggtaattcctccagacaaattactcaaattcataagcgcataaatagca

SEQ ID NO: 57590 - DNA, 707 bp, Heterodera glycines
  Genomic contig location: Contig_ID=SeqID_26837; Location=99..805; Strand=-
  SCN-specific regions: Sequence locations=1-161,375-451,475-624,646-707
atgattcaatcagctccaggcgatatttttgatgagatatgggacaaatttcaaccaaataaagttttttaaagttttatcattttcctattttttccatttattttagggcctttcgaatgaaaatcactccaaagagcaaaaaccatctaatctgttacaaattaaagaagaaaaaacggaattaaatccaaatgaaatgatttggaataaaggaattgaaataaaaaccgaaccaaaaaaagaggacgaagaaattggagtaaaaattgagccaaaaatcgaaaaagaaaaagaaaatgaagaaatgggaccaaaaatgagaaaaaaaagttggaaaataaatggaaaagttcataaaattaaaataaaaaattaatttattcgatatttatttaaaatcggattaataaaccaattttagagaataaagctcacacgacagaagaaaaactgcaaattcttagaaaatttatgacaagaaaaattgaatgtgcggaaattccaagtgaaaattcggtttatgaaatggaagaaaaaatagcaaaagaattgggcgtttgccgagcttcgattaacaaatggaaaaaagaattgggcctatcagcaggtattaatgataagaacattttgtgatttttaaaatgcatataaatgtttggcacttaaataggccatgttaatttttggaaaaaaaaaaaattaaa

SEQ ID NO: 57591 - DNA, 539 bp, Heterodera glycines
  Genomic contig location: Contig_ID=SeqID_5296; Location=403..941; Strand=+
  SCN-specific regions: Sequence locations=1-202,224-359,381-382,407 -407,450-539
atgaatccgatcacttttttgtctgcggtttgctgcttcctttttctggccaaccatttccaaagtgtcgctgctgcttcaacgaacgtgttcgttcagggaaaaaaaagctacacaattaacttgattcttgatgatagggaaggtggttatatacaacaaataacaacaaaaaaagtcaacggaaaacaatgtctgacgcttaatcaaaacctttggaaaacgtaccaagacgatgatgtgattgcattccgtcatggatcgacggacgtaattcaaacaaatcaataaataaaaaaaattcgtattgtggtttggcgaaatgaaaattttccggcctgtctcgtctcgcttacacatttatttttaaaccttaatcttattcaatattctaagattttttcttcttttttttttgttaatttttcaaaaataatataaatatttttcattttcaggcgctgattggtagcatcactgtcaagttattgcgtgcggacacttcaatagacatttctgctgataatactcatctctag

SEQ ID NO: 57592 - DNA, 1297 bp, Heterodera glycines
  Genomic contig location: Contig_ID=SeqID_5297; Location=44..1340; Strand=-
  SCN-specific regions: Sequence locations=1-137,167-209,261-680,705 -808,837-932,954-1186,1239-1241,1293-1297
  Gene Ontology: Mol. function=sodium-dependent phosphate transporter activity; Cellular component=integral to membrane; Biological process=anion transport
atgggttttgcctcagcgataccatatgtcgtctattttgcggtgatcaatctcggcggtcatgtaagttatgctgtattcacttattaaagattatccgtataatcattaggtttgatcagaatcatatcaagttgataatttattaaattttaaaatattaaatgccattgaatcgggcgaatccatttcatattactaaaaatgagtaaatatttcaaaaataattttatttttatttattcacaaaaaaattttttgtgacgatgccatctatcaatttttcaatgcagctgtccgattcattgctacaacgtcagctgctctcaacgctgaactgtcgacggttggcaatggcattggcactcggtggccaagcatttttcctgctgctgatcagcttttgcccttgcggctatgataaattggtgatcacgcttctgacgctgtccattggcatttccggatttcaggcaaagggccaaagatataaaatttcaaaaaattgcatttacagtattctggctttgtgataaactacctagacattgcacctgagttggccggcctactgcttggacttggaaacaccctctcctgtttggccggctttcttggcccaattctgatgggatggctaacgccaaccgtaagaatttttaaaatgtaatcactacgccaagaaatatatatttttaaattcttctcgaataaacaatttattgtggaattttgagaatctgtttagatattaacattagaaatgggttcaattaaattggaaaattgagtctgaaactcgagtaacaaaattttttcctgaaaatttcttgaatttttccattatttagggctccaagacggaatggttgaccgtatttggcatcactgaactgattttggtgcttggtgctttggcatttgctgtgttggccagtgccgatgtgcagccatgggccaagcgggaacagacggacgatgaggaggaggaagtgatcagcggagggacaaaaactgatcagcatatgactgatcaggatcaaatgatgatcaataatagcaggaaattgccggaacaattgctgttgttggaggatggcactgatcagcagcagaatgccaaggacaaaatttaaacacacatttttgaattgatcagacccgaacgctatacacaattttggaacaaaacgggaggattttgaaaaactaatttttaaaaaacaaacttaattattccataaatttttgattatttttatatgcacaaattgtacaattaaatttatgaaataaa

SEQ ID NO: 57593 - DNA, 689 bp, Heterodera glycines
  misc_feature (640)..(640): n is a, c, g, or t
  misc_feature (676)..(676): n is a, c, g, or t
  misc_feature (687)..(687): n is a, c, g, or t
  misc_feature (689)..(689): n is a, c, g, or t
  Genomic contig location: Contig_ID=SeqID_5298; Location=48..736; Strand=-
  SCN-specific regions: Sequence locations=1-689
cgctgcttctctccaaacggttcagcttggcactgatctgttttgcgggctgcgcactttgctatgcgctgcgctcaaatttgtcatttgccatcgtttgtatggtcaaggagggatcgcctacggtggacgacaatggcacaacaaaaaagggatgcggtgccgcgcatgcgacaacggagcaacaacgacaactgcccattaatgaaagtgatatggccattagcaggttcaggaggcagactaatcgatcggtaatcgctacaataaattatccataatcatttaattgctcaaatttttaacgatgaaaatatttttgatcttagcctaaaaaaattagtcgagagtcaactccgagaataattcttgggtcaagaaaaaaaaaagtcacatgatcttggatacatccttgagatcaacttttggcctcagcttagcatgaaataacgagaattgattgtgacaaggtctcggattaagggataaataattattttgaaagcatttttgccgtttccaagacacggtaaaaattataagctcgggatcatataactgatgttaatatcttgtcagttcaggctcttattggtcatcatgatgctgatgttgaacaatatcttccggtcccacttgngcctggtgaatttgattggtccaagcaaagtcgagngcaagtgcttngn

SEQ ID NO: 57594 - DNA, 64 bp, Heterodera glycines
  Genomic contig location: Contig_ID=SeqID_5298; Location=1459..1522; Strand=+
  SCN-specific regions: Sequence locations=1-64
tagagaccgacttttgaggcatatgcctttttttctgcgcactagtttcgatatattaagcata

SEQ ID NO: 57595 - DNA, 843 bp, Heterodera glycines
  Genomic contig location: Contig_ID=SeqID_26842; Location=1..843; Strand=-
  SCN-specific regions: Sequence locations=1-510,536-843
  Gene Ontology: Mol. function=protein C-terminus binding; Cellular component=microtubule; Biological process=regulation of cell cycle
gaccaaatgccggtggtgaatgtgtactcgacttcggtgaccagcgacaacatttcgcgcaacgatcttttgtcatgggtcaacgactgtctccaagtgagaaacattgacatttgaaatgcgacggcaaattcgaattgagaggcctccgtttgccatttcagtccagcctgaccaaaatcgaagagatggccacgggcgcggcctattgccaactgacggactttctcttcccgacccaagtgccgctcaaaaaagtgaaatggaacagccgatcggacgtcgattgggtgcacaattggcgcgtgttgcagcaatcgtggaaaaccatcggaattgacaaagtttgaatcaaaatgcaacatttggagttaatttgcaggggaggaccaattcatttgggaagttggaaaattggggtgaggggatgccaaaacgaataaaagaattcaaacggatgtcaaatcccattgcatttcagcctgtgcccgtgcagagtcttatccgggccaagtttcaggacaactttgagtttttgcaatggtcagtctcgttcccattcattcgatcgttccttttccctttaggttcaaaaagttcttcgacgcaaattacgatggtcataaatacgactctttggcggcacggaatttcgaagtccgttttgagggatttgggctcaaatgctttaaaatcacttttccattgtcacttcacacacaaagatgggtctcggaaatatattttttatccctaaaatccgtaccattttttctgctcatgtccatccccctttttttcattcatttatttccaatttcttaggagttccccgccgttttg

SEQ ID NO: 57596 - DNA, 752 bp, Heterodera glycines
  Genomic contig location: Contig_ID=SeqID_26850; Location=27..778; Strand=-
  SCN-specific regions: Sequence locations=1-53,77-197,220-308,358 -430,453-534,574-639,662-752
ttaaaaacgcagaaaaattgagcatttatatatcgcagttatccgcgaagcatggacaaaatgccaatgccaatcagcaaagttccgctggattgtcttcagaaacaagcagtgaggaagaacatgatgtggtatctgctgatctggttctgttattaaatctgatgaggctaccagtcgaatgtgttcatccgggagagaaaaattggtggaaaaattattgggcagtaattgcggacattctctccatttggacagaaatgccagaaattgtgttcctttcagtggtaagcaatggcaaaatgtacttaattatatttttaaaaaattccaaaattttgaaagaatttattttccacaagaaactgatccatgccaaaactcattcaaatcaatcatagactgattccaatcttaaatttatatccacttttgggtgattcccctgtttatatttatgtattgaaatggggcagacttttgaatagcaaaaataaagaaattgttgagtgaatagttttatgagtatttgtgtattttaatttaataaatttttaacaaaaataaataaaacccattttttatcaaaaagatttcaataaatcgtaaatatattttgaacaattcaaaattttcaccaattttaattaatttttttttagaatatgctaaacattgatgcggaaaagcgaatgactgcccaaggggcggttgattatttggaggggaaatgtaagcaaagaggaatatga

SEQ ID NO: 57597 - DNA, 811 bp, Heterodera glycines
  Genomic contig location: Contig_ID=SeqID_26851; Location=29..839; Strand=+
  SCN-specific regions: Sequence locations=1-192,216-811
taattaaatcccccccctcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaatttagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaac

SEQ ID NO: 57598 - DNA, 1482 bp, Heterodera glycines
  Genomic contig location: Contig_ID=SeqID_5299; Location=17..1498; Strand=+
  SCN-specific regions: Sequence locations=1-600,636-928,951-974,1054 -1136,1252-1482
atggacgaaattcgcgcagagattggaaagggagggaattcggtgaagaaaacttacaaaatgtggcacaaattggccaatttgttcaacaaaattcccatttcgaagtcgcagcaaaaaattggcataatttacgacaaatttggccaaacgaagacggaatttttgtggaaagcgaaagaccaaatgatggaagaacacgcgaaaaatgtggccaaattggcaggggacggacagaacgaacttagccgaactttggccaattcaattggccaaatgagaggggccaaacatcggctcaaaagctttttcacctccaaattcaaaggcaccgaaattttggaaaaattaatgggagaagacgcgaattttgcggcagtgtttcgttcaggtgaaagtttaaaaaaattttaaaatgtttttgttaatttgtctcgttcccatttttcatagatttaacttcaaacgaaataaaggaattacaaataaaattttacctaaaatttttggacagtgaaagcgaaacggacgattatttgagagcaaaattaattgtggacaatttggcattttatcaatggtaaataaaaccattggccgttaatttttatttgttttttaatttttcaattttaggttcaaaaataggcgacaaaaactgccaaagaatggacagtcccttctcgagcagcacctcctccaaatcgaacttcgcttggattccatcgccgaaatcgaaacttcggagggaacggaattggcacacgaagcgaaaatgatggcactgaaaatgtcaaaagacaaacttttcccagaagaaaacccaacggaagtgaaaacatttggcaaaagtatgaaaaatgaggcaaacaatgtgaagaagactctgttgatgatggaaatgcattgtaaaatcatcgaagaatttgcggaaaatgagcagaaatttatggacggagttaaaagtggggaaaaactaattaattaataaacttattagtgtgatttaattattaaataattagtttctaattaattaattgtaattaattattagtgattgatttagaaattgttcttgacagtcaacgtttgcacaaaatgataccacgactgagcaaaacatgccaacttttgaaggaaaatgccaaaggggagacaaacggaagaaagaaaagcaatgggaaaaatgagacggaaaagcgggcggaagcagaaaaaggagaagcaaacggacaaaggggcggagaatgcgtcgcttcggacggtaagggaaaactaatgggcaattagtgttaattatcattaattgcttttgccatttgccattgatcactgaagaggaatccgacctgatcagctgctatcgccatttaatgtgtgctgatcagccaatttcgaaatctgacaaaacatttttaatggtcaattcgctttttttccatctgaaattagtgataaacgaacttttattagtcacaa

SEQ ID NO: 57599 - DNA, 388 bp, Heterodera glycines; identical to SEQ ID NO: 51536
  Genomic contig location: Contig_ID=SeqID_26852; Location=278..665; Strand=-
  SCN-specific regions: Sequence locations=1-20,42-275,297-388

SEQ ID NO: 57600 - DNA, 65 bp, Heterodera glycines
  Genomic contig location: Contig_ID=SeqID_26855; Location=27..91; Strand=+
  SCN-specific regions: Sequence locations=1-65
cattactggagttagcatcatagcagtgcttttccttgtctttttgatgccctcgcaaaatctgg

SEQ ID NO: 57601 - DNA, 436 bp, Heterodera glycines
  Genomic contig location: Contig_ID=SeqID_26855; Location=435..870; Strand=+
  SCN-specific regions: Sequence locations=1-56,83-163,210-210,236 -391,418-436
ggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaa

SEQ ID NO: 57602 - DNA, 288 bp, Heterodera glycines
  Genomic contig location: Contig_ID=SeqID_26856; Location=187..474; Strand=-
  SCN-specific regions: Sequence locations=1-119,145-288
atgaaatggatggcctcgcaatggaacactttgatagccggagggcattggttgtggctggacgaagtgaaaatggaggaggatgaagaaatcgaggacgtctcagtggtggtgccatgggcagaggaggcggaggaggaagagcagttcccaatgttttttaccggccttttacgcatccactgaaaaattttaaaaatggtttttttttaatttttagggcttatagaataccaaatctttgacatcatgacaaaatacccaaggaaatgtacctcataaaataaa

SEQ ID NO: 57603 - DNA, 335 bp, Heterodera glycines
  Genomic contig location: Contig_ID=SeqID_26857; Location=666..1000; Strand=+
  SCN-specific regions: Sequence locations=1-217,239-300,322-335
atgttcactctttacatttcaatcatcaacattagcactgtcatttgcaaagaaatagccattaaggtcagcgaaactccaaagtaggaaaactcgttttgttattttacaaccaaattcagcttaggtcgacattcaaactcagaatcagcgcgtctctctcggagaattggccttcgccggaattgcccttgagccgaaccaacaaattggccaaatttttaaacatgacatccgggaactaggccaacacatgtgagttttgttttgttttttactagatcgttcataacctaaatatcttgttttgttttttaatttcaaaaaaaaaatca

SEQ ID NO: 57604 - DNA, 981 bp, Heterodera glycines
  Genomic contig location: Contig_ID=SeqID_26858; Location=585..1565; Strand=-
  SCN-specific regions: Sequence locations=1-277,305-350,372-378,400 -421,446-576,609-890,912-981
tggctcaacaacgccgtcaacaaaaattgcgggttgccttcaaaaaaggagaacaaaatttacgagagggcacaacaactgatggaagaagtggaaagcaaacgaagcacaaacaacggcgaggattttacgatgtctcgggagtataaaaagtgtaaaccggtaaaaacaaaagatcattcaaaaaatttgtaaatatagaaaaacaagattaaaaattttttagaacatttatagtgtattagggtattatttttgctcgattcataagtgtgttcttttaccatttccattgctttttatttgcgcagttaaaaattaactgcgcaaaattccaatttaatcggaacatatgaaaaaactaaaatttggcgtaattaaaacttattttaaaaatttgtagtccttgaaatgaatattgaatttaattttaattaatattttacctttcaacagatgttttggtacgacttacagctgttaggccatttcaagcagcggaaaaaaggattgtctccattaaaaatggtaaatttaatataaattattgtaacaaaacaaaatactaaagaggccatttttatcaaaaaaaaaaaattaaaaattaagtttcaaaaatttccgcctgcttttaaataaaaaaaaacacgtaaatcgcgccgataagggataaactcaattggtttttcttatcctcaatgtttttagctttatcaaaggtcggcttctccaatttcacttctgtcgaagcgctcaaaaaaatcttttcaaaattgttttttaccagtgacattgagcaagtgaaaaagagggaaaaacgcagcgaaagtgaatacgagtaagcatcaaaattaggggattaaatcattttaaaactcaaattgcaggtgctttttgaagaaaatttcattccgttacgaacgacgaagagagccactgcttgaccatgcgaatatcatcatttctgatgttgcacggatt

SEQ ID NO: 57605 - DNA, 790 bp, Heterodera glycines
  Genomic contig location: Contig_ID=SeqID_26859; Location=207..996; Strand=+
  SCN-specific regions: Sequence locations=1-4,26-488,510-790
atgcttttgtgctttgtttttctcttaaccaccctatcaacacaaaaagcgtttggcgtgtgacggcttcccaatttcataacaatttcggcatttgcagtcagtaaaaaatgccctttctctcattacagcagcactctcgcgtaaccaacaacgtcgctattttcgctcggttgccactgcttcgtttggacatcggggcggcccgcaatacattgtcaagtcgcgcagcgctgcggaaccacggctcttcaaccgtcttgtgcaccagacaagccgcggaatccgcgtctcagccttcgagggcggtggttcgcaccaatacggtgccgcgcaccaacacgtgccgggtggcggcggcttccgtgacttcaattctcgtcgcggtgtagggccgggagggtcagcggacccgcgccgttatgacgctggcaatgccgagcgtgaggaaatgctgcgcttgatggaacaacgcgaggaggagcatcgcaagaaggaggaggagttgcgcctggagcgcgagcgggaaaagttgaagtacgagcgtgagaagttggaacgcgagcggctggaggtggagcacatgaagttgaccgcccaaatccaagcgtccgggtggctccaagcagccgcactgcccgccgccggtggttttgttgctgcttcacccgccggttttggtgtccctgccgcaccacagcagtcgtctgcccgggactctcgccagcagcagaattattctcggcaccacagcgaagcggcggtggcactggcacgaaacagcgcgaag

SEQ ID NO: 57606 - DNA, 59 bp, Heterodera glycines; identical to SEQ ID NO: 52421
  Genomic contig location: Contig_ID=SeqID_26860; Location=312..370; Strand=-
  SCN-specific regions: Sequence locations=1-59

SEQ ID NO: 57607 - DNA, 59 bp, Heterodera glycines; identical to SEQ ID NO: 52422
  Genomic contig location: Contig_ID=SeqID_26860; Location=442..500; Strand=-
  SCN-specific regions: Sequence locations=1-59

SEQ ID NO: 57608 - DNA, 59 bp, Heterodera glycines; identical to SEQ ID NO: 52421
  Genomic contig location: Contig_ID=SeqID_26860; Location=572..630; Strand=-
  SCN-specific regions: Sequence locations=1-59

SEQ ID NO: 57609 - DNA, 59 bp, Heterodera glycines; identical to SEQ ID NO: 52422
  Genomic contig location: Contig_ID=SeqID_26860; Location=702..760; Strand=-
  SCN-specific regions: Sequence locations=1-59

SEQ ID NO: 57610 - DNA, 59 bp, Heterodera glycines; identical to SEQ ID NO: 52421
  Genomic contig location: Contig_ID=SeqID_26860; Location=832..890; Strand=-
  SCN-specific regions: Sequence locations=1-59

SEQ ID NO: 57611 - DNA, 89 bp, Heterodera glycines
  Genomic contig location: Contig_ID=SeqID_5302; Location=1561..1649; Strand=+
  SCN-specific regions: Sequence locations=1-89
ggccgagccagtcgattttatcaaacataatcttacaatacaatcgtactacctagcgggggatgcgccgaaggcgctgaccccgctag

SEQ ID NO: 57612 - DNA, 1606 bp, Heterodera glycines
  Genomic contig location: Contig_ID=SeqID_5302; Location=1968..3573; Strand=+
  SCN-specific regions: Sequence locations=1-287,316-745,767-811,834 -881,903-967,996-1606
atggagtccgctggcagcagctcacagccaattttaaacagagatttgcaaattttggtcggcgagcaaatatttactgggatatgtggtcctggccaatacattagcaatggatttttcaatttatttgttagttttttaaaattatttttgcttttgattcatgcaattttaggaggcgggaccgactgttaaaagctctgtcgtctcagttcttagcaaaatgactgtttttacaatgaatgaatgccgggcacagatttcgtcgccaaccgacaaaagggtccatttttaatttattttaaatgatattttgtaattccttatttttcagaagtttctttgtatcgactttcgaaaatcgtcggggtatttgttcttaaataagttggtccaaattatgaatgaaagcaaagggaaattcttcgaagttttgcatctgatctgtctgaaaggggtttacattgagcgattgttcgatatttttttgatgctgaatggttaccattttattattttgtccaatttgtattttttttgaacctccctttccttcagatttgaccatcattaatcttccgtacgaattcgattccttttctcgcaacggggaaaccaaaatattggacaaattaatcggaaagaatgccgcgacattacattccattcaccatttggtctatccgttccaattgttcccaaacattcgcaaccgaattgttgcgattaattccgcaacattaaggacagggacaatggaacgggtgagttttgaatggtccgagcgggtgagttttggaagctcagcccctcgaagaaaaaagaaaagaaacggggggggggaaatgagcgcacataattcatttctgctttctaataatttaagtcacataaattttttagtgttatggattgcttaaaaagggctagaaaattgttagttggtcatatttccaaatttttaacacatttccaaaaagtaaaattttttgagaatcccctaacaataagatatttgaaaagtagatattttcaaaagtgaaaaacacaattaactacccatggcattatgctccattcgcctgtgccttaattttctcactttttaggaatgcgatttctttgccttttacatggatccgagtgattgcccaaaagaacttttgccgcccaaatttggaggcatttcgatgagtatcagcatcaatcggtgcaaagaagtgttccgctcaataaaacggttgttcctttgagtcatttttcggatcaccgcttttgaattgttttttgagagcattgcaacgggacaaactccgttccgaaatcaccaagctcagactgttgtccaccttcgattttgatgaaaagtccgcgcagattttactcactcaaatcgaacgcattcgcagcactttgccaaaagtgcgttcactgaacatcgaactgagagcagtcgaattcaatgcaagtttatggaaattggaaaagtgccattttgaaagtggtgccggataaagcgctgtttcagccgaaccaggacctttattcgaacgacgacttcgccgactccaatctgatcccatcctccgcttccgcttgttcacat

SEQ ID NO: 57613 - DNA, 608 bp, Heterodera glycines
  Genomic contig location: Contig_ID=SeqID_5303; Location=436..1043; Strand=-
  SCN-specific regions: Sequence locations=1-348,370-381,403-426,460-608
  Gene Ontology: Mol. function=mevalonate transporter activity; Cellular component=membrane fraction; Biological process=mevalonate transport
atgcattcatccccatttggaggatctcttatcgctgccattggttttctgatcagcgctcttttgcccgcccttccggttctctatttatgttttggcgtcattggaggtgtgtattttgccgatgcatctgttctttacccgtttcttccccacatttccaaggtctcggcttcggtctcattttccttcctgccattgtaattgttggccaatacttttccgagagaagggcattggccacgggcatcgccgtctgtggttccggcattggcacggccatttttggaaaggtgccatcggcggtttttccatttgccaattccgcttgttttttttagctcaacccatttttgcttgatttgttctccgatatggcgggggaggaggagagttggcgtctgttccttctcttcctgtccggcacttcccttttctgcgcctttttcggctatttcttcaagccgttaaaaccgtcaaagtcccaattggaacaagtgaattgttttaagcattttcaaaagattatcccatattttgttttggatgaagtgattggatttagtaaaggttgttcggatcacagccgaactgatgggaatggatga

SEQ ID NO: 57614 - DNA, 722 bp, Heterodera glycines
  Genomic contig location: Contig_ID=SeqID_26862; Location=81..802; Strand=-
  SCN-specific regions: Sequence locations=1-133,155-563,585-722
ctctttccaaaattggtggcgatgagttggctgacagtgtgcaaatgcgtcttcttcgtgatgaaaatgcgcgtcttctctcagcgctcggcagtgttaaggcggacaaagccgtgctgaagaaacggttggaccaactgcagcagaacgacgcattggcggagcaccaacagaccaatgttttgaagcaggtatttattggcataagacgaattttaaacactaatttttctcaattcgcttttctctcattaattgaaaaaattttaagaaattcgaagccgtaattaacgaatgacagaaaattaaagatttttttgaatgatcgacaaagtctccattcctggtttttacatttttttcaatcaaaaattcatagtttggtttttcagataaattattaaccgattacaacaaaaattgtcggaacaggtcgttctcccctgcgtcgtttcccccttaaaattaaaaaaaagtttggcaaattttctaaaaatcgttgaaaactttttcgaaatttttttaaattttccgatggggaaacgacagagggggtggaatgaagtgcacctaaaaaagccttcaatggttaaatgtttttttttcagtcgaaactctcaccgacgagaacggaaaagtcgcagcaacggcatgtgttcactttgcacgacaacaacaacggattcactgggtgcacgtcggcgcgacaaccaacaacataa

SEQ ID NO: 57615 - DNA, 230 bp, Heterodera glycines
  Genomic contig location: Contig_ID=SeqID_26865; Location=204..433; Strand=+
  SCN-specific regions: Sequence locations=1-85,107-180,202-230
cacttccgccgctttgtttgttttccacaaaatgtcttcgtcagtttaatcctccatttttttgtgccatgccttgcaattgtcagccgattccgccgccgccgccctttgatgtcccccctccccccgacccatcgtttgtgttccatttgctgagtgacgacccgcccgaggcatttgaaaaggtaaaaggcaatttgaagaacgggccaatggtaacggagaagtga

SEQ ID NO: 57616 - DNA, 898 bp, Heterodera glycines
  Genomic contig location: Contig_ID=SeqID_26866; Location=31..928; Strand=+
  SCN-specific regions: Sequence locations=1-80,102-898
  Gene Ontology: Biological process=DNA repair
atgaaaagtgatcggacaaagccaaacaatggcatgaaaagtgatcgggcaaagtcaaacaatggcatgaaaagtgatcgggcaaagccaaacaatggcataaaaagtgatcggacaaagccaaacaatggcatgaaaagtgatcggacaaagccaaacaatggcatgaaaagtgatcgggcaaagtcaaacaatggcatgaaaagtgatcgggcaaagtcaaactatggcgtgaaaagtgatcgggcaaagtcaaacaatggcacgaaaagtgatcggacaaagccaaacaatggcatgaaaagtgatcgggcaaagtcaaacaatgtcacgaaaagtgatcggacaaagccaaacaatggcatgaaaagtgatcgggcaaagtcaaacaatggcatgaaaagtgatcgggcaaagtcaaactatggcacgaaaagtgatcggacaaagccaaacaatggcatgaaaagtgatcgggcaaagtcaaacaatggcatgaaaagtgatcgggcaaagtcaaactatggcgtgaaaagtgatcggacaaagccaaacaatggcatgaaaagtgatcggacaaagccaaacaatggcatgaaaagtgatcgggcaaagtcaaacaatggcatgaaaagtgatcgggcaaagtcaaacaatggcataaaaagtgatcggacaaagtcaaactatggcatgaaaagtgatcgggcaaagtcaaacaatggcatgaaaagtgatcgggcaaagtcaaacaatggcatgaaaagtgatcggacaaagccaaacaatggcatgaaaagtgatcgggcaaagtcaaacaatggcatgaaaagtgatcgggcaaagtcaaactatggcgtgaaaagtgatcgggcaaagtcaaacaatggcacgaaaa

SEQ ID NO: 57617 - DNA, 783 bp, Heterodera glycines
  Genomic contig location: Contig_ID=SeqID_26871; Location=455..1237; Strand=-
  SCN-specific regions: Sequence locations=1-247,269-783
atggccaataaacttattctgctgccgtacgagcactacaaggggctggttgcagcgagggagacaaagaatgacgacgacgacgacattgctgagcggacaaacttaggctttgtcaaacgacaggtgaccgctgcagtacagaagcggaagggaaacgtcagcgagcggaacgcaatgtacaaccagcacctgcgccggtacctgaagatgcgcaaggaacataaggagcggcccgtccgagtacagctcagcaacggtgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagccgatcacccaggaccaataagaaagcagcaaaacagcaaaaattgatcgagaagaaggaccacctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgccccttcgccacgcggaaccaaagagttgaagaggaaactcgcacagaatccgctcgccagtagcctactcaatcgactgtttgttgggtctgggttcgtcggacaagtcaaacaaacgagaggatttgttccctcaaaatggacaagaaaataa

SEQ ID NO: 57618 - DNA, 2739 bp, Heterodera glycines
  Genomic contig location: Contig_ID=SeqID_5304; Location=1..2739; Strand=-
  SCN-specific regions: Sequence locations=1-402,424-980,1009-1117,1204- 1651,1673-1770,1792-1923,1945-2238,2260-2739
  Gene Ontology: Mol. function=sodium:bicarbonate symporter activity; Cellular component=integral to membrane; Biological process =bicarbonate transport
aagttcgaaacagctgctactttccgtcaaacgtgcgacaggtgctcagtgacttttcgggtgagattcgcgttgtgttttagaatttttatcaaatttggtaatgaatgatcaaaaaacgtttctttatcacactttttgtttcaatttcctactaccctaagtgatgatcgctatcgtgtgcatgaatttgctggacgtttttctgggcaccaacacaactaaggtgaatgttcaacgcaacttccgagtgttgaaaaatgaagttcggtatttcttcagcctatggccgtgatctattttctgcatttctcgaaaaatggggagctgtttcgaggggcatagctctaatttaaaaaaattttttagtcggtcccaattattttttgtagcaaagagtatttggctcttttaaatggcttaatttttcctggaaaatttttttaaaaatggaaaaaatttctcgtgatcatttcgtctcagttgcttcaactcgctgcgctcgtagctcaccaatgtttttgccaaactttacttgccaaccaaataaaaccaattaattttatgagttgtttttttagtgtttaggtttgctttaagatgtcttctagcaaatgtctagaactttcaaatattgttttttgggcataaatgatttttttaattcaaaaacactgtccgtctttagccaagttggcccggccgtggttggttggttcatccgttcattggcaattcgttgtggatccctccactgacgctgattcttgctgttctcgcatgtgtcctcctcatttttatgggccaacaaatccatgcggtcattgtcaaccgtcgggaagaccaattgaaaaggggtaattgaaaatataatattgaagcaacactaaaatttcaaattagccagacggtgctggcattttcaaaaactagttcccgggtccaccctctccaaaagggaacaggacaaaatcaccactagaaattttttaaaaattttcaatcttggaattctttcaagaaaaaaatcttataatttttttataagagcaaagaaaattgaaaaattttcagctattttttatgatagattattaacttttttcgaaaactctccaaaaaaaatttttttttaaccaaatttgcatataaaaaattttaagatttgaaaaaaattaagcttgaaaatttaaaaaaaaatttctaacggtgtgattttggggtgcacccctccaaaactagtcaaacaacgggtatttacaaaaatcaccgggccgttttgctcaaatccgataaaaaattgtacacggcccggccaggcacgtatccagaaaaaaatttcggggagggcatttttttttcttttcgggctatatttttttaccagggttgtttttcaaaaaatttcaccgctggagccacaaaaaaaacaggaatttatagcgattttgcgcaaaaaaagacaatttttaccactttggggtcaaatggtaaaaaaataatggtacactggggtcccgcggtgccgataggcgccgctgggaaaaattttaatcaattataaaaaaaacgtacaaaattttcaaaaacattgaccaatttgcttttttttaaatttcacctcgaaattttcaagaaaaaaaaaattttccaagactgtggctaccatcttgatctcttcgatttattgggtgtcgagtccgaaagtcgcgaacctggggagcatagccatttcatcagttatctgtgagttttagttattggaactggttgccaatttttggccttttgctaacaaatacatgccgacatatttcgtagggtcgagtgccaatcatagctgtgcaagggtggggagtcccaacatttgccgtccgactttggcggccccgacagttgcgcctctgtccaaaatcaagatttttcaagaaaagaatttgaaaatttttcagctactttttggaaaaaacagtaattcatttcgctgaagtttttttcaaaaattctagaaaatctctcatacatataaattttctaagaagaaaatttctgtttgaaatttttttaattacggagaaaacggaggaggggggggggacgaactgctcctgtgcaagagtggacgtggcatgtcgctcgccgatcgcatggggtcagtgggcgtcgatcgcccgaggcggaagtcaaggaaaaggagagagaaaaaaagcatagaaagggttgagcatttcgatctatttgttttgagcaagattcttcgcaccgcgagaatataaacaccgcgagaatataaaaaggatagggctagagacagaaaaattcgaaattttttgacaaaatttggtcattttatgggcaaaacttttgcaaacggcacctccggattccccctccccagatcctcaaaattaaaaaaaaacgcgccgcaaaaaaaggtgaaaagcaaaaatggtcccaaccggataaaatttgtgaaaagtaatcgatagcaaaataaatagccggcgggggaccaatttccgagtccttgtctgactccccatgcacagctatggttccacatttctatcctaagtgaagcgagaatcccgccccatcgcattcatgctcaaatgtatttacaggaaacggtatattaccggcattgtcactgtcactctgatcggcctttctgtcacgatgaccaaactgctaagtcggtgcatgcattcattcactaatggcatagcaacgagcaaa

SEQ ID NO: 57619 - DNA, 747 bp, Heterodera glycines
  Genomic contig location: Contig_ID=SeqID_26874; Location=343..1089; Strand=-
  SCN-specific regions: Sequence locations=1-370,410-488,511-577,599 -655,689-710
atgcccgcctcagcaaattgtcgggcagcaaagcggaacagtacgtgttcaactggaaactgttcacacgggaaagaactgatcgaaatggggcacacattaaatttgcgtgtaattaggaggcaattaacgaatgccaaatccacgcccagcggcgatgcaaaccatcactttgggccatcagattggtacattgaattgtgaaagcatgcaaaaaacaaataaacaatgttaaggcaactaataccgtaataatagcgatgattcttctgtccatttactgtatacataccgccgtccaatcgtcagaaactgtggaaaaatcatcgggcagtatttttacaaagaatcaggtcaaatcattttcatgattttttgataaatttaataaattatttattttatttttcaggttccccttttgctgtccacaattacacatatttttccgatgatttttgaccttatcgggcgcattgagaagtttggatttatttttaaacaatatttctcaccttttttagacatcatgcaaaactttcgctgcgacttcacttaattaggtcaattaaaaaggtcattttataaatgtaatattcattttaggatctcatctctctatgtcattaattatgtaagaggaattattattgggaaaaataatatttatttttattttatttttattcaaatgtttttacaaaatgaaaatttgggtttattgtattttaatgtttttaaaataaa

SEQ ID NO: 57620 - DNA, 730 bp, Heterodera glycines
  Genomic contig location: Contig_ID=SeqID_26875; Location=3..732; Strand=-
  SCN-specific regions: Sequence locations=1-78,100-199,223-272,315 -434,456-458,480-526,560-730
atgagagaaaataaaataggaatatacaataatcacttaaacgcatatgtgaccactgtgagttaaggaacggtggctgattgtaagaaaaataattgtcctacggtagtaaagtattatcgtccaactgtggcacaaaaagcggtggcaaaggcgatggattcgcttgctacgagtaatggagtgacacctcgaaaagtaattaataattaattaattaatcctaacaacaaaaaactaaagttttgatataaaaattctttaatttctcctataaatttttatttgtaaaaattaaacaaattgtttttataggattttacaaaagtgtttgcttctaaaaagtcgaaaaaagaattgtataaaattgcttctggagaaatggcaccccattttttgttgaacgttggcgacaatttttacgacgaaggcgtaacaaaagaggatgttgcagagcgttttgaacaggtaattaaattaattaaggagtattagaaaaggaattaaccataaagattttttaaggaaaaaatatatataatatttaatatgtaaaaaagaaacactatattttgtataaatacaaatgtttttctgtttatagaattttacaaaagtgtacaattatgacagtttgaatgtgccatggtatacaattgctggtaacgacgactggaaaagcaaagatggaattaagccacaaattgactacccaacgggcaaatggtaa

SEQ ID NO: 57621 - DNA, 49 bp, Heterodera glycines; identical to SEQ ID NO: 51181
  Genomic contig location: Contig_ID=SeqID_26877; Location=526..574; Strand=-
  SCN-specific regions: Sequence locations=1-49

SEQ ID NO: 57622 - DNA, 688 bp, Heterodera glycines
  Genomic contig location: Contig_ID=SeqID_26878; Location=158..845; Strand=-
  SCN-specific regions: Sequence locations=1-47,79-210,246-333,355 -566,588-617,639-650,672-688
atggttcgaactaaacaattatttccctctgagcttcaatgttcttcatcttctttacaaaataattcctcagaaatctctgaaaaccaaacgggttccaagctcccgtctaaaaaagcggttaaaccggttcaaagctccggaaaaaagcggtcaagaacaatgtttgattcttttgaaagaatgcatatgaatgagaaaaagaacattggaaatgaaatgaatttggaaaatgttataaatttggatatgattgattttgaagaagttaaagaaagcgatgaaatagaaagaaaaagaaagaaaattggaaaagatatgaacctggaaagcgttataaacctggatatgattgatttagatggagtaaacgaaaccactcaaacacaaaaatctcaaccaaatacgaaacgtataccgacgggttttttgtttaaaagtgcagcagaactaaacaatgtaaaaaaattctctttacaagagtttaacattgaatgtatattttgcaaggcagtgcattttatagaagagcaatcaatcaaaaattcaaaagtgaatgaattccattcatgttgcaattttggaaaatcaaaaaatttgttggaattatttgatgaatatccatttgaattaaaacagttgtttacagaagaaaatgaaacttcgaaaaattttacgaataatataa

SEQ ID NO: 57623 - DNA, 243 bp, Heterodera glycines
  Genomic contig location: Contig_ID=SeqID_26879; Location=77..319; Strand=-
  SCN-specific regions: Sequence locations=1-243
atgcgcaagaaagtggagctgcccaggttcacacgcattttgtaccgtttcccgaacggcacttatcggatgatggtcggcacggggctcgagggcagcaaatgggtgaaggggtccaagaagaacgccgattggcagttcaaggtaagcttaaatgaaaatggcataacgtgaaggaaagtgccgacttttcagcctaacgagccgttcattggcaattattgggacggctccaaacacgaa

SEQ ID NO: 57624 - DNA, 1236 bp, Heterodera glycines; identical to SEQ ID NO: 26880
  Genomic contig location: Contig_ID=SeqID_26880; Location=1..1236; Strand=+
  SCN-specific regions: Sequence locations=1-155,177-370,392-804,828 -1042,1067-1146,1168-1236

SEQ ID NO: 57625 - DNA, 4275 bp, Heterodera glycines
  Genomic contig location: Contig_ID=SeqID_5307; Location=1052..5326; Strand=-
  SCN-specific regions: Sequence locations=1-988,1010-1845,1868 -2401,2423-2913,2935-3080,3103-3607,3629-4275
atcttcaaaaacttttctctccgtgtgagattaaagtctgccgtgtgcagttctcttcatttggccatggacgcacaacagcttcaacaattgctaaatgcgctccaacaaatggtcactaatgccgcaccacaaaacgccgcacctgcaaatttgagcaatgccaatttggcaagctctatcgatgctcgcatatcgtcattccattacaatcccgaggtcggcactacctttgaatgctggttcaaacggtatggcaaattgatcgaagaggatggaagcactctgccagaggcttcaaaagtgcgacttctcctcggcaaactcggagaggaggagtacagcaaatatcgggacacgatcagcccaacgcagcccgaccaagtgaattggaacgaaacgatttcacacctcaaaagcctttttgctgaaacccgctcgctgttcgtccgtcgctacgagtgtttcaaaattcgacagcaacaaggacaagatgtttcatcactaattgcgcagatcaacgcatcatgtgaaaatgccgatctgagtctgacaaaggaacaactcaagtgcattattttgatcatcgcgctcaacgatgaacatcacgatttgcgacaaaaggcactgaaaatgttggaggacgctcagaaaaatggcaccaacatttcgctcaagaaaattgaggaggaacttcgggcaattcagcttgtcaaggagagcgccctttcgctggtcaacccaccaattgccacaaacgccattcgcacaaggccacggcaatgggccgacccagcgcaaagacaaagcggcggctccaatcaaaggcaaactccaaatgccaattcaagcggaaagccaacgcgtggtcaaccgacgcatccatgcggatcatgtggcaaatccgaccattggcgctccgactgcacattcaaggacgccatttgccttaagtgcaacaaaaaaggacacatttcaacaatttgccggcaaaagaaagcaaaggcggcaccgaacaaccacagggcatttcacactgtcaaagtcgacgcaaattgtctgcatgtcggcacgactcaaggacggtggtggaaattatgcattttgattaatggaaggcaaacttccatgaatggcgacaccggcgctcaggccacaattatttcattgcaaacatggcgagagttgggagaaccgaatttgacgccatccgacatcgatgccaaaaactgcaatgaccagccattcgccttgcttggcaaattcatctgcaccgtccaattttccgacaaaccaccgcaaactctgatcgcctatgtgagcggagaagtcggacacaatttattgggattgccgtggatcgaagctttggagatcattccccgccaaattttatttccgtccagcaaatcggctgatcaggcgacaatgattgaaaatttttcggcagtgaagccgccaaacaaatcgatcaatgatgtgtcaacgcttaaagcggcactccaaaaagatttcccggaagtttttgaagaaggactaggacactgctcaaaggcaaaggcgcatctcattttgcggtctgatgcaaagcctgtattttgccgagctcgcccaattccacatggcgccatggaagctgtgaatgccgaattggatcgccttcttcaaattggcgcaattaagccaatcgatttcagtcattgggcagcgcctatcttagccgtaaaaaagaagaacggcaaaacgagagtctgcatcgacttctcaactggcctcaacaacgcactggaattgaaccgccatccattgccaaggccggacgacatttacgcctcactgaatggcgcaaaatttttctcaaatttggatttacgcgatgcgtatttgcaaatggaaatggatgaagaatccaagcaattgtgtgcgatcaacacacatcgagggcttttccaatgccaacgcctgccgttcggagtcaaatcggcaccggcaatatttcagcatttgatggaccaaatttgtgccggtatcccaggtgtattcgcgtatcttgacgatggattaatcgccacaaaaacgcttgatcaacacatcacggcactgtacactctttttggacgcataaaagaatatggtcttcgcatccaactggacaaatgcaaatttttgcagcccgaacttttgttccttgggcatattgtgtcagcaaatggcattcgtcctgacccatcgcgttcggacgcaattcggaaaatgcccgcaccgatcgacaaaagcaccctccgatcatttttaggcgctttgaattattatggcagatttgtcaaatgcatgcgtgagttgcgtgcaccgctcgaccgactcctccaaaaggacgtagcttggaattggacttctgaacagcaaaatgcttttgaaaaagcaaaagaaatgattacatccgatttattgctgacccactacgacccggcacgcccaatcgtcgtatcagcagatgcgtccaaagatggaatcggcgccacattaagccacacattccccgacaaaaaggaaaaagtggtagaacacgcagcatgcacattgacagcagcgcaacaaaattacagccaaattgagaaagaggcactggccattgtgtttgccgttcaaaaatttcaccgcatggtgtacggccgaaaatttattttacaaacggaccacaaacctttattggctatttttggctctaaaaagggcatcccgatttatgccgcgagccgcctgcaacgctggtcaatgattttggcgaattacgactttgaaattcgctacgtcaacaccacatcatttggccaagccgacgttttgtcccggctcattgctaattatccgcgtccagaggaagacatcctgatagcaaacatctgtgctgatacagattgcttcataaattctgttttcgaaaacagaatcgatcaaatcccagtgacaaccaccgaaatttcttcagccatggccaatgatcaaccactccaaatggttcttcaatttttaagaaacggatggccaaccaaagtcaccgaatctgaaatcagtccatattttccaaaaagggacaaaatttttgaagtggacaattgcctactgtatgaggaccgtgtgatcgtcccaacttcgcttcgcagtcgcatccttaaggcattgcacatcgctcacccaggcattgtgcgcatgaaagcacttgctcgacgtcacgtgtattggccaggaatggactcggcgattgaaaaagttgtgagcacgtgcgaagagtgccaactgggccagaaaaacccgaccaaagcgcctctttcgccatggccaacgacggacaaagtgtttcagcgagtccacatcgattttgctggcccctgctcagacggtcaccaatatttgattttgatcgactcattttcaaagtggccagaagtctatcgtatgaatacaatttctgcttatgccaccgtatttgttctccgatcaatcatttatcggctcggaatcccagaggaaattgtttccgacaacgggacccaatttcgatccgccgaattcgccacattctgtaaagaatttggaatcaagcacattttcacaccgccatttcacccacaatcgaatggccaagtggaacgattcgttgacaccttcaagcgatcgatgaagaaaatgtccaaaggtggaaaggattggatcgaaaagatgctgttctcctacagaaccactccccacgttgccttaaatggcttttcacccgatcaattatttttcggcagaaaattgcgcacgaaattgtcgctcgttcatccgaatggagaaaaagccgaaaattttgatcaaaactcattcaaaaagggacaatcaaaatacaccgacaaaatggctcaaaattttgatcggaagcatggatcaaaactgatcaatttctttccaaatgatcatgttcttctgatcaattatcgaaacaacaagacggaatggctgcaaggaaaagttgttgagaggcttcacaaatcgcccacatatcgtgtttatgtgcctgttctgcgtagactcgttcatcggcacgcgaatcagctaaggcgacgccatcttttggaagaagaagccgaaaaggaggcacctcaaatcgaagagccaccgccggttgtcgaaccgcctcatccgccccaacaaaatcagccggccaattcaccattggttatccgccgatcaacccgagttaaaaagccgcgccaattttattctccaggatga

SEQ ID NO: 57626 - DNA, 327 bp, Heterodera glycines
  Genomic contig location: Contig_ID=SeqID_26882; Location=323..649; Strand=-
  SCN-specific regions: Sequence locations=1-88,113-327
atggacgtctatatggccctcgattctggcgcgattattgattgcttccatgatcaaaagaatggactcgccagccttaatggtatgtcaattttttcaaaataagattaataaaattacatgctcgagtacatctgtttccagtaaatactcagatccgtcgccgaaaaatcttatcttccagaaatggcagattttttcacaacgcaggcagttacagatgtcgtacagccgaagggatgctatctcgtagaattccttcccttcgtcctcaaaatcgcgttcacattgctccctgtggcgatgcgagcattgctgggtttttaa

SEQ ID NO: 57627 - DNA, 119 bp, Heterodera glycines
  Genomic contig location: Contig_ID=SeqID_26884; Location=388..506; Strand=-
  SCN-specific regions: Sequence locations=1-119
atggccgtggtaagccgaatgtggtatattggaaaggagacttgcaaattcttccacggtgctgtgaaagtcttttttgacccaaattggcaaatcccaaagaccaagcttgatccaag

SEQ ID NO: 57628 - DNA, 612 bp, Heterodera glycines
  Genomic contig location: Contig_ID=SeqID_26885; Location=1..612; Strand=-
  SCN-specific regions: Sequence locations=1-612
acaaaaaaatcgatttattcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgatttttccaagtgtacgtttggggtactcaaacaattatggggagcaaaaatccaacgcagaattatagtacaggctatagggaagctattcccgaaggattcggtctccccataaatctgggcgcatcggttcgggggtactgccccgaaaacaaaaaaatcgattttttcaagtgtccgtttggggtactcaaacaattatggggagcaaaaatccaacgcagaattaaagtacagactatagggaagctattcccgaaggattcggtct

SEQ ID NO: 57629 - DNA, 531 bp, Heterodera glycines
  Genomic contig location: Contig_ID=SeqID_26885; Location=1170..1700; Strand=-
  SCN-specific regions: Sequence locations=1-55,82-161,207-207,233 -388,415-497,519-531
ggttcgatgaaacttttaaaatataagcctaaacttttgggcctgtttaaaaaggaattaaaaatttttaaaatatttattcatctcccttttgatagaaaaagcatcagagtgcctaaactaacatgtaaataaaatttggtgcgtttcagagcacgttctaaaaaatatttaagaattaattttgcaaaaaataaataattaatgaaaaagtcagaatttcgaaaaattttaaaaacaacaagcgttggcattttttcaagttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcacgttctaaaaaatatttatgaattaattttgcaaaataataa

SEQ ID NO: 57630 - DNA, 987 bp, Heterodera glycines
  Genomic contig location: Contig_ID=SeqID_5308; Location=1113..2099; Strand=-
  SCN-specific regions: Sequence locations=1-493,515-765,787-833,863-987
atgatcaagccacaaatgcgaccagtatttggtgtttggggctctgcgggtaaccttcaatgggttattagcttctacttatgtacattatttcctaagaacgggatatgtatacataggtgctgggtcgatatcaaaatgattgacaaggggtgacgcaaaaatcatttaatgagaaatttagaaaaaaaaagtttcatactatccctatgtagaaaaaaaacaatctccacctcatatggcgtatccctaatattagtacaaaatgcaataacgcgaaagattaccttagctaaacaaaaatcgtccacgatcggtttcataaatccatccccctagccacaccgggtcctcagggacagcctggccaacccggacaaccaggaggacctggccagcccggtcaacccggacaaccaggaatcaaaaggcgagagaatcgaactcagccaataaaaattattgaatgtttttgttcagcacgacaattcccggcccacctggacctcccggaaacccaggagcaccgggccagcccggcagccccggacagcccggaaaccccggaggacaaggaccgcccggtccttccggaagccctggccaacccggaaacgccggggccccaggaacccccgggcagcccggccaagctggacagcccggccacgacggtgcctactgtccttgcccccctcgcacaagcgtttttgctcgccgctctcgcgtcgctgcttaagcatttgaaatggacaagaggagaagagaaggaacaaaaaagagaaaccattcgaaatttatgttggccaatgcattcattaatttggcatcgaatggaaaaagaataaaaaagaaatttgcaacagattaatggcataatttaaaagaaaatcaaaagatcaaaacaaaaacatttcaaattaaaacactgatttgtgagtcatactgtggcaacaaatacattttgtggctcctttagcaaataaa

SEQ ID NO: 57631 - DNA, 177 bp, Heterodera glycines
  Genomic contig location: Contig_ID=SeqID_5309; Location=1..177; Strand=-
  SCN-specific regions: Sequence locations=1-177
gcaatttgaaaacagaacataattcactgcttcttctgctaaaccctccgcaacagaagtcaaatttcaggaaagaaaatgcacgaagcgaaaattatagtcggaattgcttccctttgttcgctggccgcgatttgggcactctcgtggtgatcccgcaactgtacactcaaatca

SEQ ID NO: 57632 - DNA, 1335 bp, Heterodera glycines
  Genomic contig location: Contig_ID=SeqID_5309; Location=1129..2463; Strand=-
  SCN-specific regions: Sequence locations=1-212,235-1001,1023-1335
ccactcttttccattgttttccatctttttgccattatttctggtcatatccgtttgccattgtgccgatcgtctcaattcgtcggcggatggtcagggagtgatcattttggttgcccgaggggacgacccgaacagttcccaagacaaagtggtcatcccacagggtcggtggtccaacaaatgtcgacgctttggtcataagtcacttcacttcagccaaggacgggctgcagccgccattgccatgtttgatcaccggcgtcggcatttttgagcacggacaaactttcaccaagggcaactttcactacgagtgcaaaaatggcacagccgaggtcattggtgggtattttggtgttgtccgaaaggttgtccgccttggtcagcttgcattgccgaggatatgtcagtcattcaaatcgggcgcacttttcttcggaatgggacaaggcacaaatgtttggtgagtggcaacacggcactttacgaacagagtttgtcttcagagcaaatgacacattatagcacaaattataacaattaagggtcgacttgcttcgaaaatagcatttattatgacgttggtatgtgaagggaatcgttcccttcccaaaattggcacttttaaggcgacactttcaaaaacggctctttcaaagtgacttgtaaagacacgggagttgctgttgtcggtaatgatgcccttttgagcaattcgatcaaaaggcccctaagggtgttttctgttaaattcaacggacgacgcaattcttttgggtgagtcgcgtttaattgggacgaaaaggcacagctgcgaagtttctgaaagcggcaaggttcgctatgtgatcagaagtgagtgtgagtttggggaatggccaacaaaaggagtgtttggcgtagtgttgggctgccaagggcaaaatggcaccgaaggggagttcaagccgggccaaacatgggcggacaagcacatccgctaccactgcacggaggagggccagaagaaagtgttgggtgagtaatgccgggcagcggcaaaggtcgtgtttttaaaagggcaattggccaaggatgcgtcgacgacggcggacttttcatcgaattgggccacgacgtgatgatgggcggcacggtgcacagatgcttcaagtcgcaaaatgttacttattatcaccggtacgaacagtggcggacaaatagcagcagaaacatcttaacttaaatatttccttggacagatttcgttgtgacagacaacgaagtttggcggaatgtatcagcgccacaaaagtgccaaaattgaaacgaaagaaacgggtggccatgaga

SEQ ID NO: 57633 - DNA, 1077 bp, Heterodera glycines
  Genomic contig location: Contig_ID=SeqID_5310; Location=206..1282; Strand=+
  SCN-specific regions: Sequence locations=1-6,28-92,114-555,584 -763,791-1014,1037-1077
atgcactttttgggcaacaattatttggagtacccaaacggacgcactttggccataattggggacacggaggagaaggtggaaagtgcgcgggaccacgtggacagggaattcattttgaagagatgggaggcgagtgaccgacggacggacagaccgccgaacattttgggcaattttaaggcatggaacacgggccaacacgacaatgttgaggaagaagcgacgacctacgaagaaatttaccaattgtcaccgaaattcgcactgcgcgaggacctcgaattggtgatgaagcaaattaaggtgtgcccggcaaattataagcaaataaaacgccacaaacacttgaggaccaatccggcatcgtctcctattgctaccgccaattcagcacgggccatcgtccgattattctcagagggactgaacaggcagtggcggaagcgatcaaaatactcaaaaagatggagcaggaatggccacaacagcgcacaatgggcaacagccgagcgagaagtctggacgaaatctcaatcacttcggtaaaatgggaattaattattgaaaaataaattaataacaacccaaaaatgggttgaggagaacgataaacaaatgaaaactttcagttcgtcgagtcaatttcaaagcttaaaatttcgaaaacatccgaagaagcggcgaacaatggcgaagcaaagaggaaagaagcgcaaaagggcgccaaagggacgaaaagtggcggaaaaacggcgccagggggaggaaaaggtggaaaataaaataataggacagaatggcatttggggttattaacggaatcgcatttggatttattattaattgccagaagcaatgaatggcgacagcggagaaaatggcaaagacaccgacgaagccgaaaaagaaggcaacctgaacagatcggcaagttggcagaaagagaggcgcaggaaggaaaggtgaggaggcggagaagagaaaaaaacaacgaaaataattgggaggaaacggcggggggcgggggggggggtgaagcgcacccattaattaaactttcaattaacacttaaa

SEQ ID NO: 57634 - DNA, 287 bp, Heterodera glycines
  Genomic contig location: Contig_ID=SeqID_26894; Location=152..438; Strand=-
  SCN-specific regions: Sequence locations=1-44,66-91,183-196,220-287
atgaatattcttaattataaatttttagctggtgcgcaaattggtccaaatggggacgatgaacccagcacaagtgtatcggtgagttttgttaaaaataaatttaaaatttttttttcaaatttgtaaatttattttaaaaaatacacaaattttttttattgaattacattataataatagcaatttcgaatttaaaaccttcagaaatttaagcgagattgggaatttgcgacttcctcggacgtaaacgaacaagtgaacaatctgcagaggtgaaaattaaa

SEQ ID NO: 57635 - DNA, 154 bp, Heterodera glycines
  Genomic contig location: Contig_ID=SeqID_26895; Location=168..321; Strand=+
  SCN-specific regions: Sequence locations=1-32,58-154
taagcctaaactttttggcttatttaaaaagcaattaaaatttttaaaaattttattcatctcccttttgatagaaaaagcttcagagagccttatttaacttttaattaacatttggtgcgtttcagagcacgttctaaaaaatatttatgaa

SEQ ID NO: 57636 - DNA, 727 bp, Heterodera glycines
  Genomic contig location: Contig_ID=SeqID_26897; Location=136..862; Strand=+
  SCN-specific regions: Sequence locations=1-17,39-118,144-210,247 -288,313-404,464-480,521-727
atgaatacaacaatctggaaaataggtttattgaaaagtcaaaggatggcaaaatggcggaatgccgaagatgtaaagaaaatgaaaggcccaagtatgaatttaccctctctgactctcccggtagggcaaccgggaaccgggaaaaacaagcactggtaagaatggggtctgagtgaaaaattagtgaagaaaattggagtcaaagggaaaaataaaaaataataattaatatattctttaaaagtaacactgcccaattgtgcaaatggcctacgggctagtctccttgactttcccttcttctttcccctggttcaatccctctacagaaattagattattttcaattttttttttgtatactcgtgggtttcctataaagaaaatatgattcctcatagtttttttttaaattgatacatattttatcattttttaatttttctattttttatttaaagggctacccgtatttcgatttatttaagaattaaaatagatttataattttttatttgttgttgttaaggctatttgggtagttcgcctagaaaatagaggcatcacttttttgtcacacctatttttcacgcattttatgaaaattcataaaccttagccaggtgaggggaagaattccccccttcccccgcccgaaatgaaaaattaaaaatttttacaggaaaaattgggacttttaaattttttttgtcgatttttctta

SEQ ID NO: 57637 - DNA, 631 bp, Heterodera glycines
  Genomic contig location: Contig_ID=SeqID_26899; Location=353..983; Strand=-
  SCN-specific regions: Sequence locations=1-167,189-246,333-346,368-631
gttgataagagccaactgaggccggtcgatcgtgaccatttcagcgccgctgatcggtcattttaatctactttataatatatattttggatggtccatgatagtaaattgtaataaaaatgatatcttataggcaggcatacgataactggcagacaatcgtggtgaaaataaataaattaaaaaatgaaatggagtaatcagatcgaaacgacaattgcacaaattcggcccaattggcacaacaataaaaataaaaataaaaattaaaatgtaaaatagtaaatagtaaattaaaattaaaaaaattaaaattgaaattgaaaatgaaatgaaagacgaacattattcaattgaattgaattgatgatgatgtgttggcgcgatcgtggtaaaaaaaacaacaaacaaacaacagagaaaaatacaaaaaaaggaatgaatgggcagtgagtgatctgaactgatcggaatcaaatagcacagaaaagggagggaaagttgtagtgtaaaaagtctgacacagaaagaaaggcttggcagcacagataagctgaaaactcgaaacaaacaaaaagaaaaatggatgtttatttgtgattcaaactgatcagaagatgggacctgatct

SEQ ID NO: 57638 - DNA, 903 bp, Heterodera glycines
  misc_feature (764)..(764): n is a, c, g, or t
  misc_feature (807)..(807): n is a, c, g, or t
  misc_feature (843)..(843): n is a, c, g, or t
  misc_feature (874)..(874): n is a, c, g, or t
  Genomic contig location: Contig_ID=SeqID_26900; Location=83..985; Strand=-
  SCN-specific regions: Sequence locations=1-88,110-152,174-307,349 -704,732-903
atggcatcgtcaataatctttgcaccactggccctcaaaattccactaaaatttgcaaaaatggacaattttggtaaagtaggtacctatattaaaaaatattgcaaaaatttacattttttcaccgtcagacatttatagataccgccagaccaaaaactttcttaaaaattggctgaaaccgggattcccggaaaaacgggagcctcgtcccgggttccatcccgatccattttcaaagtccccttcatttcaaaattccggtctctagatcaaatagtatcctgtctcataattggaacgtttcataaatttttaaatgatctttaatttatatttattattaaagcaaaagatttgcccgattttattaatggatgaccacgaatttatggaggggatggagcaggaagatgaggatgagtttatcgaagagccaatgtctgctgatttcgacttagggaatataaatgatccaattggtgttgacgaacctattaatcacggttattcacttggtaaatattggtgagaatcgattttccacattcagaagttcaaccgaagcctcccacagttaactccgctggcatcgatttggattcgctttccaatgactacacagattatgctctgatgaacaggtttctttgagactgagcttttgcagttaagtggaccatgaaaaacgataggtggggtgcttttattttaaaaaaataatttaaaaacgtcaccctgtggattttcaccaagtccattanactgcaaaaatgccccatttactaattgtcagcacaaaacccnttttccctttctggctgttgttcatttgcccgacgntttgtccgcccgcttaaagttgaaagccttngaaaatgctcatcacttatggtcattaaa

SEQ ID NO: 57639 - DNA, 2632 bp, Heterodera glycines
  Genomic contig location: Contig_ID=SeqID_5312; Location=1..2632; Strand=-
  SCN-specific regions: Sequence locations=1-17,250-720,765-908,931 -1245,1290-1314,1337-1353,1459-1466,1602-1603,1683-2160,2205-2632
  Gene Ontology: Biological process=reproduction
tttaaagattatcatacatattttattttatttttttgctatatataattaaattttcatttaaaattcatttctaaattaatttatgattttttaactggtataatatttaataaacacaacagaattttatttaaaattattattatttaattgttttaatattattgaaatcaatttctaaatttctatatttttgaatagatttaatttttttttaatttaatttttttttctaattattattttcagacagctgttgcggttggcacatcgttgcagattcaaaaggatggcattctctcaccgcattccatttttctgttcactgtgcttggcagctggtcaatttgcaataaattcaaaatttaattactatttttacctaatgtcatactgtattgtttactgtatataggtttgtcgccgctctgttacatccgctcgagtttggctgtgtgattccatgtttggccttgaaaattcattttagaacgcatttggggatggtcactaataaatttttgatataaaaaaaccaggaaaaaccaattaaaaagtcaaaaaaatttttaaaagcgaaaaactaaaattttggaaaaactcagacaaaaaatgtttttttttatataaaaagaagacgaaaaaaattataaattccaaaaaactaaaaatttttgtaaaactaaaaccaaaaaaaaaatactaattgtaagacccaaattaattataaatttacaaacaaaaactaaaaaaatttttttggaaaatctaagacatattgatagttagttggtcataagcatttttcatggtcaagaaatttcatggattttttttgataggggggggggggaggctctcggcttcgaacctcacggtcaaattttcgtttttcgagctttggcaaaaaaattttttttttttttacactctcgactagcatcagtagcagctcaattaattacattttgtcaaaacattaaacacctcccgtcaggtgcactgtacttcttggccatcccgagcatgtaactgaccgagtgtttttcaaaaatttcaaaaaaaattttccgaaattttccaggtatatgctgttgcccatttattcgttgtgcaatctgaacaccgtcagctggggcacacgtgaaaatccgatcagcagcacaaattcgggcgaacatcaccaccacaacggcacacatcataatgtattgttggctaagacaacgttttagatgcctcttaattttttattaaatttatttttttaacaaattaaattatttggggcacaaaaatttttgatggatcaaattttatttaaattaaatttcgagatgaaataacatgtttttatttattaatattaatttatattatttgaaaatctttatgtcttttttgtaattttctgaatactatttttaaaaatattttttgttgattaatatttaacactaaaatatttatttttaatttcttatttatttatttattatgcattaaatttgcttttaatatttgatattttattcaaatattaaagtaaatatttattttattcaattatttaattaaataaatttcttttccatttcggataaataaatatttttacttagataatttaaaaatcttataaattttttgtttctcaattaaatttaaaaataaaattaggcgccggaggatggcgaagtgtcgctgggctgcggcaatttgtgccgcgtcgtctgctgcgtgcggcacgcgttcggcgccggcggcgccaacgcgtcatcccatgccaccaccgcagtgcgccggctcgacgagggacttcaacaaattgagcgtaaattggctagtcttgagcggcgccgggacggcggagactgtggcgccagtgaattgggcgctgtcgccagcgcccagcagcagcgagccgaccaatcagtaccagaaccaactgcagcggttggcgttggtcttgttgatcaacgggcgccacaagcccaacaacaagtacgtttgttcaacaagtgtaattggacaactaagcgttgaacttttggcgccaaaacatagcggagccataaatccggcgctgactattggtcttatctttgttgtgctaattgtaagcacatgtaactctttggatggtctccctcaatgaaaaattaaaattttttaataaatatgtaaaatttgaaatttttctccggcgacgtaaataacgggccttaatttctcagtttttttaatttaacagaaaaatttttcaaaatttagcctagttaagtttttgatttattaaattttatttagcgatttttatatttggcacaaaaaccttaaaaaattactaagttgtgggactaattaaaaatattcgatttaaaaaaatttttacttttgttagcgaatggactcgccaaattggatggaggaggagccgttcaagcagttcgacaccgtttatcttgacccggacgaggcatcattctggcgcgagatgatcaacaagtactactaattttatggcatagaaattccaaaaaaaaaaattcaaaattttcaaggtaccttaggcctattaacctggactcacaggaggttgaacggatgcaaattgggctggacgagt

SEQ ID NO: 57640 - DNA, 98 bp, Heterodera glycines
  Genomic contig location: Contig_ID=SeqID_5313; Location=1329..1426; Strand=+
  SCN-specific regions: Sequence locations=1-98
ggattctttttcaaaacacctcgtagactgggggataattggagactgcgggattaatagagactgggctataattagagcatatacggtatgcattt

SEQ ID NO: 57641 - DNA, 1831 bp, Heterodera glycines
  Genomic contig location: Contig_ID=SeqID_5313; Location=1..1831; Strand=-
  SCN-specific regions: Sequence locations=1-100,208-273,296-608,630 -725,778-812,834-1039,1063-1244,1350-1373,1438-1526,1548-1556,1785 -1806,1828-1831
  Gene Ontology: Biological process=reproduction
cgccggcggtggataccttcaacaatggccaacatcatccctctgctccgggactaccgaaatgtggtcaaagtgaacgaatccgtcacaatttggtgggtttttaattaaatttttttttttagaaaatttgaattatttaatccaacaaatttttatttaatccaattttatagcgaaaataaaaagaaattaaaataaaattaactgatgagaattacgtcaaaaaaaattgggggaaaaaagatagtatgaattataaaattggaattttaatgaaattttgtttttaattttaccaaaaacttgcctcttttacaacaacccaccctcaaccgttgctaaacaacatatgtttttcaaaatccacgagatcatgactaaattttcaaaaagaacaaacaaaaatgcataccgtatatgctctaattatagcccagtctctattaatcccgcagtctccaattatcccccagtctacgaggtgttttgaaaaagaatccctctatcataatcccccagtctctaattatccccccttttctgaggaggttgaaaaataatcccccatgggctataattagagcatatacggtataatcaataccaattaatatattaaataaaatgaattaactaatgcaattattttaggtatattgcctatcaattggtgatgttgttctcttctgtgctcgggccaggcaccatctttttaatggtccttttaattaacaattttatttattttttttttttgattttttttaatttaatgttccttttaaaaattgttgtagtaatttccacaggatttgattcattaaatttctaaaacgggttgtttgaagggcgtccattaaaattttcaaggatttctaaaaatcttggctctgatgagagatttgggggcctcacttaaatttctaaaaattatactctgactagggaatggtgcgggcctcgcttaaaatttccaacgattttctaaaaattataaaaatctttactctgaatagcgagggtttcgtgggattggtttaaattttttaaaaaatttttgccaactttttcgaggtggtcggtgccatttccatctctttcaacattgacacacgccttgcactgctcgtggtcaccacgcccgtgctgtgcttctgcatttgttgcttgacctgttcaacggacaagcaattgttgatggcacaaatcattggcgccctcttcgccatgctaatggtgccaaaaataattttatacaattgaaattaataatttttattttatttttttataatatttttagttatccagataatttaaaaaaaaattattgtttaataaaaaatgttctctatgcaaggataacaaccaaaaaaaaaaattaatacattttttattatttgtttaattaattataattattaactatattaaggttgataatttttcaaacaaatataaatatttgcttttagagatgctgcccaattagttttataaaactaaaactactatttttacgctatttttaagttaataaaacattcacatagaatattttttataaattattgtttgtttttcatttgaaaaaataaaaaaacattcgcaattaaaaataatattttattttaattcaattataaatgctgatcattttcaacaatataaatgtttttcttttaaagattatcatacatattttattttatttttttgaagaaactataattaaattttcatttaaaattcatttctaaattaaatttatgattttttaactgaggtagatttaataaacacaacagaattttatttaaaattatta

SEQ ID NO: 57642 - DNA, 682 bp, Heterodera glycines
  Genomic contig location: Contig_ID=SeqID_26904; Location=1176..1857; Strand=+
  SCN-specific regions: Sequence locations=1-631,655-682
ttggatttgcaacgacgtttggatggacattttcccatcctttgaccgtcctcaacttggcctcaaattggcacttctttcgccacgtttcaatgcgttggtggacaaacatttcaatggcaaaagcgaattgacaatttggagatcaatcgaaattcgtcgcaaggacaaaggaccagaaccgaaactatctgtgtggttggatgacaaatttgtgccatttccattgcccgaccgtccgttgcccagcaaaatccgttttaagaatcttcagattgagtaattcggaatcagagatttatggcaataaaagcattcatcccatttttaggtacattgatcactccgtcatcgcttttcttcgttcaaatcaccaaattttcgacaaaagaggcaccaatttacatttgtggattccatcatcacactctacgaatggccagccgattttggacattttttgtcgtgaaatttggcccattttttcgacaaacattcgctgtttgggctttaccaatggtgttgatttggacaatttgcgtcgtctcatttcaccgacaattctcaccgatctcaaccaattgaattcaatcaattccggtgatttgtcgcccgctgcgtttggtggtgattttgatgggccaaatgcaacaatttctgctggccaagcattgtcaaaatg

SEQ ID NO: 57643 - DNA, 56 bp, Heterodera glycines
  Genomic contig location: Contig_ID=SeqID_26905; Location=251..306; Strand=+
  SCN-specific regions: Sequence locations=1-56
gctatagggaagctactcccgaaggattcggtctccccataaatctgggcgcatcg

SEQ ID NO: 57644 - DNA, 213 bp, Heterodera glycines
  Genomic contig location: Contig_ID=SeqID_26906; Location=342..554; Strand=-
  SCN-specific regions: Sequence locations=1-213
gaacgaaaatgcaaacgatttgaactatgctttgaaccttttcgactacagaataaagcgtgactatttgaggtataattacgcaaaagtgtcagccgatggaagcgcagaaaaaccgtacaaagcgatggaagcggaagaaatagaggggaaaatggagcagctaaaggttggactcaagtcaattgtgacgaacagagaaggactgactga

SEQ ID NO: 57645 - DNA, 51 bp, Heterodera glycines
  Genomic contig location: Contig_ID=SeqID_26908; Location=623..673; Strand=+
  SCN-specific regions: Sequence locations=1-51
atggatgtgccaaacgttggagacgaacacgaggacttcgaagacgatgcg

SEQ ID NO: 57646 - DNA, 493 bp, Heterodera glycines
  Genomic contig location: Contig_ID=SeqID_26909; Location=71..563; Strand=+
  SCN-specific regions: Sequence locations=1-227,270-493
atgagtgattttgaatttgcggcaataaacgctgccggaaatgtcttcccaaattcggtcaaaagtggttgcctatttcactttgggcaggcgttatttcgtcgcatccaacgtcttcctaatttgtacacaatctacctacaagacagaaatttccaattgtcaattcgatcattggaggtagaaattggggggggggatttttcggttttagaccccacccccagaaaattttaaaataaaaaaataatttttatttttttttaaatcaaggcattggcatttgtgccagatcactatgtgtacaattatttttgtgcattgatgtcaaagtcttttggaaaaagcgcgccgaaaaaaagtgattgagaagcaaatctgaatttctaatagtcatttagcccaaaatgattaattgtttgaaatgattgaagaaaatttgtttgaaaattttcattaatttaatttagctctaacttttggattttattaa

SEQ ID NO: 57647 - DNA, 131 bp, Heterodera glycines
  Genomic contig location: Contig_ID=SeqID_26909; Location=497..627; Strand=-
  SCN-specific regions: Sequence locations=75-131
aaaaaaaattaattttaatttatttcaattgaaaataatacaaaattaaattttgattttttatttaataaaatccaaaagttagagctaaattaaattaatgaaaattttcaaacaaattttcttcaatc

SEQ ID NO: 57648 - DNA, 238 bp, Heterodera glycines
  Genomic contig location: Contig_ID=SeqID_26910; Location=619..856; Strand=-
  SCN-specific regions: Sequence locations=1-129,151-238
  Gene Ontology: Mol. function=helicase activity; Cellular component =eukaryotic translation initiation factor 4 complex; Biological process=nucleobase, nucleoside, nucleotide and nucleic acid metabolism
gcattgatactcggaccaactcgcgaattggcagttcaaattcagaaggtctttcttattgtttcttacttgttttgaacaagtgattcaggttattttggcactcggtgattatatgaatgtgcaatgccacgcctgcatcggtggtacaaatgtcggcgaggacatccgaaaattggattatggacagcacatcgtagctggtactcctggacgtgttttcggtgatagacaatga

SEQ ID NO: 57649 - DNA, 646 bp, Heterodera glycines
  Genomic contig location: Contig_ID=SeqID_5314; Location=331..976; Strand=+
  SCN-specific regions: Sequence locations=1-303,330-339,361-598,620-646
atgaaactaatcagtgatcagaggaaaatcaccgaacaaaaaagtgatcaacctgcgagaaaatgtgattagcggagttttcatctgaaattaaattattagactcgtaattacaaaaaattcagagatcgcttccggatttcatatttttatccggcaaattttatagtaaatttatttctctttttaaataaagcagaatacatacgttttgtttccatttataaaaaaatatcaaggctcagagatgaaaagaatgatactttgatgggggttaacagctgtgctttatctctaggatttcaacaaaaatccttaaaaattccaaattttgaaccgcttttacggttcatccaaaatcccattgttttttttggctaataaaatttccaataaaaaattctcaggtggccaaatgggttggaagtgtccaaatttcggcacgaaatggccacaatgggctggtcactgcaaatcaaccaactcgacgtggacgagtggcgttatcggagcagagaaaagtggacatgagaatggaattgagggatggatgaatgggacaatggaataagagcgatttgcttaacctttttttctcacattttaacactttttgttgcaaaatctttgcttttcatttttatta

SEQ ID NO: 57650 - DNA, 813 bp, Heterodera glycines
  misc_feature (17)..(17): n is a, c, g, or t
  Genomic contig location: Contig_ID=SeqID_5315; Location=2823..3635; Strand=-
  SCN-specific regions: Sequence locations=1-27,65-409,432-774,804-813
atgccgcttctcccggnccgagtggtcagcagcagcagtagaaatgaatgaatgaatttattggttgattgatgcgattatgtgaccgaaatgctgttggcactatgccagttcaatattgttttatgtacctcttgacctttgcttgttcgaaaatgtgtccatttccattgttttttatgtaaaattcattgtgagtatcgttgataaaagggctaaagacaaaaacaggctgcggcgctagtttaaagaaggggtcttttgaattttatcaaaaagtaaaaacaaaaagggggggaccctattggtttgtaaaattttttaatgtataatctagagtgtcacgggaccgggaatttttgccaaaaccgggacctcggtttttgtccgggaaccgggaaattttccaagaaaaaatagaaaatcattcatttaaatgatttttttgcccctatttcgcgaattttttacccctatttaggcccctattttggactttttcgcccctaaaaatcccatccctactcatcactcactcatccgcaatgtccaagccaccggcacccttcgtctgcacattttaatttgcgtttcccattgtttaggcatttttccgtgccaccacttctgccagtcacattttgttatttcgtttacccccatcagggcaaattgtgccatttgaattggtcaatgaacaaactcgagaaaaactgacattggaggaaggacgagattatcctaattggttgctgaagcgatgtccaattggacaaattaattaattaactaaattatattttctacaataaa

SEQ ID NO: 57651 - DNA, 953 bp, Heterodera glycines
  Genomic contig location: Contig_ID=SeqID_5316; Location=56..1008; Strand=-
  SCN-specific regions: Sequence locations=1-16,38-234,256-638,660-953
atgcgaatttgccaccgaattggagagaatggcaccaagcaaatgcgaattgtcaattccgaaggaaattcattgccaatcccgcaaattccgttgccgaacaatgtcgtcggattcagacgcattcagatcaagtaaaaacttgattagattcaaattgatttgtggccatcacttttcctgcttttcagttacatcgaccacaatgtcatcgaatttctccgccgttttcaccgttttttctctgcatgtacaacagaattggaaattttcactgcaaatgttcgcatttcggagttcgttttgctcaacatttttccaatgctacgcgattctattcgtgtaatgaatttaaacgacatcgcttttccccgtttgcttcaattggaaccgtcactgctcaccgattgtccatcacttcgttactttgaaatggagaacaaagtcccaataatttttctgcctgatgatgatagtgccaatgcgtcggatggccaagcggtgaccgaatggctgctcacgcctcgtccggatggtgtaccgaagatgctcaaatgtacaatgcgtgcgctaggtggtgacaaaaggtggtcagcgatggaggaacagctcagagcggtgacttttcccctcttaatttgtctttttgtatgtgtgtttcccatttttaggcattttccaatgcttcttcaccaatgactttccgtctttacgtaaacttcacaattacacgaaaaaagcggattgttcatattgagccatttgaatggacaaacgaagtgactggggagcaattgacactggaacaacatgagcggaattattttgcaatcagccgttgtccaattggatgggaggagcaaaattgggcaaatgtattgaatgaattaatggatgatcgacagaacccaattgacattgtgatcaaagatggcgaattcgacgaacggtga

SEQ ID NO: 57652 - DNA, 49 bp, Heterodera glycines; identical to SEQ ID NO: 51181
  Genomic contig location: Contig_ID=SeqID_26913; Location=703..751; Strand=-
  SCN-specific regions: Sequence locations=1-49

SEQ ID NO: 57653 - DNA, 721 bp, Heterodera glycines
  Genomic contig location: Contig_ID=SeqID_26914; Location=420..1140; Strand=+
  SCN-specific regions: Sequence locations=1-700
atggaaaatcacataattcctggaatcccttttcttcttgacggtcaaatcgccataaaattcttcactttgcgatatttcactagcaatcatcatccagcaccgtttgagatggatttcgacgactggggagtgagacacatgcactcgtccgagcaagggtatttcgccttgcgtgcggttgagttcggtgaccgacaacagttcgaatatgttcttaatttggcttcggccagagatgtgaagaaccgaggaaaaagggtacgcggctacaactatgggcattggcagacggtcaagagagaacacatgctgcgcgtggtcttggaaaaatttcggcagaatgaaccgctgtgtgaagctctgctccggacgggctttgtccgactcgtggaagccagcactgaccgatattgggccgccggattgctgataactgatgaagctatacgcagttcaaataattggatgggtcggaatgagcttggctgggtgttgatgcacgtcagagaccaacttcgaccattgccgcaacaagtccacctgatccacaagcactacatcgtatgccaggcggcagcgcctgactacgttgtggccctcgcagcggagccacatgttcagccgtatgctgttcggattaacaacgaaactgtcaatgctgcccgacaactgcaaattggcgatactttggtgatagaaagtgtggagtggagagaag

SEQ ID NO: 57654 - DNA, 614 bp, Heterodera glycines
  Genomic contig location: Contig_ID=SeqID_26917; Location=140..753; Strand=-
  SCN-specific regions: Sequence locations=1-124,164-195,223-364,386-581
atggaaatctttgacgaatttattgttgttgacgaaaaagcgatcaatggattctctggccaaaactatagcagatacaactggtcatttcgtgatgtgacccaatttgctgcactgtaatttcaattttttaaattttaaaattaaaaataatattaaaaaacaatcaaattttgataacataattggcctagcgtgatttttcacatttttcagtgattttatgacaagctgttatcccatattgaaaatcaaggacattggcaatgcttcttcttccaagccaaattctgtgccattggcacaaattatccgttgggattgggacaaaaatggggcacaacgggtcattagtgtaagtttaaagaaatgatcagcctttaaaaatgattttaatcaattaaatcatttagaccaatacactcaacaagggcagtgaacttagtttccacatctgtgccaatgattatgcttcatttgttattcgaattctcaaaaagcaggagaaaaagtaaatttggtaattcccggcggcacctatcggccggagtgggacaaaacgtcgtcggacgactttttggaccataacttttttctttcttaaccaaattaaa

SEQ ID NO: 57655 - DNA, 321 bp, Heterodera glycines
  Genomic contig location: Contig_ID=SeqID_26918; Location=225..545; Strand=+
  SCN-specific regions: Sequence locations=1-42,79-137,159-321
tttttgggccccggggtcgtttgggccccaacccaaaaatagaaaaatgtgcttttttaaaaattaagattctaaaaactaagcctgagggatccctcgccacttggcataaattaggtttaattaacattcgctcattttttacaattttacttattccaactcctattattttttaatagttaaccaatttgatgtgcattctgatttggacatttttcagaaatggctaacccaattgcaaccaaaaaacaaaaagtaaaattgtcttacgaaggccacctttacaccttcgctaaaatgagttctgattggatgaca

SEQ ID NO: 57656 - DNA, 367 bp, Heterodera glycines
  Genomic contig location: Contig_ID=SeqID_26919; Location=202..568; Strand=-
  SCN-specific regions: Sequence locations=1-36,59-111,145-185,207 -276,330-367
atcctgcactcgaattaacaccatttttttcaataaaccacattttcattatccattttctatcaagatcacatgaactttactatttcctatatttgtatcgcgtaaatcttataaaagatttaaataatattaattttttaagattctacaccgcgtctgaaaccttcaaatctgtaagtaaaatattttccacaaagtgctaatttttccgtttctgttgaatccattatcaaatgctttttttatcagagcattaataaatttcgatttatcatttatataactaaaatatttttaatgattaaaataatattaatttatttatagattctgcacgcgaattaacaccatttttttcaataaa

SEQ ID NO: 57657 - DNA, 370 bp, Heterodera glycines
  Genomic contig location: Contig_ID=SeqID_26921; Location=173..542; Strand=+
  SCN-specific regions: Sequence locations=1-370
atgtttctggccggcgaagtttttgcctgctccgcattcggagggagtactgtagtacagtattttaatctggctatagattaacgaaatttcctcttctctattgatttaataacataccttataattaaattaaacaatatacagtacgtacatggactaccatttggcgaatttgggccaactgtctccggcggtgacttctgctgctggcaacaatattgccgcaggcggcgtcgatttcttccagccgcaacttgcgcaattcaactcatccgccgcaattggactcatggcacaacaacacccgccaaaagacatcaaaagggagcagcagccaagcaacacgtgattattacactcacccaaa

SEQ ID NO: 57658 - DNA, 7968 bp, Heterodera glycines
  Genomic contig location: Contig_ID=SeqID_621; Location=1812..9779; Strand=+
  SCN-specific regions: Sequence locations=1-163,185-246,269-554,587 -1305,1327-1439,1461-2500,2522-2650,2672-3968,3990-4278,4300 -4955,4977-7324,7346-7584,7606-7968
atgtcggctgggattagatcagttttaggtcccgcaacggctagggttagaacgaatttgaatgagggactagcgctcttacacaatcaaaatgttaccgccgaagcactcatccgtgcatctgaaaaaatcggccggagtgttaaattagtccagggatacatgcgggactgggacagaatcatggctgggttagacggggacgcaagaactgccgaggaagcggtttatcttgggtttcgcccaggcggtgaacagctcggagagctcattgttgaagccaacgaagcggtgaccgaattggatctgcgaaccgatcaattgcgcattcaagtcgcaccaatgcaaccgcaacaacatcagcaggcagtccaagtgcaaccattcgtcgcacatcgcccggtcgtcccattgcccaccatgggactcttggatttcgatgggaccccatcccgttggagttctttctgggccaattttcgggacaatgttgaccatagaaacgatttatccccggctcaaaaattgtgttatctcatgggacaattgaagggccccgcaaaagacattgttttggggtattccactacggacgctgattaccccatagtaaaggaagcccttgtcgggcggtacggagatgagacaaaacgtgcccacgaattacgggccgaactcatccgacttccaaaagcgaacgccgcaactccgtctctccgtttgttctcggaatccgtcgaacgtatttgtcggcaactcaattcgttggaagctggccttgacgatagtccatacctgattacggcattaatggaaaagttgccaggcgaaatccgtctaaaactgctcgagcaggagagagatggtggtgccaaatggacagcccgccaatggaggcttggtctttctggactagtgcagttaagggaagcggtgaatatggatcgcgaaaatatgcaccgccaaccaccgaataatggcggagtaggggagcggcgccaaaacagccatcaaacatttcagacgcagcctcgccgggctttcccggttgtcaagccggttagaccggaaattcgaaaccccacccctccgccacgaaaattttcaccaaattgctctttgtgcgagagtggcgatcacaagccgactaattgtccgcgttatttcaccgcgaaaaaacggcagcagcgattaacagaacaaggtcgctgtcatttgtgcattagaagtggccattccgcggccaattgcgcaactaatttcaaatgttcaaaatgtggtgatcggcatcacttaatcgtttgtccaaaatttcgttctgaacagtccaccactcaaaatcgggactctcgaagcgtccatttttctggtgaaaatagaggcggcatgcgccagggtcttttagcctcagcgccggtgtcagccaccgctttgtcgcaccctggaaaaaagagaaatccatcatatttaatggtaagaaccacgccggtgtataactatcgggaacccgccaatcccacaagagctccagttttttgggaccctgggagccaaacttcatttatcgccactgatttaactaatgaaataaaaccgcccagagtttcttcagaagaaatgattgttgggggttttatcggtaatcaaaaggaaacatattcccgtttccactccccgtgctactctgttatgcttggcagggaggacggtggttgggagcaaattctgcttaaccaaacagacagaatcacgccgcctattgagtgtttggtagaaccaagaaattcaaacgaatttttgagtggtgatgaccaggaagggcctatcccgtattttttggaaccaaaaatcatgatcggagttcgtgaattctggcgttttattctggatcgtagggaaattcgaccgggaatttttgaaatccagacagttttcggaacgatttatgggggcgaagaaatggcagttgcctcgaaccccgggaattcgctaacctgcacaatcattcaatcagcacacattcagcctgagtcggacgtcggccgcttctgggcattagagtcaattggcataactgactgtccaaaattgaatgatgatgaaaaggcactgaaaaaatttaatgagtcagtttctgctgaccctgaggggcgttacgaggtagctctcccatggaaggaggagggagagtacccggcggaaaatttcagattagcattttcaagactttctgcacttatacggagactgaaggaatcgccacaactttttagcggttgtaacgacattatacaggaatatttagagaaaggaataattgaaaaggcccatcgcgctaaaagtccacaacatttcttgccccaccatacagtgatgggcaaaaagcttcggatcgtttttgatgcttcatcccacgaaaagggtgcccaatcattaaacgaaatgttattttcggggccaaatctctatcctgatttagccggaaaactcattcagtttagggccacaaaataccctatttgggccgacatagaaaaggcttttctgatggtaagtctgaaagaatcggaccgtgaattttcaaaatttttgtgggtaaaaaatatatttgcaccactttctggggaaaatctcctcgttttccgctttcggaggataacatttggaatagtgtcttgcccttttctattggcagcgacactccaacatcatttggaagcatttcccagtgagttagcagaggaaatccgggaaaaatctctgctttacgttgataaccttctgcttttggctgattcgcctgaggaagcacgcagaaaggcagccgaagcacaaaaaattttcgccgcggctcaaatgcgtctgtgcgaattcattgcggctgatccgtcaagtttggacgaaatacctgaaaatgatcgcctccgaaatgaggcaccaacggttctcggactaaaatggactatttgtgaggacaatttgtctttgacttttcctacggttcctagtccggacggtttaacccggagaacggtcctaaaaacagttgcgtccttttttgaccccttagggttatgttcgccttgtttggttggggcgaaattgtttttccaaaaattatgggatggttcaaaaggctgggacgatccaatcccagcggaagagaccaaagaatgggatgaaattaaagccctctgggcagcaaaaacgatgcacatagcgcgcttcacgcctcgaattaacactggcggaattcaattacatgttttcaccgatgcatcacctaatgcgtttgcctgcacggtctatttgagagctgaaatgccgcagggaattctctcgtcgttggcttacgctcgttctcggctccgcccgaagaaaatggcggtggaccaggcggatggtctcactatcccacgattagagctacttggaatcctaatcggatctcgggcagtaaaatttgtgcataaacatttaaattatgagatcgaacaaattaatctttggtcagattcgcgcattgcgctttcgtggctagcgtccaccgataaaatgccgatgtttatagcgaatcgtgttcgagaaattcgcgccaatcggcacataatcttccgctatgttcgctccgcggacaatcccgcggacctcgccacgcggccagtgacacctgatgagttaaaattatcagaattatggtggagagggccaaattggctcggcaaaacacctgaaaattggccggacgaactcaccgtcagcctcccaccggaggaaagcgccatttcagagccaattgtctgcgctccgttgaccactccgccggcagtgttcgattttgatcggttcagttcatggcaaaaactgatcagaacggccatgtacgcgttgaaattcctgtcagaaacgggaaaaaagaggaaattgctccccgaatttagagaggctgaaaattttagcccagattgtaataaattcacacacaattggatcattagaatagtacaggggacttttagccccccaaaagaaacttatctggataatgacggcctgattcgtctcaaatcaaggctttgtggcactggaaacccgggattcgaacatccaattgtcatcccatcagagtcgtgggtctgcgcccttctcattaggcattcacatttgaatttgtgccacgccggtgttgactcaaccttgacagatttcttgcaaaattattggtgccataaggccaggcggacagtccgctcggtcatcttcagttgtaatatgtgcaaaagggatagggcaaggaaatttggactcccgcctatgccaccccttccgaaaaatcgcacatgtccctctgccgttttcgaaaatgtcggcatggattttttaggtccaacactttacaaaatacccaatgaacagcccgcaaaggcttgggtcctattgatcaccagtttggcatgcagggcggtacatctcgaattggtgtcgtccatgtcagcagagcattttttgcttgccttccgtcgctttgtcgcgcgaagaggacttccaaaatcgatcctttcagatcacggttctcaatttgtgttggccaaaacactttttgagaaaaacactgaagtgtccatcaaatggacgctaatccccgcatttagcccatggtcgggcggggtctatgaacgactaaattctctcataaagaattgttttcggagagttttaggccgacgactcttgagctgggaggaaataaacacatttttagcggaggctgaggcctcgatcaactcaaggccgatcacttttgtatcagatgagtctgacggtcctctgccgctcagaccaatcgattttattgctcctagagcaaaccttgaatttgaaggaacggatatggaagacgaaagttatcgtccatcggctgctgaaaaattagccaccagatggtgggcaacagctaaatccattagaaatttttgggaccgctggtccagcgaatatttgctcctcctccgggagcgtaatcaaacagcacataaaggaccgcaccttaattctaatgtccaacccgaacttgggcatattgttttagtggaacgcgacgaatatccacgaaacacatggccaatgggtagaattgtgggactgaatggtcccgaagggcatccccgtagtgccgaaattaaaatgccaaatggacatatttggacacgtccggtctcaaaattagttcccttagaggtaaatccggacaataaagacttaaaccaggccctgtcgccgcggggagattcccgggagggaaatgaggagtcaaatgaagaattaacgagaaatcagcgatcagaagaacccgttgaaatggggcctgaattgatcaatgagtcaattcggcccaaggccaaattcagatgggcgaaaaatccgcctattcaaattcaacgggctagcaagacgccccgagcattaacatcgtctccagcttatttgttgtccatggtggcgattttcattctccttggggtaccgattgccgacgctttcgccctttcaacagcaaatcagcagtcgaatcagtcatcgtggataacctgtaatatgaagggggtcaaaatagaggccccagaagggtctaaaaacatagaattatgctgtgatgggatatgtgggaccagaaattacataaaaccattcgttttcccattactggaggagagtctcctctccggcttttcatgtcgggccacttattggtcgccacctgataacaccattcaacaaaatatagaatgtgcaccaatagacgtatgcactttattggactgctatttatgtgaaagccgaattttaaacgcacattgctcacccgcaatttcagcaatcctgattggaattctggctcttctggccggtttcatatgctgtgcactttgctgcttgttcagatggagcgcctggtgctacaaatcgcttcgaatgattgtcaaatgcatttttcgatgccagaaacacaaaaacctaaaatacacacgactccgaagggaatcctatggggataatagtgccgaagagggctattcgccacgaaattactacaggacaacgggtaagcctttaaccaaattgggctatgcattggccatttcggtcatggtttcaaatgttggatggactcatggtgatccagtttcgatcacagccaaaactgaggagtgtgaaacgagtccaatcagtaccgaatgccgtttaaattcggtgactttgttaaatttactcccggctggtcaaccggtggatcttatagtccggacaacggacgctgcggttttaggcaaaatcacattcaaattaaagggattagtacaagaatgtattcccgagtcggtgggattcattaggtcgtaccaagttaaaaccctggcgagcaaaagatgcccagggatgggctcatgttccggcaaaacctgtgaaaacttgttgcccaacggaaccgtttcagaattggccgaaggtaactcattcccaggtaattccttctgcttagacagcagcagcttttggttccatggatgcggtggaactaattccgcttgcttgtttttccgtaactacgcaactccgaccctaactggggaaggttctgtttatgaaatgttcagatgcccggcatggcaattccgaattaaaacggaaattaaagttagcttcagtgggggcattactattagtgaagagacagagctttactcgggtcgtacttttcacataaaaggggctaatttgtcggtcactccagccgtttttggcaacccggcggctccaataatgtccgaaacattttttggcggatcggacagtgctgttctcgttccgaacattgaacccgctttacattgtagaaacgaattagatgcgttgttaatgaaatgcgccctttcgttggacgcatgcacaaaatgccgtcccgatcacagcgaaggtattgttcgatgccactgcaaggaagtggacatcgaaagatggcggaacgacccgtctaaacgattaccactctcggtcggccctttaactcttaattatcgtaaacctaggcaggtttgggcggagtcggaatatgtacccgttcaaatggccttaaaaatggagggtttgactctaagcattcggaaagatatggccaaatgcataatcacaccagggggcttagcaggctgctatggatgtcggatgggaagccgttttaacttcacttgtaaggcatccctcggtaatcccctggcagatataatttgtgataatggtgcccgttgggttacacattgtccagaaaattcaataaaaatgaatgtgtcattatccctaaatgaaggggaggtaaaaaccgtttgccatgtatcttgccccgggggcattaccaattttacgatggaaggacttttacattatttgcctattgttagaggcgaatggaagatttctggaaataaagtcgaaagaggttctcaattgcccgacttttcgatactagaacatttttatcgagttttgagttgggtcctaggcggacctcaacttttcattgttgtgtgcgttttttgtgcaggaatcttcgggttgtacatttgtttgaagtgtaatccaattttccgtgcctatcgccgattgattcgagtagtcactctgatcaccatcttgttgatcactgcaccattggtcacatgtgatgagggcaccaaagatgaagagacgatcatcaaccagtcatggtcacaattcaaatttttgctttccaaattcaaggcagaattagcatggggcacttttctcattctggcatcggcaaacgtatatgccatttacataatctataaggaatggaccatacggcacggtgagccgcagagaaatcccatacgaaaggacagagtccagccaaggggtgatagaattatgcccggctttcgcctttga

SEQ ID NO: 57659 - DNA, 1274 bp, Heterodera glycines
  Genomic contig location: Contig_ID=SeqID_621; Location=10007..11280; Strand=+
  SCN-specific regions: Sequence locations=1-28,50-530,552-774,801 -914,936-1171,1194-1274
atgtctcaacaaaaccaaccccaattcaccgctcctcctcccgctcccctctatccatacggctatgcgccgcactatggctacatgccaccacatgccccaatgggctaccaaccagtgccaaccgcaccaccgcccagttttgtgccacaacagcaggaatccgttccacaggctcatccgcagggcaatgcgacggttcaggcaaccgccgcgcaggccattccgcaaaattcggcctctgttccaccagcaactgccgcaccaattcaccaggtgcagcagaacaacaatggtcagggggtcgtcccccaagcgggccgtcaagcccaggacatgcaccagagcggaagccgttcacaggtggaatccatcccctaatttttttcacatattcctttattacctgtttcttccctccacaaattttccttccactcacgaattttatcattaaccatttcccagcacggaccggctccgtacgcattccgtcgcaaaggaaaattcggcgttgccaaaccggtcaatttcgggccccctccggccccgattcctcgagtttctgaggtgctgctccaattggtgaccgagttcaccaacttcaccaccgaatacacgcgcaacttcaacgcttttgcgaccagtttttcgtgtgattttaacaattacgcgacggagttcgcgcagttctcggcctgggtccgagagaatgctcatcaatttgggggcaaaaacgcttccggccaggcggctaatgaaacagaagacaaagaagaggaggaggaggaggaagaggaaaccgaggccaacgatgcctaagaaggaaacccctggctggggggaacttctgtcatggacagaaattttgttgaatccatatataatcttgatcgtataaatttcgcttttccttaaaagatttggattgggaattttgccctagtcggacttttttaaaatatggggatcatcttcccacctaatccctgcgtttttcccatttttaaatatcttcgtggtcagtacgtagcgtaagccggtccttggtcatcaacaatttgccgaacgcccaactcaacggcccgcccatggatcagcttgtccgacggatggccgtataaaagaaagacgaaggaatgatgctcaccttcttccactacccttttccaaagtccaatttcttcccccaaaatttgcttttgctatccaattttcaaagatcgtattcaagtgatcatttttcatttcacatttcattttcttggtgtgta

SEQ ID NO: 57660 - DNA, 610 bp, Heterodera glycines
  Genomic contig location: Contig_ID=SeqID_621; Location=11608..12217; Strand=+
  SCN-specific regions: Sequence locations=1-389,419-610
atggaaaagcaacgggcggaggcggacaaaatgaacaacaggaaggcatttttggcacgaaaacggggcgaagtggcggcaaacattggcaaaacggcggcggaaacgaatggcaccggcggcggcactgtggcggaggagaaggacgaggatttggtacgcattcggctcgtgttcccgagttctgcccgcatggaacagaactttcgccactccgacagtctcgaggtatgtttttttgtgtgtagttcgacgacagcaagcagtccaacagctggttattctcattgcatcaagaaaaaagattatttccatctttcaagcgttttatgatgcattaaaaagtttttcacaaaaattgttacaaaaaatcgctaaaaacttttttgaaaaatttttttttcttaaaattttataaggtttttcttttttgaaaatttccgggatgagggaatagggacaaaacaaacgtcaccgaccgaaacgtcaccgcaaaatttttagttaactagccctaattcgaacaaaaaaaatttttttttagaaaattcaaggaatgaaacaaattcggtggcaggcctcattttgggggtgtactcgggaaacgtag

SEQ ID NO: 57661 - DNA, 478 bp, Heterodera glycines
  Genomic contig location: Contig_ID=SeqID_622; Location=1424..1901; Strand=-
  SCN-specific regions: Sequence locations=1-388,410-478
atggcgtgctcagcaggaagcacgaaaaaaaccaatttaagcaaaaatcagcatgaaaaagatggacttagaagcctcaaactaagttagaaatgcgtttttcatgcttattagcacgccccaagttagcaaaaaatttcagcaaatgctgcacaatccggtctctacatactaatatttcatcaaaatgatttcattttttgttatttattgtctttgtttgtgctcattttgtttgatacttgcattttcctcaaaaacggcgtgaaagtggacaccaaaaattgtgacactgaaaagcgcaaaaactgacatcatttaacaaacgaaaaaatgaaatgacgtcggaaaaatgtcatattaattgtacacactcaagactctcgagtttctccaaattttaaattaatcagattgcaaacgatggcgactttttgccggtctgctcaacgatgccaacttttttatagtaaataaa

SEQ ID NO: 57662 - DNA, 1204 bp, Heterodera glycines
  Genomic contig location: Contig_ID=SeqID_26922; Location=307..1510; Strand=+
  SCN-specific regions: Sequence locations=1-272,295-1097,1163-1204
atggaattgttcattttttatcacgacgaatacgaacggttgtacaattgcaccgggctgaacattgactccgtccctttggagcagcgccaatttgtgcccgagtcaatcgcaattagcattttgtgcaccatttactatgtaattagagaaattaaatgcctaattaaattaatgtaaaaattaaaaagccgaatagtaaaatattcgaagtcagattagctaggttttttgatgattttgcattaatcgaattcacttctttttaatgatttaaaattttaatagaaaaatgactcagtgttaatgactaataaatttgaagaaaatagaaaataatcacagatagaaagagtactgtattgtctgattcaatacgttgagatactgtatctgccctgtatgtactccatatggaagcgtttgcgtgacaattcctgctacaaattgctgttctacatcggcatcactgacatgggcattttgtggattctcggcttcttcagggcatggcttaacctgcatggatatgtgttctgctcctatcccacactgatttattttgtcggtgttttggtaacaggtgagaaataattattagttattagtcttatattaattgaataaaattttcgcttatatctctcagtgaaaagtaggactggttcattcccttatttgctagagttcccaggttccggtttttgaagagtcaatttcccggtccgggtcccggtagaataacgggagctgggaaaatttgccattattaggttaaaatttaaattttgactaaaaaccccaaaaaaagcttttctgacaataaacaccaaaatgagtatttatccagttcgttttttctgattaaccccttttccactgatgaaagtttttgctaccggtcttggtattggttttcttaaccctcttttgcacaaaacttttttttaatttctaaactctcaccaaaattaaggaattttcggacaagttgaaaatctaagtaaattatcagttttttgaaccaaggtaccgaaaaaggtcgggaattggggatgagagctcggggtcagggatttctattgaaaattaagtggatttaaatttagtaatattttatttaataatgttttctcctttatttttataattaaaaattttagccctttggatggctgaaagcactgctgatttggtaggctaa

SEQ ID NO: 57663 - DNA, 334 bp, Heterodera glycines
  Genomic contig location: Contig_ID=SeqID_26926; Location=48..381; Strand=+
  SCN-specific regions: Sequence locations=1-334
gcggcaaattatggcattgtgttggactccctcccaccgctcgatgactactaccccggcggacacttccctgaggagctaaagaagccggagcagtggtacgaggagaaccgcaacacgccgtttgacctgcgcgaagtcattgcggattactgcaaagcaggtaaaaattgggcatcaaaaaaaaatatgcaaattttcttcagatgtccaaattttggcccatggaatggccaaaatgcggcagctgttcgccgctgcaactagccaggagctgaccgactccatcaccatggcgtctgttcgacttcacaagggccaacgggaccactga

SEQ ID NO: 57664 - DNA, 245 bp, Heterodera glycines
  Genomic contig location: Contig_ID=SeqID_26928; Location=69..313; Strand=-
  SCN-specific regions: Sequence locations=1-245
atgagtggccaacaaaaagcggaaggattattcccagtggacgaatgcttcgggacgaacatcggtcgcccaatagccgaactggtcgatgagaacggattcggcagggaaagccgagaagaattggtctctttcgaagagttcgtgcggggcggagacaaaaagcgaggcaaaaaggagaaagacgaaggtgaaaaaggaacaatgggagttgaagcggcaaaaagacaattaattgttgaagg

SEQ ID NO: 57665 - DNA, 312 bp, Heterodera glycines
  Genomic contig location: Contig_ID=SeqID_26931; Location=157..468; Strand=-
  SCN-specific regions: Sequence locations=1-73,111-205,227-312
atgatggcccgctgtttgcccggggccaatgcggaggacacatttgtcgtcgacgtcgaaagtatgaaacttcaaatttattattagaaaaaaaaaagaaaaaaatttttgcagatacatcacactcaattaatctggtgaattattcggacaccagcagcaacgagacaacttttacctggtaagaatggagggggggggggggtaaaattttcattgaaaattataaaatctgttttgcatttcagcacaactgatcgtccaaaaagaaaagcggctgaaaaagccatgatgcttttgataaaaccgtaa

SEQ ID NO: 57666 - DNA, 560 bp, Heterodera glycines
  Genomic contig location: Contig_ID=SeqID_5320; Location=847..1406; Strand=-
  SCN-specific regions: Sequence locations=1-98,218-262,284-535,559-560
atgggagaagcatcgcggcaagagccgacaaaactgtggaaccgcgtcattgtggacaatttgactgcgcgacggttgagacgcgagcaaagcaataggaaagaggaggaaaaagcgacggaagaaagagacgaacggcacaaagatgaggaggagggggaggaggaagaaaagcggagggaaggagaggaaaagcagggagaggaaatggaagaagcaatgggcacgagtcggaaacaaagtgagaaaagagatatttgccaaatttattaattaatatttagcaaccaatttgtgtttgtttgttcagagcacaaacgatcattctccggcattctgtcaaaacttatgccgagaaaaaagtcctactaacaaaacaacggacaaaagctgaaagaaggcgcacaattagggagagaagggtggcgaatgccttcttcaggaaaatatgccgtttttgaggaagggaaaacttttacattctctcctttgacattgtaatatctttccgagtacgattgttgtaaatcgatttattcattttaatcataaaaaataaa

SEQ ID NO: 57667 - DNA, 984 bp, Heterodera glycines
  Genomic contig location: Contig_ID=SeqID_5320; Location=2545..3528; Strand=-
  SCN-specific regions: Sequence locations=1-544,567-578,642-984
atgtccgccgtttgttggaacccaattctcttcgcttggctgggcgccaggggaaaagtgagaaatcgtaaaaataaaattccaaaagctaataatacggtaacgaaatttgatgcttttctatcataggaccgaaccaccgccagcaacgcggcgattctctccgccgccggaggagcaccatccgaaatgacagccaacaaaaagaacagcgcattgaccgttttcattggaaccatccgacggcttagccaaagcgaactaacggcacaaccgaagcggagaaagggcgaaaggcacggggaataaatggcacaaaagaaggaggggaggggggggggggggaatcaccggcaaatggcacaaaagatggaggggtggggggggggggaatcaccggcaaatggcacaaaagatggaggggtgggggggggggggggaatcaccggcaaatggaacagagttgggggggggggaatcaccagcccagaaaaacttaaatacgaagggttaaactgaatacgcatttatttggttggccatttcagccaaagagaagaaagattaacgtatcattgaatttttttcaaaatatttaattcttaattttttaaattctttgaaaattttagaaaaaaattctgctcacagtgagcgaattgcggccatttccgcaacaaattactggagaaaagcaaaactgcaacaagcgaaaaggacagggtcggttgtttgcctctttccggcaataaaattgccgacggaaatgactcattaaaagttgggaatgcttaaaaagctatcatttttattttgaatttcagcccattttttcgtgtgaaaagttccaattgatgcagccgaataatcggagatgaaaatcaacaaattcaaacattttttgatcgtatttaagagctatataatgaattctaccgttctagacttttatgaagaaatttaatttatgtaaaaaacaataaa

SEQ ID NO: 57668 - DNA, 280 bp, Heterodera glycines
  Genomic contig location: Contig_ID=SeqID_26932; Location=971..1250; Strand=-
  SCN-specific regions: Sequence locations=1-56,78-125,150-280
attttttaagaaaaaataggagttttgagggcgcggcggtgccgataggcgccgccggggaaaaaattggaaattttgatcatttataaactggttttcactgaaaattagccaatttataggtaaaattttgaaaaattttatgggaatttaatccaattcttaggggtgtaaaagtcgcttttcgcgccaaaaagcgaaatgcgaaatgcgaaacgccaaaaaatgcaaataatgcgaaaggcgaaatgcgaaaagcgaaacctaggcacatccctgc

SEQ ID NO: 57669 - DNA, 558 bp, Heterodera glycines
  misc_feature (555)..(555): n is a, c, g, or t
  Genomic contig location: Contig_ID=SeqID_26933; Location=6..563; Strand=-
  SCN-specific regions: Sequence locations=1-13,36-94,117-136,159 -352,409-412,434-558
atgattttatggcatttaatatttgttatatttttcattgcttttaaaattgactccggcaaaattcaaacaaattttgacgaaatatttggcgaaggatggaacaaaaatgaaagagaagataaagttataaaaatggaacaaaatgacccaaatgaacataatgaaagatcagcagcagttgatcaaatgggtggagaaatgggaaatgacccaaatgatcaacaaaaaagagaaatcattcaaaaatttgatgcaattaaagaaaagcttaaggaaagaggaaaataccactgggaaaatacaaccaacattgagaggaaaattgctagattattaggcgcaaatcgccataaaatatataaatggaaaaaagaattaaatttaaataaaaagaaaattttttatgagaagaaaagaaaagaattcattgaacgaattgatgaattcaaaagtttatacgacaaaggcaaacagaaagaatttgtgaaggaattgggcatttctaatgtgacatttcgtaaatggaaaaaagaattaatgccaaattgtcantaa

SEQ ID NO: 57670 - DNA, 348 bp, Heterodera glycines
  Genomic contig location: Contig_ID=SeqID_26933; Location=1503..1850; Strand=+
  SCN-specific regions: Sequence locations=1-348
  Gene Ontology: Biological process=N-linked glycosylation
atgtcttgtgaactgcccgtcaaccacgccgatgcccatctccctctggctgcagccacggcagaagaacggaagaagaatgccaagcggaaatgggaagagacggtcagagtgaaaacggaaactgtcgacgaaccgaagcagaatgagccggaagaaaatgccaagcggaaacgggaagagacggtcagagtgaagacggaaactgtagacgaaccgaagcagaatgagccggaagaaaatgccaagcggaaacgggaagagacggtcagagtgaagacggaaactgtagacgaaccgaagcagaatgagccggaagaaaatgccaagcggaaacgggaagagacg

SEQ ID NO: 57671 - DNA, 921 bp, Heterodera glycines
  Genomic contig location: Contig_ID=SeqID_26934; Location=45..965; Strand=+
  SCN-specific regions: Sequence locations=1-401,423-427,450-530,580 -686,708-921
atggtcattcgagacacagaacaatcggaaaaaggtgccaagtcgacagagagagtgtgccaaacatttcgatttgccatttctctgctcaattgtttatggaaagaaatggacgaagaacggaggaaaatgttggcaaaatggctaaaggacggccgatggacagaatttgtgagaattgtgaacggttggttaatcacttcacttagactaaaaacatttagcttttgatcgggagcacattagacaaattggcagagggacaaaaccccaaattggccattgacgacgcacaattgttggagcagttcaaagtgccgttccatttgaaactcgtccacagcctaacgatttacagactgctgaaacgctcttttcaattctcttcgtttttttgtggccaaaattttcaaaaatttaacgaagtcaaaaataatctgttcactttgctcaattcgtccagtgaattcaattggttggaacggaaattcccttttgtgctgaaaattggtaattattaaaaagcaaagaaaaataaaatttatttttgaatttttagagaaaatgaaccacagaatgcgcatttatttgtaccgaaaattgataattaacagaagttggagtgccggatcgctggcgacccatgcccgaattattttgccattgttactggaagaacttgacacaaaaatatacaataaaaatatcgcaaaatgtcgaatttttgaggagttggaagaactattgttaatcatcaagttcgaggtgttcagagcaattgaaagttttagcagtgtttgttggcttatgtacttatggcaatacgttgaggggtacgacgggaggacaatggagtcgacgaaagagatgccgaccaggcaaatgatcgacgaatgtaccaaactcaatgccgcgatgccg

SEQ ID NO: 57672 - DNA, 167 bp, Heterodera glycines
  Genomic contig location: Contig_ID=SeqID_26935; Location=10..176; Strand=-
  SCN-specific regions: Sequence locations=1-167
ccattttgtcttattttgtaaaaaagtttgtgagccctgctttggacatgattattgcggattcgcatttgattatggcgaatttggatttgattatggcgaatttggatttgattatggcgaatttggatttgattatggcgaatttggatttgattatggcttga

SEQ ID NO: 57673 - DNA, 1725 bp, Heterodera glycines
  misc_feature (1620)..(1620): n is a, c, g, or t
  misc_feature (1712)..(1712): n is a, c, g, or t
  Genomic contig location: Contig_ID=SeqID_26936; Location=1..1725; Strand=-
  SCN-specific regions: Sequence locations=1-185,293-345,367-373,395 -413,435-541,563-658,681-1009,1032-1285,1307-1725
atcacttcttaattggtccaaattggtcaccctcaacttgttcccccaatttttgcagcttttgggcgcaatgctcatcgattggctggacgattcggtggacttcccaaatggcatttacttcgccttcctctgtttaactgccattgaatacggcaaattaattcctacggagtgagttgaacaaattaaaaaaaaaattttctaacaattttttcaaattttatgatgaaaataattaaagtttaaaaattaaaaagttttttatcatttaaaatatttgaataaaattgatcagaaaccaatgatcaatttccctgatcaccccctgtccatttttaatggccaattcatttggccaaaaaatgattttaaaaaatttcctaaaatttaagtgctctctatctgccgctggtgatcggctacatttgctttggccttgccatttccaccattgcacttggcaaaaaaatagggaaatttttttcgggttttcaaccgaaaatttttcagacattggctcaacatatgtgaaaaaattatactatttgggccaaaaaattcggaacattgccagcatcaaaatttggtttggtgccaagcatttgcgagtgcgtgatctgctcgccgcgctcgggcacaacatcggcctggagccgacagtgctgtgcgacttggacttggagcaactgatcacggtgggcacaaagtcaatggaaccacgttgggatagggatggcataatgccaaatgggaatggcacaatgccaaatggtgtaggggatgggcatggcacaatgccaatggggatggcacaatcccaaatggggaggtgatggggactggcatatctcgtggaaagaaattgaatggcacaacgccaggggtatgaatggctcaatgccaaggcgggggatggcataatgccaattgtgagagttgggcgggatggcacaacggcttagggtggagaggttggtaaatagttgtggacaagcttgaaaatgatagaagatttgagaaaggaaggacgagaatggcacaaagtcaagggatggacgagattggcacaacgtgccgccatcgagccctaaattttgtaactgattttcagaatgccattcaagtgaaggagggtcggctgcaccgagtgccacagacgcacatggtatgccgatttgttcaccaaaaacaattaattgctttaattaataattaaaccaattaagataatggatggcatttggccacccggtcagtttttttgtgccgtggcacggcggggattgatatttttctaagaaatcatttggcacttttttggttaacagagttggtcccgctttttctcaaggatggcaccttccctggttcgttcatggctcatcataaagcactgagagttcattgatttatcgtgcaaaattaatcaataaaatcaaacgattggctaatcaatcgataaatcgctcgttggcaccacccccacagaatgggtggacgcggacgagcggcgcaaatggagcgtggccagtgcaatggtgcgcaaacggagcatccggcacggttctactactaccgcagcgttggcacacccatttttggttggtgtgccattanaatgggatggatcactgtggcattttgtattagtgtctttttggccagatttgctacaccagagtaatacagtaaccgcttttttaacattntcatgacactgct

SEQ ID NO: 57674 - DNA, 194 bp, Heterodera glycines
  Genomic contig location: Contig_ID=SeqID_26938; Location=252..445; Strand=-
  SCN-specific regions: Sequence locations=1-194
atgtctgaagaagacacaaatacggaaaaatttccttcgtctgaaacggtcgttccatttttgttcgaagaaaatgaacaaattgcggcatcacattttaattatgatgacaatcagtccgggaaatgggttctatcatttcaaattgatgatgagcttgacacaaaatggaaacgcgcccgacaattgtacaa

SEQ ID NO: 57675 - DNA, 412 bp, Heterodera glycines
  Genomic contig location: Contig_ID=SeqID_26939; Location=554..965; Strand=-
  SCN-specific regions: Sequence locations=1-87,130-204,226-412
atggcaaagttcgcctccaaagtggacactgacggaggagccaaggcattttattgtcaggtcaaacagctcacacagcaaaaggtgtttatttaacaattaattttttatgtataactattttttaatctttttctttttgtatattttctcttttcagccccttttggtggcctgccctttggcgtcagttccttcaaatgattttctttcttcctcaaatctgttcgattttttcctcatcgacgaatcgtttgaactagccgacacagaactgatcagaccacttctgttagccgatcgctttacattatgtacggcacataaaactcctgctaggttggcactttcatctgcatttacatttagtaaacagctaatttctcattccttaaaaggcattctctgctga

SEQ ID NO: 57676 - DNA, 559 bp, Heterodera glycines
  Genomic contig location: Contig_ID=SeqID_26940; Location=253..811; Strand=+
  SCN-specific regions: Sequence locations=1-96,141-145,167-398,422-559
atgtcttcaaattttatcggttcgccaaattgctttttccgtccaacagctgatcagggtaagagaaataattaaaaaaagaattacgaaaaaaggaaaattattttatctgttttaaataaaataaaataaaaatttatcaccattagcagcagcagcagaagaagtggacaagtatgaagtgttcagttggcacggagatttgagcgaccaattggcagcacaatttttggtcagtgatcagcagctgttgaaggtgggacattttcagaacggacaaatgagcaaagtgggggggggggacaaatgagcacagatgggggggggggagggggagagaggccggacggatcagtcacggacaaagggccgaccaattccgagagcaatcaagagacattttgccaaaaatcagacaattaatgagtgaaggaaattggaaattatttagtggactgaaaaactttttttatttaaggaatgccgagaaaaacttgccagtgccgaattgagagaaacgaaattgctgtgcaaaaacggggaattgaatgcagagaat

SEQ ID NO: 57677 - DNA, 648 bp, Heterodera glycines
  Genomic contig location: Contig_ID=SeqID_26941; Location=55..702; Strand=-
  SCN-specific regions: Sequence locations=1-181,206-648
atgatgaaagaagtatttgaaaaagcagtagaaatttcaaaaaatactgactgtgaaattcctgacattacaatgttatttgatgtaagagaaggaacagatttaaggcgctataatataccgaaatcgaatgaagtttgtgctatcatttttcgtgatgctaatgatgatatacctgctgcaaattatttccttttaattttgcgattatttgcaccttatcattttaagaacgcacctctgatgagaagggaaaagaaaagaaggacaaaaggaagaaaatgtgaaaatgagtgataaaacatgccaagagagatgagactgttaattgaattgaatgttgaaatggcattttaagaataagaagcaattcaaaagagtgaaattgaatttgttaaggttttgtctaacctgcaaaattgtgcagtttttgttcaattttttaatcttgtaatttttgaaaaattttgcacaaaaaatgattatcgtcaggttttttttcaaaaagtcacaaaaaagctcattttacatgaaattttgctaaataacacaaaaatgtggtcagtactccaaaaaaggaaaaatctcacaaaaaagaacattcttacaaattggctttttggcaaaacaccaaatataattaataaa

SEQ ID NO: 57678 - DNA, 435 bp, Heterodera glycines
  Genomic contig location: Contig_ID=SeqID_26941; Location=704..1138; Strand=-
  SCN-specific regions: Sequence locations=1-12,34-95,117-168,200-435
gaagaaaacaacaaaatcaaaggaacccaagaattttatgactgttgcaactatggtaaaaacagtaatttagaagaaatgatacaagaatacccaatggatttgcgggttttatttcaacctgaaatagaccaaaataattacacacaaattggagagttacacaatgatttcaaaaagaaattaagatatttaaattcctctttttcatgtgcgtctttgggatgtatgcgatttaaatttcctgataaaaatgtgccaattttcaaaatacaaggtagcatttatcattcatataatagtgttgctaggccaaatgaagaagaactaccgacgaatggacagctttattttatagatactgatgaagcgattaattatcgattaagtgcctacaaagaccaattaacgaaactttcattcccagtcatataa

SEQ ID NO: 57679 - DNA, 216 bp, Heterodera glycines
  Genomic contig location: Contig_ID=SeqID_5323; Location=822..1037; Strand=+
  SCN-specific regions: Sequence locations=1-216
atgcatgaatctggagctgtacaagctcagtgagaattcagagttcaaatctaggtccatatttgggctgaccgtggctagtttactcagaattatgtattgtaaattcagtattttcaggtcgtattacaaaaacttttgcgtggtggttaagaaaaatgttatttttggagactgctttcaaacttgactttccagtaattcaattaatattaa

SEQ ID NO: 57680 - DNA, 419 bp, Heterodera glycines
  Genomic contig location: Contig_ID=SeqID_5323; Location=1153..1571; Strand=-
  SCN-specific regions: Sequence locations=1-97,137-169,191-419
atgaaattcgggctttttttccttttgatttgtttcttttttgaaattttcgaggtgaagccaaaccaatccgaattgaatgaccaaaatccgttagtttttatataaaatttaaaaaatttatatttaaattttagcccgggattttggaccaattttgtgcaggaaaatggcattggggacgaaaatggtcaaattgggcaaattgccaaagagatggacgaggacgaaccaatgattgagcaactttcagacgaatctttttataaggcaccgccgccttcgcctgcgcacccaacttttcaggtggtaattagcgaaatatgatgaacaattaagtggaagacaatttaatatggtgtagcataagttttgttccccgaaaattttcgaaaattttattttttctaatgaataaa

SEQ ID NO: 57681 - DNA, 1760 bp, Heterodera glycines
  Genomic contig location: Contig_ID=SeqID_5323; Location=1878..3637; Strand=-
  SCN-specific regions: Sequence locations=1-43,108-305,329-441,463 -490,512-734,756-895,917-1667,1703-1760
atggcgcaacagccgaccaacaaaggcacaccgaacaaactgaaaagacggaatgagagaaagaaaagagggataaaaagaaagagagaaggaaagagaaaaagaaaaacatacagaatcttttttgaagacattgcggcggcaaaaggaaaagaaaaagtgagtgaaagagtgaaagaggcaaagagaaaagccaggacttttatagtgaagaacagtgaacaataggaaaaagagaggtacctaatttctgcgtaatacaacataccgtatttcctaaaataaagccgccccctaaattagtgccccctttcaaataaagccccccaccttttgagggggtggggtgaaaaatagagcccccgggggctctattttaggaagtacggtattacagcggaccaggccgttttcgtgcgagcccaagtttttggctataacttttttctttgccaaccaaatccaaccatctttgtacaatcaatagccctaacaaataagtgtcctctattagcctttaaaatgaaaaagggaggtagtttgtgcgtaatactgttataaatagggaccggattttgaggcatatgtttttttttttttgctaatctgctatgacttatatacatgaattacgagtttttaattggcttggtttgaatcttctagcttggactttttggtgcctttttttcttgcgaaaatttggctaagatatggacaaaaacgaaaaaatagcgaaatatggatttattcccgataaccctaaatatggatttatatggactaaaagctcaaatcataaaaatttatcgtagaaatgctattttttagcaactttcttcatagaatatgcgcagaaaaaaatatataaaacccatataatctcgtaaaaagacccaactcgtttttattaccccaactcgtttttttgactggaaaatgggaatttaagtgctaaccgcagtttataattactacagactgaaatgtatagtcaacgcatttacaaaattgccaacgagttgggtgtcgtcctataatctatacatattcataactttttttcaaacttgatcaaaaattcatttttttactccagaaaaacatgatatccatttgttttgacagtgcgaaagaaaaattgtgaattttgtggtaatattaagaaaatttttttgtccaaaagtgtaaattttgctgcctttttcctttttgtgcctttttttgtcgtttttgtacatttttatgccttttttcacctttttcgtgcctattttcggtaactatttgaaaaatgttcgtgcctaaaaatccggtctcatgttataaattcgagcccaaaacttgtgggttttcgggagcattgaacacgaatcagacacccatttcgaccaaatccagaacccggaattgtaacaatttctttttgttttgcgcaaaatagcgtcaacgcaccttattttatggctttctcgcagcttgagagtttgaagtccatcgggaattacaattgtttgggttcgattcccgaatttttattctgtctcattctttccttccttttcaaattttttcaagattttgataaaattttaatcattagatttttatttgttttgtcgctaattttgtttgatactgtattttaactccgacataagtattcgatagtttatttattaattatttgatattctgtcaccggtcccttctcacctcgggggacaaaataacattttcttcaataatgagaaaataaa

SEQ ID NO: 57682 - DNA, 1140 bp, Heterodera glycines
  Genomic contig location: Contig_ID=SeqID_5323; Location=3898..5037; Strand=+
  SCN-specific regions: Sequence locations=1-1109,1131-1140
atgggcattcgattcaatggacatttggcgcaaaatcggagagaatggcaccaaagaagtactaattgtcaattcgcatgggaaggcactgccaattccgcaaaagccgatgccaaagaaaatcatcggattcaaatgcattacaatcgagtgaattggacatttatgaaaaattggctaacatttctcgttttttttttcagatacttccaccaaaatgtcgtctcctttctccaccgttttcgctctcttttcggctcttctgggattaatttgtccattggatttggctcactcactgatcgcactgctgagtaccttatgtgcaagctttggccattgctccggggcaaagtctgcggcatggaattttggccagcggagttccgatgtttgcgacagttcgccccatacattctgcgcgactgtccgtccctgcgaaccgtctgtcttccctactgtagtcatttcgacgagtcggatggccaagcggtgtccaaatggcttttgtcgcctcggccggacggtcttccaaaagtgttccgttgcgaattcgatttggctgagatgcgatgggtgtcactgatcagagaattcaaagcggtgatttatttgttgatcattattttacacaacttgctattacttttcattctgtccatgtttcagtcatttgcaaatgcttctcgccatgtcaatttcatcattgtcattcgcttttcctgtgccgatgactccgccgttgcgacgttcgatctgatcaacaatttcactggggagcgatcgacactgaaaaggcttaacaaagacaacagcgacgacaataacaatgatcgttttctgctgattcgctgtccgatttcgcgagatgagtgtaaatggagcaaatgggaaaaggaagcgattggatgggaattcgacaatcagtggaacagaatcatcttctcaattaaggactatggaatcgaccattggtcggctatttgaaaatttttaactgttttttcatttttcatttttttagttgctatcccggtccgagtggtcatcagaataagagcaaatgaattgatgggacaatgtgaccgattcgctgaattttgtgtccttttaatttgaattgtttgtttctaaattgaa

SEQ ID NO: 57683 - DNA, 297 bp, Heterodera glycines
  Genomic contig location: Contig_ID=SeqID_5324; Location=277..573; Strand=-
  SCN-specific regions: Sequence locations=1-33,55-297
atggccgaaatatggactaaaaaggcaaaaatggcgaaatatggatttattcccgaaaacccacaaaatatggatcggcgacttcctggcggtcggcgtctgcgcttgccgggctggttcagcctgaacaatgttcccctccttcgtacccctccattgagccctgatttgtcaccaatcgaaaatctttggcactttgtcaagcggaaaatcgccggaaggcactttcagtcaaagccccaacttggcatttggaggcctggaactcaattccgcttgacccaattatcaatttga

SEQ ID NO: 57684 - DNA, 80 bp, Heterodera glycines; identical to SEQ ID NO: 51817
  Genomic contig location: Contig_ID=SeqID_26942; Location=167..246; Strand=-
  SCN-specific regions: Sequence locations=69-80

SEQ ID NO: 57685 - DNA, 80 bp, Heterodera glycines; identical to SEQ ID NO: 51817
  Genomic contig location: Contig_ID=SeqID_26942; Location=780..859; Strand=-
  SCN-specific regions: Sequence locations=69-80

SEQ ID NO: 57686 - DNA, 984 bp, Heterodera glycines
  Genomic contig location: Contig_ID=SeqID_26943; Location=256..1239; Strand=+
  SCN-specific regions: Sequence locations=1-231,253-984
atggcactcacactgcaggaggtggagacggtgctgaagcgggtggaggcggagaaggcacacgcgtcggaaaggtggggctgatcaactattgtttcttaaaatttatatgcattttctattaaaaaacgccctcatcgacaggggcttgagttgagacacttcattcctaactgtctctaagtaacagtagttaatgcaaaagaatttgtgtaaaaaatgctttaattgccaaattaggcaatttttaataattcattagcctcacaacgctttatgtcggcttcatttaatagttttttaagtcaactccaatccgcaattctcgagcgtgacaatttgcgtcaattgctcgacaaccttcatgatcagaatgcacagttggtgaacggtcttaaggtgagccaagaaagacaacacgtttttgcccaatcattacaaatttccattttgaattttgcatttcttttccaggccaatctcagccaggcgagtggcgaccgtgacaaggcactcgccgaggtcaaatcgttgcagagcaacatcaacgcgttggacaatgtctaccaacggctaaaggctgaccatgagaaattgcgtgaggagatggaacagatccaatccactgataccaacgtggaggcgtgcaagaaggagattcaggtgggtaatggaacgcaaactttgcccttttatgtctatttttttctataaattcaaaattttctttaaactttatggaaaaatacttttagaaaagctttccgtgtcattaatacaattatttttgcacagaaattgcgcaacacggtcgcttaccaagagaaacaaattgcggaatgggaacaaaagtgtgaggagctcaaccaaaccattgagcgcaaggacaaacaaatggaggaaatttgtcgccttggagccgacatggaaagcagcattgaggtgaaactaaaaaaaccaattaccaaacggatttaccgttaa

SEQ ID NO: 57687 - DNA, 843 bp, Heterodera glycines
  Genomic contig location: Contig_ID=SeqID_26944; Location=361..1203; Strand=+
  SCN-specific regions: Sequence locations=1-155,180-231,253-383,458 -605,659-786,814-843
atgcgctacgacgagctgcgcttctcatgccggcgccagggcggcgacggcagcagtggcacgttctgccaacagtgccgcttcgtgttcccgaacgcggactgctttgaggcgcaccgccggcgcgtggatgttgcgccggcaccgcctccgggcgtcgccgccgccgctgctgtgcctcactgtggtgaggaagcaacgggtggagacggtgacgacgcggtttctttagctgctgctgttggcgccgctgtcgcgccagcgtttgcggaccgccgtcgcgggcggccccaccgttcaatgtgtgaggagcggcgcctgtgtgagtggtgcaatgtggttgtgtgggcgagaagcggtccgcacgtgtgtcgccgccgtccgcagcagcaacagcagcaggaggatcgcgcagttctgcagcagcaacaacagcagaaccaccacaatcagcagccggcaccgccaaagtgtgagaagtgcggcggtccacacgacccggaacgaacgccgcacttcatccagcccaagcaatacgcgcgccagtgccagtggcgacgcggtgcggcacgtggcgcccacgacaacgctgacgacggagcggttgctgatgctgctgatgctgcagccgctgttgatgacgatgacgatgatgatgtcagtgaagaggaaggggcggaagctggtgccgcgcgtggtggtgttggagatggcgctcgcggacaccttcggaagccaaagccggtgcgcttcatcttttgggatgttgaatgcgcacaggagcgcgtgggagagcagcaggagcagctggaggacggtaatgaattcgtttttaaacgatga

SEQ ID NO: 57688 - DNA, 420 bp, Heterodera glycines
  Genomic contig location: Contig_ID=SeqID_26944; Location=1273..1692; Strand=+
  SCN-specific regions: Sequence locations=1-7,37-248,271-420
atggatgcagttcaacagcagcagcagcagttgcccgaactgttgaagcacgtgccggtgctggtgtgcgccgaggtgatctgcgagcgctgcatcgcctacggggtggacattgagcgtgagccgttgcgccgcgcgccccagtgccagtgcggtgtcccgtggcgtggtgcgaaccggcgccggtggtgctctcgcatcggcgaggagctgtttgacgacgacgacaccggcggaccagcgaccgcacaacaacaacaacaacaacaaatgccaccggatggattgaacccgcggcgactgcgcttcttctgcgacggcgagccgggcaccggacgtggcgcaatggcccaatttgtggactttttgctccacaccggccccaaagggacgcgcaccgtgatgttggcgcacaacggg

SEQ ID NO: 57689 - DNA, 308 bp, Heterodera glycines
  Genomic contig location: Contig_ID=SeqID_26945; Location=63..370; Strand=-
  SCN-specific regions: Sequence locations=1-308
atgcgatgccaaatgggcatttgcggagaacgaacggtgcgctgtcacgcagctgtactcgccaagcacagagatcaaagtggcgccgcaacacgtgagtgtgacgaagggcagaaggaattgcactgaccgattaattaatggtcattaaaaacggttgaaaataatgggatggaaagaatcttatcaacaaaaaaacaaccagatttttgcttttttaaagaatttgccattgggcagcagaagagcggacggagtgacagtgatccaattggaaccgcagcaagtggaaattcgcatgaagcccg

SEQ ID NO: 57690 - DNA, 372 bp, Heterodera glycines
  Genomic contig location: Contig_ID=SeqID_26947; Location=1085..1456; Strand=-
  SCN-specific regions: Sequence locations=1-131,153-372
atggacatcgcaggtgtgcgcaagaagctaccgctgatgaatttataagtccagatgaaaagtcggagacccgttttgtccgttgtttttacaggtctgaccttgcaacgcgattacatgccgaaccgatccactgctgacacccttgccgcccctttcaacgccgaatgcactaccgatgagcccaaagcgctgaggacatcgcttcttagagggcgaggatgtgctaatattgtgattttaaaatatatttggcgttttgttatttaatttgtttcatttttgtttgtgatttttgtgaagtgttagttgttagtttatgctgtcgtcagtttttattgattgtcttcgccttaatttatttgaaataaa

SEQ ID NO: 57691 - DNA, 84 bp, Heterodera glycines
  Genomic contig location: Contig_ID=SeqID_26948; Location=880..963; Strand=+
  SCN-specific regions: Sequence locations=1-34,62-84
gtcctctccccccccccccccccggcgtccctttcctccccaaacaccacagccacaccaattcattctcttctaactttccaa

SEQ ID NO: 57692 - DNA, 383 bp, Heterodera glycines
  Genomic contig location: Contig_ID=SeqID_26949; Location=242..624; Strand=-
  SCN-specific regions: Sequence locations=1-110,140-181,204-318,340 -340,381-383
atggtagtgactcttatgattggaatgaaaaatggcgttgaaaaactgttcaagcagcgtccactcacaattgaccagttggacgagcagtacattgacaaaggtggcacaaatttaaacaatttttttttttatttttcccaatggccaaattaaattttatggcaaaatttgctcatcttttcaatttgaatttttaattttcagaagttttggtacaaaattggaagcccaatgttgtgtatttggtgcaatttccgcacaccgattcggccccaagtttatccccggcggcgatccaattggagacatggctacggatcaaagaaatcccattttatgtgggttttaattggggaaattgaaaaacattttaaaataaa

SEQ ID NO: 57693 - DNA, 1359 bp, Heterodera glycines
  misc_feature (4)..(4): n is a, c, g, or t
  Genomic contig location: Contig_ID=SeqID_5326; Location=481..1839; Strand=-
  SCN-specific regions: Sequence locations=1-10,114-125,483-756,943 -1013,1035-1137,1159-1359
  Gene Ontology: Biological process=N-linked glycosylation
atgnaacaaaaggaagaggaagagaagcgaaaggagggagagaaaagggaggaggaggagaagcagaagaaatcgagagagaaagaagaaaaggagaggaaggagcaagaggaaaaaatgatggaagaagcggagaggaaacggattgaacaagagaaagtaagaaaggaggaagagacacagaaaaaggaggaggaagagaagaagcgactggaggaagagagcaggaaaagaatggaaaagaaacgagcggaagaagaaaagaaaaagcaagatgaagagaagaagaaggaagaagaaaaagagcggaaaagaaaggaggaagaggaaaagaaaaagcacaaagaagagaaaaaggaagaagaagaagagagaaaaaggaaagcgacagaagacaaaaagaaagagcaagcggaggaggagaagacgaagagtaatgaagaggagaaaaagaaagcaatggaagaagagaaaaagacggacggatttgacaatgctttggaggacaaagaggcgactgaaggccaaatacgagtggaattgggcgcaaaactggacaaaaacgcaaaagaggcgctaatgagggcaaaatggtgggaattaggccaaaccattacaaaattaaccaatcatttcgatattaatcatttgaaggtacaaagatgggaaattactgaacacacgaacatcattaaaatacaaggcacttttggagatgccgcgcggagaagcaaaacttattgtgaacaaagtggagaaaggagacgcaggtggaagagcaaaagggggaaaagagagggggaagggacaagagagaagataaagagtggagagggaaaagagaaaaagggagagagaggagggaaaattggagaaaggagggggagaagagaaaaagtgaaaaggggaaagagcgagagaaaaaggggagaagagaggagaaactacggtttttgaaaattgaacacattcacaggtcggtacaaattggagttggagttgactaagactaccgtaaaaccatctacagaagccaatcttatcgtctttggggtacccttagttttcatttgttttatgtgataaataattgtcctttaaattcagaagaatgagccaagaaaagcaacggaagtcaaaggaagcaaagaaactgaggaggaaaagccggggacaagcaaaattcaaaaaagggaggaaaagcgtaaagcaccggaatttgtcaaaaagccaaaacaaagcattgtaaaaaggggaagatcaaaagtgaacaagtcaatgcgcctttcaggaagcgatcagtggttctcgcgtttgtttggccggttcgtacgccggcaacccaatgccatcgtttaa

SEQ ID NO: 57694 - DNA, 1214 bp, Heterodera glycines
  Genomic contig location: Contig_ID=SeqID_5328; Location=137..1350; Strand=-
  SCN-specific regions: Sequence locations=1-1127,1149-1168,1191-1214
  Gene Ontology: Mol. function=structural constituent of muscle; Cellular component=sarcomere; Biological process=striated muscle contraction
atgtgcacatggcagcacctggaggtcgaaattctgagcggaaactcagtgagcgttcgatggacaaccgcggaaacggtgcagcagcaaatcccgcaaggggcgcacgcagttattcaataccgttccgagggcagttccgtgtggaacgaggtgttggagcagtacagtaaatcaccggctgtgattgaggatgagttgaaggagggcgtgccgtaccgaattcgcgttcttatgaagtcggccgacggagaggaaattggaaaatcagcggaaagtcgcactgtgaagctttctggctcgaacctgcccatcttgacgaagactttgcgcgatgctttggttccgaaaaacaacgaaattcgacttgaagtttgtgccgtcggcgagccggcgccaacctatctttggtttaaaaacggcgaggaaattgtgccaacgccagaaaacgacaacgtgtcgataagcaatgaaggttatctgagcaaactgaccattcatcgaatggccgacggagacgagggggtgtacacgtgccaagtcagcaacagtcacggcaccatcgaaagccgtgccgagcttttgctgggtgccatccaagcacacttcaccaaggcattcgcggaacgcatggacttggtcgagggcaaggacataacgctcgagtgcgaagtgtcgcatccggacgccaacgtccgctggtcccgcaacaaacgtacaattaacgaggcaaccaaccgcgtcgcgctagactctgtgggcaaagtgcgtcaccttacgctttacggggcgatgaaggaggactcgggcacgtacacttgcgaaacggagggcggccaagatcgtgtgcagactgaacttgccgtgcgacctcccgacgcgcgcattatgttctccccgcagggccgaacagtgcacgactacggcgaacgcgtgtgcctgttcgcggaactgtcccggacgacggagcgggccaattggttccgcaacggagtgggactcatgtcgaagaagtgctttgcctatgttgacgaactgcgcgctaacctggagatatacaactttgacgagaacgatgtcggcgactaccacgtcacattggtcagccgcaaatggcgaaaaatgcgactgaaaaaatgggaaaaacttttcaggacagcggagaacgcagtgcaccggccaagctcaagttcgaagttgcgcctaaaatacag

SEQ ID NO: 57695 - DNA, 1134 bp, Heterodera glycines
  Genomic contig location: Contig_ID=SeqID_5329; Location=430..1563; Strand=-
  SCN-specific regions: Sequence locations=1-424,446-490,514-1134
atgtatttgcaattctcacagattgtgccgttggacttcatcatgaaagttcaggttaaattttgtggcggctcttatgtgatcaaatgcgtttttcagatcacattggacgaccaaacgatcgaaagtgttttgacagtggaggaaacgccggtggaatttgctgagaaattgccccgcaaaagtagaacggatgatgacattacaaatggctgtcttacataagttcgttcattttcagcaattgcccattgcgacgagacaattaccctcgcggcgacactcagtcacgacgctgcgcaaaaagtgaatttgcattcctagtcaggaaaagccatttatgaaattcatttatagatttcttggtaccataacggcagagaactgaccgaattgggcacggagcacgtcatctccaaggagggatgcctttgtaagttgaaatccgtacaaatggcgacgaaaacccggcatttgttttgcttacggttggcattgtgttttttataaaaacaaaaggcaaaaatacagtttagcagttggattattgaccaattataggtctaattagtggtgatcagtcatcatttacgcttgataaatgcgaaaatcatttaaggtagtttggaaattcgcaaaatatcctaccgaatgggcggtcgttacacgctgaaagtggacagaatggagtcatccaccgttttggagggtcattgattgggggagggatttcgaccttactgtcctttttcagttcatggaaagccgagtctcgaccagcagaaaggcgaacgcattgttttggactcaaatgaaaacctttccctgaacatccgtctcaaatcactgcccgaaccggaagtggatctgtacctgaacggcgaactgctcacgcctgaactgcgcacttcggtcactgttctcgaggaggcgctcctgctgacgcgcaaagagctgaccaaggaggacaggggcacctatcgggtggtgctgttcaacgagtacggcgaggacgctgtcgaatacgaagtgtacgtgcgcgacgtgccggacccgccctccgggctgatggtgaccgatgtggggcacgactactgtttcttgaaagtcggtcccttgagggcaaacttttga

SEQ ID NO: 57696 - DNA, 656 bp, Heterodera glycines
  Genomic contig location: Contig_ID=SeqID_26956; Location=146..801; Strand=-
  SCN-specific regions: Sequence locations=1-138,160-265,287-304,327 -365,453-627,649-656
atgctcaccttcattttgttggttccgctggtcatcgtcatcggcgcgttcatctacctcctgttcatgaagccaaagagtgcggcaagcgacgaagaaggagacgaagaagccaaaggaacagctgatggcgatgtcgagaagggagaagacgacaagtccgatttgatttgtctacaattgtaagaggattaacggtttttgccccattttcagaaaggagactccacctgctggtgaaggcgtgacagtgcctgctgaacaagtggtagatgaacagccaaaggaggacgatgggtgagcaaaaagggcggaattgttgttttcaaccaatgttgcttttcttttacagtggcgacaaagctgaggaggagaagaaagaggaaggcgggtcggcagcagaggagaagcagaaagagggagccgcggagaccggcggaggagaggagaagtcggcgaccacggaagagacgaccgaggaaacgacggagacgaccgacgaaactgcgaccactgagacttccgaaagcggctccggctctgcatcgtcctcagcatcgggctctggatctggctcgggaggttcgacttcggcggacgctacttctgaggacaaaacttccgacgcatcatcgtcttcatcggagggctcttag

SEQ ID NO: 57697 - DNA, 428 bp, Heterodera glycines
  Genomic contig location: Contig_ID=SeqID_26957; Location=260..687; Strand=-
  SCN-specific regions: Sequence locations=1-129,151-214,237-237,259-428
atgatgcattattttgcaatattttggtccttaaatataatatttctccaacaaaatggccaaaatgttgccagtgcaaccaatccgttgatgggcaagcaccagatgaaaattgccaaattggaaaatctgttgaggtaaataacaaataatttgtttgcataattcagcagaggcccagcccaatgctgtccttggaaatcgaaaaatagtctctattttcttggaaggttcttgaaaaacttttaaataatttaagcagtgagacatttgaccagtaatcttagagaattcgggcagttcactatgaatctgacctgaccaacacttaattttactcaattccaaattcccaaggtaatcggattactcgtgtgccgtgccatttgcgccgcataacaaaatcgaccttttcgccgctcattaaa

SEQ ID NO: 57698 - DNA, 446 bp, Heterodera glycines
  Genomic contig location: Contig_ID=SeqID_26958; Location=302..747; Strand=+
  SCN-specific regions: Sequence locations=1-9,33-406,428-446
agcccattgccattggaggcccaggtttttgtcgtcgtattttttctgtcgtaccttgtcttgaagtcgcttcgtcgagattgacgaaacgctggctgtcaaacggaagtatggcgttgggcgaattttagtgaagggcgaagtttggttatttggtggcgtggaacgcgactccaattgggaacgcgtcttcttggttcctgtggaatcgcggaccgcaaatcgtctgatcccacttatccagcaatacatccttccggggaccactattgtttcggatgaatggcgttcgtaccgtggaattccgaatttgccataaaattacactcattggaccgtaaatcattctcagaactttgtcaatcctgccaatcgtcaagcacacacacaaaatgtcgagtcattgtggaagaaattgaaaaagaatttcaaacagcattttggaa

SEQ ID NO: 57699 - DNA, 560 bp, Heterodera glycines
  Genomic contig location: Contig_ID=SeqID_26961; Location=573..1132; Strand=+
  SCN-specific regions: Sequence locations=1-124,148-166,188-241,263-539
atgaaagaagccgccgcaattgtcgatgattgctgcgactctcagctgtcaactgcggctgatattcatgtgctttctgagtgtgagttcatttttttgtaaaatattaattgttttggtattaaaaaataagcatgttttcaaaaataaattaccgtacttactgaaatatgacccccgcgggggcagaggtgttcgaaaatttatggacgactctatttcattgaatacagaataataatactttttataaatgcaaaaattgaatattctatatttttatgtaataaaactctccctcaaagatgtgatcgggctcaaaatgcagttgagtggtttgagcaatggaagcacttaattgggctcaatgttgttgaccagaagtggaaggatgatgagtggaaggatgatggtgttgagaaaatgttcgaagtttttgaatttatttaaattgccaatttaaaggggctgccaaattctttgataaggaaaaacagtgattaaaaaaattttagattaattaatgcaaattcaattatgtttaaactcaaaattaaaga

SEQ ID NO: 57700 - DNA, 450 bp, Heterodera glycines
  Genomic contig location: Contig_ID=SeqID_5330; Location=824..1273; Strand=+
  SCN-specific regions: Sequence locations=1-450
atggcgttaaatccgacaattgaccagctcgtgaaaatgctggcggatcaacagaaaatggtgcaggaccaatcacagcaaattgctcaactgattgcgatcggacaaaacgcaccaaatgcggcggcacagcccaatcaaggagcaaattcagtgccaatattgccggacatttcaccattcgagccaacggacgacaagagccgaatttcggaatggattgagcgcttcaaattcgcgttggattgcacagcaccaacggcggacgacgaagtcaaggtcaaatgtttgatgaataagctgagcgaatcggctttcagcgaatacagcagatcagttctgccgtcgtcggtcacagatttcagttttaaagtgacgacagaaaagcttgaaaagctgtttgccaaggctcagtccatattcatcgaccgctacgagtgtttaaaagcg

SEQ ID NO: 57701 - DNA, 3668 bp, Heterodera glycines
  Genomic contig location: Contig_ID=SeqID_5331; Location=1831..5498; Strand=+
  SCN-specific regions: Sequence locations=1-614,646-1759,1798 -2004,2033-2369,2415-2993,3015-3032,3054-3668
atgtcgaacaacttgttcaacccatgtttatcaatgcggcacatcagcaaatgccggtatttttttattttttttttcataaaacaaattctgttttagtcaccattttgtgctgatggcacgcacaccattcaatttttgaatgggagcgtctctattgtgggccgcccgctgccgtctgttatttaaacagttttttctattcaattgattattcaggccgatttgtctcaccgtagtagcagtagatcaccgcccgcaccaacaaacaccagctggccctctccctgtgaccaatgttgtgctgcgcaacggcgacggtcaacgtgttgaagcttcgggttggcagcaccaggccagtgttctggcgtctttggacatcgggagtgcctactggttcaccaactgcactgcgcgggcccgataccagcaactggactgttggtatcgcattggcgtcgatggcaaaaatgccattgtcgtccctcacaccgccgctccacaggtaagtttttcaaacttttcttataacagaatattgtgttaagccgacggctccgcaaagtggtggactccaccattcaattgcctccattttgggagcacaggtgggcttaaatttattcaaaaattttttttaaatatggaataatttaaggcgccacatgttcagacgggtggaggccgtacgttcaatgaggcgcgtgcccctcccgaagcgagcccaattgaggaggacgcgaataacaatgtgagaaaatgatttttttttttgggttgtgtattttttttttgaataaaatttgctcagacaaatgatcatcgttttgggatcccggtgcttcatcaaagacgggcacctcaattggttggttattatgatttgctttttcttgaataattataccatggataaatttaaggtgactcgatcaattgaggactgtttcgtcattgaacgaacgacgccaatgcgcaacaccctccgcaacaccaggggcgaactttgcgagatccgcttcctgcctttggaggacgccgagcggcccgatctcgtgctggagacgctcattcagcatctgctcgaccgtgtgctggaaggtcacccgcctccgatgctcgttggacttcagcttcatccgcccggattcgatcgaccgtacgtcatccgactccgcccaccggagcaaaataatgcggcagcattgtcggcgcctattgagcgcctcaacgagcagtctgctgccggaatcgatctgctcgctgggactaccgtaaccaaagtgcttgctgtgtggcccctggagcctattcgtgctaatgctcagcgtggaggttgtgctattgtacctttaaatattgatttttctaatgaatttaggtggttgcgactttgacgctgaacaccatgtgtccaacaccgtgcggtcccttgtgcgcgtcgtcaacccaaacgaccgccattgtctggcgcgttccgtcctcctggggctctgtgaccgtgagacgcgacagccgaacggcggtggacgggacacatttgcagcgtacgctggacgacaagaccaacacggggcgcaggcggtggaccttttgaggaacgctggacttcccgtcgacaaacaaatgtacacgctggaggacgttgaacagcttcagcggtggatcatcaacgagcacggtgttggacaaattcggcttgtcgtgttcgagaaggagcaagagtatcggattgtcttcaaaggagaggggtgagtattttgtaatttttaattaatgtctaaaatattcttttaagtgtggctgcgcatttcaatttgtgcctcttgctggagcgtggtcactttaactacattggaagaattgaacaactgttcaaaatcgagaactactgtttcgactgtgaacgcagagcaacgactcgctatcatctggccggctgtaaagttgtgtgtcgtttgtgtcttcggtttggcgcagggtttccatgtcaaccggaacaggtaataattaaaaaataaataaataaaatgaaatatgcttttttttttagttgccaaatggtgggagcagttctcgtcgctgcaatgaatgtggctttgtatttccgaacgacggctgctacgactatcatcttgccaacatggctcccgctccgattgatggccgaggccaacgccaacggcagccaatttgtcaatggcgtcgtttctgtcgagcctgtggtcgtgtcgcttattttggcgtccatcaatgtgcaccactccgtcggcccgctggaccaattgactgtcgccgttgtcatgggcggcacacactggatgagccgtgcttcatccaaccgctccttgacaggcctgctcatcagaacaacaacaacaacaacgatgatgacgacgacgacgatgacgacgctgatgtcctcgacgatgatgaagcggatgacgaactcccacttcgtctttgcttcttcgacgctgaaacgtcccaggagcggcccctgcaattgaacaaccaaattgctcagaagcacgtaccgcttctcatcgttgctgaagtcatctgcgagccatgtcttcgagcgggaatcaacgtcaacgatggattcggaagaagagctcctgattgtgtttgtttgtgtcggatggtgcgaggtcaacaactgaggcagtggtcttctcccccgtttgtcaatggagcaggcgacaacactccgcccccagagggcgctccggcattcaatcagcgccgcttctactttcactcttttgacaacgaggccaacgatccgattgagcaatttttgctctttctgatgaagcacggctccaagaaggcacacacagtctgcatcgcgcataacggtggaaagtacgattttcatctcgtacttgaggcactccatcgccgcagcattccaccgaagcgactctgcacgacggggctaaaaatatattcaatgaagctgcgcggattaaatcaacgacgaattacattcaaggactccatcaactactttttctgtgaattggatgccttggttaagagctttgatctgccacaacatctggcaacggtgaagcccttcttcccgtacttgtacatacagcgacaacatctgctacaccgtctcaacggtcttccggcaatagaacactattcgcccgacacgatgaaggtcgaaaaacggaccaagttttcttcgatggcacggttacaacaacaacaacgccaactttcaactgcgtgatcaactcatcatgtactgtgtcaacgatgtggcaattcttcgtgaatctgtccttcgatttcgtcaactcatcggtgaacacacccaaggccttgaccccttcctctgcgcttcgacggccgccggcctagcgctcgccacgctccgccgctgcttcctccccgtcaaccgtttggtgcactctccagaaggcgggtacctccgtggacgacgagcttctgccgaatctcgtcgctacatccgcttctttgagttggaaaacgatggagcacaagtgcagtgcgctgactggtcagtgggggaggcgcacatcgaggattctgggtaccgtgtggacggcctttggcgccgtgacccgccccttcgtccaatggccatcgagtggatgggatgcttctatcacggtattttccaatca

SEQ ID NO: 57702 - DNA, 843 bp, Heterodera glycines
  Genomic contig location: Contig_ID=SeqID_26968; Location=341..1183; Strand=-
  SCN-specific regions: Sequence locations=1-158,180-375,397-462,484 -553,584-604,626-773,825-843
  Gene Ontology: Mol. function=calmodulin binding; Biological process =signal transduction
atgatatcacgtttaataccccacaaaattctgttcagatatgagttcaaggatctgctcggcaccggcgccttctccaaagtgttcctggccgagtgccgctttgtgcccggcacttttgtcgccatcaaatgcattgacaagaaggcactgaagggcaaggaggagtcgttggaaaacgaaatacgggtgttgaaaaggtgcgttgccaaaattgagtttgaaagagggcaacgtgagaccaaggaacaattaccgccaaatgactgactttaggcattttgtccgatttctcaaaactgatcggaaaaaaacgtattgcccaatttgtaactaattaactaccctgctctcccaacctaagaacatcagatcatttaaaataaaacataaatccgatcattttgtgttcaaccgcgtttttttgaatccgtaaaatcgaatcactttgagcatgttgatcaaacacacacacgtaatcacagagttcattgttattgttcagactgcgccacaacaacattgtgcagctgtacgacacatttggtaaaagattttatttttgaatttaaattatatttttgctactgcgaatgattaattattaaattgtttttaagaagaaaagcattgcgtatatttggtgatggaggtaattgaatttgttattgatatgatacaaattatatcaataaatatgtgccttaagctggtcaccggtggcgaactgttcgaccgaattgtggccaaagggtcgtacacagaaaaggtgctttttaatgtttttattttaaaaattaatttttttaaaaatataaaaatttcaggacgcatcaaatctga

SEQ ID NO: 57703 - DNA, 450 bp, Heterodera glycines
  Genomic contig location: Contig_ID=SeqID_26969; Location=335..784; Strand=-
  SCN-specific regions: Sequence locations=1-334,373-450
atgccaagcggactaatcaaaaattgcattgtcgcaaaacggcacccaatgaatcaccattttaatcggcaccagcggtgcctagatggactttgcctgcacttgccaacctcatcaatcggcagcaaagtcgccgatgtcggcaccaaattctcgccaaaactttcgatcagaaaaaagtccatccacggcgattgccttcaaccggaacttgatgttctgttgaacgaactcagagagtgcattttggacggaaacgctgtggtcgaagagttggagcagttcaaacggaaagacggggacaatttgcacaaggaatttccagtgaattgcgaagagaaagggaaagaggaagaagctgaagaaaagagacggacgaggacagaaaaagtgcagcgatttgtgaagatggtgaaaaggcaatttgaattggggcgacgcattgaaaag

SEQ ID NO: 57704 - DNA, 929 bp, Heterodera glycines
  Genomic contig location: Contig_ID=SeqID_26970; Location=29..957; Strand=-
  SCN-specific regions: Sequence locations=1-405,427-929
atgggtgaaagcactgcgcgtgatggcctgggcacgacgatttgccaacaacgcacgaagaaaagccgaggatatgcacggaacaatggggggatctgacccctcacggcgaaaagcggcaattcggggacaaatcgtggctctcccaacccacgacgaagagacggacgcaaaatgggcaattgtacgggcaacacaacggaattgccaaccccgggacggcatgcgaaccgagctggacgaaaacggggtgcaacggctcatcagtcgaatcggctggtgcgaagaagcggaactcagtcggccggtgatactcccgaaaagatcaagagcaggagcgctcattatcgacgacatacatgtgcgactccatcacatgggaacggacggcactctgtcggaattcttgaggagctggtggtgtcccagtgcacgacaacaagttcggcaagtacttggtcaatgcaaacgatgccgacggctcagggggatgccctaccccctcccgacaatgccacaactgccaatggatcgagtgagacgacgattgccgtttgaatcagtcgggctcgactacctcgggccgacagtcactctcgacgataagggacaacaaaggaagacatgggtgctgctaatcacctgtttgacgacgagggccatttatgtcgacgcgactcgagacttatcggccaacagcttcatctcagcactgaggagattcatcgcccggcgcggagcaccgagtcgaattctcagtgaaaacgcgccaaccttcactgtggttggcaaaacgctcgccgagttcggcatgccgggagacaatccgatcgattttgcggactcccgaggcattaagtggcgattcacgccccagcacacgccgtgggccggaggaattttcgagcgggccgtgcaactcgtcaaac

SEQ ID NO: 57705 - DNA, 293 bp, Heterodera glycines
  Genomic contig location: Contig_ID=SeqID_26971; Location=1..293; Strand=-
  SCN-specific regions: Sequence locations=1-293
gtttggcgcgaacgtcaaatttactcagctaagaatttggatgatttgtcaaagtgtttaaccgcggacgaaccatcaactttttccgtctctccgaatttgaattccgaaacggaaagcccttcgaagagttcgccggtggacgggggacaatcgccggttgcttcggaggaggacacaaaggcaagcgaagggcaaagaaacgaatagggcaaaggcattcattccacagaaaatcaaggaggaattccacgcattctccacactcagttccaacatgatcgcccttctgc

SEQ ID NO: 57706 - DNA, 382 bp, Heterodera glycines
  Genomic contig location: Contig_ID=SeqID_5332; Location=425..806; Strand=-
  SCN-specific regions: Sequence locations=1-123,145-262,307-350,373-382
atgcgagttgcaccgccaaagtcggcaattgttgcggcaaaagttgagccaattcgaagttgggtacgtataaaatgggtggggggcgggggaggaatttcggggaaaggggaaatttatataccaaactaaaatttaaaatttgctattttgaagaagcacaaaaaataaaaattgattttgaggtggaaacaggcggaatgcagtatattcaccagcaacaagcggccaatgaccttttgctgatgggcgacgacgaattggaacagaagggaaaaggggagggggagaaggacgaggagggggcagcagaacacaacgaaatggcatcgaacgaagtgaaaatgggcaatttaaaacagttttaaaaaattggaataaa

SEQ ID NO: 57707 - DNA, 576 bp, Heterodera glycines
  Genomic contig location: Contig_ID=SeqID_5333; Location=640..1215; Strand=-
  SCN-specific regions: Sequence locations=1-250,277-286,308-314,336 -342,380-526,548-576
atggccaatcaaaaagaagttgatcaatcgatggccccttttcagtgtcttcaagcaaacatgcactgtactgacaagcaaccgcagcacatcatcactggtggcggtggtggcatcaaattggaacgggcactgagtcggattagtcagttggagtgccggctgaacacattgagtccgctgctaagtgatggcaatgccatggacaatggcacggcggaaaacaatggccaaggcaaagaaacagcgcaatttaaaagaaattaaaaaaggaaatgggtgaaccaacaaaggcagaaaacaaaaggacattgtttttattagggactgagttttcgagtctaattttaaaaaataaaaaaataaattttaattaaaacacagcacgacttgggcacgcggttaatggaaccaacgacaaattcaacgtgtatcatcagcagcagcaacagacgcgcagcaacaggcgaagacgcggcacagccgcaaaatgtgccgtaacggagaagcgcgcgtcactgtgcagcgcggcggcggagagcggcacggaacagcaggtggtcaaataaaaataaa

SEQ ID NO: 57708 - DNA, 905 bp, Heterodera glycines
  Genomic contig location: Contig_ID=SeqID_5333; Location=1924..2828; Strand=-
  SCN-specific regions: Sequence locations=1-158,180-452,475-560,610-877
atgacggaacgatgtgtgcttgtggcaaggtcgaaatgtcaaaacgccccgaatcaaaatgtgaaattcgacaaatgtttcagacaatcggacggattcggactgacagtgaacggagaatacccagtgaaagttgcaggtgttgttttttatttgacaaccaaacacacatttaattaatttggcaactttttagtggtaaagcacaacggggccgctcaaatagccggcgtaaggtaaaacaaaaatgaagtaaaaaaaggcaattgctttcccatgaggacagactaattaattaggcttaagcatcatttttagacaaaagagcgaatttaatgtgcaattatattcatcatttttatatgcgtatagcaacagtttaatttaattgtattttttatcactttacagtaatagcctttatcactttatatgtaccgtatccgctcgcttccatttcatttccaaaattaagggagggcgaccgaattttgaaagtcaatggaatgccagtgacagcgcaaaatttccaggaagtgatcaaaatgatttctggtcagtatttttatttaaaaataaatttaaataaattattcaaatttaatttaagaaattagcaattaacaattgtgtacactaattgactctaattaggaggttacaatttggcactgactctgctcggccccgcctctgtggcaacaaacagttgggacgactttgacaaacttttccccgtacaacaccacccatcgccggctacggcactgtgccagaaatctccgccgccattgacagcgacaaaaagaacaaaaacaatgataacggaggaggacaaaaatggacacaattgggaggtggcaacgaattataagagaaaaaataatttaatttaaattaataaa

SEQ ID NO: 57709 - DNA, 509 bp, Heterodera glycines
  Genomic contig location: Contig_ID=SeqID_5334; Location=106..614; Strand=-
  SCN-specific regions: Sequence locations=1-145,321-348,370-509
atgtcctcccgttggtcagttatttctgaagaaaactcatcaaattcaagcagtacaactacagattacccaccgtccatcccgggtacggtaaaccggtggagagaatactgtaaagagtggtattcgtacatctcactaaatcaattattttatttgtaaataaatttttatttttttcaaaactaagtaaaaaaataaaatattttatttatttttaatatatcaatttaaatattccatttattttacttttaaaaaatgaaattaattaatatatgtcttttttattataaatatttaaattgatttattttttagaactttctccgcagtgccggcgcttttccccgccgacttccgccgccggcaccgaattgaccaaaaagggcggaccacagacgacaacggcggatggaacgcagcgcgaaaacaccaaaatttcaccgggttagcaaatgaagctgaacagcaaagttttctaataatagtcattggataaaaataaa

SEQ ID NO: 57710 - DNA, 747 bp, Heterodera glycines
  Genomic contig location: Contig_ID=SeqID_26973; Location=421..1167; Strand=-
  SCN-specific regions: Sequence locations=1-143,166-243,265-624,653-747
  Gene Ontology: Mol. function=3',5'-cyclic-nucleotide phosphodiesterase activity; Cellular component=insoluble fraction; Biological process=signal transduction
gtgtgacatgtgaaaagggacggaaaaagaaccgatcgaaggcccttcccttttcagatcacacgcatcgaagccatgggaattgcactatcgctggtcggtttttggtttgttgatcagaggcagccccataatcagcagaaaaattcggacgaggcctgggaaaatacggcatttcgttcaaattagtgatactttttgtccgctttccccccgcccattcccttcccttttgtcccaattgacaaatggccttttgattttgaggactgagggtgtgctcgaggagttcttccgccaaggcgacttggaagtgcgtttcattcggcccacattttttcccgtggtaattagctaattaacggtttcccaaaaggcgtccatgggtcttccctattcgcccctttgcgaccggcacaccgttcacgtggcagactcgcaaatcggcttcatcgacttcattgtcgaggtctgttccgccgacaccgccgccgtttcaattcgatccgctaattagcgctaatgatgacatttgttgtacagccgacaatggtcgtctgcggcgaaatgctggtcaaaatggtggagccgctggtgtccctgccgaccaccgattcgctgtttcccccgggcgcccaccgcggcggccccgacgacggaagtgcgtccgccacttcgctgtcgccgttgccgcccgatctgtacgcttcgtcttttccgacgattccgggaagatagacactccat

SEQ ID NO: 57711 - DNA, 94 bp, Heterodera glycines
  Genomic contig location: Contig_ID=SeqID_26976; Location=918..1011; Strand=+
  SCN-specific regions: Sequence locations=1-94
atggcaaaggaaagggagggcactcgagtaggcgcggacagggagggcactcgcacagacagagagcagcgaaggccgggtgcagtgaaaggcg

SEQ ID NO: 57712 - DNA, 219 bp, Heterodera glycines
  Genomic contig location: Contig_ID=SeqID_26976; Location=494..712; Strand=-
  SCN-specific regions: Sequence locations=1-219
ccaagtttgaggtcgacacaataaacatactcttattaaaattgtgcccaacttggtctatttgcctggacgaaaaccggcacgactcatcgctctccgatcggtcccgaccccctacattcccccgaacggctactctgcgcgcctcgcccatttcatccccttcccgtccccttcaccccgcagagttcgacgcaaatttcttgtcgccacgacatt

SEQ ID NO: 57713 - DNA, 1423 bp, Heterodera glycines
  Genomic contig location: Contig_ID=SeqID_26977; Location=340..1762; Strand=+
  SCN-specific regions: Sequence locations=1-1423
agtctgaacccggatcatgatgagcctgctaaaatagacgaggtgttggacaattattcgaagcatgtgcttggccagcagcccgagaagggcaagcagtccacggacagccgctccatgatgaacaccttcttcatgtacttcgaaatgaatgtttacgccaagctgaaggagggcaagggaaaagagaggaaaaaggtaagaaacatagggaagtttatttatttccttttgcactttacccttcattttaagaaacttcggctgcacatgttacaatttgtggtactgaacaacgtatttgagggaatcgacgagcaaactctgctcaagttcgacatcaaaggcactttcgcgccgggcagtgccgtgcagcacgaccagaagcagaagtggtacacaggagagacgggttggcagaagagtttgtaccgcgagtacgacttcatcggcatctcccgcgaagggagagagatttccgcctttttcccggagggcattcagctgcatcctgaagcgtatagacaattggccgacggagtgaagaacgacacgagcgtaagcattagagtggagaccgcattgacaaactatattaatctcaaatagctaacagaaactcccatttacagtaccttaccgagaacggagtcaatgactacagtctgctgttgggtgtccaattcatggacccatacccagactcaccaaaagacagaaaagacttcgagggaacaaaaaagggcgcaaagtgtgtggaagcaaaatgccataattgcaaacgatggcctgatgcagaatacgaagagaaggcgaccctttgtctgtacatgggaatcattgacattgtgacgccgtccaacgaaaaggcggagaagcatttctttgaaatgatgtatcgaaggaaagacatagcagattttatacactacaaacgcatgagcgagttcatcccctaccacaatgttggcttttctaaatcaaagggtgcccgttgtgacagcttcccgcctcccccccccccactttgcactttgtgcgtctgccatcagctggatgagatttctgtaaagcatcctattcctagaccgccattatttttggaaaagggaacttgtgggaaaaaacctcgttttaactgaagggtttgttaaggaactcttgtaaatccgtaatgcaaattttgtttggaccgaaagtatttataatggcatttttaccttctcaggaaattgtgacgccagtgccgccccaaatgtatggaaaacgctttgttggcactgtgctcggctgcttgttcagccccgagtcttcaacatcggtgggtggagaatcggaacgccaatttcaattgggcatgaggcaaagcatttgtaaaacattcggcgagaaacggggaatcaagacaaaccatggaattgag

SEQ ID NO: 57714 - DNA, 74 bp, Heterodera glycines
  Genomic contig location: Contig_ID=SeqID_26978; Location=12..85; Strand=-
  SCN-specific regions: Sequence locations=1-74
atgcttttgctttatttccgcatttcaagtgattacgcattttttgaaagatgcacatcgcgaattgctgaaca

SEQ ID NO: 57715 - DNA, 537 bp, Heterodera glycines
  Genomic contig location: Contig_ID=SeqID_26978; Location=458..994; Strand=-
  SCN-specific regions: Sequence locations=1-152,174-286,308-380,421 -474,496-537
atgttactacaaaaagggcaaagttagtcaaagttgaattaattataattaggccaaaccatttttcatcaaaatgaatgtcgtctcatgaccctataataacgaaaatatcaaattacagtatcttagttatttttgtaaaaaatacggaataaataacatattacagtgtattagttttttttactgtgcaattgagacattttcttacagtatcttagtttgttgtaacgataatgtacatctctttttccgataaaattctttttatctatgattgatactattttaggtaaacattgtcacccaatttgtgccatttgcattgtatccgtctccattccctcgcactatttgttgtgtccgagaacaacagatatgaataaaacaaatatttatttgaagcacaaatataataataaaatggtcaaggcgatgggaattgcaatgggaggaataaatgacagaatgaacgagggagggaggaaagacagcgcttatatgagggaaggaattgtgcctaagggaaatcagtga

SEQ ID NO: 57716 - DNA, 1884 bp, Heterodera glycines
  Genomic contig location: Contig_ID=SeqID_5336; Location=1345..3228; Strand=-
  SCN-specific regions: Sequence locations=1-345,367-1064,1087-1884
atggatgcatttggattgttggatggcatcaaagccaaaatcaactctccgataaatctttgcagcgcaagggaagaattgagaggcaaaacacatgccccaatcaaatccaacaaagttgccggcaaacgaaacaaggacgccgagaaagaaatcaatcagctaaagcaggagtacaccaatgtttttaaaactgaattgggactctgcaaaaaggtcaaagcgcacttagaattgaacgccgacgcacggccaatatacagaaaggcccgtccggtcccgtacaacgccaaagaagcagttgacagagaattggatcgttgggagaaaatgggagtcatcggcaaagttgagcacacagaatgggcagcaccgattttggtcgtcaaaaaggccgatggtagcgctcgactgtgcatcgactattcaaccggactcaacaatgcgctaaaagaccaccagcacccgttaccattaccggaagacatatttgccaccttaaatggaggccagtatttttcacaaattgatctccgggatgcgtatcttcaagtggagctggacgaagcatcaaaaaagctgtgtgtcattgccacccatagaggaaattatgaagtcaaaagacttccatttggcataaaaacagctcctggcattttccaatcgataatggaccaaatgttggcagattttgacttcgcgacagcctacctagacgacatcatcatcgtcagcaaggaccaaaaaaaacattctgaacatttgaaaaagatgttctcgcgatttcaagaatggggaattcgcgtcaaacgggaaaaatgttcgtttttccaagatgaaattaaatatctcggacaaataatcgacaaaaacggacgcagacccgaccccagcaaaatcaccgccatcaatgagatgccagaaccgacggatgtctcttcacttcggtcatatttgggaatggtaaaccattaccaacaattcattaaaaacatgcgcttcgtcagaaagccgcttgatgatttgctaaaaaggacaccgaatggaattggagcgacaaatgcaaaaaggcatttgacaaaatcaaagaaattttgtcatccaaattgctgctcacgcactatgaccctcaaaaagagatcgtagtagcagcagatgcttctgatcagggaattggagcagtgatttcgcacaaattcccggacggaacgatgaaagccattgcgcatgtatcttccgctttaactcctgccgagaagaactactcacaaattgagaaggaagcactagcaataatttttgcagtgcagaaatttcacaaaatgatctatggacgtaaatttacgctcctaactgatcataagcctcttctcgccatcttcggcaacaaaaaaggagtgcggcaatgcagttccaatccgatggtcactcattctcttggcatacgactttaacattgaatatgtcaataccaacgacttcggccaagctgatgcactttcacggctaattgccaaaggaaaagatgcggaagaccgcgtcatcgcaaatacttcggtcgattcggatgtagaatcgattttcattggaaccgtcgagaagcttcccatcaaattcgatgacattgtccagtcgtcaaaaagtgatcagaacatcaaaaaggtcatgaaatttattagaaatggctggccacaaaatattggcaacgaaaatgtggaaatcagaattttccaccaaaggaaggaacaactcagcatcaccaaagattgtttgatgtatgctgaaagagttgtgattccaacgcaacaccgagccaaaattctgcaactgctccacaaaggacatcctggaatgaaaaggatgaagcagttggctcgtgaataa

SEQ ID NO: 57717 - DNA, 760 bp, Heterodera glycines
  Genomic contig location: Contig_ID=SeqID_5336; Location=5345..6104; Strand=+
  SCN-specific regions: Sequence locations=1-128,161-262,285-311,338-760
atggacatgtcaaatgccgttacgacaatctttcccggatgccagatccggttttgcttttttaattttgtacggaacttacaaaaggaagtgaagcagcaaggcttatggcaggtaattttctcccctttatttaaaaattttttttttcaaaatttaagcgttattgttctgatccggtgtttgctttgaatgttcggatgctcacatcagtcgcattcgttccgctttgtgatgtcaggaatgcagtgacagcacttgacatggaatttggaaatttggcggcttttcgacctctcattgattggtcagaaaataaaattttcaattttagaataagtttttaggcttttggacaattatgttgggcgtcctcgtcccaatggcacatggtcacaaccattgttccgtccggagcagtggaacgtctaccaacgaacattggatggaaatgcgaggacgaacaataacgcagaagcggaacaccaccgtttgcagggcgcgttcaattgtcgtcatccatcgttgtggaatttcattgatgttcttcgacgtgaacagaaaattgccgaccacaaatacaattctgcgatcgctggattgtcacctgataaaaagcgaggcaaatatttggcagctgatagaagaattctgaatatggttcgcaattacattccattgaatgcagtgaatgatcatgattatcttccacccattccccagcccaatcaatttcacactattttggaatttcttcgag

SEQ ID NO: 57718 - DNA, 435 bp, Heterodera glycines
  Genomic contig location: Contig_ID=SeqID_26982; Location=117..551; Strand=-
  SCN-specific regions: Sequence locations=1-435
atggcaaaattttgggcttttttatgccataaatcccaaatattttggctatcttttttagttgataaaaatcgcatcgatgataatgatccgtgtgacgtgcactaccatggcatagacaaattcaaatatttggacgatttttttgcacattggcaagccgatgcccaaattcaccacattgatttgtttatgggcaaggcatatttgaattatttcctttggcacaacgccaacgaaacatggacaagtgatgagaaaaatgtgttaaagaaattcagcattcagctgcaaaaagtggcaaaaaagttgaacacacgttcacagtttgccatgactgtactgccagagctttacgaattttgttgcccaacagatttggccaatgacgacgacttggaaaattgtattggccatgaagtggccaaccccacg

SEQ ID NO: 57719 - DNA, 1102 bp, Heterodera glycines
  Genomic contig location: Contig_ID=SeqID_26986; Location=38..1139; Strand=-
  SCN-specific regions: Sequence locations=1-261,285-910,933-1102
atgattctccgatttagactcaaaaattacgtattaattggtgacttggaaaaagcatttttacgagttggattaaatgaattagacagagacacaacacgatttttatgggtaaacaaatcatacttgaatgaaataagacaaaattatcgagaaattgaaatgagagacatcgaattgagacgattcacacggataccatttggagttaacgcttcaccatttttattaactgctgtagttaatctccacttgtcaaagataaatgaaatgtttgaaaaattcaagacaattcaagttaataaggaattatgtctaaatgataaagaagaagaatttaaaaatctttgcatagaacttaaacaaaatgcatatgttgataatttcgtaatgatgtgcgacgatgaaaaggaaataaaattcaaacattattggagcaaagaaatatttaaacttgcatcaatgaatctgagagaatttgtgtctaatcatgaacaaagtaataaagaaattcaaaaattggaaggatcagagataccaaaagtaacaaaaatgttgggtataaaatggaatgtcgattcagatgaacttgaactccaaataaaaattccactaatgagtaaagacacaacaaaaagacaaattttaacgatgattgccaaaaatttcgatccaatgggatggatttcaccagtaatactgaaatataaactatttttccaaaaactatggcgatctaacaaagattgggacgataaattagatgatcaagaaattattgaatggaataatatttcaaacaccgaaatgatagccataccacgttcacctttcacaagccaatatttaaaacattcaatattacacattttcgctgacgcttctgagttggcttatgccacatcagcttatttacatacaaacgatcaaataaatttattgttcgcaaaaacaagacttactccacttaaaggcttaacaattcctaaactcgaattattaggtttattgatagccgcaagagccgccaaatttataaaaagggaatcaaaattgaatctcgaaaatacctatatttggtcagactcaaaatgtgtactca

SEQ ID NO: 57720 - DNA, 736 bp, Heterodera glycines
  Genomic contig location: Contig_ID=SeqID_26987; Location=336..1071; Strand=+
  SCN-specific regions: Sequence locations=1-75,110-237,267-409,432 -492,514-644,668-736
atgtgcgcaagactatgcgaagcattgtgggcacaattccagcagtggagagccagcacaaaagtgtgtgtgtgcaaaaaaaaaattaaattttaaattatttttaaatgattgaaatagtgcgccattgccactatagtgctgctggtcgagactgcaaatctctaccgagaattctacttttttttgccctgaccctcaaactgatcagaaaaaatcgatcaaagaattccgtcgatataatattttaatttgataaattttttctgttcagttttgtgatcagagaaaaaaaacccccgaaaattcacaatagaaaatcggccagcttccatcaaaacgcttcacgcatttttaaaatttccgatgctccataaagtcatttgcttttgccaatttaacattttgtcaggtgctgacaggaggcggtggaagaaaggaatcggcgggcagtatggcggcaccaccgcccgtcgtcgagctggtcactggcagcagcagcataaagcagcaaccggcgccgccgcttggaagcagtgctcggctacggaaagtgtccggtgaacggaggccaccgccgagcggagaaagcggcggcggcggattggttttagctgcttcatccccattggcaggcaaaaccgtaggaggaggcggaggaggagggccaattgttggcacaattggagcaacaaaaagcccaatgtttggcgacatgcggccacattatgtgtga

SEQ ID NO: 57721 - DNA, 744 bp, Heterodera glycines
  Genomic contig location: Contig_ID=SeqID_26989; Location=1..744; Strand=+
  SCN-specific regions: Sequence locations=1-269,291-382,417-744
tcaaagaagagtgaggacatgatcgaggcttttgatcgggtgttcgacaagtcgaagattatcccgatgaaaatatatagcgacagtggactcgagtttcaggcgggaaaaatgaaaaaatattttgaggaaaaattcatcatcaaaaatgtaatgtatagccccgacctccacgccggagtcgttgaaagggcaaatagaacaataaaggagcgtttgtacagatattttacaaaaacgaacactctacgatgggtcgacgtaatagacaaaataataacaaatattaacaacagtgtgaataggacactgggagtcaaaacatcttcaattaattttgaaaatgcccgtgcgctctgggaaaaattatataaggctagggaatttaaaattttaaaaaagaaaaaatttaaaatcggtgatatcgttcgtattaccaaggaaaagggaaaattttcaaagggatacctcccaaactttaccgaagaattgtttaaaatcgttgttgccaatccgacgacacccgattcatacaggatcgaagatttggaaggaaatttaataaaaggcatattttataaccaggaattagtgaaaacagatggatgatttttacattgtactaccttcgaacacaccggggcaggagaacactacgtcaaaattcacagtacgactccccgagactctggaattgggcacaaattggtcagtagctctctcatcaattatttacccctactc

SEQ ID NO: 57722 - DNA, 322 bp, Heterodera glycines
  Genomic contig location: Contig_ID=SeqID_26990; Location=843..1164; Strand=-
  SCN-specific regions: Sequence locations=1-322
atggtcattttcgagctaggtattttgatggctgacttaaagaaaatgaaaagagatatagaggtagagaaaacaagagtaaatagagaaaaattaggactataagaatataatacagctccaacttcgtgtatcgagttggagtagtacaagctcagggttaatatagatcaggtttaaaggcatattcggattttactgatctaaaatttacagaatcaggtttagtattgatcataaaaaattcgagaaaaattattggaccaattttcaactttggcatggtcgggaaaaaattctgaaaaattgacaagcaaataaa

SEQ ID NO: 57723 - DNA, 554 bp, Heterodera glycines
  Genomic contig location: Contig_ID=SeqID_26991; Location=205..758; Strand=-
  SCN-specific regions: Sequence locations=1-554
atgacagcagcgcgaagtctggtcaacgcgataatagaaggcgagccaaaagaagaaattcgcttatttgtggccaaaaaggcagattttgtggcgaccggacagtacccaacggaggaagatcaaaagaagtctttggaatgtttcttcaaaaagtgtttggtggccagacgcgccttggaggaaagcaaatttgagaagattggcatgacggcgcccgctggactcaaccacttggccgaatcagagaagaaaaagtgggaagaagcgtccaaggaaacgccatgggcgttagaacaattgagggcaaaaatcgtgcacaaggcctcaaaactgatggcacaccctcgtgtcataatcggtgatcagtctgctcaccaattggcggaaatcctggaccaaacggcagtgattgggcccaaaaacggaacattggcggaaacagtgcgcactctgaagccagtggtactgtcgagcaaagtgaaggcagctctgatcattgccggacgcgactctcttctgagaggagaaactgtcgaaatgatgatggaaca

SEQ ID NO: 57724 - DNA, 398 bp, Heterodera glycines
  Genomic contig location: Contig_ID=SeqID_26991; Location=1..398; Strand=+
  SCN-specific regions: Sequence locations=1-398
gagttgccgaatcggaaaagttcgtgaattgatcgccctttttccgtcacccagacgggaatgaaggggtttaggctcctcattggtccaagacgtgcgaccagttcttcgtattcatcgtgcttgtcatggacataaggcgggcatatccagaagaacttcacgtgtgcaaaacgacggcacagattcgcgatcatttcgtactgttccatcatcatttcgacagtttctcctctcagaagagagtcgcgtccggcaatgatcagagctgccttcactttgctcgacagtaccactggcttcagagtgcgcactgtttccgccaatgttccgtttttgggcccaatcactgccgtttggtccaggatttccgccaattggtgagcagactgatcacc

SEQ ID NO: 57725 - DNA, 2014 bp, Heterodera glycines
  Genomic contig location: Contig_ID=SeqID_5338; Location=308..2321; Strand=+
  SCN-specific regions: Sequence locations=1-490,512-826,848-850,873 -998,1020-1766,1788-1945,1967-2014
  Gene Ontology: Mol. function=transcriptional repressor activity; Cellular component=transcription factor complex; Biological process =negative regulation of transcription
ttaccccaacagcagaaatctctttctgtcacttcaccaccaattgacaaattcgcgaaggaagggacagaatgcaattggcgatttccttcaacatgcgccacatgaacttaccgatggcatgctccaattgagcggagaatcgtcagaaatgctgatggcaacgactctgttgggactgagcgaacagatcaaagaggaggagggcgatgggacaatgttagaagaaaagatactgaccgacgacaaacacacttttggtgagcagtgcaaaagcattcaacatttcgaaatgctgaattatccgttgtgccatttccccaattactcttgtgctttagccactttgggtcacaaaagacggcaccaccacggccagcagtcctccgttggtgccgcttgctcttccacccaatcctccgccccttcttcaagtcaatcggaacaggctgattcaacactccatccggaagagcggaaacgcattttgcatttgcatgcggaaaagaatcgccgttttgcgctgaaggaaggcttcgagtcgcttgtgaatgccattccggtagttgagcagacgggcgttaaatgcaccaatgcggtggtgctgaacagggcggcacagcacatcaaacaattgaagagcgaacaggatcagcagcagatgaagttgagggtgttgcgggagaagattaccaacatgaacgaacgaatcgcgtgagttaggagtggaagagggggggatgaaccgatgcaccccaaaactccgccgccgaaactccgcctggcaaaaaatttcacttacaaattttcaagaaaaaatcttaggaaaattttttcttaaattcggagataaaaatattttctaaaaattttccagcgattttttttggaaaacagtttttcatcatcaagttttgaaaaaatcgctagaaatttttttaaaattacttttttcttcgaattttctaagaaaaatttttcgaatatatcgaagtttgaaaaaaaattaaaatttttttggcgaagtttcggccggcggagttttgtcctgctccgtggatgaacgtggtggaccgagcaacaaacactcccatcgttttagcctaatccagtccaatttgccttcctcatcaaccggtggttcacggccttgtgaagctcagactcccagcatgcgcattcaagtggaacaattcttcgaacattacaaaaaggaacgttcccgtgaagattaccgcttttggctggtgagtcgtgattaaaaaagggggcggggagtcggagacaaaaaaaacacgaaggggtaacgatttttttgctcttcattgttaagttttttggccaaattttgtccaacaaaagcgagtgaattccttcagatgggtgaggtgctcaagcctattgtgcattcgtttgccgaacaaattcacccggacgcgtctgaccatgaccgtgttttgcattcgttgaagaaatggctggacacccattggaatgcggcggtgcttcgtcccatcgcttccgatgtgttggtccgattggcgaccgcaagcgcagcattcactgacgaagcggcgctgagcaattatataatgaatgaagtgcgcaacgcatcctccgctcagtgacacgatgccgcttttgaatgaatgtcagcactttgggatgcccggttctttttgaggttgcccttctccttctctggcgatgtgccctccccatccattttgttgcgactattcctattttttttcattattttgtacattctctgctcccccacttttccatcccttctctcccttgataacatatctttcgtttcttttccttgtcacctcattgcccttcgttgaattgctggtcaattctctgcaaccttttttctacacatatttcttattattttttgctcaatcagaataggccatcacagaaatgtgtcaaatatatatttttaattaatcagagaaatatttgtcagagttttaccatatttttaataaatggctaa

SEQ ID NO: 57726 - DNA, 1360 bp, Heterodera glycines
  Genomic contig location: Contig_ID=SeqID_5340; Location=287..1646; Strand=-
  SCN-specific regions: Sequence locations=1-200,222-480,502-885,910 -1256,1278-1360
atgccttccaaatgtccttcgtttggccaggctgaaaagcggttggagcgtacgcactgcgaacgcccgctcgccgacgacctcaaaacagacgctgatcaacgggggcatatccgaggcggagcaggcgcacattcagaaggtgctcgaaagggcggaggccgggcgccagaacgaacagcagcgcatatggtgggccaattcaaaaggcattcccaactgagtccctccagcaaaatgatcgaacggttggaacggctgagggcacgcgctacgggcaacggcgtcacgcaatgccttttgtgccaaaccgaattcggactgttggcggcaaaaagttacgctgcgatgtgctcggactgccgaaaggtgccaatgggaaaagccgcttaaactcaatccgacccgttcagtacgtatgccaaaggaattgcggcgttgaaacattcgatcagaagcgtcgtgagcccatttttctgtgcaaaatctgctcagagtaccgggaggttgtaagtgcctttcgcttgtctcttttcgcctctgttcttcgtctgatcgtttgttcgttcattttgctcagatgtggaagaagtcgggtgcctggttctaccgcgaggttccgctgcccctcggctcctcacggccctcctccgccatggccgggtccatcgcaatgatggccaacggcgggcagtcctcctatctgccgctcagcccatccgcacggtccaacccccccttgggcagccaaaccggaccaatgcaacggaggcacttcgaatttggggccgggaacgacccctgcagcggagcagaaaacattcgaatgcattccgctggagagggcaatcagcaaaggacggagggcaggacggaacagcacccgcagcagaagaggaacagcaacagggcaccagtgccaatcccagcggaacatcagcaaaggtcgaaaaagccgggggggggagaagcgaagggaccaatggcaatggcaggctgaagacgaccccgcgaccgcgcatcatcccttcttgggtccacgaaggccttcagcagtccagcgtcagtgtggacgacgactcggacggcgagtcggcttcctcgtccacttcctcgtctttggaacccgcacagttccgcaagtcgttggtcgcggctaaagagcgtgcgctttcggtaaaacagcacgcggctgctcatcccctcggggcaaacgccggcggatttgcgagtggattaaggacaaacaaagcgaagccgaagagcaaaggcaacgccacggaggctttgggacatcagcagggcatccaaaagatgcagagagttgcactgggaagagtcggacgaatgtcggacacag

SEQ ID NO: 57727 - DNA, 951 bp, Heterodera glycines
  Genomic contig location: Contig_ID=SeqID_26995; Location=272..1222; Strand=-
  SCN-specific regions: Sequence locations=1-249,271-492,517-951
  Gene Ontology: Mol. function=structural constituent of cuticle; Cellular component=extracellular; Biological process=cuticle biosynthesis (sensu Nematoda)
atgttcgaaattaaaacgggcggaaagggcggcgaagcggcggccgcgcgattggccaacatggtaaagtgggcatttgacaattggaaagtgccaattgaaaaggccctcaaaataaagtgccggggattaaatcggtggcaaaatttcagaaataagggcaattccccctaaataggggcaaaatcggcacctgatgttttaattggcagtaatcgaccctaattgacccttaaacatgcaatttccgtctccaggcaatccagcgtcgccagttggagaagcgtgacacgctcggcgactattggtcgcgccgtttgcacgacatggcgttgcgggacgacccggtggacgagcgggcggaaggcattggcggacgactcggcggcagcggtggtggtgccacctcgccccaggcgccgaccactggcggcgtcgccaaaacggcggcgacgtcgaacgcaagcaaaagcggcggcacttcgtcaacacgcggcggaagcagcagcagcaaagagaatgcaccgcgcgcggagagtgcaggggcatcagccaaagcgaaggtagtacatagggcagagaaaaagagggcatagcgggaaaaggaaacgccgcgttcactccatatgataaaatttagtccaaagaaaagaccgcgcgggatgtgccacaatcggcgtacgcgcgaggggcgcgtgacgaatttgtggagacgccatcgacgggatgctgtaaggaaaatgcatcaaattggaatttttataaaatgacccgtcaatttgtctctgaattttagtgccaaattcacacaatttttcaatttttccgcatttaggcacatgccaacgcggaccgcccggtcgtacgggtccgccgggccgtgacggattgcgtggaatagacggagagccaggacgtagggatttcaaaattgaaaaatctaatgtttaa

SEQ ID NO: 57728 - DNA, 697 bp, Heterodera glycines
  Genomic contig location: Contig_ID=SeqID_26998; Location=556..1252; Strand=-
  SCN-specific regions: Sequence locations=1-271,295-427,449-697
atgcttctcacttttcctttctgtcttctgttgatttttgctaaatcattcaattgccaaatgcaaaatttcaattgttttgcccaaaatgggcccaatcgccgcctctctcccgcccaattagcagacacagccttttggcatgagcaattccaaaagattgagctcaatagcgcggacttcaaattgaaagagtttatttgcgagttgagccaaaagcagcgaatatttgaggcagtttttggaacattgccaagagtaagttaaccgcttaattaattaattaactaatgagtccaccaccattaattaggcccttgttcctccttccatggatgatgaatttgaatttatcaaaagtagaagagaaatgcttgtccacaatgatcccgctttgagtgaagtgctcaatggtttatttgtcactgcaatgaatgccaaacagaaattgcaattatttccgggtgaataaataacacttttaattaattaccattattaatttgtttcctttttcgatgttgacgcttttctgcttgtcaaaacgatgcgaaagcatctgagttttgtgcttctgttcttggccaaacgttaccgaattcggctgagtgatccgaaagagcgaattgttttgacggaacaaagtctaaaggactttttagaagaatcattccaattaataagccaagtaattaaa

SEQ ID NO: 57729 - DNA, 1164 bp, Heterodera glycines
  misc_feature (55)..(55): n is a, c, g, or t
  Genomic contig location: Contig_ID=SeqID_26999; Location=182..1345; Strand=-
  SCN-specific regions: Sequence locations=1-51,96-134,157-386,410 -619,641-977,1014-1164
atgtttttcactggcattgaccgactaatcggaattgctttttcggaaatgtaanaaaaaatttttactaatttaatttttaattactaattttagtcacgactttttaaaaacgcgactgtatttggcaatgactactgtcatttccttgtcatatggattccttttctctgttgtgagttaccaagaagcaaaacaggacggcgatctaatggtcactggttcatacatagatgtcttaagggtaataattaatattgtttcgttctgattagagttgagcgggaccggggcgggaaatcccggttttttcaggtcccgaatttttaacaaaaattttcataattttttgtaaacaaccaaagaccaggtttcaaaaaagattcaatataattttttttttaattttggcgtttttgttaatagaggacactcaaatctatcgaacaataccaagaattgtttaaattagttgcttaggaaaaaattatggcaacttttttgtcggatattttaactgtgttatatttttcagatcattcctctgtttgttacaataagtaacttgtttactataatgacttttgccatttatatctttcttggcattacaatacgtataaaagcatcaggtaaaacatattaaatatgatacaccgccggtattttatttttatcaaaatttttgtgcttttttactggtgttttttgatcctgcgattcaacctaataaatggtaattaaaataaaaaatataggcttgccgtccgctgattcgtttaatcgtcgcacttttcgtgcccttttttgcattatcactgtgaatatcggcggctatttaatctcagcaattacttactttctgctaattccaattgcttctccggtcactctttggtttttcgctttaatggccgcaattcctatgaacattggcgcagtgtcaaacggacccattttatattttacgaggtgtcattttaattaaaaatgttttaataattatttttaaagtttagtacggagtatcggcaggcatttcaaaaggaatttccatttgtgttcaaacaaactcccaaccaaaatcaagtcgtacctcggcaaaatgggccacctattcgtgtaatctcacaatcaagaataattgacagtagtaaaccataa

SEQ ID NO: 57730 - DNA, 48 bp, Heterodera glycines
  Genomic contig location: Contig_ID=SeqID_26999; Location=1516..1563; Strand=+
  SCN-specific regions: Sequence locations=1-48
atggccactttgatgaagcaattcaaaaagggaacaaagtgccaaaag

SEQ ID NO: 57731 - DNA, 3341 bp, Heterodera glycines
  Genomic contig location: Contig_ID=SeqID_5341; Location=90..3430; Strand=-
  SCN-specific regions: Sequence locations=1-83,115-1143,1165-1484,1507- 1537,1564-1684,1706-1827,1849-2327,2350-2391,2413-3341
atgttatggttaattacgactatcgttttcgcttctgctgtgcttgtctatatattctacccacgaaatggacaaggtaattaatgaacaaattattaagaaaaaacatgattatatttttacataaaaagtaacttttggtttggttatatcaaggaaaagctcatggttatttattaactgttcatgtttgttttcaggtgtttcttcaactccccccgaaacggagtctgttgatgatgcacagaattcgcttgacagtaacaaatccaaagataatgtttttaaggtactttcgctgaatgaatcttcaattatctaatgaccactggccttattttcagagcatttattcgtctttcgttaggggaaagtccacaagtttggctgacattccgcaaatgctgcagcgacgccattcgacggtggacgattcgcacatcccatcacaagttgccaatgtggctaaaaggtgacttcatttcctcgggttttttgattcaattcgtctttattacaattttattttaaagtcaacttccaaaaattcaattttttcgaaattttttgattgttttaattaagagactcacaatcagccaaataaaataccaattatgcataattgtagggctatttttggttatcttatagcacattcagatttgtttaaaaatatttaggctgtgtaatgcctcatgaaatttaagtgggtttagtaagattttggccacttaacggggccataactttgtgaagtcaaagtgaaaaccctaatcaattcgtcaaaattgggctaatataagagaataaaatggtacattctcattaaaatcgctttatttaaatgaccgagaaatctaatttcaaacactgtcaataaatgatccatttctttaagcctttttcgcaacagtgcaatgtatcgacgtcaaaaatctgttggaggaaatcgagaagcacttcccaagccaccgaacgaattttttgaaccgattcctatgccagaaatcccggtttttgttcatttacatatgtgaatctctaaagcacttaaggatgaccgttttaaacctctcacttttctccgtcaaaatctccggtaggcagggaaaattaagccatgaccttttcaataatacatttaatttactattatttcattttattcgttcattttttagaattctcggattcccttcaaactgtgatatcaaccagaaggacatccaagtgttcataatcgaaccgaacgaagttattgtgaagccgggggatccgggttggttttttgtaccagattatgttacctttttaagaagtaccaataaacaaaaagactcgctaatacatatttctccaatacttaacttattgtgagtcggagttttttttaactttgattgtttcaaatgtttagatgatgcaatttttgtcactttggaaggttgtctgtccgttttcatcacggtaattaaacggcattttttgttggtttttccccatggactatttgcattgttgtatgaattgtatcagatgtttatttattttttcaattttaagccacctgatgccaacgataagccaattcatgtgcgacggattgagcccggtgacttcttcttcagttcgctttctcttattgacattttcatggtttgtcctctcccccctccgtcccttcactttttcctttagggtaatccttctaccttgaaaacagtgactttacgcgcggacgttcggacacgtttggccaagtattcgctgctcaatttctacaacttttatataaatgagccgaatgtgtctgcgtgggttcgtccggttcagataatcgccactcgacttttgcacgttgtgctgaccacgcttcatcagcagatgggccttggggaggaacttattaacaaagttggacagttgcaataattagttgggtttgtcgccattttcagcgcttaaatccgccaacagaacgaagcaaagagaaacatcgcgggcagtctttgcgagcgctgaactcgttgacaaaacccaagctaaaacgaatgtcgacggaagttgagcagccaaaggcagagcagaaaatggcactcgctgttagctatttcagcgaagcattgcgtctttcagaaagcgatgccaatgatttgattcgaccttttctcaaaataattcatttggaagagaatcagtcgttgttcgaggagggcagttctgaaaatcagcccgcattggccattatcgtgtcgggcgttctgaagctcactcaacagccccgcttctcgacatttgaagacagcggccaggaaatatggactgctttcatccatcccaaagaacttgtcggaggccttcaggttggggctcattcactgattgttttggagttcaattaaacattttcgaattgaacatagatactgacggatgaaccggctttctacactgtgaagggtgcttgtcattgtgtggttgctttgctcgagaaaagtgatgtcgaccgtctgattgagcaaaggccttcctccgtccttccaattgcttactcagttttgctccgactttccccctttgttcgtgctgttgattttgcgctcggctggttattgttggattctggtgaagcagtttataggtcctcttctatttttgtgttcatttgcaatcgattgatccgttccattctcttttaggcagggcgacttctctgaatccttttttatggttctcagcggacgacttcgttccgtgtcccacaaagttgcaattgaagagttcggaaaaggtgacgtgttggggctcgttgatgtgttgcaacataatccaagagcaacgacgggtaagtcgcatggaaatcattgaaactctcgcaaactgagtgtttggcgtagtgttggctgttcggttttcgcaacttgcccgcatccccgagggacttttgaactttgtgaagatgcaggtcggtgcagtttctcgacacataatctcttatccttctatttacagtacccacaagtcggtttccgtctcgttcgcttgcttggccaatattacgctggtcggagtcatttcccgctgatcagtcacccatcgtctgacccactgacccaaagagtttttcgtcttattgatcagtaatttcatatttttcccgttagaaccttcacacaattgccgttttccccgcttccatggacattcccttggttgcttttacctgtgaactttaccatgctttgagtgcgactacccgtgttcttcggcttagtagcacttcggtgatggaacggcttggcgttgactccgtcatggaaaggtatggacaaattaaa

SEQ ID NO: 57732 - DNA, 646 bp, Heterodera glycines
  Genomic contig location: Contig_ID=SeqID_5343; Location=20..665; Strand=+
  SCN-specific regions: Sequence locations=1-418,447-646
atgacggacccagcggtattttaagattatttagttacgactacactcatagaatttagaatttgttggacgagcgtcaacagcaagcccagcaaactttggcaggtcttcgtcgcgattatgaagaattggatcacacctttgtcgtatatgaaaaggaatttgaaactagggtaaattatttgattcttaagcatgcttcgcttcccaaaaataattgtaacaaatttagataaatcgcaccaaaactgcttgggaagacgcagttcgttctcgctctaatgaaaatggtgagtgaatgttagagttaataatggacaagtagatccatttgagcctttaattcatttttttacagacaaacgtcagttgctcgagtcaattagggaccgtcttcaaaatgttttcgaaggtcaacaatatttattaaaaacaaaaatccagattatttaagaaaccctgaaacacaaggctgttattgagaaattagaggagcgcgacaaacggatgggcaatatgttggaaagcgtagacaatattgaaaatctcaggaagtgaaccgacatagaatgtatgtagtattcccccacttcttatcccgatatcaccattattgcctcgttcactcctgatctctctacagtca

SEQ ID NO: 57733 - DNA, 1314 bp, Heterodera glycines
  Genomic contig location: Contig_ID=SeqID_5343; Location=220..1533; Strand=-
  SCN-specific regions: Sequence locations=1-126,149-225,249-759,783 -814,837-1068,1097-1314
gataggaaaaagcaaacgcatttgcgctgtgaaaggtgaatacgaacaaaatttcaagtttgttaatgttaatacttttggtttcagacagaggagagaagcaattaatgtgtgagatattcaagactttctttaaattttaattttagagcggttacaacgaactaaaggaccttttgccagcttctgcctctttcattgggtgtaggttccttctaaatcccttcattctttgtatttgaatattccaaggcaaaaccaccaacgctgccatcctctttaggtattaatccttttcataaaataggtaaattccccttcccattttccctctcagagctgccgattatgtaaaggctcttgaaacatccatggagcaaaacgctgaagaattggcaaagttacaaacgcaatattcggcattggaaatgattttgcagcaatacgaaaatttttcgttgaattcacagccctgctcggctttgcaacttcagattgtaacaattttagtcaaaccgaaaatgttattctttcaaacattaagcttcaacactttctcgacacctgcttcgactctttcacctcgagagttgacctttcaaattaccaggccctcactcggtcgttgctctcctgggttgaatgtcttgaataccaagtatttttactttttaggcttcatttaactgatcttttttagggaacatcggatgtacttctgaacaaactctacaaaaatcattgatgaatgttgggctcacaagataacaccaaatatttccgcgttttattgtagagggataagtataattttaccaataattattcacgtaatatacatttattacggataagttttatgctttattgactgtagagagatcaggagtgaacgaggcaataatggtgatatcgggataagaagtgggggaatactacatacattctatgtcggttcacttcctgagattttcaatattgtctacgctttccaacatattgcccatccgtttgtcgcgctcctctaatttctcaataacagccttgtgtttcagggtttcttaaataatctggatttttgtttttaataaatattgttgaccttcgaaaacattttgaagacggtccctaattgactcgagcaactgacgtttgtctgtaaaaaaatgaattaaaggctcaaatggatctacttgtccattattaactctaacattcactcaccattttcattagagcgagaacgaactgcgtcttcccaagcagttttggtgcgatttatctaaatttgttacaattatttttgggaagcga

SEQ ID NO: 57734 - DNA, 1185 bp, Heterodera glycines
  Genomic contig location: Contig_ID=SeqID_27003; Location=1..1185; Strand=-
  SCN-specific regions: Sequence locations=1-569,591-782,806-1185
  Gene Ontology: Mol. function=apoptosis inhibitor activity; Cellular component=cytoplasm; Biological process=chromatin modification
ttcccgggtttgacccaatttttatgggaaaaatgtggaaagtcaggcctttccctggttttccaaggccctggggacatgtacgacgttggcatgggccatggcgctaatttctctgtgaacgttccgctgagggaagggatggacgacgaaagttaccacagcggtaattgcaaatttatttatcaaaattggcaatttctaaaatttggcattttcagtttttaagcccgtcatacaggccgtcgtggacaatttcaatccttcggtgattgttctccaatgtggcgctgattcgttgggctccgatcggcttggctgttttaacctcagctttgacggccacgggtatgtttagaatggcacaaaagggggagagagagagagaaaggagagagtggttgagaaaaagtctatggccaaaccatttgggcaatttgccttggaatactcttccaaattcattccctcagggaatgcgtccgtttcgtcaagtccctcggccttcccctgcttatcctcggcgggggcggctacacactgcgcaacgtggcgaggtaaaaatacacaaaggaaaaaagaggagcacaatattaaaagtggggtaatttggtgtgaagatgctgggccaacgagaccgccattctcgtggaaagagactcggagatcagcaacgaaatcccggacaattcggaatacttggagtattttgcacccgaattcactcttcgtcccgaactgcccaaacgcatagaaaatgccaatagcaaagaagtgagggatttatgttggaaatgtaaaaaacgttctgctaattggacatttccctttttgataatgggtggaagggggaggaatgtattaaaagagggatttgtaactaattttgggtcaattagcgtctgttttaaattacagccattttattcacaatacttaaacacaaagattactatcttagtaatgttctgaatgtaaattataaaacaattaattcgcagtttctttttagtatttggctgccatcaaagcagaagtgttagaaaacatcaaattggtgcggggtgcgccctcggttcagctgcaacctgtccctggcgatgccttcgatttgcatgacatcgactcgaggagaagagaacggcgcgaaaatggcacggatttccgttcgatttgatcactttt

SEQ ID NO: 57735 - DNA, 93 bp, Heterodera glycines
  Genomic contig location: Contig_ID=SeqID_27004; Location=341..433; Strand=+
  SCN-specific regions: Sequence locations=1-93
ggccaacagacccacaaaaacacctcttgcacatctatgttcgagaagcgttgtttcaagattaagtcgcgagatatgtcattaggagattac

SEQ ID NO: 57736 - DNA, 646 bp, Heterodera glycines
  Genomic contig location: Contig_ID=SeqID_27006; Location=307..952; Strand=-
  SCN-specific regions: Sequence locations=1-14,38-280,302-646
atggtcatcagcacaacaacgacaacaatgacaacgaattgcttgacagagcggaggtaccaacggaattggcacgacaatcaaagggaacggcaaaaacagcagagggaaagacaacgcaccgggaaagtgccaacggcggcggcacttttggacagtgccaatggtcggcgtacttttgctgcttctgccggtgcggcaggtcgaatcatttgcatgcaaaggatgcacgccgcccatgcgtatgcccaggcgaaaagggcgaaagggtaagtcaacgagacaaatattaagagaaatgccaatgaagaacacagttaatgaccactaatgactcaattgtgtccgacacattcactttcgttcgttctctcaatttgatgttttcccttgtcacagggagaactcggcttttcgggccctcgcggctttgccggcacgccgggcactgacggacccgaaggacagccaggcgctcccggcatggttggcgcagaaggcgatttcggcgatatgggcccaaaaggaccacgtggagaccgaggactaccaggggcaccaggccgagagggcattcccggcttggacggattgccgggtttgcccggcgatatgggcccgcccggatgcaatggaacggacgtaa

SEQ ID NO: 57737 - DNA, 1751 bp, Heterodera glycines
  Genomic contig location: Contig_ID=SeqID_5344; Location=2624..4374; Strand=+
  SCN-specific regions: Sequence locations=1-225,247-570,592-689,723 -753,775-877,899-934,960-1267,1291-1723,1745-1751
atgcaaaagaaggtattaaatccgattaacttttaaatatgaatccgtttttaagctttattatgtgaatcaatcagcgacacttttgccttgtctttcatcaaaaattttcataaattaccaatagttgaggctaacgctgatcaaattcaaggaaagaatataatggattttgtaaaaagttatttaaataattatttgacgaaatctatcgaaaaagacgaaactggagaaaaccctatgaattcaaatagtgatttaattaagatgaagcttaatgcgttggttgataaagcaggagagcaatgccaaaaagttcgcaagaatcaatcaaaaaattttctgggaaaatttagtgcaaaaattggcaaaacatttcaaaaaagagagttaaaaaattcgaaaacaataaaaaatgaatttgatggtaattttattctgtgcatttaccattttttgtacacattttgccttgaacttatcaaaaatattgcaaatgatcagagcaacaaaatgaacagcgacgaattaagccaaattaagcaaatttatttaaatttatatggcaaatcatcaaaaaaggttataaaatattttaaaatgaattttgaagccggaaatgattttaaaaattcaattggaatttactcattaccaaaagaaaaggagatgaaaacggaaaattttggtaaatttaaatatttttaataaaaaatttaaaacttttagaggaaaatttatcagcgaatagtccatttgaaatgatttcaaaattatcagataaaactggtaaatacccgaaaaatattacgtcaaaagaaattacaaaggagagaaataaaatcacaaaatttgtaaagaaaagcattgccaatttaaattttggggaaataaaaaagattttgacactaaaatggtttgccaaaatatttgctaattttaaaaaggccaattttattatatttaccgatttaacaaagctgaaggacattttactaattgcattgagaaatgacaaatcaccagaagagagccaaaaaaaggttcatgatttttaaatttcattttcgatttaatcactttaaaagaaaaaagaacaattaaattatttaagattattaatttggccgacaatattttgttggcaatttcatccaatcacaaatgtcaaaaacgaataaatcaagcattaaatgaacgaaaatatggcaaaaatgacgacaaaatgattaaaaacgagccatttatctatatgaataaaatgatagaaattagaaaatgtaagttcttcttagtaaaaaaagtttgattaactagcaagtttttatataaactgaaaccgtcaaagaatttaaacctgaattctaaaaatttttacttttctaaaataatttaatagtttgggagaaaaaaggaccattctgaaaagccgataaaaagtggtaattatctaaaaaataaattaaagagtaattttttatcatttaaattcttgtgaattcaaaaagtttcgttcctttttagcttatcgccaaattggaccacgtgtaaaacgccaaattggcacagatattgttgcgctgatcggatactgtaacttttattttggcttggccgttctgttcattggcgcaccaattgtggctgccgtttttctgtccccggctctgttggcattgttttttatcaccggatgggttggcgttccggcggcaaaagtcttttttgaaaattgcattttgaacatttga

SEQ ID NO: 57738 - DNA, 435 bp, Heterodera glycines
  misc_feature (23)..(23): n is a, c, g, or t
  Genomic contig location: Contig_ID=SeqID_5344; Location=4633..5067; Strand=-
  SCN-specific regions: Sequence locations=1-192,214-349,371-435
atgtcctatccaatttttgtttngagagaggagatggtcgatgaagcaagaaggggtgcttcgcttcaacagcagaagtgagaggtcaaaagatgcttttattataaaggatgtgccgatgagattttgcccatccccgggggggaaattctttggccccgtctttccgcaagtccatctcggcattttaggacaacaaatatataaaattttgaaatacataaaaaaacaaatctattcattacagatttttttgccagcatgccgattatcaagggctaaaatccgtagatttgcgtatccatttttgggttattttaaaatcaatcaattagattaagcttactttaaaaaatagtgaaaatattaaaattttctgaggtgatgtccaaaattgttttcaacccaatgcatgcgagaagtaggccgaataaa

SEQ ID NO: 57739 - DNA, 954 bp, Heterodera glycines
  Genomic contig location: Contig_ID=SeqID_27012; Location=613..1566; Strand=-
  SCN-specific regions: Sequence locations=1-365,410-478,508-527,550 -693,715-954
  Gene Ontology: Mol. function=protein binding; Cellular component =nucleus; Biological process=signal transduction
atgccaaatgaatgctcttcaggatcgcctcagggctatttgtccgacgattttgaccaacagatgagtccatgctcggatgtttgtggccaatccagtccgctgtttgtccaacaggtggcgcttgcttggttgctaattgaaatgataaattattgcgaaatccggcttgcaatattttaattttgtaaaattcaacaattttctaatataaaatatggatacagtgggagtgggaaacatctgttgcaaatactaaattaaaatcttaaatttaagcatcagttcatattcaactccaacagacagtcaacgtccaatgatgtgttaaacaagtcgtctgacccgcaatcggtctttatgacaaataaataaatcatttttatatattttttataattttattttaccagatgatttatgaagcggcccgttttgacagcattatgaaggatttggccgattgtggggtacaaagacggcaacagcagcaacaacaacaaaatgttccgaagtcagtgcggttatggtggtggtggtggtggtggttgattggatacaatgtttttttcccgttggtgtgatcgaattcaatcgatccgattgctaatttggtttatttatttccaaaacattttaatatggaaaatgggccgttcagataaagggagtgaagtcgacattttttgtgcgaaaaattaataaaagtgaattttttggctgattccgtcatcacaaattaggcagaatgatcggcattttgcagaattctattttaatcattttttctgacaaccttttttgcagcacacctccgtccctgtcgctgcccaatggcatttccgtcattcaatatgaggagccaatgttctggtgcaaggtcacatactatgagctaaaccagcgggtcggcgaagtgttccacgcctccaaaccatcgcttattattgacgg

SEQ ID NO: 57740 - DNA, 366 bp, Heterodera glycines
  Genomic contig location: Contig_ID=SeqID_27015; Location=172..537; Strand=-
  SCN-specific regions: Sequence locations=1-366
atgggaaatcatcatgccgctaatggctcgccaacatcaggcagcccctccagcagtacggtaaggaaattttagaatttacagctaattttttttttttaaatagcgccatttggaggcggtggtgcgtaaatcggcaatgtcaaaaaatgcacgcataaagtgagaaaaataatgtatgaaaattggtatttaaaaaaatgaataaatttagattggcacaattgagggaacagcaacggcgaaaatcagtggcaattgcaatggaaagggtgaaaaaaaacaaattatcaaaaaaaaattcaaattaggcaataaaatttccaatgagcgtatttttggagtttaaatgtaaatctaaataaa

SEQ ID NO: 57741 - DNA, 729 bp, Heterodera glycines
  Genomic contig location: Contig_ID=SeqID_27016; Location=37..765; Strand=+
  SCN-specific regions: Sequence locations=1-307,330-482,545-606,658-729
atgaagccaattagggcaaacttaatggattatatcccagacaaaaagtggctgattgtgagtctttcggtttctataaatccctcataattgaaagatatgaggttcgcaagtgctaatttgatgctgccgctaggaatttttggcacagatgcaaaaaaacaaaatgaaaacagacccttttggatgatcagcttagtccccaaagccgattataaattggaacttcgatattagcttaacaaagattttttatactaaaagatttccttaaaaaatgattattcattttttagcatgtcaatggcaatgaaaaactgcaaagaaatgccgatgaaaaatgcatgccaaagggtcgtggaccgaagaaggagggggcagtacccgccaagaaatggtcatccgctttacgtgtggtcgctgcgatgacacgcttcaaaaacatcccaagggtgggcagcatggaaatcactttttgtgtgaaattaattaagtttaaattatgaaattaatgaatttgaaattatcaaattatttaaattatgcaattaattacataactttaaatcttcaacaaatttttttttattacatttggacatgtggaaaaaaattttaaattttaattgtttcatatgcttttataattataatttacgaatatgatttaattaatttcagcaaatggtcggatttccttattttttggtctcttttcccatttattaa

SEQ ID NO: 57742 - DNA, 502 bp, Heterodera glycines
  Genomic contig location: Contig_ID=SeqID_27018; Location=118..619; Strand=+
  SCN-specific regions: Sequence locations=1-2,52-316,338-440,463-502
atgtttttgaagctgtcccccctctctttgcttctcttcctttcgctccttttgctcatttctttcgccattggctacagccccgtgggcaatgccaaaagtcacccgctgaaattgcgcaaacggatcagttacagtgacggcggagtgatggcactgaacagcgcggcgcggaagacgcgaatgccgacgcgcaaaatggtggagaagccgcggatgcgctttaagggaggtgagagaatctggggaaagccggaaatgccgtaatcagccgaaggaaaaactgatttaaatcaccattcggtccattgaatgatcacctttttctctcaggaagcaaattggcacccaaacacagcgcagtgacgacacaacgccaatgagccaatgtttgaattcggaaggacaacggcacgcacagagagagaaagaaaaatcagtcaatggcaaaacattggccaattcctttgcattttgtatttatattcagagaaaattaata

SEQ ID NO: 57743 - DNA, 391 bp, Heterodera glycines
  Genomic contig location: Contig_ID=SeqID_27021; Location=599..989; Strand=+
  SCN-specific regions: Sequence locations=1-235,257-391
tactttttaattgcattttttttcatttcaacatttaataaagcttggattgccatataaaataaaagttgtagcaagacttcataaatgtgcaattatcagatatttaaagaaaccagcacaaatttggtattcgaaatggaagaaggatttcaaaatgctttgtatgaccaatactgaattgcagcaccctctcatttctgcgttgtctctctcccaaatgatatttcccgccaaaagaaattttaaaaaattaccgaaattttaaaattagcgttcatttatacgttgttggcaaaatgcacattgttaataattaaataacaagttaaaggttgatctccgatgaaaaaatttttttcataagaaaaagttgttttgcctttctcta

SEQ ID NO: 57744 - DNA, 294 bp, Heterodera glycines
  Genomic contig location: Contig_ID=SeqID_623; Location=712..1005; Strand=+
  SCN-specific regions: Sequence locations=1-294
atgatgccaaagattggtcatattttcactggtcttttggcactgtcctccgtcgcaccgggcacggtaaacgcttcccaaacgggtggagcagtccaatcagttcaacaacaatggacatcaccacctcaaatgccgggccaaaatttaatggtaagattagtaaaatgtcctattaatttttgaaaaaagcctcaggaaacgccgatatcaatgaaaaatcgtgaactatcacttggcggaaaggaaagtttcgaaactgcggtttatggacaatcaaaggtagaaagttaa

SEQ ID NO: 57745 - DNA, 893 bp, Heterodera glycines
  Genomic contig location: Contig_ID=SeqID_624; Location=122..1014; Strand=+
  SCN-specific regions: Sequence locations=1-30,53-345,439-452,474-893
atgggtataaatatcataaatagcgggcgaaatgaagaaatgggagaaatggagaataatgataagcaagttttagacgaagtggaaaatatgaacaaaaaaggcagattaaacgagtccagcaaattaaatggagttacttacgagagccattctttttttaaaacaattgatcatacagaaatggaactcttgacgaaagacgaagagcacgttctcaaatcactggaaaaatcgctacaatcgcagatgttagcggttcggaaaagtttcgctgaaagtgaggggtcgaaaatgccggtggaggacgaagaccaagtagcaccactaatggacgagtggggagaaaaggaggaaaagaaggaaaagaaggaagagaaaggaatgaaggaaaacaaaaaggaggaaaagaaggaaaaggaggaaaggaaggagaagagggaagtgcctaggaaaaaggcggaggaagaaaaacgaagcgcaagtgcggtgacggtcggagaagaagtcgtgtcaatcgtggactccacagaagaacgggaacaggagcgggaacaagaactgttcctaaacccgcaggtaacaaatgagcgcatggctttttgggaatcaacgctgtataatcattgcacaaaaaagacgtggcggaaaaagaggccaaccgaaagacggcagaagtgggagtgacagtcggctcaaaaaaaacgtgtttggagcgagctggagcctcctgtgttgcccgatgagccaatctcgaaatttagcgaaaaaatgcatcgatgcgcagagatcgaccaaaacacgaagaaagcacgtgtggtgatggatacactcctcgcaattcgagagaatgcgctcgaactgagcgaccaggcgcaaaagggtttccgtga

SEQ ID NO: 57746 - DNA, 91 bp, Heterodera glycines; identical to SEQ ID NO: 53030
  Genomic contig location: Contig_ID=SeqID_624; Location=2421..2511; Strand=+
  SCN-specific regions: Sequence locations=1-91

SEQ ID NO: 57747 - DNA, 568 bp, Heterodera glycines
  Genomic contig location: Contig_ID=SeqID_624; Location=3755..4322; Strand=+
  SCN-specific regions: Sequence locations=1-45,67-89,111-236,258 -502,524-538,562-568
atgctcgcacttttgttcgtgagttcaatgccaaaatttaaaacggggattttgcatgtttttccatattttttagcaaaaaacagtttaaatttcaaataatatttgccggatttccttaatttcttatatctcactggttttgtgatttgccacttttatgtgccatttctcctcatttgaccaccgcggctgcgctgcgctccgtatgccgtgacactttttgggaggcacacacattggacctgttcaccagaagtggcacagtggcatacgaactgggcggaaccattgccaaaattggcactgtggtgggcagaattgaagatgccatccgcgcattaattccacaatcaactcaagaaaaaggtactgtacaaaaaaataaataaaacttaattggaaaaaacaatgtaattttttttgctcctggcattaaaataagaaggaagaatcgccgatgccaattagtgttttaatgacatttattatcagattttgcaataaaatggacaattttcttaataattaatttcagataatgaaaaattatcaaatgcaaaattga

SEQ ID NO: 57748 - DNA, 1804 bp, Heterodera glycines
  Genomic contig location: Contig_ID=SeqID_627; Location=236..2039; Strand=+
  SCN-specific regions: Sequence locations=1-6,28-36,58-152,174-223,245- 564,589-620,642-1550,1572-1804
atgaccaaaatttccaattttttccccggcggcgcctatgggcaccgccgggccccccaaaactcctattttttcttagaaaatggcccaaaatcacaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcggcgcctgccccctcttcccaaaaagtttttttggaaaaagcgcgcctcaaaaaagcgttttattgatttttaaatttggaataaaattttaaaaaatgacttttgctttatgattttaactattaaaaagttgcagaaaaaatttcgcttttcgcattttcgcatattttggcttttcgcatttcgctttttttttcatttcgcatttttcagtttcgcaaatttcgcttttcgtatttcgctttttatttttcaatttggcccatccctgttatatacaaaatcaaaattggcggtatgttcagttttaccaaaaatcttttaccacatcttttaaagtcttcggcttctgccatgcatttgtgttgttcaatcttcgccctgggtttcagaattgctgcttaacggatagaccgtagcactgatgctgctccttcgcttacagtgtttcgcgaccggagtacagtaacgccgctgataaaggtgacccggttactgtggaacactttattgtacagcatgcggcaatcctcgcgtattgttttgttcaacgcccagtaaatcaccgggggaaatcctagggcgaaaaatctaattaaatattataagcaacagccgaccgtggacatggaacctaaaaaacgaatttttggaaattaattgccagccaaaattatgggtttgaccaagcaaattcagcgagagtgatcatccactgatgggcttcgttgtattgcaaatagacgtaaaagaagccggtcaaagaatgcatcagcgaaatcaaaaacacttggataaatgtctgagaatttaagaagtcataaaattaaatttactatcttaattggtcaaatttctgacaataattaagaaggcaatcctaaatcaatttgtttttaatttgcgctaaaaatctgtttctactgggtgactctgattgtgtaggtgctagtcaatgcgcgagaaagtgcataaatgatgacgtcacaaaaaggggtcggggtcgttttcgcgtgggccgttttcgcgtggggcgagtttttgaactataatttttttatttgtcaaccaaatccaataatcttggtatcattcgatagccctaagtgttctctattagcctacaaaatttggaaaaatttcgttaaggtccaaaaaagttatggtcagaagagttcaacaaaccaaattttccaactttttttggctcgaactttttttatactgaacgaaattttttggaattttgcaggctaatagtgcatctggagggctttcgaatcataccaagaatgttggatttggttggcaaagaaaaaagttatagtccaaaaactccgccccacgcgaaaacggcctggcccgccaaaagatgcttttagtgccattgaattttttggtctttttatttgccgcttttctcatgaagtaaaattaaatgttggagaataatcggcacagtttggttttgccgaactgtttaatctgaatgttgtgccatttgtgcaagagttgtgccaacaacggcaaagaagctttaattggtcatcaaa

SEQ ID NO: 57749 - DNA, 732 bp, Heterodera glycines
  Genomic contig location: Contig_ID=SeqID_628; Location=1147..1878; Strand=+
  SCN-specific regions: Sequence locations=1-99,121-160,189-444,467 -561,583-732
atgggtaaaatcctgtcccagttacgaaattacggatccctttttttggtgcctcggaattagtaaccctcctccgttctgttcaatcaaaattccggactaatatattaattaattcatccattaccaaatccatcgtactttcggcaatataaattgcttaaaataaaagaaataaataaataaatcatgtgagttaaaaactcgatgcggtcatcccagcgaagtaaatcagtgtcggattggagcagaaaacggctccgcggaagctgagcaacgcgcttaaatagcccaggacgaacatgttgaccaggtcggtgatgccgatgtaaaacaacattttgtagcaagaattctcgcgcatatgcttccaaatggagtaaatgcagggcaaatataggacctgcatagttcgaaaatgttcgaaatagggtacggatttttatagatgtttcattttttctgactttctgagaactttggaagacagaatttgttttagttgctactgttaagcaactgttggctctgttatgatttttaatatatattcctgaaaccataaaaacatagaaatcctcttttatggattatatttaatattttctaccgattttttaatttttagtcatttttcctaaaaatgttggtgatttcggtccaatagatggagaaactgatcaaaaaagttttgatcaggacaccaaaaatgatcggataaggaatcattag

SEQ ID NO: 57750 - DNA, 428 bp, Heterodera glycines
  Genomic contig location: Contig_ID=SeqID_629; Location=683..1110; Strand=-
  SCN-specific regions: Sequence locations=1-428
atggttttgaaaggcaaaaaatctcaattctacaaatttttatgtgtacttggatttcacaaattttccccgttatgtacttggaaagtgacttggtacgatccgagccctgaataatatagatgaggttaaaatgcttttttcacaatttatgtttcaaaactagaagaaagaagacctaaaaaatctttttcacgaaaaattacttctttataaaaaggaaaaatcttaattttctaaacgaaatattaaatttttcagttaattattaggtattagggtcgagattcttaggttttaaaaatttcagcggctttattttaaatgagaaatgttcaagaaaaatacttttggacttttctcaccgaaaatagggcgtttttttcctattttgattttttcaaaatttttaacataattaaaataaa

SEQ ID NO: 57751 - DNA, 272 bp, Heterodera glycines
  Genomic contig location: Contig_ID=SeqID_5346; Location=1240..1511; Strand=-
  SCN-specific regions: Sequence locations=1-20,42-82,104-272
atgagtgttgagacgggcgccgacgaagacgacgacggagacggcgaacttctcgcaattccttctccgtccgcaattgccgcccctttggcgggggcacaacaaaaacaaagtgttggccaattcgccaaatttatgccaatcgattcggaggacggcggcgacgaagccaatgaaagggaagggaaaagcgaagagggacaaatggccaacggaggaggacaaatggtggaaggggcgtcgctgagaagccaaatgcttaagctgagcaa

SEQ ID NO: 57752 - DNA, 2388 bp, Heterodera glycines
  Genomic contig location: Contig_ID=SeqID_5348; Location=829..3216; Strand=-
  SCN-specific regions: Sequence locations=1-27,49-227,249-461,483 -501,537-700,722-2140,2165-2290,2312-2388
tgctctgtgtgttcctctcgccactctcttccgcccgtttccatcacgcttccgtccccgcgtgtgccctttggctgttcctcaacttcctcctcctcctcctcatcccttccgatgcttcccattcactgatcccttctctgatcaccattttcgtcctcttcgccttctttcccttccggccattggtcattttcggcacttcctttgccatttcattggcacatcttggcgcatttgggttttctgacgaggccaagccgagcacggaaaaggtgggcattcacagtgatcagtacgtcatggcaaccaacagaccttaaatttgaatccagcttttaattattaaatcgaattttatctctgatcaggaaactccattataaccatgcataggttttatttgataagacattgagtaaagctgttctctgggctattgatcagagttggttgacttgatcacattcagcacactcacattttttgcaatattacggcaacaataattttatttttaaaacaaaatcaattttcagctaatcgctgctttgttggcacatttgtggactcatttggtcggcttttactcaatggcaaacggtagaaaaatttctcgtgccgtttttctgagtgcgcgcaattcggtggaaagtgaaacggagtggaaaagggagagagaacgaatggtaaaaaaaaattaaatgatttgccataatttctgatcggaaactcctaaattcgttttccctagaattattggggcttaagttgctgataacacctttttacaatccctttttggcttttaggcccagcttctgtccgcttcgctgccccctcatgtcatttcgtctgtactgctccaacttgacgggcccgaactgccgcgagtgtttgttgaacactttgcccatgccaggtgactcaaattgccgcaaacccggcaatttccagcgtttctccgtcccactgattagccaatgcctaattaatcacttataccatttcagtgtcatctttgcccgattccacggcttggcctcagtgttggcacaactgcaagtgcccgactcggcacgtctgctcaacgagttggacttgcgcattgggcggttggccaaactgcacggccttttgctggtccaatccgacgccgtgttggcaatttccggggtgccggaagcgcgcgctgatcacgcgctcgtcgcctgccgctttgcattagaccttttggcattgacaaagtgatcaatccgagtcacactaatattgaatgagtcatcttcaaatgatcactaatggtcttcacactatcacaccgatcaactcattgctgatcaaaaacaaaagatcagataatttctgatcaaatctctttttttgtccaccaaattatttgacttttatttggccgtctctaacccgcttatcttttttctctgtcttgccacaggagtttcaacgagtcggcatccgtcgatattgatattcgcattggcatcggttcgggttcgttgtccggcggcattgtcggcgcccgtcgatggcactgggaggtgattggcatggcggtggacgcggcaatgcatttagaagccaattgtgcgccagacaccgtactaatttcggacgacacgcggcgactgatcggcgcgagattagccgccgatcgggtggacagaggttgctggcggttgagcccaacgggcacggcacaaccgaccaacaacccggcacttaggcctttgcttttcctgaccgcgtcgcgtcgcttttcactgctcacgacaccgcaggcaatggcattaatcaatcaataccgatcaatattttggccaatgaattattgagattttattctgcctaaagtgcgcaatgttcattccaaagaaagtctcattagatcaaaattttggtcaatttaatctctaagcaatgtatcaaagtattacaaatttgatcaattatattcattccagcagattgatcagtctttcgatcgtttttgtccagactgaaaagtccttttttaaacagccactttttattcccattaatcagttatcaagcaaccataatcactgatcaaaaccccttcaggcgatcaaccgtctgctcaaccaatcggtccgtccccccaccgccgtcgccgccaccaccgacggaattccgttgccgacgccgttcaccaagcggaagcagttccaaccggcgcaaaaggtcagcctgtttcggcgccgtgttcgtctgccgtccgatcagtgccacagttcgctgccatcgcctctgctgggacactctccgctgatgactttgtcccttcgctttgccgaccatcaaattgagcagctgttccacgcacaaatcgatcggtggtacgtttga

SEQ ID NO: 57753 - DNA, 546 bp, Heterodera glycines
  Genomic contig location: Contig_ID=SeqID_27022; Location=1..546; Strand=+
  SCN-specific regions: Sequence locations=1-158,180-546
  Gene Ontology: Mol. function=homogentisate 12-dioxygenase activity; Biological process=phenylalanine catabolism
ttaatggggctaattattttcttttttaggacccgagcattttcactgtgctcaccgtccctggccttcgtaagggcgtcgcactcgccgattttgtcattttcccgccgcgttggtccgtcgccgagggcactttccgtcctccttatttccaccgttcgttttttgggcctttctatccgataataagcaaatccaggaaattgtatgagcgaatttatgggtctgatcgttggccgatacgaagcgaaggagggtgggttcagcgcaggaggcgcgtctctccattcgatgatgacgccgcacgggccggacgcggcgtgcttcgaaaaggcgtcgacggacaaattgaacgccggaaggattggggacgggacaatggtggactaatgagggaaataacgagcaaggagcgacctaattaaggcttttatgttcgaaagttcgctcagtttggttgtgaccgattgggccaacgaagaatctgtggatgagcgataccacgaggattggcaaccattgaaaagtcattttgagaggagcaaa

SEQ ID NO: 57754 - DNA, 237 bp, Heterodera glycines
  Genomic contig location: Contig_ID=SeqID_27023; Location=518..754; Strand=+
  SCN-specific regions: Sequence locations=1-48,132-237
atgaaatcatttgaggcgcttcggaagagtttttgtctgcccgaattgggagagaaaggggagggaagtgaaaatagaacagaaaatggagaggaaaatgaggaggaagagaaagagacggaagaggagaaacaaatcatacagaaatattgtgagcagttgaaaaatggagacgaaactgcggaaaatgcccacattttgttcaaaatcaacataataccactgcaaagagatggg

SEQ ID NO: 57755 - DNA, 1290 bp, Heterodera glycines
  Genomic contig location: Contig_ID=SeqID_27024; Location=46..1335; Strand=+
  SCN-specific regions: Sequence locations=1-466,495-621,675-807,831 -1087,1110-1290
gctgaattatggagcacatttggacaacaatcatcacaaggaaaagttccagggaatatttgttgaaatggcacttcaaaatgccaactacgcatttcggcacaattttgacacatttttggcggaaatgctcaaaagagcggaggaagggtcactatacttcccaattctgataaccgataatgacggttcattgatgattgaacagatggcgtttgaatcgtactttttggtaatttcttattgaagcgaatattttcagaccggagagcgcctatttgtagaatttgttagaggtcagccctattttgaacaattttgctgcgatttggaaagagatggtaaattgagggattttgtcatggcccaagaagccactctcgaagaaaagcaaaattatttggcaaaacaatatgagacttacttcggcattttgtatttgatgcgacacaattggcattgtgacaaaaaaggggaggaaattggggaagaaaaaaggcggacaaaatgcgaaagatttcgcaaatacacagacattgtgtacgaatatttgttcaaagtctatgcaaaaagtaaggaaggaattacggtagaatataatgttgtttggcatactgtaggtttaaaattaaattattatttttaggaaattaattaattttttcaaatttaaagctgaagagcctttgttgggtcagcaattccccgtatttaaaccaacgtttaatgtctcaacattaataaatgaagtattgctttatctgcacaaatgttcagtgttattttttgacgaggaactcagaaatcaaaattattatatttttaaaatacaattgcaaaatgggcacaaattgcgcaattataaggctaattttggcactttggaagaatcgctgcgcaaaaaatttgacaaaaaactgaaaacgatgcttaaaaaggcgagagaaaacgaaaggaggacgagagaatggagtgccaattacaatgacagcagcaatttgctgagggaatcgcccttttttcacagagttttgcgggttcgtttcaatttgcgatgcgcgggacagactttttttcgaggcccgggaaagagacattttccaaaaacattccgtaaaacttaaagccttgcaaacacttttcgggaatgcacccggcacggatttcatgattagaatcatattttagggtcctgatccgggtgcatttctcaaaaactacctgggtcaagatcagggttcccaggaaaaccctgacaagatcctaacctgtcaacttcctgttcacccg

SEQ ID NO: 57756 - DNA, 114 bp, Heterodera glycines
  Genomic contig location: Contig_ID=SeqID_27025; Location=1096..1209; Strand=+
  SCN-specific regions: Sequence locations=1-114
atgtcttcgcataatacttcagttattgatgaaaatcgacgatggagtgacttacgctgtttaacagatagggcgtctacatttgccaattcaggattcgtccctggaatcaag

SEQ ID NO: 57757 - DNA, 621 bp, Heterodera glycines
  Genomic contig location: Contig_ID=SeqID_27026; Location=161..781; Strand=+
  SCN-specific regions: Sequence locations=1-621
atgttcgatggaacacaagtcaaattcatcggaaagggagtcgccaatttcaaattccgcgatatttgcatcaaaagcgaatattatgtggcaaaaaggggatcgctaaatttgctaagtgtgcaaatgatggacgcttttggactcctgaacgaactcaaggccaaaattaatgcgccagtaaatctgtgccgagttggagacgagacaagaggttttacaaaagctccaaaaccgtcacaaaatttgacagtcaaagcgcacatcgaccatctcaaagcgacatttcccgacattttcaaaaacgaattgggccgatgtatgaagttcaaggcgcatctgactttaaaagcagacgccgcaccggtctacagaaaggctcgcccagtcccatacaacgcacaagaagcgattgatggagaattggagcgatgggagaaaatgggtgtgattgggaaagttgaatacaccgaatgggcagctccgattttggcggtgaaaaaggccgacggaagtgcacgttttcgcaaatcgacctcagggatgcatatctccaaatcgaattggatgatgaatcgagaaaactatgctcgatttcaacccatcatggcaattacgaaa

SEQ ID NO: 57758 - DNA, 364 bp, Heterodera glycines
  Genomic contig location: Contig_ID=SeqID_27027; Location=61..424; Strand=+
  SCN-specific regions: Sequence locations=1-234,256-278,301-364
atggccataaaatatggaccaaaaatcgcaaaatatggacataaatggaaaaaatgtcaaaatatggacataaatttctcaaaattgaatgtaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaaacataaaagctaaaatttattaattttttttagcgcaaaatcaacaacaaaagcgaaattttcgcttttctgcttatttttgacataatttattaa

SEQ ID NO: 57759 - DNA, 155 bp, Heterodera glycines; identical to SEQ ID NO: 51421
  Genomic contig location: Contig_ID=SeqID_27027; Location=158..312; Strand=-
  SCN-specific regions: Sequence locations=1-155

SEQ ID NO: 57760 - DNA, 1670 bp, Heterodera glycines
  misc_feature (1659)..(1659): n is a, c, g, or t
  Genomic contig location: Contig_ID=SeqID_27031; Location=13..1682; Strand=-
  SCN-specific regions: Sequence locations=1-435,458-916,947-1459,1481 -1507,1529-1530,1552-1575,1600-1670
atgaacgcaactctgaaaaacagaagcgaagacaacgcattaattcagaaaaataaaagcgatgatcacggattaattgcacttttgtcatcaagaatatcatcagcagggtaattgatggggatggggttaccaggggtggagcgcggacagaaaaatcacacgtcgcggatctcgcatcgcggaaggccaagtcatatgttaagcgccgccgatactttttagcaatttttttgtttgtttgtagattaatattttcaaaatttcgtcgtttagtcgagacttaaatgaccgagagtcgagacagctaccctaaaacccaagaaatttcacctaaaccgataacggtgctgaccgatagattccgtacggggacctgaaaacagacagtgattatatcgccccggtatcggccctgacctaatccaattaatctgcataaaaattaacaacaacaatagaaaagtgagcaacgcggacatggactgtgcactgatcagttttggacgagagttggaaaaacgcttgcgatttgtgcatcatgagtttagacaatttacttacaagagtgaaaagcaatgtggtagagacccgcacagtaaacaatattttgattataaacaaccattcattggtgataacaatacgccggcagaagggtactactgtaaatgtttattaattgtaacaccgtattcccatctattataacggtgctgggacgtttgtcaaaaaccaccccctcaaatggaaattttttggagtttttgtgcctaatgtgccgattttagaatttttgaaaaaatccttaacaaaaatgcgataaaaacgaaaaacacatccctatgaaatgatcaaaaaaaattcagaaaatacacccctaagaattgaaaaaattttcaaaaaattgaccaccaatttaatattatttatgataaaaatttttgactaaaaatttgtccttattcgaaaaaaactttaaaccaattgaagcaaatttaagttgtttgattaagtttttacgtgatttgctacctaaaaacgttaaatttttatttgcctatttaatgcctattttgcgatttttttctgcctttttaggtgcctatttcgcgattttttgtgcctaaaaatcgcatccctacttatcataattaattattctttaaggagtaaacagattgagatgaaaatttttggcgagccgttgtggaattatgcgagagtaattgaaattgatacgaacgacgccaaaggtcaaacctaattagtagggagtccaattatatggaaatccatttttttcctggactgtgggaggcctaaaacgcacgaaaaacatgtttttagcttgttttgaagcttttaggatgactttccatatgcatattttgcatatttgtgcatattttggcatttcatgcatattttatgtgcatatttgggcatttttccaaaaaacccctattaaaacggcccccatgaggtaaattggcatttttgactcttaaagaccgaaaaaatttccgaaaaagacattttttagcaaaattttgtcaaaataatgattgaatttaaattttcttaaaaatttgttaatttatgtcaaaaataagttaaaaaatggaaatttttcgatttttattcaattttcgccanaaattaataaa

SEQ ID NO: 57761 - DNA, 409 bp, Heterodera glycines
  Genomic contig location: Contig_ID=SeqID_5349; Location=2369..2777; Strand=+
  SCN-specific regions: Sequence locations=1-222,244-409
atggacaaaggatatgtccgagggaagagattcgagaaactaagactcttgaataatgacgggattattgattgccacgcagctcagtcggttaaaaagaattccacggtatggaaaggccgtgagttcgagtcacaccgggagaattaactcttaagacaaaggatgtgctcgagaggagagattagagaattgaaatgagctctattgattggtggactgatgccgaaaatagggaaaataggccgagactctcgactatctctctaattgatttgatttgatacctttgccgtcatcgttttcagtccagctgatttggacgcaatgttgctggcgtaatgcatgatggaactgaggaattgattgatcagagaggaatattgcaattatttaattgtaatttaaa

SEQ ID NO: 57762 - DNA, 950 bp, Heterodera glycines
  Genomic contig location: Contig_ID=SeqID_5350; Location=2656..3605; Strand=-
  SCN-specific regions: Sequence locations=1-494,516-716,752-929
atgcagacactgtttgaaaaggcgagaaaatattgtggcgagcaaatgtatccattaggtgaggaaaaaaagtttttttttttaaatttttgtttgttttcgatatgttgcatcggagcaaaccgaaagcgtattgggacgacatttacgactcaccaggtgaattggcgggattgcccgctaatcatttgcacccttgtgtgacaggcctggaattcatcgcacaaaaaaaaaaatcgaaattcgtgattctgaggcctcctccccctaaaaacgggcataggcacttggtttcctaggccccttagtttgggaacggaatatcgcgtcccctacaatgtccgagatttgatgttcccatctctgatgtgtaacggcattttttgcaggcggactgcgtatcatgcgaccgtacaccaaggacgagaacggacacccgggctgtcccatcaacgggtccattgacggtaaaaccgagaaaacagcagcaatattttttctaacaaacataaaaaattggtcactcatttttttgaaagtgcaatattttacttacctacatttacttacgattgtttttctattgaattttttttgaattaaatcaaagaaaattctcggctttgtatccccctatcctttaggtcttttcttctccacactgttgcgcggcaaaaatctgcctaaggattcgccatttgggtcagtatatactcattaaaaaaaaatttaattaaaaaaatttattatagcgacgtgcaaatggtcgtttcggcgcgcaaactgctcgattttgacacatgcaatttgtactttgccgacttttatttgcacgcggcaagcgtggacgagccaactcagtcctccgtgctccactacgtcacggtggtggtgtgcaagcacaactcggacacggacaagtgattatgatttattttattaataataaa

SEQ ID NO: 57763 - DNA, 157 bp, Heterodera glycines
  Genomic contig location: Contig_ID=SeqID_5350; Location=282..438; Strand=-
  SCN-specific regions: Sequence locations=1-157
atgggccaatttgacttgggtggactgctcggcaacgtcaaccaatttacgagccaagcgggcgtcaatttgggcggcattttcggccagatgggtcaacagcagccgaacacggcgcaaagcaatgatcaaccgccacggcattttcatcggggcg

SEQ ID NO: 57764 - DNA, 313 bp, Heterodera glycines
  Genomic contig location: Contig_ID=SeqID_27032; Location=16..328; Strand=-
  SCN-specific regions: Sequence locations=1-221,243-313
atgcgaggaggaaaaggccaagtcgcgggaactcgcccatcggatggaacgcgaaaggcaattggaggcggaaagggaggcactgaagtgagagcatttggcacagcaaagacaaaatgaaatgccaacgcatctccacttcccttttaaggcatcaaatgttgtcgaaggaagtgaaacaattggaagtggaaaaggagcgaatgggcggcgaaatgagagaggcgcggcggagagcggagcaactgcaggaacagctagcagaggcacagcaggagacggacaggggcacagacggaaacacgacagttga

SEQ ID NO: 57765 - DNA, 771 bp, Heterodera glycines
  Genomic contig location: Contig_ID=SeqID_27033; Location=1..771; Strand=-
  SCN-specific regions: Sequence locations=1-20,89-107,155-172,379 -420,455-489,563-676,700-731
agcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggt

SEQ ID NO: 57766 - DNA, 133 bp, Heterodera glycines
  Genomic contig location: Contig_ID=SeqID_27036; Location=680..812; Strand=+
  SCN-specific regions: Sequence locations=1-133
ttaaaaaacgggcgcaaagcgcccgtcctgaggccgcgaagcggccgaatgtccccaaaataattaaaagacgggcgcgaagcgcccgtcctgaggccgcgaagcggccgaatttccccaaaaaaattaaaaa

SEQ ID NO: 57767 - DNA, 748 bp, Heterodera glycines
  Genomic contig location: Contig_ID=SeqID_27039; Location=677..1424; Strand=+
  SCN-specific regions: Sequence locations=1-71,96-100,122-122,144 -190,221-360,384-505,528-748
atgagtaagagatttggataattctactgaaggtgccatcagaaagtgaatgaatgtgtttttattgcgtcattttttaatataaaataataaatggaccttaaataaatagggaattggggtaattctactgatggtcactattatagattgaatcataatatttgtatcatttttaattaagtctaagaaaaaataataaatatgattaaataaataagagaaattaaacaacttaaaaaacaaaaaatcgaaataaaccgaaatttttatgaagatccttcgttgacatttgagcagctttatccatttgtaaacaaatgctttagttggacgatgaaaatattaattattcatacgaaattaaaaattttatttgctaatgaatttcatattatagaatataattgagcaggaattaaaaatcttcgggattgatcgggttggtcgggatccatattttgaatttcaatgttttggaattcatctcggaaattatgcaacgctttttattggtgaaatttttgaaattttgtttaggctaatacaaaacgttaatgaccattcgagcaatacacggagactttgcaaagaggcttatccaaattctattcattattgttggaatgaattgaaattttgcaggaaaatacttgggattgagcaggaacaaaaaatcaagaataactcaaggcttaatcgataggccggaattatttaacaattataattcactataatatgccaa

SEQ ID NO: 57768 - DNA, 1786 bp, Heterodera glycines
  Genomic contig location: Contig_ID=SeqID_5352; Location=554..2339; Strand=-
  SCN-specific regions: Sequence locations=1-6,28-169,221-909,931 -987,1025-1193,1228-1786
  Gene Ontology: Mol. function=dicarboxylic acid transporter activity; Cellular component=mitochondrial membrane; Biological process =gametogenesis
ttaatttttgtatttttggatgaagaaatcgatgggatttggcgttggttcggatgaccgccgacggtcggctgccgcccgcccagcgccgaaattacagcagcgtgctgaacgcgttggtgcgcgtcacgcgcgaggagggcgtcctcacactatggcgggtgggccgaaaatattttgattttaaatattttaattttaaatagtttattcattatttctagtcatgatttctggatggattcctcgatttttcgtaaaattcgaagagttcaattttttctgatttttttttttttttgatattttacgatgcattactgagttttttcaaaaaatgatcaaaaaacgctgaaacgtttcaatttttcttaaaatttcttattaaaaattttcgaagattttttcctgaaaattctaagtttgaaaatttttttttaatttcggcggcgagattttatctcggcaagatttcgggcgcagcgagacggaattgattccttttttctttatttttcaattcaaatttcatttaaaatgccacctctgaatcccccccccccccaaaagggctgtactccgacagtgatccgtgccatggtggtcaacgcggcccaattggccacctattcgcaggccaagcagcagctgctcgcctccggccatttccgtgacggaattccgctccatttttgcgcttcaatgatttccggattggccaccaccatcgcctcaatgcccgtggacattgtgaagacgaggcacaaattagcaattaaatgacggacaattaattaattaccctaaacggggaaaatgcgcaagaaaaatcactttttattgagggccgaaacttttgaaggaacactatcaaattttgttgattgttgacgaaaggatcaaattggaaattttaaattggcaaaagtggaaaaatcttgaccagaaacaaagggtgaaagtgagaaaaaacatttgaaaatcgggaatatttgaaaatttaatttattttttttcaaaaaatgcgttaatatgtctcaaaagcaattaggtaaacggacaattaatcaactgtaaacaagtgaaaagcgcaaaaaaaattgtagagggccacaaaattggcaaaaagtggaaaacgcttgatcagaaacagggataaaagcgagaaacaacatttgaaaatcgggattttgaaaatttaatttatttttttttcaaaaaaataaagcgttgcatatttatcaaaagcaatttggaagtcgataaatttattttggcaccgctaatgacacctcttgtttgaatcatttgcataaattcatttaacagaatccaaaacatgagcgttgttgacggtcgtcctgaattctccggcgtcgtggacgtcgtccgccgcgtgttggccaacgagggcattttcgccctttggaagggctttttgccctattacatgcggctgggcccgcacactgtgctcacattcatccttctggtgctatttctaatcatttttgactaaaagggctggctgttcgagagtctcggaagagtttggagagtttgtttcttaatatcgactctcgagctcatttccgggtctcgatttcggaaaatctttttttccgtcaaaatttacagttttataaaaaaaatccaccgttttttctttctttaaggaacaaatgaacgccctttacaaacggttgaaatacggcgcctaaaaatgcatgagggagaagaatgaacacacttttccgatttcaatttcactttttaattttgttgt

SEQ ID NO: 57769 - DNA, 751 bp, Heterodera glycines
  Genomic contig location: Contig_ID=SeqID_5353; Location=809..1559; Strand=-
  SCN-specific regions: Sequence locations=1-443,595-726,748-751
  Gene Ontology: Biological process=regulation of protein activity, epigenetic
agcatttgccatcgaaccgcgctcaaattttggagctgaagcggaacagtcaggcgtgctttctgttgctgcatttgaagctgtatctgttacgactgtacgggctgaaggaggagtgcgtttttttttactttttcaaaaattaaaacaaatgccaaaaaatttgcaggaaaattgccgattattctccgtccgaagcgaaggaggtgtacgagaagccgtgctgtcgtcgcaacatccggtgcttttcgcccgattttgccaccacagttggcgaaagtggcgccgccggcgcggcaccgcagcggacggtaacggacgaatgggcggagagacggagcatcgcggaggaatttcacaaggtacagtataccacacacaaaaaaacattcaaaagcatacggtatgagtgtggtgaaggaggaaatgcccacaatctgttgaattttacaaaaaaaaaaaagatttttaaatttttgtgaaaggtttaaaatgaattttctaatatttttaaaacattaaattttttaaaagaaaattttaaattttgtaaaggtttcaaacattttaaatttttcaaatatttttaaaaatgtttcagttccacgaaatgcttttgtcattggacgaacggcgggacgacgacgaggaaagggcggtaggcgctgcggcgaacacttcgaattcgtcggcgacgacggcgccggcgggcggcgaccattccgcagctgatgatcatcaaaatgaatga

SEQ ID NO: 57770 - DNA, 333 bp, Heterodera glycines
  Genomic contig location: Contig_ID=SeqID_27043; Location=738..1070; Strand=-
  SCN-specific regions: Sequence locations=1-39,88-173,227-244
atgccttctggatggagaaattgcagatttcatcgtgagtaaataaataattattatgaaatttttattttaaattttttaaaatttgcttttaaaccaaacaaaaaaaaataatatgtgacgtaacacaactctacaatttcaaaattgttcaaaaataaacgtaataaaggaataaattaaatataaaaattcatattatagagtgtaaattataatttaaatacattcattggttgtagtcaaaaattataatttaatgaacttttaaaaaaattttcaggaaaaatttactataagttttgataaattaaataatgattaaaaaataaa

SEQ ID NO: 57771 - DNA, 420 bp, Heterodera glycines
  Genomic contig location: Contig_ID=SeqID_27046; Location=1224..1643; Strand=+
  SCN-specific regions: Sequence locations=1-420
attaatttaacctctgacaattggtcgggcgcccacccgaaaatcagcgaggcgctgctgcgccattgcgacggcggtgccaccgcttatggcgccagcgttttggacagaaaaattgagcggactttcaacgaagtttttgagcgagacgtggcggtgttttttgttggcactggtgcgcaaaaaatatcaaaaaagagctaaaagagattatgtgaattggtttttacgattgtttgccccaggcaccgctgccaatgcgttgtcaatggcttatgtgaatcgcgcgggtggcatcattttcgcgcatcggcatgcccatctgattgaggacgagtgcggcgcgcccgaatattttacgggcggcgccaggttggtcggcgtaagcggcgccgagggacgcattgagccggaagtaat

SEQ ID NO: 57772 - DNA, 672 bp, Heterodera glycines
  Genomic contig location: Contig_ID=SeqID_27048; Location=292..963; Strand=-
  SCN-specific regions: Sequence locations=1-359,381-512,539-621,664-672
ggggggactgcccggaaaacaaaaaaatcgatttttcaagtgtcggttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 57773 - DNA, 427 bp, Heterodera glycines
  Genomic contig location: Contig_ID=SeqID_27049; Location=23..449; Strand=-
  SCN-specific regions: Sequence locations=1-427
atgacaccgccctttagaacatcggtgattgctgtaacgaaacgaatcacattcccaagtaaacctaatatggttaccatccacataccaacagctatgtggatagtcaccatccacatagctgttggtatgtggatggttaccatattaggtttacttgggaatgtgattcgtttcgttaaaacaatgaccggtgttttaaagggtggtgtcattaccgctgcagacgtgcaggatttgaagcgtggttggacccagcttgagctggatgcgaaagttggagcattgaaggcgaaaaatgaccggatgtatcagtccatttgtgcgcgccttcaaggacaggccgccacaattcagcggctgcgggcgacaaaaggcttgaaacgatctcgtggagacaagagaaagacttcagttcgtggaaatg

SEQ ID NO: 57774 - DNA, 333 bp, Heterodera glycines
  Genomic contig location: Contig_ID=SeqID_27049; Location=533..865; Strand=+
  SCN-specific regions: Sequence locations=1-333
atgagcgcatgtctcactcccttagtggctgcattgcaagcacagctctccacacttcagcgtttgcgggagccacaaggcttgctccgctgccgtcgacacacgacaaagccttcagctcgtcgaaatggtaagcaacatccacatagaaagtggtatgtgaaaattgagcatccacatagccgttggtatgtggatgctctatttttcaattttcaaaatttaggtgttgcaggaaagaagaaaggcctgagaaaggatcagaagactgcaggccgccgcagagttgtcattgacgattcatctaacggaggtgggtctagaggactgtaa

SEQ ID NO: 57775 - DNA, 665 bp, Heterodera glycines
  Genomic contig location: Contig_ID=SeqID_5355; Location=24..688; Strand=-
  SCN-specific regions: Sequence locations=1-233,270-287,312-665
atggctttatctgcagccaaaccggctctactgcagtttacgcgtccaatcgacttttacgcgtccaatcaaaagtttatgtgtccaatcaaaagtttgtgtgttttgatatcagaggttatcgaaaccaaaataagcacgcacatattagtctctctattattaaattttataacaattgattgaatgcgtatatacctatcgatactttgataataagtgatcaatgacggatttaaattttattaaaaattaattagtaattttttctttctcttggagttacgtttttaatatttaaattattatttctttttgcaatggttggtaccttatgtgaaaaggatgttcgatttaggaaaattttgattggacgcgtaaacttttgattggacgcgtaaaagtcgattggacgcgtaaaagtcgattggacgcgcaaactgtgattggacgcgtaaaagtcgattctacgcgtacaatgccgtagagccaaatccttaacaaaacataatcacattttctaatttatataattagagagtgggaaatttcagggttttcccattctttggcatcacgccaatgaacctgaagagagggaaatggacgggcactcgtactctaaccgagcagagcaggacattatccttgactacgtcaaaagg

SEQ ID NO: 57776 - DNA, 538 bp, Heterodera glycines
  Genomic contig location: Contig_ID=SeqID_5355; Location=920..1457; Strand=-
  SCN-specific regions: Sequence locations=1-38,75-278,301-538
atgaatgtcataattgccaaggtaatgatgacacccggaaaattttttagattaattatgttaaatatttattactgcaccgccgattattgttgacatatcactgaaacagaacgggtaatgaaaattggaaaatgctaataagccgataagcaatactaataaataaagaaattagaagaaaatatattgaaacggaataaagcataattatggcatttcggtaacggattaggctagtatttggtatttaatattcgacttaatgaccctaagggattttgcatttcccaatacaaattaggacgcacttgccatttttcataataaaaaaaatcggatactaaagctccatttcgacggagactaaaccgtccggggcgaagccgttatttaaaaaaccttctttatgaaaatttttgtcgaaaagatttttgaacatttttggccataactttttttaaacttaatgaaattttttaaaattttgcaggctcgtaaagaacatttagatctatcgaatgatatcaaggattaa

SEQ ID NO: 57777 - DNA, 619 bp, Heterodera glycines
  Genomic contig location: Contig_ID=SeqID_5356; Location=242..860; Strand=+
  SCN-specific regions: Sequence locations=1-84,114-187,210-312,343 -539,571-619
atgtgctcgtacaaaaacagcctggcccggccgataggtgccgccgtaaaaaaaaaaaaaaattgaaaattgggagtttttggtagcattttttacataaaaatggccatttcaaagcttttttttctcaaaaccagcgaaataaaacattaatcagaaaaaaattaaaatgtttaggtgaagcctgaaaataagaaaaatcttagaaataaggacattttcagtttctaagatctggcccctccaagtaatgacaaatcttagaactaaggaataaggacacttacgaaccctgcttaatgacattatgtcataaaatttcaaaattataaatatatttaagaaatctgaacaattttcgtcgttaccccaaaatcagaacattcttataaataagaacaaatggaagccctggtttaaaggcccgcttggactcattcatactggcgctaacgaaatcggctacccgacttttggggatttgcaacttggggacccgacattagggaacccgacatttagggacccgacatttggggattttaataaaacaaaaaaaatattaaaaaagcccttgacggatttctgttctcgttggcccttggggaaggcactttaa

SEQ ID NO: 57778 - DNA, 833 bp, Heterodera glycines
  Genomic contig location: Contig_ID=SeqID_27052; Location=11..843; Strand=+
  SCN-specific regions: Sequence locations=1-119,150-189,211-380,430 -451,473-571,593-833
atgacaaatgcacaaagacagtcgcagggattcgcttctcctcaggtgaaaacaacggctaatgaggtccgtaattatgtcagcgtggggagggaaggagccacgtgcctgcccctcccaaataaacaaaaatgaatttttaatatttaaaagagagaatttttgaaaatttcgaacatatttgtcctgataaaaaatctttttcaaattcgaaaaatttaacgcttcttttttaaataggcgaaaaagggtgaaaactaaaaactaaaaatcaggcccaaaaattatgaattaccaaagaaaattaattttctcttcagaaacaagtaaactttcatattttgtccgaaaatgactatttaagtctattctttgtcaagaaaaattaacttaatttaaaattattatgaattttcttaataaaaatttgattctgggattgtggggttagtttcccgcaaaatccggccggtggatcggtctcgcgccgatctctaatcccaataacttagtatgtttttttttatttattcaaaaatttgaaaaccctggatacaggctggactaaatcaagaataaaatgcaatataaattttagcaaataaaatggctagcgcgggtgcatgagcttgaatcgacgattgagtcggccaaattggtcattagaattgcgctgccgcccaatttaattgagaaatgggttaataatgaaaattgggctgtgttgaaagaaaatctgaaaaacatcgacatggaagattttatggcctatcaggacgaaaggcgttggtttgggtgcaatttctcgaccactgtttgcgataattggggat

SEQ ID NO: 57779 - DNA, 459 bp, Heterodera glycines
  Genomic contig location: Contig_ID=SeqID_27053; Location=1..459; Strand=+
  SCN-specific regions: Sequence locations=1-80,109-249,271-344,373 -381,403-459
tttaaagccatccattgcctgccggttctcggcaccgcaaagcactaatacggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttaaaataataattcattacccaaaagttttttacaaccacttattgccaatctaatttcttgcagattgaaagccatccattgcctgccggttctcggcacagcaaagcactaatagggtgtttgactc

SEQ ID NO: 57780 - DNA, 658 bp, Heterodera glycines
  Genomic contig location: Contig_ID=SeqID_27054; Location=56..713; Strand=-
  SCN-specific regions: Sequence locations=1-658
gttttaggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgcttgagtaccccaaacggacacttgaaaaaatcgatttatttgt

SEQ ID NO: 57781 - DNA, 1160 bp, Heterodera glycines
  Genomic contig location: Contig_ID=SeqID_27055; Location=3..1162; Strand=+
  SCN-specific regions: Sequence locations=1-166,195-302,328-1160
  Gene Ontology: Cellular component=COPII vesicle coat; Biological process=ER to Golgi transport
atgcaaaacacgacggacgttgaaattgctgcgctcgacgcggacaaagcggtgcaaattgagatcaaatatgacgacaagttggacgagaaggaggccgcctatttccaagtgaatcattcattcaatcaccccaccaattttgcatttttcactcccaaatttcaattttattttaatttttacattttattctggttactggttgcaggaatggtccaatactaatttgacctagatgggtttttagaagtgagaggagggatgtcatggatgagggataaaacaaaagaaaattcgaaattttaaacaaaaattcttacttttcccttagaaattttcagagggttatcttagcctcccctcctcttttcctggatgaagggattttttctaaaacattttcattaaactatacaaatttagtgtttctttttttcagttggccgtgctgttcaccagttgcggaggccaacgacggctccgtgtgcacaatgtaaaaatggaaatttgtaaaaaacaaatttacaaataatgcaatcctccggcacagctctcactgccgatcagctccgattatgcgcaactgtaccggctgattgacgaggactgcttggccacccacttgttcaagcagggcaagcaaaaaataaaaaaaacatttcaccaaaatattatttttgaaatttcagcggaacaaacgctgcgcgaaaaggcgcccaaagaaattcgggacgagctgacactacgctgtgcccaaatgttggccgcctaccgcgagaagtgcagcgagcaggccccgcttggccaactgattttgcccgagtgcgccaaactgttgccgctgcatgtcaactgcattgagcgccacgacgcgctcaacggaggtcagtagagcgaacatttaggaaatttcatgatgatacatgtgattcgggaactgtatcggaccggatttggtgtgaaaatcctgtaattttgattggacattgatccgattccattttttaaatcccgtgaaaagcccggcaacacccaggataaatgatgtcattgtggacatggttgctgtagtgttcagcttcatactgtatttacattcgagcgcattgttatttgcacttcattcctccgtcctcattttttctttcgttttttaa

SEQ ID NO: 57782 - DNA, 717 bp, Heterodera glycines
  Genomic contig location: Contig_ID=SeqID_27056; Location=47..763; Strand=-
  SCN-specific regions: Sequence locations=1-100,122-201,225-503,561 -687,714-717
atgcacttttcgtggtttacctgtgcaactttcatgtgagtgcaattctttcttttatgctttacgttttgcctattttttgaaaattgtttaagcccaaaaaatctctcacagacttttgttggtcataatgccaattgttaattttttttttttttgaatcaactgcttttattttttgtattacacatttgtatattaactaataatatgcaataaaatttagtacaaaagtccaaaattttgcactcacgtacaattttattttaaatccgtatttttataaaaattgaaaaaatcaactaaaaatttttatgtgaacttttaatttttactaataaacggatttttgtaaaaaaaaatttagaagaataaaattttatgaattttgcagattctgttgcccttagaatttattttcctgcaaatttcaagtgattctgacaaaaacacgaactgaataagaaaatcaacttcttcatacttcgtgaaaatttatgtccatataattaattatattccctaataatttaaataaataataataattaataatttatcttttagtaattttgcttgatagaattaataatcttttaaccaataatcggtgagattttgtacaaataagcagattgttgtttaagtagacggattgtgctggatatacaaaatttgaatgattaaccacattttgctaaacaaaaacaaaataaa

SEQ ID NO: 57783 - DNA, 183 bp, Heterodera glycines
  Genomic contig location: Contig_ID=SeqID_27061; Location=531..713; Strand=+
  SCN-specific regions: Sequence locations=1-183
ctgatcgtttcccttgttgaccttttcggcaccgccgacgacctttggcctaaatccgcttccaccctgaccatccttctcacaatcatttcgctgattttggccattgcagctgcaatgcttcttgtttcgggtgtccaattccgatctccgtatttgctagtgccacacatcttaatgcag

SEQ ID NO: 57784 - DNA, 1350 bp, Heterodera glycines
  Genomic contig location: Contig_ID=SeqID_5359; Location=1132..2481; Strand=-
  SCN-specific regions: Sequence locations=1-194,216-527,553-808,871 -913,935-1350
atgccaaaatatggaaatatggacataaatcgcgaaatatggaaaaatatggaaaatattgatatggaaagtcatcctagaagcttcaaaccaagcaaacacatgcttttcgtgcgtttcaggcctcccacagtccaggaaaaaaatatggatttcgatataattggaagccctactcatcaatttcgaccactttgttttttcctccaattttagcctgttttgaacattgttaacgacaatagttgaagaaattgactatagaaggatttgacacgcccaattctttgacagcgtttttgtttcggtagtcttcaatccacatgtagatgatggtgaacatttgtgtgagactcaaagcactattgtgaaaaaaacttttttcgcgcacagatttgtatagatgacagtgttgacagtgccacttaaaaaaggacttaaaaaagattttttttttcaaattacttgaaatccatcctttatttggctacgttttgtcagagccatatacatagttccaacaattatggcataaacatttattttggacaagtccgctgtgtgccaaaaattgtaaaatctcttcagagttttgggaaaaaagccatctcaaatttatatcgtccaatgttggaaaagcgatgaacggcagattgttggaatcattaatagaataccttgaaactttaaccatttgctaaaatgaattaaaaaaagatttaaggcaaaaatttctcaagaaaaataagattttagggtccggcggtgccgataggcgccgccgggaaatttttgaaaatttcagtgcaatttattaataaaatttgtaaaaaattgttaattttttgaaaaaaaattcaaaaaaaatttccgaaaatttccgactttttatcaaaaatttcggaaagcggaattccgggggtccaaaatttttcggaaatcggaattccgactccaaaaatgtcggaaatcggaattccgtgccatccctgctccaaactgttgcaattgtgctcactttgaccatcatttggcaactcctttcactccaccagttctgcggcacttttaccgacccaaaagtcaattgcattagaatttcacaaatgatcaaagtgatgtgattttcaggccttcctctgtggtcgtctttgcgaacgctatacgctcattggaaaggactcaaaaaacggcgaattcggcgatgtgatcgaccggcacaacccattcattctttatgaacatcaccaatggacaaccaaccaaagaacagaaacgccaattctttcacttcttggtcgcgagattgcctcccgctggacgccattgcattccgataacggcccgtaa

SEQ ID NO: 57785 - DNA, 713 bp, Heterodera glycines
  Genomic contig location: Contig_ID=SeqID_27062; Location=557..1269; Strand=+
  SCN-specific regions: Sequence locations=1-202,243-275,297-590,614 -671,694-713
atgatcagcaattttggctgctttttcctccagtttttgccaaactttggcctgttctcctccgtttggatcgttttctttgttggcgttgatcgactgatttctgtccttctcccattaaggtaatgtacgagaaaaaccctgccgatatttagagattattttagtggaattttacgaatttaatcatagaatatttcactaaaataatttgttttaaaaatataaatctataaataaatctttggacttcagatatggtctctttgagcagcaccttttcatttatattttaccaatgcttacggttacatttggctacagtatctatgtgcttgtagaagctgcaaaatggccactttttgtataccccgactggtaaataaagctcatttttgaaaatttaaaatttcattcgttttttaaatattaattttaggccagttttatgcacaaattctgacatgttcagttttggcatgaccacaatgctcctgagaaatggtctggtcattaatggggtgtcaatcatttgttatttgtttgttggactgtcactgttttggtcatggcaaaaaagttagttggactaaaatttaattatttttaatttctttctgtgccctgcctcggcctttcaaaggggctaaagattttacatgggaatacaattaaaaaacataaagctaaaatttttcattaaaatatgacaa

SEQ ID NO: 57786 - DNA, 587 bp, Heterodera glycines
  Genomic contig location: Contig_ID=SeqID_27064; Location=136..722; Strand=+
  SCN-specific regions: Sequence locations=1-140,163-258,280-400,422-587
ttcacttgcgccgctttggaattgcccgacttttcggacttcgcccgactccgtccgttaattgacgcactcattgctgaattggtaggccttttttacctcactacttacggaaattaaaaaaaaaactcgaaaatctagttttttttagtttgttttttgccaggaatgggggggggggtagggcaagaggatgcaaaatcaagaatccggcattcatttcgaccaattccaaaccccgggcccgatttcgaataaagactcaaatatttgaatttcgcatttgatttggcattggatgccaaaaatacacaaagaacaaacagcaaacaaatgttgtgtctctcccattttaggatctcaacgatttcctcggctgcaccgcggcgctcgaaatgctggcggagacggccgccacggcgccaaagtgtgtgcccttttttggccaaattggcctcctggacaaagtgtacgcgctgttcatccgaaccaaggaggagccggacatgggcatcattcacattggtatcaattcccaacctaatttggatacacttcttcgggatttcggaccatcgcaaaattaa

SEQ ID NO: 57787 - DNA, 690 bp, Heterodera glycines
  Genomic contig location: Contig_ID=SeqID_27068; Location=395..1084; Strand=-
  SCN-specific regions: Sequence locations=1-165,187-516,543-690
atgaaccgaaagagattcatttacccacgcgagggactgaaaatggtgccatgtaaaatggactgctttatactggaatacacgacggagtctggtgcctggcttgacacccatcagcattttcttctataattttttcaggctcgttgctccaacaagtcggctgctatggaaaaagcattttgtgccattggctatttgcaaaaagcggttggatggattttaatggctgttcttcgtgtaacaggactgagtgcaacaaacccggacgaatctatccacttaaacaaaccgacatgggtgaatgatggatgaaatatctccttttcatgtattttattggcaattttcagatgccaaatgtgatgtgttcatcagccaattcactgctccaaacaacacgaaattgtccaaagaacaaattgacgtattctgcgcaaaagtggaggaagtactaaatatggcactaccaggcaatgcaaattattgcatatatttaattgaaatactggccataagtaaaaattcacaaatttaaatttcaggacaaagttgtttggacggaagggagtgcctatttggctcatattgcaacggcactctatgcatgtgtagagaagggtttgttactgtgcgttcatcgcaaacggatattcgctgttgggccaaggatgaatcatttgacgaaat

SEQ ID NO: 57788 - DNA, 1409 bp, Heterodera glycines
  Genomic contig location: Contig_ID=SeqID_27070; Location=513..1921; Strand=-
  SCN-specific regions: Sequence locations=1-205,227-259,281-403,425 -471,493-722,781-912,936-989,1020-1058,1080-1191,1231-1409
atgctcttataccattggcaactacaacaagttgaagcagttcgacgccttcttctgtccgctggttggtgcctccgttcttcttccgttgccgtcggtggtggtcaatgcgttcgaccatttgcaacacgcgacggtggccaaaaacgcgtcagtgatgatgaatggaaaacggagagggagcagtatcagaagtacgagcaacacaaccagcaacagcagcagccgagggtgggcaagcagggcggcaacggccaatggcggaaaggcggcggcgccgtccggggcaaaaaaagcaccgtagtgcgcaacgatttcttccaaatttatgtgcgctcgggcgcgggcggcagaggactggcgaggtgagagaagccatgtttgacagagaatgattagtgaatggtggggggagggcagggcatgtcgaaatttacggcattagtcgaacgatttaaaaaaaacagttgcgactgaattttcaagttttcaaaatttttttttcgtgggaatacggtgccgaaatttacggcactaattacaggaaatttaaaaatatatttggctcgctccgttttgtgcctttcttttttttttatcccccccccccttttgagccttttaaaaaaaatcttcccaatttttgcatgccttatacatttttggcccaaatttgaattattttttttaaatcaaggggaaatacgcacaataatcgtttcaatttttcattaaaaaatttttttttggattttttaatgaaaattttgaaaaaaaattcgagggggcggcgactgaaaatttctgcatttttcaaccattctttgcgcctaaaaaatacataaaaattgaaaattgctcccaaaaaaggtacaacggcatcggcggttgcggtggctttgtgtacgcccggccgagtgccaagctgagctttgaccgcttctgtggcggatttacatccgaccgtgccgccaatgcggcttggaagaaagacgacgacgatgaggaggatgaggatggccaagtgaacgaggaagagcagcggaggagggcacgaacggtggcggcggaggacggcgaaaacgcgcggcagacgaagttggccgggcgccatggcagggacagggtgagcgcagaaaccggcacaattattgccctccgccattttttggccgaaaattaaaaaaaaaattttgtttttatttatttttttaaattttttttttttttgtaattttgggtcaaattttcaatgaataatgggttcctataggagctgcagaattttttttgaagtttcaatgaaatataagaagtaaattactagtatgtctagtttgaaattaaaaaaaagccttgatacggatttttttttggaaattgattgggaaattatttgaaaaaataaa

SEQ ID NO: 57789 - DNA, 904 bp, Heterodera glycines
  Genomic contig location: Contig_ID=SeqID_27071; Location=1..904; Strand=+
  SCN-specific regions: Sequence locations=1-13,36-491,519-622,644 -841,863-904
  Gene Ontology: Mol. function=cysteine-type endopeptidase activity; Cellular component=integral to membrane; Biological process=protein targeting
taacaaatagcactcaaatttccaaaatttttcccggcggcgcctatcggcaccgccggacctccgttttcccactatttttacatggtttttgccttaaaacggccaaaattgggtcatttttagtgaaaagtgcagtttttacccagcagcggaaaaaaagggtttttttttgggtaaatagcaaaaaaaaggtatccagttggagcaaaaaaaaaaagaaaaagatcttcaggtcgggccccccccccgaaaaatgtttctagatagcctctgtgtcttctaactttataaatttacaggtgccggttattccaaaattggttggcatccgcaagatgaggaggaatgggagtacttccgctattgctaccgctgtttggcattcaaagcgccacgcgttcaccactgttcgaagtgtaaccgttgcgttttggtaaataattgtgccataggttcttctcatcattgcgttttcttttgctttagttgatggaccatcactgcccgtggattaacaattgtgtcggacaacgcaatcagatttatttcatcaaatttctggttgtttccatcgttgggagtgtccatgccgccgtcgttctcacgagttgtctctatcaagtcattttctttgtgggtttcatttattttcttgattttctctaaaaaattaccaaattttcagtttatgctccaaaatcctgactctgtacagcaaaaccctctccaaagtccgtccgatttgtccatctcttccttttaccttttcattgcctccattttcgctgtcggtctttcctacggtgtgataattgcggttggaattctgctaattgttcagctgagaagcatttatttggaccggacaggcatcgaatcgctaaaagacaaatgacttaaa

SEQ ID NO: 57790 - DNA, 466 bp, Heterodera glycines
  Genomic contig location: Contig_ID=SeqID_5361; Location=242..707; Strand=+
  SCN-specific regions: Sequence locations=1-466
atggcattgaaccacccacttgtccactgggaaagttggtttctgattaaaaatattaggagcaccgggcgagagtcgaacccacgcctcgggatgggtgggcaaccaattctccactgaactacgctaatttttgattttttgtaagccactaaattttaattttagacggcggtgcaaaagtttgccaatggcacagtgttggcgaacagcgactggcgcaaggggacggagagtgagccggcgggctactaattaggacacgcatacactaattaatttatgccaattatttatgtcgttttctttttagctaatacttatgttgtttcatacttttgagagaatttcaattttttagatttttcatacatataaaagaattttactttttaaatttgttgttttgttactcacgcccgttcccttcccctaattgccctcataatttgtattgattgctgca

SEQ ID NO: 57791 - DNA, 609 bp, Heterodera glycines
  Genomic contig location: Contig_ID=SeqID_5363; Location=2140..2748; Strand=+
  SCN-specific regions: Sequence locations=1-23,45-153,175-609
atggcggtgacgaatgtgaagacggaaaaaatgcgggaaaaattggcgccgcaaaaattgggagcaattagcaacggaaagtacagtatgacgacggacgacaagggcggcggcaactacaatacaccaccgtacagtagtactctcaagaacaacagtaacaacagtgacagtaataattgtcgtaaagacaacggtggtggtgcctcaggattgaaaaaccagcagaatcccggcatcggttggatctgattttgtcgcgcattcattaacaagaaaatgccaaactgagtcccgcgtttctcgggactcgagagtgggaccaaaaactcgcgacccaaaaagcccgagactcatttcgatcaaaatccttggcctcattaagcgcaaaatgtgcgccttacgctggacaaaatgcgccaaaaagaggcgcaagcgctgcgcgagcgctccaccgatgtgtacgccaaggattatgtgccaaaaaaatatgcaaagaattcggcggagtacggtcgaccggtcggcggttaccgtaaaacaagaatttatgattgttttttagccgccagggtcgctgacggaaatgagggcgaacaaagcgtgtaa

SEQ ID NO: 57792 - DNA, 668 bp, Heterodera glycines
  Genomic contig location: Contig_ID=SeqID_27073; Location=929..1596; Strand=+
  SCN-specific regions: Sequence locations=1-376,399-537,570-668
atggcacccaaaaaattcatgccaatggagttaatcgtggaaattgtcactttcctccaatttcgtcggcgatgggccaatgttcgcgtgtcgagagcatttgatcactttctgcttgaacaaattggcttatttttgacgaaaacgaactcatcggtttgtaacatcaaagcaatcactttttaaagaatttgatcaatttaatggtttttttcaaatttttcaatttttctaagaattttaaatttggtttttcatgcatttttccattaacccgttggacagttaaaacatgtaaaaaaaaagccccaatttgtactatgccccgattcactgttttcgataaaaaattcattaaaaaaacaaacagaaaagattatttgctttttagagatgagaattgaacttttgagtgaaaattggaccaaataaatgggcataagccactacgaaaaaaagaggaaatgcccaccaagcttcatcctgaacctccaccaaagcgcaaaataaacttattttggaattaacaattttaggaataatattttttaataaatatttttaaatttcaggctaaacaatgcttaacagagtttggagaaatgataaagaatttgccatcaaaacacaagagaaatgtttttaatgaaagcgcgcgtaacgaaggc

SEQ ID NO: 57793 - DNA, 189 bp, Heterodera glycines
  Genomic contig location: Contig_ID=SeqID_27074; Location=850..1038; Strand=+
  SCN-specific regions: Sequence locations=1-189
atgcatgtgaatgtgaagaatgaaaaagacaacgttatggaaatgccgaaacagcaagtgctcatctcaacaatggactcgttcatttttgcgccagagtctgtcactaaacctttgatgaaagatttaaagttggtgcaggacaaccaagtctttaaggctggacgaagtcttggcaagacggggctg

SEQ ID NO: 57794 - DNA, 171 bp, Heterodera glycines
  Genomic contig location: Contig_ID=SeqID_27078; Location=21..191; Strand=-
  SCN-specific regions: Sequence locations=1-171
atgattcatcaaatcccagcaaaagcccccacccgtcccgaacttcaacagtccggccaatgtggatgctgccgtaagtggattgattcttcggcatatgaatgaatatatatcatttcatcaaaatttcaggttttgttccgcagcgatccggcacgatacagggaggaa

SEQ ID NO: 57795 - DNA, 387 bp, Heterodera glycines
  Genomic contig location: Contig_ID=SeqID_27081; Location=486..872; Strand=+
  SCN-specific regions: Sequence locations=1-33,55-345,367-387
gtgccatgtattttgtcaagtgccataccattccaaaggacaattccgtcatcaaattaaactctcgaagtgcacgaattcacatcactgtatttttgtagaatacaagtgccactttcaaacgttattctttaaagcgctacgccctcgtcattgtccaggaagtgccgcctaaacagcgattgtatctcaacttggaagatttgtccggtaattactgctcggattggtcaattttttgtttttcatctatcagcagatgttgaatgcgttcaaaatcgctttgcgtttcgcgcattgacctacccctggtcaacaccgcaaagctttgtgttcactagcgatcagatccctgaactgacagccaaattgcagtgtctcctgaag

SEQ ID NO: 57796 - DNA, 108 bp, Heterodera glycines
  Genomic contig location: Contig_ID=SeqID_5365; Location=4253..4360; Strand=-
  SCN-specific regions: Sequence locations=1-108
gctggttatccgttgccttttaagcgcccctcgggatgggaggagccctatcggagagataaaatgggggggggaagggtaaaggccatttccggtcccggccttaca

SEQ ID NO: 57797 - DNA, 2258 bp, Heterodera glycines
  Genomic contig location: Contig_ID=SeqID_5365; Location=648..2905; Strand=-
  SCN-specific regions: Sequence locations=1-229,251-523,545-634,669 -709,731-1053,1076-1087,1121-1468,1492-1689,1747-1761,1783-1830,1853 -1900,1922-1955,1997-2166,2210-2258
atgaaggaaaaacgcgaaagaatttttgacttggaatatttttacaaaagcaaaaaatttgaaggagcgaaaaccataaaaaatggacaaaacattgaactcgaaattgatcagcaacacaatgccaaggaagaaggcattgaaaaggttgatctgcaattttacattttcataaagccatttggccgtgatgaagttccactcattggccatgcgcgagtaaaaatggcaccggaaggatggctgttacgacgctatttgaccatggcagtgatttggccaaacccatcaaaaagatatgtgatcaatttgggtcgcattgatccgcccggcctttattggaatcggaaactgatggttgatcagaaaaatgatcacgggacttaccatgcccttttgtatgccaatacgatcaaaatcggtcgaactgagaactccgaggagaaaatgcttttgggatacgcaaaattggagaaagtttatgaccaaaatgaaccagcgatagacctaaaactgaatgaggttaaatttataagtaattattaggaatgcgactttagtgacgaaaaaattgacagagtccaaaatagtgacaaaataatggctaaaagtcaagagtgatatatttttagcaaaaaattgagcaaaaataatttttattaactaattgcagttgcaaattaggtacatttcatttctaatattttcttagcaattatttacattatttaaattgataatttcgtcaaaaaagattaggcagaggaatttagagaaaatttttcaattcttaggggtgtatttttaaaaaatttttaggccgtttcttaggggtattttttgaaatttttttgtttttatttttaggggtgcattttttggtttcattgcatttttgtaaagtaatttcccaaaaatatccaaatagttaaaaaatagtggcaaaacgccaaaataatgaactttaactattttaaggacaaagcgccctaataatgatttctagtgactgatagtgtcatcagaatcgaaaattttcaacgcagaaatgagttttttgcgctcctttcttcacaaaaaattgagcaaaaaaaaaaaatagttaaaaaaaattaaaaatcgcatccctagtaattatcggaaattttttttcattgtttggcataaggcaaaaattgaaaaacccccggccgatggtcaaccccgtcccaattcttgctccgaaaattatggttaagccccgccgctcggggaagaaattctcgaggagcgaggggaagggcaggccggagacctgggctcgggcagaaagcccaaaaatgtcggtggagctgagtcgggcagctcggggtcagggcttaaccctacgataaaccatgtcccgaaatttcccatcccaatattggtgttccaaccaaaatgcatgggcaaaaagccaaaagcccggcacacgagatcaaaaaccctcatggcaaaaagaagacaattctgggtttttggtttcgaaaaataaatgagggcttcattaaaataatgattttaattttgcaattcattttaaatttcagtttaacgaatatcaattgtcatttccaatcaaacatagtctgttctataaaagcattatggaagagacggaacttattgagaatgttgaattaaaaatttatcaattcgaggttaaaacccaaaattttaaattaaatttttgaattcattcataaatttaacttttagaatatttttgcaaataaaacgaataaaagagagataaagaagaagcgtgaagaagaaatttgttcaatatgtttagaagcaatggaatataaaaatgaacaaattacagaaattcataatgacggaaagggcaaaataacggttgttttgtcgttaattaattactttaattacttttaatttagcataaattccacaatgaatgcatcaaaaattggttaaaatttattttttttttaatttttatttttttaaattacttttaggtttgcacaaaacaagatttgctgtcctctctgtatgatggaagcaaatttagtgctggtaagaaatttggatgtgattttagcagattaatcttaatagttatagaattgagaattgatcacaatattttgtgcatcaaatcaaattttctcatacttttgctaaaaaaattatatttttcattttattaaataataattattttcttaagattcaaaattaatttgtattctttttcagtcatcaacttttaa

SEQ ID NO: 57798 - DNA, 354 bp, Heterodera glycines
  Genomic contig location: Contig_ID=SeqID_5367; Location=262..615; Strand=+
  SCN-specific regions: Sequence locations=1-240,308-354
gtcaatttgctgtttgcttcgcctctgttcattttcattgtgatcgcttatccgccactgatcggcacttggggtgcccttttctttatgccaatggcactgatcagtgccgtacttttgtttttgctttatcggtggatgcccgagacaaaaggcttatcagtgaacacaattttcctgagaatggccaagttgggactgttaaacagcagcagtgagggaagcactacaagcataaatggtgatgatgaggatgaagaaactgaagcattaattttaaaaaattaaaattaatttgtttaattttgaacaaaaagttgtattaaaactcatttgtattttaattcatattta

SEQ ID NO: 57799 - DNA, 721 bp, Heterodera glycines
  Genomic contig location: Contig_ID=SeqID_5368; Location=1246..1966; Strand=+
  SCN-specific regions: Sequence locations=1-4,29-58,80-112,135-145,178- 328,387-721
atgcttttatatttatttttatatttatgtctacattattccgtttttggagacgggtaagaaaactaatcaaaaactttgtcctacgaacgcatttttgacaaatgaaaatataaaatttgtttaagtaattttccaaaaatggaaaatatttattaatttttaattaaaaattttggaataatgagaaagttttaaccctccgtgagaaccttatttctaacaagccagaagggcatgaggtatttttttgcattttattaaaggtttttttttagcctatgtttaaaaaaagtttggggttttggtcttttaattctttttttaaaaaaataaaaaaataataataattagaaaaaaaaattaaatttaaaaaaaattaaaaaattccaactgattcaaagaaaaaatctataatatttaaaagaccctgggatagggtgatttgccgaaaaaatgcaaaatgtaaaacataattccagtccgccgccgcacattttcccggcaccatcgaaatgtgaaagtgggactttgtttgcgccatcgttttgttcatcgcatttcttctatttgtgctcaaatggacaaccgatcagaatgaaatgtccggcagaccttgtgtttgaccaactgatttctgtgtgcaactacaaaaatgcatgcggcaaaaggcaacaaccgtatgcttcttgtggaagaattacgatattttgaaaaatta

SEQ ID NO: 57800 - DNA, 562 bp, Heterodera glycines
  Genomic contig location: Contig_ID=SeqID_27085; Location=211..772; Strand=+
  SCN-specific regions: Sequence locations=1-387,409-562
gttaacggaaagcggcctctcaatggtcaattgggacattatcaaaacgatgaagccgccattcactcaaatggaatgggagaaggaattttcaaaatatcggcaatttccagaataccgattgtgtgtacatattattttgtttgatcacttttttttacaaatcagcaaaaattctgacggcgaaatgactttggccgacttcaaatttatttggaccatggaatatcttcatcggatgtgggggagagccatcggacttgtttttctccttccttgcgcatatttttggcgtcgtggttatttcaacggaccaatgaaattgcggatggttttttctggcctacttattgcttctcaagtccactttcattgattctttcgttagggtttccttttccgtctttttagggccttgttggctggtggatggttaaatcgggacttgacccatcaaataattcgaattccgacgtgcccagagtttcacattatcggtgaggactcaacatgccttttcacttaccttattttattttagggttgcgtccccgacgtcggg

SEQ ID NO: 57801 - DNA, 697 bp, Heterodera glycines
  Genomic contig location: Contig_ID=SeqID_27087; Location=803..1499; Strand=-
  SCN-specific regions: Sequence locations=1-111,141-178,214-227,249 -478,500-552,574-647,669-697
gacaaaattgctggcgatggttattcatacacggatgacaatgtgtgcgtgttcaacaatgtggtgacaagccgtggacctggtgagagaccttgctcaacaatttgattgaatttaatttaaaaattattaatttatttgatgaatggcaaccgattttttgcagggattttttgagtttttatgtataattaagtttttattttttttaatctaacccaagttgcataaaatttggggtccgtttagcgtatggggtagctaaagcgcgaaaaatttgagtctgactatttttaatgcatttttctggaaattttccaccccttcccccaatatggctgtaaaaaagccctagaaatcatcaaattacgaatgaatttctagcatagcccccaaaaaaaaactgacaggaacccacggattttaattgtggcgcaattgtctggcgcctaactttcaaatcagttaaaaatttaggaaaatttaatttttataatttcaattgcaggcactgcctttgaatttgcgctgaaacttgtcgaaatgttggtcagtgaggagaaagcgaaagaaataagcaattctttgcttgtccattgatcagttgctcttatcaaactagtcaagatgagatgatcaaaaagcaatggaatatattcattgaatttgtgtgatggatacaattttaagcaataaa

SEQ ID NO: 57802 - DNA, 72 bp, Heterodera glycines
  Genomic contig location: Contig_ID=SeqID_27090; Location=1724..1795; Strand=+
  SCN-specific regions: Sequence locations=1-72
atgacaccaaactgtgtattcccgaagttttgccgccggaattcatctctttggtcgacccaaatccgaaag

SEQ ID NO: 57803 - DNA, 231 bp, Heterodera glycines
  Genomic contig location: Contig_ID=SeqID_27091; Location=668..898; Strand=+
  SCN-specific regions: Sequence locations=1-11,33-36,92-206,228-231
atgaattgcagtaaaatgttaaaaatcaattaacacttataaattttttaaagctttttttatttttttattttataatttttttttatttgcagatcaaataaatattagagtgcagcgggaccgggaaatttgggcaagaccgggaccgggacttttttggttgaaaacccgggacttttttggttgaaaacccgggactttttatattaaaaagaaattttatagaga

SEQ ID NO: 57804 - DNA, 901 bp, Heterodera glycines
  Genomic contig location: Contig_ID=SeqID_5369; Location=499..1399; Strand=-
  SCN-specific regions: Sequence locations=1-41,65-435,457-471,502 -873,895-901
atgacgcccatttttctcccaattgccttgtgcattttactccacactgtctcttttccccacaatgcccacgccgccggagattatggtaaatattagtgatgcttaattccctcagactcgagagtcacggcttgaaaaaaatttactggttctttggagtattggtctagactctatgggtcaagtctcggtcaaaagtcgggtctcggctcaagaaaaattacgggtcttttgggtcttggtctcgactttaggaaatcaaatctcggggcctagtctcggtctcgagtcgagttttgctctcgatggtgcctagtcatggtctcgttgctgttttggtctcgagtatcaaaggtcaagtctcggcccgagaaaaatcacggatcttttgggagtctttgtcttgagtctaagggtcaagtctcggtattacaaataaaaaatatgaaaatttccaaatgttttctcttttttttgtaatattttaaaaaaaattttccatttaaagcatctgatgatgagcaaaatttcccattgctggacagcgaagacagctcctcaacagcttcatttactgacacagaaaattatgaaagccacactgacagtagtggacacagtaaccaaacgccgaaaaaacggtggcaaaaagcgggaaaacagatcattaaaaactatgattggaaaaaagttgaatattatctcaacaaagaagtgctgcccaatatccgtaaagaggtacagtatccaaatgcaaacggtttttgtgtttcagcaaacaaaaaaaaataggcagtcgactaaggaccctgctgggacaggaactgagagtgaaaaaagttttgtaatttttttggcaggtattatggctcaagaaaacatgtaaatcaataataaa

SEQ ID NO: 57805 - DNA, 952 bp, Heterodera glycines
  Genomic contig location: Contig_ID=SeqID_5371; Location=1597..2548; Strand=+
  SCN-specific regions: Sequence locations=1-382,404-542,564-952
  Gene Ontology: Mol. function=copper, zinc superoxide dismutase activity; Cellular component=cytoplasm; Biological process =neurogenesis
atggcggcaggtgcccattttaatccgtacaatgtaagccatggagcaccagacgcacgcgtacggcacgtgggcgacttgggcaatttggctgtcaatgtgaattaattatggaattaattaagtatagtaattgaccaattgtatgccaattatactaataatcagtgatttgtagtagtacacttatacaattggcctaaatacgaatttaatttggatgaataattgactactaaaatcagacaagctttattgaaataagaatttgacaagacatgatgataaatcaatatcattaattagacattgttttgttaattgctcatgcctttatggcatgtgatcaatcaatcaatgcgtgttaaaattaaagcgccaattgtcccaaaatgaatttttgctcccattgatttcgttttctgatcatccaaactactaaagctctattagctaatataaatacctaatcacatatcctgtgctcgtattggcagtacaattttaaaaatgctttcatttggtcacgatttcgggaatttaaattttgaaaaacaggcatttttaggctgaaggcgttgccgtggtgaatattcaagaccgattgttgaagctgaacggattgcacagtgtggtcggacgagcattggttgtgcatgagaagcgggacgacctgggcttgggcggcaacgcggaaagcctaaaaacgggcaactcgggcaaacgggtgggctgcggcgtggttggcatcaccaaggagctgtaatcaaagtgccatgatcagcccagcatcggctgatcagtcgaaaaaaaagaaaaaacatttgaattaagtgaccggtgatcgggttttattttgtatccaaattgatcagtcaaggaataacaacaaattagtgattgaaaatgtcggaaaaagggcaattgtctagaattgtggtcccaacaaaaa

SEQ ID NO: 57806 - DNA, 439 bp, Heterodera glycines
  Genomic contig location: Contig_ID=SeqID_27092; Location=658..1096; Strand=-
  SCN-specific regions: Sequence locations=1-90,123-170,205-439
cataaatgggacaaatgggacgaatatattcgataatatcctttttttgatcaaagaatttaactctggaattttgataagcgaaattaaattattttgcaaatgaggaaattgaaaattaacgataaaacttttgcattacattagagaaataaaattcacgataaatcaaattaaataataaatttcaaaaatttaaattttgaatggcatttcaaataacacaaaggcatcgtttgcattgccacttttgactggcaattaaattgtaggcaatataaatttaaaatgtttgttcaaacaatttgcttagatttatgcccctgatatacttaatttcttaattctctctttctctctcttatcctctgatcattgttcccccgtcaatgtcagcccggggggcggtccttcttttcactaatcgagactctttata

SEQ ID NO: 57807 - DNA, 690 bp, Heterodera glycines
  Genomic contig location: Contig_ID=SeqID_27098; Location=967..1656; Strand=+
  SCN-specific regions: Sequence locations=1-68,90-474,496-499,553 -607,630-690
  Gene Ontology: Biological process=positive regulation of growth rate
atgaccgccgcttggcatcgcacagacccaaaactgaaggcggagcgacgaatggccgaaacgctggcagaagcggcggtggccatttcaatcacttcattcaccgacatggtaaagatttcatctctggttaaggcagactcagttcgcttaccgtaatgcctttcctaccgtaatgcgttgttcccttttggcatcgtcccttttcctttcagctttcttttggcatcggttgtttcaccactcttccggtggtccgtctcttctgtctttacaccttcttcggcattttcttcacttacctttaccaaatcacttattttgccgctgtgatggcttttgccggccaaatggaacagtcgggcgatcattcgcttctttttggtcttcgcgcactccgtcccgaggaggcgggtgggaatttaatgggactaattaaccccaaaaatatttaattaattaactcattcagacagcactttcaaaagatggatgttggccggttcatcagcagaagcagcagcagatgagggagaagaaaaggggggagaaatgaagccaaacggagccaaagacgggaagagaagggaaagggacaaatgccaaagggtggagggaacggaggaggacaattggcaaacggagggacaaaaggaccaaaaaagggacggacaaaaggaccaggaagag

SEQ ID NO: 57808 - DNA, 770 bp, Heterodera glycines
  Genomic contig location: Contig_ID=SeqID_27100; Location=52..821; Strand=+
  SCN-specific regions: Sequence locations=1-35,72-617,639-720,742-770
atgcgttggaattcaacatttcaacaactcccaccaaaccaacaaaaagaaatgtataatttggtaaagaatgggccaaattcggcctcttctagccgaagtccacagccatttcaaagttcaaaccaattcccatcaaaccaatttgggtcaggtcagtcgaacagattctgtgcttaattagctgaaaattaactgaaatggagaaatttagctaaattacgtgcaaattaatttgctgatgttttaggcactgtgccgttggggaaagcatatttgggccaacaaccattggtggcctctggttcatcaagtagaccattacaatccagcggcacctttttgagaccaaatcattcgagaaatcctagatttaactcatcaggcaactttcaagtaccacagaacagttctgcaaatgcttccgccagttcttcatcgtttcactcactatttggattggaggaccctcaaaagaacactttcgaatcgatgttcggatcaaagaagggataaagcagcattatgtgctaatgagctaagagagaagatgagaaagaaaagcatgatgttcgaccatcatatattgttgaccaatttcatttctgtcccttattttttgtaacgtcctttttctttcataaattactttactaggtcacttcacaaaaagtgcaaatcggggggggggggtaaccaaaaaggcaaaaatcataaatctgactttttctatggattttttattaataactttcagtttttgtattcga

SEQ ID NO: 57809 - DNA, 3063 bp, Heterodera glycines
  Genomic contig location: Contig_ID=SeqID_5372; Location=223..3285; Strand=+
  SCN-specific regions: Sequence locations=1-34,57-118,140-218,241 -328,351-393,488-507,531-594,616-808,838-910,933-1035,1058-1074,1096 -1112,1189-1411,1433-1472,1508-1530,1555-1562,1599-1611,1764 -1807,1831-2074,2103-2316,...
  SCN-specific regions: Sequence locations=...2340-2837,2860-2927,2949 -3063
atggaaagtgatctggacaaaaacaatgtgtgccaattccaaacaacatttccattacatgattatctcaacaaaattaatcgggatttggaagttgagcaaaaatgtaagatttgtgaaaattaaaaaaaatatttatgacgaaatttatataagtgtatttatatttctataaaaaatggttatttattctgtttttgtttgacctaacgtaaatccatttttaattgattatttaaatacctcctaactcaattatttatatacacaattttcggcaattaaattcgattaatttccaaatttattgaaaactgaaatgaaaatcttaataataaaattataattatctttatctttgcacaaagcaaacagtttttaataaactctttcttttaaaaacaattttattaaattaaataaatatcaaaaaaaataattaaataaattcatatgtaataataataataataattatttttttttagttaaatcagagcgccagcttaaacgttttattaactttgccaaaacaaggagttctccaccaataaattctgatgtgcatccaatttccaaaatttcaatttcgatgaaaaattttccaattggcccgtatgaattattcgattttcagaacaagtcggaaagtgtaatgattgaaggtaaaacatataatgtttcgtgtcccgacatttgcgcctttgtccaaaatcgggttcaaaataaagttttttttcaatccctgatcgcgtaagcagctttaaataagctattgaaagtgattgtatccgatcatttgatcttcaaaaattaaaaaaaaataataaaatttttcaaacaacaaattattgaacataatgaaccaaaagaccgtgttttcttaattttattgctaattaggcgctatcagagtttgaaaaaattcaaactttgagtccgattttggacataggcgcaaatgtcggggctcctaatgtttagatgaaaaaatgtttttattctcatttgcaaaaatggaaaaaaaattctccgagatttttgaaaaagagccttggataaaaaagaatatatgctgtttctccattattatctgcatgaaaacgccgcccataaataatttcaacatttttatttaaatcgaattcaaaaaattaatataaaaaataaataaaataaatatattttcagctgtgaaacaagacgcaaatgaaactgatcaatcatccggcattgcaaatatgattgagataattgatcctttgaaatgcagcgagctttgtggggttgccgatgaactttttattgaaaaagatgaacatcaaagctttcgtgtaagtaacaaatgtcacattggcgcgggtacttttggcgacttaaaatttaaagtgtcattaccaattgattagggtaattaaatttcatttaattatttgttcgatttgatggaataagtgttttctttcgcctggaaaatttaaaaagtttaattaagaaatttaaaaaacttcattttagcgggggagtacgaaaaagaattaaatgaaagtaaaattaattcgaaatttaatattaaaattagctatatataattaaaactcattttgcacgataaaaaataatgataaaatgctttaaaatttaaaaataaaaaaacattaaaatttattaatttttaaaaatttaaataaaaaatataaaaaattggaattaatttgtccaactatattaatttatttttaatttattaaacaattatatttgcgattattctattaataacttcttggaattaattgtttaagcaaagtttttcatgtttttaaaataacggatttctgacaaaatatatcaaagtctttctttagcaaactaattggtggacaaaacaacaaattgtctttttactagagaccggcataattaatcgtttaattagtctttttcgattgtttgttgttgtttttttgatttgaatatcaaaaaatcgatccaacaacacttcccctatcaattttttacaatacttttgaaccaaaaaaaaaactatagttactcaatttttaaattctcgtttttttatttgtaatttttttttaaaacagacagttggcggcgaagtcatcaccgacaactattatccatgggttgtttttgtccgagtccacgtgcattgtgcatattcggccccaatctacattcactgtaccggagtgcttatatcgtttaagcatgtcatgacggctgctcattgcatgcatttaaatacaaccatgttaaatgagtgcattggctggatgaaattttttccagctgggtgtgttaattaatgttgatttgtttttacaaggtgtgctcggggtgctgagacattatatagtagggtgggggaccccggaaacggtgcgggaattccgggttttcccaggtcccggagtttttaaacagccaggtgcccatgtagggccggaaaaataagcattgataagtagggttgtaaatttatatggactaaaaaacgcgaaatatggactaaaaaagtacgaaatatggaataaaaaaccaaatatggaccaaaaaatggactaaaaactgccaaaatatatgttttaaacactcaaacattcctaaaaaggtttttatatatatatatttgcttaaataaacttaagaaatacaataaacaaccaaaaaaaatggatttaaaacttaaaaatgcgaactttttattgtcgtccgttgtataaaaatacctccaagttcattttaaaaaaagaaaagttcgcaaaaaaatagtgcaaatatttattaaaatgccaaaatgacaacgaaaaaacaaattttttaaaatttttatttgcagtcgatctttaggggtgtatttttcgctgttttgcatttttcttgtgaaaaattgccaaaaatggccaaaatatggaccaaaaatgctatttttgagcccctttcttcatagcatatgcgcagaaaaaatatgttaatccatataatttacaaccctattgataagaatggtaatttgagttgaaaatttttttgatggaa

SEQ ID NO: 57810 - DNA, 1693 bp, Heterodera glycines
  misc_feature (1621)..(1621): n is a, c, g, or t
  Genomic contig location: Contig_ID=SeqID_5373; Location=69..1761; Strand=+
  SCN-specific regions: Sequence locations=1-211,235-363,385-766,789 -875,919-1325,1359-1528,1567-1693
acagttggcggcgaagtcatcaccgacaactattatccatgggttgtttttgtccgagtccacgtgcattgtgcatattcggccccaatctacattcactgtaccggagtgcttatatcgtttaagcatgtcatgacggctgctcattgcatgcatttaaatacaaccatgttaaatgagtgcattggctggatgaaatttgttccagctgggtgtgttaattaatgttgatttgtttttacaaggtgtgcccggggtgctgagacattatatagtagggtgggggaccccggaaacggtccgggaattccggattttcccaggtcccggagtttttaaacagccaggtgcccatgtagggccggaaaaataagcattgataaaagatgtgaatttgagttgaaaatttttgaaggaacttagtggaatgaaatttttttaaaaaaatacacattttgcctaacataaagatgcataataattagctttatactgccgtttatgtaaaaaaaaatttggatatgttttttcgtagttgatacggtaacagtatgataaaaaagctcacctcaattttttaaattgattgaaatttttaagtttaataaattgtgcatatttgatgccaaaaaatctacttttctataagaaagattcttttttttgtatattttcaaaaaaatgaattaaatttcgcgtttttttcgccactatttaaggcccctaagttgtaatgtttctcgcttaaaaacccgaatactaattattatatttgaaaaagaagtaattttatttaaccctattataaaatttttgattcgtaaaattgtctgttgaaaaccaggtcttaatataattctaacaaaattcgaatcaaattttattagaaattaataagttaaaaatttttaaaaattagatggaagaaaaccgagttgcacgacgtttacattcattttagttcatctactatgagtgaaacaaaaattgaaaaagttcggagaatttcaattgtcaaagattttgacatgtcacatgacaatttattacggcccgacgatcttgccattctcgaggtaaattttttctttataagattgaaaaataaaattttttgaaggcttttctcattttatacagcgacacactaatagtaatgtggggtagaagaggtaacttgccggtgggacttgaacccacggtccatttatagcgtggaatgccataactgactgacaaatgagctacggctgttacaaaaaaaaatttaacctgcttttgttcgagtttttaatgttaatcgcagtaaattagaggatttggcgaatttttatttatttaaagaatttaaaaaattagaaaaagaacactgagtttttctaaagatagaacgaattttttttttcttaaatttttgcttttgtgtacaaaattcacggttacagaacatgttggttctgtttttgtagctcaattcattattatcccaacgaccaaacattttataggttagcataggagctattttcatggaatttctgaatttttaaattggttaaattttttaaaaagaatccgcctattcttatggacaatttataaaagcattaattttttttanattttctttcattcagctaagccgaacattagaccgaaaagcggacaatgttgttccgatttgcttgtataa

SEQ ID NO: 57811 - DNA, 2501 bp, Heterodera glycines
  Genomic contig location: Contig_ID=SeqID_5374; Location=141..2641; Strand=+
  SCN-specific regions: Sequence locations=1-256,280-620,642-684,706 -797,819-1075,1230-1347,1370-1662,1686-1874,1957-2213,2235-2435,2457 -2501
cgtcaaactacttaaacaaaagccagacagcaactttagtgccaatacggtccgcaatttattgcaacaaaatttacaacaacattttgccttggaaatacaatccaagcaaatttgtatgcgcaagtagcagaaataagggcattacaagcgtaagtaaatttatttgtttgaacaacagttagtcatataatcctctggacatttaatgtcgaaaagtgtccgagttttttaggtttccaaatgtataggtgtgattttttaaattttattttataacattcattttctcattgttttcttgaaactaaggttgccaaaatataagtgatttttcttcattttgtgatttttctcgcgtttacatttggcattgtttgactactaatgccttttttgcttttaaaatttctgtcaattttgattcaaaaaaatgtgtgaattttaataatattatgcgtaataattatttagggcgattgtggcggccctttgatgattgaacgaaacggattgtattatttaattggcattgtaattgcagcgtatcacccaaaagcaggattctacaggaaatacgttcctggtgatatttgtttatttttttatttttgaacaattaaatgaaaattcttggtaggcaaggtaagaataaaaatttatgactaactgaaaatttttttcttacaatttaaaagattttaatttaatcgaaatgtacctaatggtcaggtttatgataccattccagcacgaatcagcaaaacaattaatgattgcatatactagtttttctatttaataaaattttggcttggaaattttggctatgtttttgcagataaattcttggcgcatggtcatatttataaaattgaaaatgacaaaaaattactgataaacttgctgaaaaatagcaaatttatattcttgatatcattcgataactctaagagagttcatgattagcttgtaaaatttcaaaaatttcgttaactttcaaaggggttatggccaaaggaaatcacaaaacaggtttttcgcatatttttagtcataactttttgatcgtttgaattttttaattttttcaaaatttttattttcatttttctaagtttttttaattcatttcaattttttgaataatttttttaagttaatttcttttttccaaatgtatttcataatttttttaaaattatttttaatacattcatttattttatcaatgttttcctcaaaacccgtttcattaattttttcgatttaaagatgtttatactcgtgtgaactcctttgatagttgcggttttgtggaactggtcacaaacaatgaagctacatgttttcaagaatttttaaagtctgaccgacttgaaacagtttgtgcaacacaacacgcgcagattttggaaaagaccttaagaaaaagttgcgaatatgtttccgtggatcaaatgtgttacattggcatgatgctattttcccacccttaaaacatttaagcactcccagcaatttccccccccccaaaagcaattaaggaatcaaaactaattcaatcaaaaattgtattattagtaataattcacaatccatttaaaacattttgaatttattaattttgattgataaatttgtttttgcattcgtttggagttaatttaatttttattttttaactagcataaaatagggcccgctgggccctgtgaaagtgccgtggccgccgctttcaacactggcgccagcaaggaatacgaagcagcacccaaatttattttcaaacaatttcacacaacttttcatcattcctacacaacttaatttaacaaccttgcatacaacattccgtacaattttcaaaaaagtttaaatttttgaaaaattatgaaagaaattttaaaatagatatttcgattaataatattttgaaaaaaattataaaattttctatgtagaggcaaaaattttcggttttcagtgcttaagtttttttgctaaaaaaatgtgaaatttttaaaagaatttttctttattttttacagtcacagttgccttatgtacactcatttcctcctcactagaaaatttttaagaatttaatttaactaaattatagattttcaaaagaaagatgtttttttctaagaaattttctgtataatgctataaattaaaaaatgttggaaaaccttttgataattaagcattaaaaccactttttaatggttaataattacacatcaatttaaacaatcacttattaatatggtaatgaaacaaactttcgacattttaattacaatttatttttgacctgttgcagagctttaaaatgatgatgtaaagataaaaattttaaatgtatgctttttggacattgtcttctaaacaaattctccaaatatctcatcaaatgacttttgtttcaactttttcttttcagttgaatcaacgactaattttaacgattaaaaaaataattattatgaata

SEQ ID NO: 57812 - DNA, 956 bp, Heterodera glycines
  Genomic contig location: Contig_ID=SeqID_27102; Location=134..1089; Strand=-
  SCN-specific regions: Sequence locations=1-254,276-370,392-470,492 -502,524-956
  Gene Ontology: Biological process=N-linked glycosylation
atgtcgtcgtcgattgaccatcttttcgaagaaatgttgggaacggatgagcccaaaaaaggtgaaaaggaggaagcaaacagcgaatctcaaaagaaatttgaaaaagaagtggaaaaattgaaaaaggaaatgaaggaggaggaagcaaaaaggactcaaaaaagactggaagaggaagtgacaaaactgaaaaagagtttggcgaaaatgaaaaaagagaaaaaggccgaaaaaaggaaaactgatgaaatggaagaggaaaaagcgatggtcatgaataaaattaaaaaagtccaaaatctggaagaaaaggaaggaattggtgaaagtaatgaagaaatcgaagaaagaaaagaaaagcaaagaattcggcaagtgcttgtggatgatgagatttatttaaatctcgaagaagaggagcaaatgctgtacgagcctctgaaagggcaagaaaccgagaaattcggattttttgagtcttgcttaaacagagcaaaatcaaaaaccaaaatggaaaatggatcggaaatgataaaaccgaaaaaagcgacgaatccatttcgcctattaaaagcggaaataaattcggcggaaatggatattgtggggagacgaggagaagaaattcctccggaaggaaagaaattgggcaatgggtggaaaagtgaaggaaatggaaatgaaggggtgatcaaaaagttgggggaaatacgacaaatggcgttgtcaatcaacgaagaagtgcaaaacgttttgggtttaattgagaggaagggagagatccaacattggcaagaaaatggtgcttggaacagacgcggacgaggacgtggcggaaacttttaccagcacggaagcggaagaggcaattggcaacaaagaggcagaggacacattcatcgtgcggactggacgactccatgcacatcacgatcaatgatgaatgaatggca

SEQ ID NO: 57813 - DNA, 1072 bp, Heterodera glycines
  Genomic contig location: Contig_ID=SeqID_27103; Location=209..1280; Strand=-
  SCN-specific regions: Sequence locations=1-200,246-257,291-383,405 -493,541-792,814-852,965-1050
atgaaaaggaaattaagacaatcacagaagctaattgaagaaaaggaggagataaatgaagacacaaaaagggaattggtcagaaaatttgaagaaatgcgaaaagaaaaaatttatgggtttaaattagaaaataaaaacatagcgaaaattgaaagagaaattgcgaaggatttgggaattagtcggacaaaaatttacaaatggaagaaggaatttggtataataataataatatcgaataaaaagtggaatcctaattaactaattaattaaaataattaattttacccaccactttaggggtggtgagaaaattctcaaaccagcgaaaaattgaaataattgagaaattcgaaaagtgtaaagaacagttagaaaagcaattcaatttgaaaacaactcagaaaattgaagcaaaaattgcggaaaaatttggcgtcagagtgaggacaattttcgattgggggagaaaactcggacaattcatccgtaatattttaatttaactaaattatatttaaaataaatattattttagcaaaacagaaaaaatacacaaaaactgaaaaattggaatctgtggaaaagtttgaccgaatgaaaaagaaaaatccgaatttgagtggtgcacaaattgccaaaaagttggaaattcgcatgagaaatgtaagaagatggaggaaacaatttggaaccgattgaatgtaaaagaaaaaaaacaccaaaattatataaaattgtcacccaaattctcttttaaattagtttgttatgtagatatttaaattctcttttcttcaattttaatttctttgtgggtcataacaaatttgcctatttttcattttgtttataaatattttaaataatgtttgtatattttaaatcattgaagataaattattcaaaaaaaaaatatatattttattcatttattaaaacatttaaaaaaagatttattgaagaaaattttgaagtttaattattcattttccaatttcgttttattctgtcccatctaacgcgtgcccggaaaatgagtcagtgataaaaaatattttaaaataaa

SEQ ID NO: 57814 - DNA, 940 bp, Heterodera glycines
  Genomic contig location: Contig_ID=SeqID_27107; Location=512..1451; Strand=+
  SCN-specific regions: Sequence locations=1-137,159-264,288-940
atggacttaagaattgttactcatcgtcagccttttcaacaccaccgaccgatttcttatgcgacggagggaatagtcgaatatccggcccaagaatatggggagatacatggacaaataatgaacactccgtctggaaaccataaaatacttgtacaggatgaggaagtgattatcgaagagaacgatgaacgagtttagaaagggtgcagacttcccattttcaaggatcgatcttcgattgattgctgacaatgaattcacttaaattttttatataaaattttctcacttgaatatttctctcgtttgaattaaaagttagtttatttcttcatatcttgtatttgattcatgacatcattaatcattatgcattttaagtctttgattctacaaattgaagtcgttttttgtgttaaatgggttcgatttttgatgaaattgttcaaagggctgaaaaattgcacagtgatgttcgtttgggcggcgtcacagaacttcgtcttcccgattcgtccattattcctaccgatgtacattaatggatcattcttttcctatcgtttttatttattccatcaattgcagagaggaaacggcacttcgtgttccgctgctttgttggacgctggtttagacgatgtattcagacgcagtgaagagatttggtcgagaaaacagtcactgcggccgacggccgtcggaatgggcgcttcgctaaagacctaccaggacttagttggtggaactgttcattcactgtttaaagattaattcaaaataatcattcagagtcagctttcatccacccgtctcccaatgtcaaaagttgccgaaaagcctccgtcggctgatgcttctgaccgttacgaggatataaacactgatgttttgaatgaacgatttacggatgcggaaacaaacaaatttgtgcaac

SEQ ID NO: 57815 - DNA, 885 bp, Heterodera glycines
  Genomic contig location: Contig_ID=SeqID_5376; Location=1206..2090; Strand=-
  SCN-specific regions: Sequence locations=1-1,43-49,77-180,202-233,257- 304,342-539,574-622,644-724,751-885
atgccagttgttgctgctgttggtaagaggaaattttttaaattctctgaaatttttttatattttttaattattacagtaagccttgctgttgtggctgtacctgtgtcgggccgtgccaatgttgtaacccaccactgctgatcaaattgccaaggtctaggcaatcgatgttttagaaattgtttcctaatttttcccgaattttcaggacttgcccctgctgttgcaaatgctgtggctgttgctgttgcaggccatgtaaaatccaaaaagtttttaattttttaaccaaaaaagttttaggctgttgctgctgcggttgcggcggcggtggcggacgtaagaagcgctcaattgtcctccgctcggccattgaagcggccaaaaccggaaaacgtgagaattttcaaaatatattaccgtattttccaaaaaatatacatggcatttcaaaaaacgcatacatgataccttaaaaattcgccggtgaatttagtaatttaaggcctttatttttaatctccctcaagtatgggaattaatattaataaatattttaaaaaaaaattagggacttacggtgctttattttaggaacactaaatagggtaatcaggacgacatataggttgaagtaatacggtacttgtttttttttgtcacggtacaccaaccccaagcctaattccaattttgacggtaccaacctgctcttactcagaaaattaaaaaaaaatttaatttttagctgctccaccagccaccaaaatgccaatgccatcacagccatgcccaccagcagaagatataaactgcaaacccacaacagcgcgcagcggcgccactgagtgccaaaagtgtgcagcaattagtgccaataaa

SEQ ID NO: 57816 - DNA, 1851 bp, Heterodera glycines
  Genomic contig location: Contig_ID=SeqID_5376; Location=4906..6756; Strand=-
  SCN-specific regions: Sequence locations=1-112,141-163,199-401,441 -446,501-587,734-862,944-952,974-1305,1332-1515,1545-1773,1803-1851
caacagtgaatggggccgtaaaatgcaccaagatttgttggacggtgttgacttcttggtgagcaacaacattgcggaccgacgccaagtggccataatgggtgaggcaatcaatttaataattaatattaaattaattagattctaatccgggggaactcagaatttttgtatatttttatttttacttttttatatgtccgtatttctttgtgcattttgaaaagcctcactcaggagcttgttaagagctttcgaataataccaactttgttggctttgttcagcaaagaaaaaggctatgatgatctaaacttggctcagacaaaagtgccgaaattaacggcatagaaaaactttgattttgtttttttaaattcgcaaacttacactcgcttcacaaataatttcatatttttttcataatttaataaataattgggtccatttttatcaataaaataatttatattttttatatttattattttttaaaattaggtggcagctatggaggttatgctacattggtcggaatgaccttcacacccgacatttttgcgtgcggtaataaatcaaagaagaaaaataaaccaattaaaataaataattgtcaattaaaattaattcgcgaatgaataactcaaatagaatgaattatttaattaattcttctaatttaaacaataatagaaaccaatgcaattaaaataaatgattaattaattgattaggggtggacattgttggaccttcaaatctgatcactttattggacacaattcctccgtattggctcggcttctacaacgacatgatcacaatgcttggagctgataaaaacacggaagaaggtgcatagttttatatttttatctttaactaaaaatttattcttttatataaaattcatttaaatttatatcatttttaaaattttattccctcataatttttataaaaattgtcaaatcacaccaaatttaaaagctactaattgactttaggtttagctaatcctaaaattatgcattaattttgctgatttcaaggaaattttttggggggtgggagtaacaatttaaaaaaatttaaaacccactaaaaaatcctctaaaaatttaataaaactcaaattattcataacattaaaaattactttaaaattaggccgtcgttttttgaaaagccgatcaccactgtactttgcaaatcgggtcaagaatccactgctgatcgtccacggggcaaacgacccacgggttaagcaggccgagtcaggtgtaaaatgtttcaagaaatttcaaaaaaattttaaattataattttaagaccaatttgttgctgcactaaagcggaaccacatcccagtgacatacattctgtttcccgacgaaggtgtggtgaaaaagaaagaaaaatatgaatattttttaaactttgatattttggaaaaaatttgacgattagtttttcaatttttatttaaatttcttggaattttttggttttttcatttaatattttttcaaaaatttttttttggaccttttgcttaaataataatttcaaaacataaaataacgctttatattcgtttcaagaatcatgaaaattattgtaggaataaattttccaaaaaaaaattctaggccatggtcccagaaaaccgcacaacacattggcaatggccggattcattgaggaatttttgcaccaatgcttgcacggcgatattgaaccattcaatttgggtaaaacgatttttggttcataaaaattatttaaaaaatttttaatttcaggccaatataactcgaccgcaatggtagcttttgtccataattattt

SEQ ID NO: 57817 - DNA, 1292 bp, Heterodera glycines
  Genomic contig location: Contig_ID=SeqID_5376; Location=3242..4533; Strand=-
  SCN-specific regions: Sequence locations=1-166,200-243,303-386,433 -594,616-1064,1086-1239,1287-1292
atgaaggttatggccgatgccaaaacgtcaatcactgggctgaggagccaagcaaaaaatttcaatgccgaagagcgacaatttcatgacttgaaattttcacattcactgcacatgaacccaccagatgcatctgcgggtgtggataaaaagtaagaaaaaagactatttaaattttatttttgaaaatttattttttctcaaattctgtcaacaattttttttcaaaaaattccatttttctaaaaaaaaatttaaattaaatattcataaaattgaattaatttttttttcataatattgttttatcatcgtaattcgtaaaatattccctattttaatgatttttaaccaattttttttccaaaaaattccatacctttttcaaaataaaaaaaaaattttatttcataaaaatttaattaaaattttcgaagcactgttttatcatcgtattttcagttttttctcttaaaatactgggaaccgcccacttaggcgccggccattttggcgcagaacgaatcatatcatttttatttaccaaccaaattaaatagtcttggtatgattttaaatggcttgatagtgcctattaacctgaaaagtttaaaataatttagctgagacacaaaaaagttatggccaaaaaacctcaaaaaattgcatttttctggccattttggcgcagaacgaatcatgtcatttttatttaccaccaaactaaataatcttggtatgattttaagtggcttgatagtgcctattaacctgcaaagtttcaaaaaatttagctgagaaacaaaaaagttatggccaaaaaacctcaaaaaattgcatttttctggccattttggtgcagcgcgctatatcttttttaaaacctaatataattttttgaaatttgcaggctaataaagaacatttagacctattgattaatatcaacattattttatttggtcgaattaaaaaaaagttatgaatctttaaacttgtctgcgcaaaaatgaccccgaccctaaaatactaataaaatcacaaatttcctatactttgtgttgaaggccttaaaaaaattttttgaggccttaaaaaaaattcaggacctcacccattgcggacagagaagcggaaggaaatatgagatttcgtgaaattatgcaacagagggccagcaaattgccgttgggaggtgaagagccatttgccgcactttgatcattaattggacagatttttaatttctttttattttattgtatgcgttaatttattttatcttaaataaa

SEQ ID NO: 57818 - DNA, 377 bp, Heterodera glycines
  Genomic contig location: Contig_ID=SeqID_5377; Location=545..921; Strand=+
  SCN-specific regions: Sequence locations=1-125,147-377
atgattttgttcaaccataatgtaagggttcgaacaacagggtttcattaaatggaagaatttcagcatttaggtttatagtccttgtttataaggactgtcattatttgcttacaaaattttgtttataaatatctttacataaatattttagagaaatcattggttatttcgtgaaaacaaatgctctgtgattcctggtgacaaaaaaaaagctctcccgcgaatgagacagaaagatggctcccgtaaattaattcagcattcttttttgtccttattcataatgacggtccttatttaatttaatgtatccttataaaaactagtattttttaaaatttctctttttaaagattttttattttctaatttta

SEQ ID NO: 57819 - DNA, 1435 bp, Heterodera glycines
  Genomic contig location: Contig_ID=SeqID_5377; Location=253..1687; Strand=-
  SCN-specific regions: Sequence locations=1-57,154-353,440-579,601 -678,702-761,815-997,1019-1187,1209-1435
tgcgaccatcaggaacaccagtcattgaaagcatgaggtctttaggcccataaccagaaaattaatgaaatttattaagaaaattgacaaaaaataatttttttaaaaatacacactaaattatattgcaatttttatttattattattttaagcatggacttcgaaacatggctggtcagcttcatctctgacgatcaaccgtttgagtaacattttgatttaaataaattttaaaatgaaaacgtttcgaaaaaattaggaaaattttttgatttaaatttattgtgtacataaaaactcatttagatattttctctacaaaagaagcaaaaaacgtgctgattacgttcgtttaaaaaaaaaaaaatcattttttaaatatattcatttaaatatatttttaattattattaagtatttttatatattatttttttgtgaaaattgcagctgttcaccactcgtcctgagttggctggacgacccctaagcaaaatgattgggtttgattattcggcacgggatggcttacgcattcaagcatatttaagcttaccaccacaggtaaacaaacaaattaccctaaatattaatttatctatttttaccaaatatgaaataaaatgccagaaatttgaaattttcaacaacaaaattttctaattcatctagagattttcattgaaaatgtttcaaaaataagtacagtatttaaatgaaaaaattaaataatttcatacaacacggcaattcattttctttattaaaattagaaaataaaaaatctttaaaaagagaaattttaaaaaatactagtttttataaggatacattaaattaaataaggaccgtcattatgaataaggacaaaaaagaatgctgaattaatttacgggagccatctttctgtctcattcgcgggagagctttttttttgtcaccaggaatcacagagcatttgttttcacgaaataaccaatgatttctctaaaatatttatgtaaagatatttataaacaaaattttgtaagcaaataatgacagtccttataaacaaggactataaacctaaatgctgaaattcttccatttaatgaaaccctgttgttcgaacccttacattatggttgaacaaaatcatcttttacaaacgagttgtacttttagaaaataaggactgtccttggaaataaggacaaaaagtttgttgagttcaaaaggttcaagtgcaaagatttcccatgagctcagaccccgttgttgtcgccggcacaagtgcgtggggacaagctggagttggcacgccagggcatgttgccacgacggccccaaaaattgattgtgctcgtccacgggggcccaaaatcgcgcgatttcttcggcttcgccgccatcaacgcgtggctgaccagccgaggatacgctgtgctcca

SEQ ID NO: 57820 - DNA, 1252 bp, Heterodera glycines
  misc_feature (124)..(124): n is a, c, g, or t
  Genomic contig location: Contig_ID=SeqID_27112; Location=165..1416; Strand=-
  SCN-specific regions: Sequence locations=1-193,215-388,410-550,572 -876,898-1252
  Gene Ontology: Mol. function=casein kinase I activity; Biological process=locomotor rhythm
agggacggaagtgagtgataatcttttggggtattttgtgcggggcaaaaatgggaatagtgagtggaaaagggaagaaaatgaccaaattagggcaattacaaagcattaatcacatattacnacagagatgttcgctgccaaattggaggtgtgcggaatggcggcattgaacgcgctgaacatggtggccatttgtcgtgactttttcgtcccattcattaatccttttcccaccgaatgttctcaaaggattacgttgtgctgagggcggccaacaaagcgaagttgggccatttctgcgctttggtcgaccggggaatgattaaggaccatttcaaatttctcgtcatggacatggcaattagtgtttgattgttcctaatggtcttttgttgttttttagttgggtgacaatttgttcaaattgcgactccaattccaacagcaccgtttctcggcccccacttcgcttcggttggctttggagatgctcgagtccctggaacagctccactcttttggctttgtccatcgcgacgtaaaggtgaacagaaagaagccaaagtgaaagcaaaatgacgaaaaagaaaagagttattaattagggaaaaggaaaaagacaattcgaggccctaattaattctagcattataaaaagatgttctttaagccaaccaattttgctctgtccgaagagaatggacaaagtggcggccgtgtaattttgttggactttggcctttgccgacactttcagacggccaccggcggaattaaaccgcccagggagaaaacgcaattcaggtgagaagagagggaaagcactccatggttggccaattaaatggccattcatttggccaagtgttcttctccccaccctcaggggaagtgttcgttacgcttcgctggcggcgcatcgcgcgatggaactgtcgccgaaggacgacttggagtcgtggttctagtgagtacagcagctcattgccacatttaattactgtttagcgtcgtcgtcgagtttatgtccggtttgtcgcctttggcaccgattggagtgcctttgttttttttttgtttcccctcaggcgatctcccatggagccatttcagcgcagccgaaagagactcagtgaaaagggcgaaggaaaatgcgaggacaatggacggaatggttggccatattttgaagaaacagcgtaaattaatctcactttttaaggtccatctgttaaaatactgcccaagg

SEQ ID NO: 57821 - DNA, 185 bp, Heterodera glycines
  Genomic contig location: Contig_ID=SeqID_27118; Location=1..185; Strand=-
  SCN-specific regions: Sequence locations=1-29,51-185
ggacaattcaatggccgtattttcaacaataaattgaacaatttgggattccccactttcatcacttttgcggtgagctttttcattcctaaagccatttaaaaatgagcataattaagcaattaatggacccaagcagaggattttatgacaaagacggggacaaagtgacattggccgttgat

SEQ ID NO: 57822 - DNA, 1806 bp, Heterodera glycines
  Genomic contig location: Contig_ID=SeqID_631; Location=517..2322; Strand=+
  SCN-specific regions: Sequence locations=1-535,557-582,604-968,990 -1486,1508-1806
atgtccaaatattcatcttcattttatacgcctgcaaccgaacccaactgccactgcgctagcattcgtaaattgggcatttgcgcttctgccgcatttacgggagctgccctttacattaaccttgtggaacagccaagccgtctgcaattggaaaccgctgccgcgttgaaacagtttaaagagagttacacacgtgcgattcccatgcaagtatgtataagatgcaaactaatgcataattgaagcagaattttccctcatcgaagattaactattctatatttcttaggctggtttggcaattctttctggcattgttggcatcggtggtacaattaagactggcgagaaggcttgggcttttggcgctgctttaatgttggccaatattccatacacttttctatgcgtttttccagtcaacaaacgtttgctggctaccaacgtaacaaaataaattggaattggaaggggtggagcccaaacaaaaaatacaaatttaactaagggagaacacttatggcctggttattatatgtagttcattaaaatatcgtaaaaattgagctgaacacgaaccatttaatagcaaaaatcctaagatttttaaaacccagaggtggaatttttttttttgatttctctcctctccccgtaaattggactgactccgccaaaaggtgtaccgacatttcgccaacttgacatctcgccaactgacatctcgccaactgacatttcgccaactcagccaaaaacattcatttcgccaactcaaccaaaaacattcatttcgccaactcagccaaaaacattcatttcgcctactaagccaaaatctgacatttcgccaactgacatttcgccaaatagttaaaaaaattaaagaaaaaaaagtaaaaagagtaaaaaaatgctgtgttaatatcaaatacagccctattccagtttacacgtccaatcagtgaccatcatcatttcttatgtcctgttcggcgcgcttttttcaactatgttcagcgcggcaccgctggagttcaaggatggctggcgtatttgccaaaacctacattggcaccactcaattcgagattgatcgcggggcggaggcatttgaaccgcatgctgatgtcggacactttcttctgcgtcgcactcgaagcacaactcgtaaatgcacctattctgtcatgaaatttatgaaatttttcaattttagcgttcagtatttcccaggcatccataatgacaggcagtggaccaatacaattcggactgcattcgccacaaccttcaactccaaccattccattgtcagaagaatgcagcttattccacgctgggaacaagacatcgtctgtcctccacgtttcccgatctcgttttggaatgtatacaccagggctcaaatggcaattgagcgaacgaacaacggcatggaagccgcgcatggacaatttgcagtaaaaaatttcatcggaaaacattttttggtattttcagcgtgatctcaaccatcatccatcattgagtgacttcattgctgcattcatgaaggacatcaacaaacagttggacatcggacgcgcagaacagctccagaaaagcactaaacgacgacaacggtacgtcatcaaagaacaaaatgtggtgcggatccttgacgaggccgactttgaatcggaagaaggattgacaaacgccttgcacctgctcgggatcgtgatgcaaggctttgcggagggacttcacgtccgtggaaattcagagaatggtgaagaaactgaggccgatgaaaattga

SEQ ID NO: 57823 - DNA, 256 bp, Heterodera glycines
  Genomic contig location: Contig_ID=SeqID_631; Location=1..256; Strand=-
  SCN-specific regions: Sequence locations=1-104,128-256
tatggcacccccacaaagtgtccaagccacggaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgtatttt

SEQ ID NO: 57824 - DNA, 741 bp, Heterodera glycines
  Genomic contig location: Contig_ID=SeqID_632; Location=235..975; Strand=+
  SCN-specific regions: Sequence locations=1-741
ttggatttgcaacgacgtttggatggacattttcccatcctttgaccgtcctcaactcggcctcaaaatggcacttctttcgccacgttttaattcgctggtggacaaacatttcgatggcaaaagcgaattgacaatttggagaccaatcgaaatttttccattgcgcgaccgtccgctgcccagcaaaattcgctttaaagaccttcggattgagtaatttaaaatcagagctgtcgcaataaaagctttccttccatttttaggtacattgatcactccgtcatcgcttttcttcgttcaaatcaccaaattttcgacaaaagaggcaccaatttagatttgtggatttattattcaaacaccacggatggccagcggatttgggatgtttttgttcgtgaaatttggccaattttttctgaaaacattcgccacttgggcttttacgatgctgttaatttggacaatttgcttcgtcgcacttcgtcgacaattctcactgatctcaaccaattgaattcaatcaatttatttggtctgtcgcccgctgcatttggtgatgattttgatgtgccaaattcaacaatttctgctggccaagcattgtccaaatggttgcactctccgagaaaagatggccaacccaagcgattgcgttgcgataattacaacgcacaagggaacactgattggatcaacaatttcaaggaggtgaccataataacgacaaattactga

SEQ ID NO: 57825 - DNA, 1278 bp, Heterodera glycines
  Genomic contig location: Contig_ID=SeqID_633; Location=268..1545; Strand=+
  SCN-specific regions: Sequence locations=1-1116,1147-1278
ttggatttgcaacgacgtttggatggacattttcccctcttttgaccgtactcaacttggcctcaaattggcacttctttcgccacgtttcaatgcgttggtggacaaacatttcgatggcaaaagcgaattgacaatttggagaccaatcgaaattcgtcgcaaggacaaaggaccagaaccgaaactatctgtacgaatcgattacaaatttgtggaatttccattgcccgaccgtccgttgcccagcaaaattcgctttaagaaccttcggatttagtaattaaaaatcaaagctttatggcaataaaagcattcattccattttcagttacatttatcactccgtcatcgcttttcttcgttcaaatcaccaaattttcgacaaaagaggcaccaatttagagttgtggcttccttattcacataccacgaatggccagcggatttgggatgtttttgttcgtgaaatttggccaattttttcggcaaatattcgccatttgtgcttttcccatcgtgatcatttggacaatttgcttcgtcaaatttcgccgacaattctcatcgatcttaatcagttgacttcaatcaaatcatttggtctgttgcccgctgcgtttggtgatgattttgatgggccaaattcaacaatttctgctggccaagcattgtccaaatggttgcactctccgagaaaagatggacaacccaagcgattgcattgcgcagacaaacaaacgaacttcgattggatcaacaatttcaaggaggtgtggcccaacatttttgtgatttttgttttcctatcaaattgtttagcaatttctccgtgccaatgccatttcttccgtcagttacgaaattcatttttatgttcgtacgccgtcaatgccaatggtgccattcgaattggtgaacgaatggacaaaggaaaagctgacattagccaaagcaaagggatgggacaaccgatggataatgaaacgatgcaaaattattggggagacggcagtggtcaattgggaagacggaaattgggacaacaattgtaacagtgtcttcgtttggctttttcgtaccactaattgcatcgggtgagcaattaaaaaaggcatttaattttgtttaaataattaaaattttgcttaatttagcccattgtctccgccaccagcagaagaagccggacaaaacatcacaaaagggccgtcatctgaactgacaatgagtgatggacaaacgaagaaaaacagtgatcagccgcagaaggaatga

SEQ ID NO: 57826 - DNA, 475 bp, Heterodera glycines
  Genomic contig location: Contig_ID=SeqID_634; Location=105..579; Strand=+
  SCN-specific regions: Sequence locations=1-179,201-225,256-475
atgccaatggtgccatttgaattggtgaacgaatggacaaaggaaaagctgacattggccaaagcaaagggatgggacaaccgatggataatgaaacgatgcaaaattattggggagacagcggcggtcaattgggaagacggaaattgggacaacaattgtaacagtgtctgcgtttggcttttcagtaccactaattgcatcgggtgagcaattaaaaaaggcatttaattttgtttaaataattaaaattttgcttaattaaggccattgtctccgccaccagcagaagaagccggacaaaacatcacaaaagggccgtcatctgaactgacaatgagtgatggacaaacgaagaaaaacagtgatcagccgcagaaggaatgaatgaattgagaatgatcgaccgagcataattcaaatcagtgatcaaatgtatcttataagaaaaaacctctcaaatatgtatatgtaa

SEQ ID NO: 57827 - DNA, 1738 bp, Heterodera glycines
  Genomic contig location: Contig_ID=SeqID_634; Location=2103..3840; Strand=-
  SCN-specific regions: Sequence locations=1-456,481-648,670-865,887 -907,929-949,971-1130,1152-1221,1252-1379,1401-1487,1509-1738
atgtcttccactgtccttcaaaatgccctccgtctgttgttcattactctgatcattttcaactgttgccatgggtaaacaaaaaaaagcacagcccaaacggcggatgttctattgcaatttccacgaccttaaaactttcggttttctccaagttttaaaaaaaagaaacaaatgtgaaaagaacgagtttttaaattccgtttaatttatttcccgtgcaattttttaaaggtcgagaaaaatgcaatagagccgcctcaattccgttttctgattttcctatttttccagcgcttcgactcgtgttaagcacaagaaaccaaccgatgagacgacttcgacaaatgaatttgctggtctcagtgtcaagctatggatcatcattggtgtctctgttttgctcgtgtgagttttccagggctttcattttgccaatgccatcatcaatcaaaatcatttcccgttttccccctttttcagcctcgttgttgtgtgtgccattgttgtgatttgctgtttgtgccgcgaacgccgtttcggccacgacaacgatgagctttcgacagcagtgtcaagcagttactacaaatcgcggcagggaccaacggattcgagggactggccgccgacctcagcttctgggcatggccatggtcgtggaggacgaagcggtggtggtgcgatcacggcggtgccaagcggaatgatgtccaagatgccaacaatgaagacgaagcagccgttctcatttcgaatgctgatgccgaaaagcttacgctcaattggaccatcacgaccagcgccatcaacagcaacaatggaacgaggcggggcccagacaaaattgaagacgacgacaatgctcggaggaggagaccagacaaaagtgaagacgacgacaatgctcggaggaggagaccagacaaaagtgaagacgacgacaatgctcggaggaggagaccagacaaaattgaagacgtcgtcgacagtgccgtcgggaggagaacattacacaacgtggtgatgcgcaatgaatgaacgcggcggacggcgatggcattcgataataatggacgaacaatttcgcatttaattgtctgtcgtgtgatatttgtgtcccccatttttgatgtgttcattcattcatttcctgtgtatgttaccacatatgtgtagtattgtgtttgtatgctgccaattcggtttgtatgtggaataatgtgtatatatgtataaaatatatatgtaatcctttggaattcggccagttattgctagggttaagatttatgtttatgaaaaatagtgtgccctattctattcattttccttccacactttaacctgttaaaaaacggatttaagcgctttgccgcatattttttgattttacaaatctttttttaacacctaagaaaacctataatttttggctctgggccatcaaatacaatttccgaattgggggccacatattcaaatttcgtcaaatcttgaacactgcaaatccaaacggatccattcgatgatttttagcctaaattgttgcttttatgcctcacaaattgctgaagcgctatttttggatatttagcgaactctttattgacttttttaaagttctcgacgagctaagtctaaaaatcaaggaattaagtcgaaccggcgccatttaataagcactgggacaactgagtcccaatgaaaatggaaacttcagtaccaaagaaataaa

SEQ ID NO: 57828 - DNA, 155 bp, Heterodera glycines
  Genomic contig location: Contig_ID=SeqID_634; Location=6586..6740; Strand=-
  SCN-specific regions: Sequence locations=1-155
atgattgcccgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaa

SEQ ID NO: 57829 - DNA, 2192 bp, Heterodera glycines
  Genomic contig location: Contig_ID=SeqID_634; Location=4338..6529; Strand=+
  SCN-specific regions: Sequence locations=1-44,224-285,308-583,610 -664,686-736,805-854,878-1220,1242-1946,1969-2192
atggccattctgacgccgatcaaaggacaaccgacggaacaatcgcatcagcaccaccaccatcagcagcagcagcagcaacaaccgacgcaacacgtgcccatccagcgggaagacatcgcaacacagacggaccaacaagcggacgaagaagcggcgacagcaccagcactagtagcagcagcggtgacgcaggcgcaacatcagccgaagcagcagcaaccgccgccacaagtgaccaccaccaatgcgaattcgacaacaccgccaacgccgcaagtggagacaagcaacaacaacaacaaacggtagagttttggtgccattggacgggagggggagaggatgccgtcaaccaacaattttggttgatgataatgccatttttagacatcccaaattgttttctgcaggttttaaccccgggaaaccctaaccgacgtttttagcaattttttttaaagatttcagagtttggccctcctccctttgaattcatgggcattctctgttttttcacataaaacagaaattacgcaaaaaattttcctgcttttcagtgatccaaatgtgatggtggacgaccagcagcaacaacagccgaaacaacaacagatggtgccgccgccttctccactgcaaaacatcggacaaacgatgcgcaaagtcaaatcggccactaccccttatgaagcgctgagatgtgagctgatcgatgcgttggtggtgcagcccaaactacgacaacagcagaacaacaacggcaacaacgacggcaccggcaacaacgacggcaccggcaacggacatcgcggagggcttcgcaggcaaaaattcaaatcaatttgtcaccctcccccattttcccctctttttcaggtcaatttcggtgatcggtgacaattggttgtcctacgattgggttgaaagcgatcagccgatggaccaaattgagtaaaattcattcatttcaaattgtttggcactttttaatgcttttcccctttgtttaagcaatcagcaagagcagccgatcatcgacgatcccaacaacaacatcaacgcggatgaggggggcttggttgaccaaatcagcggcgcggtcgcttcactgtccacaatcaaccttggccctgtgtacaccgctgttggcaacggggtggactactttgggcacctgtggcagtatcgggtgagccaaaaatgccaaatttgacggatttaattgaatttcccctcctccgtttttcagctcttccgtttcgccttcatccttctgtgcttctactttggcatgggcttcatggaacggttggctgtcgcgatgatcgccgcatgcgtccgctgggcttggccaccggtgcacttcatgctcggctcgtcacggggaacgctgttctatttgacggactggttcgcatggatggaagactttttgtcaagttgggtgtgcgacatggccaacaggtgcggttttacggtgtgggggcacacggtcgataccgtaccaacactactaattccccacaccccattttcagatactgtcatcaatacggtgtgatgtgcgacagtcagtgttcctttgtcagccgaacgcagcgcgcagcttccttcaccggacgtcgcttctgaaggatgatacgcgagatgaaatgaattttgataacgatttttgatggcgacattgatgtgtatgtattgtatattctgtctattatggttctgctatttgagtacgtccgtgtatattgtatatgtactgtattgtattttgtatccatatggcatattcaattccaattttaacgcctaattttgtatacccatgttgtgttgcatgcgttcataaactttgtaaaattatatgtactcaattttatcagtgggctataaactattttttaggcgttttttgttattttttcatgactacattttccaagttttggactacaacttttttcattgttgaccaaatctaacaatcttggtatcattcgaaagcccttcacaagccctattagccttacaaaaaaccaaaaaaattttagcttgtaaaaaagttattaagaaaaaacttccaaaattttggtttttttgttatttcatgttataactagggatgccaaaaatatggaccaaaaatcgcgaaatatggacataaaatggcaaaaatctcaaaatatgaa

SEQ ID NO: 57830 - DNA, 4842 bp, Heterodera glycines
  Genomic contig location: Contig_ID=SeqID_5379; Location=397..5238; Strand=-
  SCN-specific regions: Sequence locations=1-1786,1808-2221,2243 -3133,3155-4040,4062-4842
atgctggtgcagaccggactgaactcggagggcaattcccgcccgcccgaggctcgtaccaaaaccaagcgaaagccgaagcgacggacgaacgacccggccattcaatcggagaaacgaggggaacgatcccttggcactgatcaacgggcattcacagcgatgggcgagagcctgccggcttacctgatggtatgccccgtggtagcggccaatgacgacatcacgcgtcagcgtcctaccgctctgctcttggatccagggagtcaggtggattgggtccagacaatcctgacagagcaactcgaactaccaactgcggggtcagccccgcttgtcgtgcaagtgttcggcggatcaaagaagagagtcccgtcgtccaggcaccggctgaagctcaaacgattggacggagggtgggagccgctggaggtgtcatccgtgcccaatgtttgcacgcccattcaaaccaagctggttgggccgggaactcccggactgctcgaaccggtgggcgcgacacttcagccccaaatcgtgatcggaatacgcaagttttgggactttgtgattggtttcaaaaaatcggccgagggggccttcctaattgatacagtcttcgggactgtgctttgtggagagcatttcggagctcacttggggcaaccagcgccccataaccacatcctcatggccataaccgatgaagacagcggatggagtcgcatgccggccccgtcggcagttgagcagttctggtcactcgagacgatcggaattcgggacgacccgaccggagacgccgacaccgaggcgatcattcaattcgagaaatcagttcgacaaaatgaagacggccgttattcaattcggctgccgtggcgggaccccattcccgcgttgcccagcaacttcgctgtagcctacaggcgcctcaccagcctgatcggccgattacagcgaatgcccgacgtgttggagcggtaccgggcagtgatcgaagagcaattcagtaccggcatcatcgaaaaagccgcgatcggggccaaccagcgggaacatttcatcccgcatcaagccgtgatcacgcccaagaagctgcggattgtctacgacgccagtgctcatgccaaaggagctccgtccttgaatgactgcctgctacggggacccgtgtggctgcctgatttggctggaatgctgttgagatttcgggcttgccaagtgcccgtgattgccgacgtcgagaaggcctttctgatggttgagatcgaagagacggatcgcgaggtatgcaaatttctgtgggttcgggatcccacgaggccagtgacgacggacaatcttttgccgctgagattccggcgcctcgctttcgggctgacgccaagcccgttctgcctcgccgctgtagttcgtcatcatctccggaaattcggttcggacttcgcggagcagctgatccgcgacacctatgtcgacaatgtgctcatccccgcggacacacgagaggaagcggccgaaaaggccagcttggcgaagcgaatgttcactgatgctcggatgaatctgagagagttcctcagcaatgaccagaatctcaatcgggaattcccgacggacgactacctcgggaagacgacaacaaaaatgctcggccttgaatgggattccgagcgggacgaaattcggatgaattacccggggatccccccggattgcgccacaaccaactctcgcaggtccgtactcaaaatgatcgccagtctcttcgatcctttggggaccttggcccctgccactctcgcagccaagcgtttcttccaacgcttgtgggacgcgactcacgattgggactctccactcagcccagctgatcagcgagaatgggaacgaatcaccgcaagttgggacggggaagtaaccctgattccccggaaagtgataagtggaaccggactgtcattatcccttcacattttcacggatgcgtcggagttcgcctacgccgccgcagtgtacattcgttccgaaggacccgacgggatcttttcccgtctgctcatggccaagtcgcgcctcaagccaaagaaagcggcggacactttcactataccaaggatggagttgatgggcatcctgctcggcgtgcggttggcggctttcgtccgtgcccaactccaccgtccggtcgctgaacagcatttatggagcgactccatgattgctttgcactgggtaaggaaccacacaccccaaccgcagttcgtagccaatcgactgctcgagatacggacggcaacggaatcaccttccaccatgttcggtcggaggataactccgccgacattgcaacgcgcgggatgcctcccgctgaacttcacggcagtcaattgtggtggaatgggccctggtggattgtctcacccaccgacaaatggccaaaagagttggagttcaaggtgtacaaggaggggacagacttccccctggaccaggacactcctagcacaatgctcctcgcctccgcgcaagacgattcgttcccgacagctttcctcagaaagtgcggccagtggaagcgagcggtccgtatcatcgcttggtcgctgcgattcggcagaaaggcaagaaaggggggggacaaatgaagtccgaatggagagagaggggaaacgtgatcccctgtgcactgaggagttaaacgcagcgcaagagaccatcatccgatcagcccaaaacgagggcaaaatgccgcaagggattcaaaccgaggtggacgagaacggtacgagacgcctgcacagccgagtggagaattgcgctgaaacggaactcagcagaccaatcgtcctgccgaagcattcaaggatcggcattctgctgatcgcggacactcatgagggactgcgccattctggtataaatgcgactctctcccagttcttgaaggggtactggacccctggagcccgtcaacaagcgagaaaggtgatcaaatcatgccggaagtgccgccgaatggaagcggcgccttacgctcttcctccaatgccaccgctgccagctgatcgggtcagacgtcggctgccattcgaatcggtggggctggacttcttgggccctacggcggcgttggatgagtcggggcagcggcgcaaagcctgggtgctgctgatcacgtgcttgacaactcgggcaatttatgtcgacgccactcgagacctctcagctgacagcctgatcacgcttctacgccgattcatcgccaggcgaggggcgccttcacggatcctcagtgacaatgcgccttcattcactttggtaggccgaactctttcatcattcggagttacgggtaacgaccccgtggcattcactgattctcgcggaatcaagtggcgattcactcccagccacaccccctgggcgggaggagtgttcgaacgggcactgcagaagacactcggaagctgggtgatcagttatgacgagctgatcacgcttctggcagaggtggaagcagcggtcaatttgagaccgctcacttacgtcagtgacggagccggcgatccgctaccgatcagaccgatcgacttcatccaggagaacggccgattggggattggtcccctgaacccagcctcagagctcccacccgatcggaaggaccccccgcatgttcagctcgagaagcgatggaaggcggcgcagcaacggacagaacatttttggaggcggtggcactccgagtacctgctgcagttacgggagaaagccggctggcagcatcggaacagacgggtggtcgccggcgggacaccaaaagtcggcgacgtcgtgctggtggaggacaaaatgcagccccgcaatgtgtggcagatgggccgaatcatcgaactcaggggaccaccggatcagatcaggagtgtgctaatccgaatgccaaatggccgaatttgggggcgcccggtaaataagatatgccccctcgaggaatcaccggaatcggaacgggacgggacagcagaaacgtgcgagagcggcgacatcaggggggacctcattcccccgggcccaatcatgcaacagacggaaccccaggatgaggacaacgccgaaccaacgcagcaggaggcgggcacaatcggggagtccgtgccggccagcgccgaagaaacgaccgaagtcgtcggtcagagcgggcaggacaaggaaggagcgcaaatcgaacgggaaaacaatcccgtggcccttcgacggtcacagcgggaccggaaaatccgagaaattcgtgacccggagtggtcaatgccgagaaaaccgcaaaagcggaagtttggacaatcccgcataggactgacgctttttgccgtgctaatgtggaccgggaccgtcgtcgggtgccaacccgccccccgaaactcgagactgacggcgctgcgcgactcgaatgacctcaagaatccatgcgagatgagctgcgcggcgcgtggagtgaccgtgtacagcgacgaatcggtggacaaactcgaaatttgctgcgcggatgggtgttgggcaacttcgcccaagaatcccgagactcactacgaactcccggtcgagcctccagccgccgacattttcgggaaaaccggaggattggacgacattttggtcgtatttcaagcgggcagtggacgacaagcccatcccgggcttcgaaaagcagcttcttctccttcgctgcttaaaggaaggatccccagccaggagggctgtcgaggtctacaccccgtcggacgggaattatcccgtggtcattcaactgctgagggaacgatttggggacacggatga

SEQ ID NO: 57831 - DNA, 60 bp, Heterodera glycines; identical to SEQ ID NO: 52045
  Genomic contig location: Contig_ID=SeqID_27122; Location=701..760; Strand=-
  SCN-specific regions: Sequence locations=1-60

SEQ ID NO: 57832 - DNA, 1250 bp, Heterodera glycines
  Genomic contig location: Contig_ID=SeqID_27124; Location=38..1287; Strand=+
  SCN-specific regions: Sequence locations=1-285,307-387,410-429,452 -619,641-942,964-1250
atgaacaaccagaaaaaaagtggaccgatgggaaaaggctctgaaccgaaaaatgggtcagattttgaagcggaattttttacggccgaggaaaacaagcttttccgacaacttttgggccgattacgaacatttgaggctgcagtttgcagccaattcagacaaatggaaaacgaaataagtaagaggacaaatgaaacatccacgcacttgggaacaatggaacgatcgatcaatgagacgaacgcgagtggggaaattgaaaattttgagcgtgaggaaaaaattgcaaagttggaaggagaaattgataatttgggagataagtgggcagaatacaaagaaaatgcccaaagggaattgagtgaattgtcaatcaaaatggaaaagaattttaatgagacaaaaagttctattgatggggtgaaactaaaattggaatcagtggaaaatgagttgaaaaaatcaattgacgttgtcgaaacaagggtcgaatttctggaaatggaaaatgctagtgatgaagacatgtggattgataacggtcacgaggatgctaattttacggacggaaatgttcagaaaaatgagggtgaagacgaagagatggacgaaagtgaagacaaaaataatggagaaatggaagatgaatctggggaaaacgaagggaacaaagacaaaagttgtgaactaatgatggccgatcctttttttatgaatgtagcacccccgggagtatacgatgggaatcccgccatgccgttttcacgttggtatgagaaatttaaggacttacttttactgtgcccccaactcaacgaagagcagaaattaagccgattgcgtgtatgtttggccggacaagcacgaggggaattggactcaatgagtccagcaccggaaaccctccaggcggcaattgatcatttgaaacgcaaattcgaaaatgaaaacacaaaatccattgctaggcaagccatgtcgatttgtaagcaagccccaggggaaaaagttatgaattcgcgaaccgactgaatgaagcagttaggactgtgcttgccggagagacccaaggggtgattcaaaaaggcttttagaggaatttttagaccgtttgacccctgatctccaatttgaagtaaagtcgggaatgtcgacagattactcgagagcctatgaattggctcaacattttgaattgttgttggcggctagaaggtctacacaagtctctgtagccgaattgacaa

SEQ ID NO: 57833 - DNA, 251 bp, Heterodera glycines
  Genomic contig location: Contig_ID=SeqID_27127; Location=33..283; Strand=-
  SCN-specific regions: Sequence locations=1-63,105-212,234-251
atgaattttatttttcttttaaattttttgttcgtcgcaattgtattttgtggcgccagtgagttttaatgaatttttacaaattaaattaattttttaaatttccatttgagggaaactctattatccggaatgtgaaaataaaaaaatgttcaaaggccaatggaattatacatattctagttatggaaatgatctttgtcatacgcaagctgaacattttcaatgcattgaatttaaatgttccatcg

SEQ ID NO: 57834 - DNA, 168 bp, Heterodera glycines
  Genomic contig location: Contig_ID=SeqID_27127; Location=356..523; Strand=-
  SCN-specific regions: Sequence locations=1-21,44-168
atggtagtgaacaatttgtccttttgaatttaaattatttcattcattttataggataggacgggactgggaattttgagaaatctggggacagtgaacccggttctgggccataaaccaacgaaaaaaggaaagaaatctggtacttgagcatttcctgataataaa

SEQ ID NO: 57835 - DNA, 1965 bp, Heterodera glycines
  Genomic contig location: Contig_ID=SeqID_5381; Location=580..2544; Strand=-
  SCN-specific regions: Sequence locations=1-618,641-1965
atggtcttccatggcccaccggttagtgagagcgaacctgaaccggaaatcatcgtcacggaggaagtatcgtcctcagagcttcaagaggaaaacgagcgacgagtccagagagcgggacacactcccccatcagcaccgcacattccagaaccggaagaattgcgcattgaatgttaccaacaaagctggccaaaaggagaacaatacgtcggttataacattttaaccgaatgttctggtgaacgtcacgaaagttgtgccaaatgtacgtatcggcaaattgcttcaacacgcaaaaaacaattgaacggattcgaagattgcaaagcaaattctctgatgaacgcaatgcttttcgacttggtccagcgacttttaaatcttcgcagcgaaacagtcgtcctccacgaagaatacgtaatgccgtccatcttgacaccgaagcagttggctgaaaaattttggaaagaacaattcgtcaccaaaaatcggcaactcgttaagcaagcatcgctcatggatttgttgaagcaatggagcacttcgtgtgatcactttggagcattaatgcagctgaaccaatttgagccaataaagctcaggccaatctcaatcgaagggaaagaaacatcagaattcgagaattggctcgaaaacctcaacaaattcaccgcaaatgtcgcttctcgaacaaaggcagccatagcaaaccagcactacagtaaccacgaaattatttgcgttggcgatctggcggcagaagaattggcgaacgcatcgaggactcaatggttcacgcactacgcctcggacagacttcatctatcccctgggcccgatgtacagcacatcattttctgctacttggccaatgaaagcgacttaacaaaaggcatcaccccgtacatccgagaactcgcaaagacggacattcaactaacaatagtgttagcaaaaacggacgacaaatcctggctcaaaaacaagaatgaatgctaccagttggctaaggcggccaaggcaggctttttcgtctaccaccggcgaaccggtgaagcaagacaattaaccgacatgatcttggcgcgagaagaagacgaaatcatggaagttgatccgacaccttcaacatcagccgcaagcagcagtggacttatgtccagaaactcaataaacacgctgatggtcatcagcatgttcgcgctgatgttccttcagccaacagcagcggcaccgttacgcattcatcgagcctcattaagccaaaatgcacaaagattcctccaaatggtatccgcgcattacagcacactcacaactgcaccgccatctgaattaacaatcactttgagcaccgcactccgaccagtaacttcgtcgtggtacagcacaataactcgaactgaaatgatgaccaccacgaagacaaatccatggacaacgacaacatgggcatcgatgacgaccaccaagcaaagatggactccaatgatgtcaaacagcgcatcaacttggacgacaagacgaacccgaatactatacgtcacgaaagcaagaagccaacaaactgacgcaacgacaccttccggcacgatcaaatcagcaaaaagagacttgggaacgaaccgtgatggagcggacgttttctggtgttccgacaggggcagtacgatttgggaactcaagggccccgaaagttcacctttctgccgtcccccgccaacactcactgctcaatggcacaatctggcaatagagctcttcgcgaaagtcataaagccagagcaaatcgcattcgcatggcattgctccatcaaacgcaccagtgaacgttattatacaaatttgttggccgataagttcgtcaccatcgagaaggaatttccaccggtcagcaagcggatctgcaatgccggtatatttacaattgtaacagaatttccggaaaatgcgcatttgtaa

SEQ ID NO: 57836 - DNA, 355 bp, Heterodera glycines
  Genomic contig location: Contig_ID=SeqID_5382; Location=111..465; Strand=-
  SCN-specific regions: Sequence locations=1-355
atgtctattatccccggcactagtccggaaggtgtccgctatgctggtgtgaccgtcttttcgaaacatagaacctacacccaggcccaaaaaatggcaatgataacaatgaagatttgccctcgtttgtacgaaatccagctttttggcaatgcattaggggtagaccacgacacagcttcagcgcgggcactcgcaagagaagtttaaattatgccattttttatggataatttatatagattgttgttgaacaactcggagcacgtcaagtaagccatcgagaaatggaacaaagggtggacgaggtgatgaaaaaggcaaaaaaaaagccaataagatactgggaaataaa

SEQ ID NO: 57837 - DNA, 865 bp, Heterodera glycines
  Genomic contig location: Contig_ID=SeqID_5382; Location=756..1620; Strand=-
  SCN-specific regions: Sequence locations=1-392,414-472,498-753,775-865
atgtctattatccccggcactagtccggaaggtgtccgctatgctggtgtgaccgtcttttcgaaacatagaacctacacccaggcccaaaaaatggcaatgataacaatgaagatttgccctcgtttgtacgaaatccagctttttggcaatgcattaggggtagaccacgacacagcttcagcgcgggcactcgcaagagaagtttaaattatgccattttttatggataatttatatagattgttgttgaacaactcggagcacgtcaagtaagccatcgagaaatggaacaaagggtggacgaggtgatgaaaaaggcaaaaaagccaataagatactggaaaataaacggattctaaaaaaggtattgacaggtctctctaatgtaaggttttatttcatatattacagatgggagctcacctgctggacaaaaaaattgacattttcagatgcacataagtaacagataattttaaatttaatttttaattcttcttcacaaatataaatggataagtagtgtcggaatttccattccgatcgctaatcaatgatcagcgaatcgttgaaagagctcgtgccgaaaaagaacggctttacaatcaatacaacgctgccatagactacgccatacaaaatccccttatcaacacgcctggcaggacttcctggcacgaagtcgcccatggcttttgcggttgggaaaactcagatttcatcggagatttagaatatgtaattatatcataaaatataacaaaatgattatactgtctatttgagaccggattggcacggtgaccaggcgggcttttaccgggcggcccggtcccgtcccatttttctaaattcaaataaa

SEQ ID NO: 57838 - DNA, 1265 bp, Heterodera glycines
  Genomic contig location: Contig_ID=SeqID_5383; Location=1370..2634; Strand=-
  SCN-specific regions: Sequence locations=1-693,727-929,951-1092,1114 -1265
atgccaaaatatggacataaaatatgcataaaaatgccaaaatatggaaatatggatataaatcccgaaatatggaaaatatggatatggaaacccatcctagaagcttcaaaccaagctaaaaacatgtttttcgtgcgtttcaggccctcaacagtccaggaaaaaaatatggatatccatatgattggcatccctatttatcaatatcaaactatccggtcacgtcagttaaccctcacgtttgggccccagcatgtttcggttataatttttttcttagttatccaaagccaagattgttggtatcattcgaaggctacatgtttagaaggtattataatatatcgcttcgcgattggacaattgctaaaaagttataactagaaaattgcaaaaagtcaaaacttttgaaatttttcttaaaatttttttatatgctacaaaatctttttgttttttgtaaggctaatagagctagatgaagaactttcgaataataccaagaatgttggatttggatgactaagaaaaagttatatccgaaacatgcagtggcccaaacgtgtggggcccaattgacgggttccgagacaatcagagaaaaaaaagaagcaaattcagagtttgaggagaaggttaaaaaattcaaagaaattatgggcgaattttctaaagcgaataaacaaggtgaattttaaatttaaaaaaaagttaattaattttctcctcccaacaaaaaggaaacacaaaaaggaaaaggtaattagtttaattaagaaaaaaatatgagaaaaaagtaaaaagctttttaaagttctgatcggccaaaaaagcggcgatttaaacaacggatcgaaagcgtttgcgatgaagaaagacgaatgtcgaggagcagaagcatcacaccgaggagagagaagaccaattacaaacaaatgatttttaaagcatttgtcatgtatttgtcggtttacggcgaacgaatggacgcaaaagtgttttataaaatatttaaaaccgtttttaagtgttatttagaaatgccaatacattgacgcaccacaatttttgtctggcccaaatggaacaacaaactgtgcataaaaaccagctgggtacttctggcgaagaaatttatcacttttctaattacctaacataaaaaaacacaaccatttttcagagaccgaacaattaaaaaaatttaaaatgttcagaccaaagacgacatttttttattcattacattttttctgaataaa

SEQ ID NO: 57839 - DNA, 1020 bp, Heterodera glycines
  Genomic contig location: Contig_ID=SeqID_27133; Location=158..1177; Strand=+
  SCN-specific regions: Sequence locations=1-168,209-316,340-1020
  Gene Ontology: Mol. function=ATP-binding cassette (ABC) transporter activity; Cellular component=membrane; Biological process=transport
atggacaatttgagcggtggtgagaagactgttgcggccttggctttgcttttcgctattcattcgagcaatccgtcgccttttttcgtgctcgatgagatcgatgctgcgcttgacaacacaaacattggaaaggtgtgtcatttttgatttcatagtaattttgccattattttaaatttgattatactttttaataaataaatttccaagaatctcccttggtaatttgttaaattagagtgaattactaaatttggcttttccacaggtcgtgcattacatcggtgaacggtctcggaccgacatccaattgatcgtcatctctctgaaggaggaaatgtacaacaaggccgactccctcattggtgtgtttccccgttccacgcagccgtgcattgcgagtggcattttgacatacgatctcgaaaactttagccaaatgctcgaagagcaataaacacttttcctctcatctctctgagtttttgcttattttctcacacttaaattaccttgcattttgattttgatgtaaatttctatgggatatttaggcataactgttcaaatattttgagactgaattaatccagcaaaaatgcgcccaaatatcccagttatagttggctatttaatcttttcgacttacttatgctattttctgacgtttacctgatgataaacttaacctttgattacttatccacattcttttcaatgttttaattcattttggcttactttcttttaattcttacttttttcataatccgtcttaggcagcagatttggagatgagtcaagaagtgagttcggaaggcggcttccctaattacaaccgcaaccaatattttaaaagcattagtaggttttgttttgggtttaggtaattgaccttaaatattttcagtcgacagtttgtcacagaagggacttctcgaagcgaatcgtcaaccgcccatcagtcactcgacactcagttttttgatggaaaggaaaaaggacccaatgtcgtaa

SEQ ID NO: 57840 - DNA, 1231 bp, Heterodera glycines
  Genomic contig location: Contig_ID=SeqID_27134; Location=61..1291; Strand=-
  SCN-specific regions: Sequence locations=1-48,107-460,482-838,860 -941,963-1092,1116-1116,1143-1231
atgtcagacaatcggaaagaagcggaggcaaagatggaaaaagcaatgtaaaattaaaattaaaaatgctaattttcaattttcaattttgaattttattttttttcagtttcatctccgccgattgttggctttgtgcgttcgatttgctctctccacgtaaacttggacttggaattgcattgatcagccacggatttgacttttatgtggacgaacatttcaaaactcgtaaatggacattcggaattattcgaattggaagcaaaatcgggaagaatggcaccaaggaaatggatgttgtcaattgttatcaacgaccaatgccaattccgcaaaatccgttgccaaagaaagtcgtcggattcaaggccatttcattagagtaaaatgaatcaattattgtcaagtggtaatgagtcttcatttttttcagttacatcgaccgcaatgtcatcgcttttctccaccgttttcgccaacttttcgccgtctgtccaattaatttgtccatccaaacggcccgtgatgattatcgcatttcggagttcattttgcgcaatatttggccaatgcttggaaaaaacattcatgccattgaaatgtccgttagaattttcaatcatttgcgtcaattcgtcccgtcaattctcaacgaatgtccaccacttcgcgttgtctccttttctgtcgatctcttcatcgcatttccgaccgatgacaatgccgcggcatcggatggacaagcggtggccaaatggcttttcactccgcttcaaagcaacgtgccaaaggtgttgagaagtccgttggacatgaatgatgggtttttggtgtcggacattgaagacttcaaagcggtgatttcgaattgatttatttggcattttcaatttcccccctcatttttaggcatttgcctcggcttcatcacccgtcaatttcattgttgtcattcaatttccgccgtcttttgctaattccgttgtgccatttgtgatgaccaatgaattaactcgtgaacatttggcattgaaaagaacgaaatggaacacatcgtttttgttgatccgttgtccaattgtgcgagatgaaagcataattttcaattttcaattttgttttcccttttctccagtttcatctccgccgactgttggctttgtgtcttcgaattgcttcccccgcgtcagcttggctttggcattgcgatgatcagccaccgttttga

SEQ ID NO: 57841 - DNA, 1050 bp, Heterodera glycines; identical to SEQ ID NO: 27136
  Genomic contig location: Contig_ID=SeqID_27136; Location=1..1050; Strand=+
  SCN-specific regions: Sequence locations=1-87,109-988,1011-1050

SEQ ID NO: 57842 - DNA, 62 bp, Heterodera glycines
  Genomic contig location: Contig_ID=SeqID_27137; Location=1035..1096; Strand=-
  SCN-specific regions: Sequence locations=1-62
atggcggcgactgctcaaagaatggcacataaaagttcgctttgcggaaagtcgggacgaag

SEQ ID NO: 57843 - DNA, 117 bp, Heterodera glycines; identical to SEQ ID NO: 53938
  Genomic contig location: Contig_ID=SeqID_27137; Location=30..146; Strand=+
  SCN-specific regions: Sequence locations=1-117

SEQ ID NO: 57844 - DNA, 249 bp, Heterodera glycines
  Genomic contig location: Contig_ID=SeqID_27138; Location=411..659; Strand=+
  SCN-specific regions: Sequence locations=1-249
atgtccctccgcaaatgtccgtccgcaaatgtccgtccgcaaatgtccgtccgcaaatgtccctccgcaaatgtccgtccgcaaatgtccgtccgcaaatgtccgtccgcaaaagtccgtccgcaaatgtccgtccgcaaatgtccgtccgcaaatgtccgtccgcaaatgtccgtccgcaaaagtccgtccgcaaatgtccgtccgcaaatgtccgtccgcaaatgtccgtccgcaaatgtctggtag

SEQ ID NO: 57845 - DNA, 476 bp, Heterodera glycines
  Genomic contig location: Contig_ID=SeqID_5384; Location=2330..2805; Strand=-
  SCN-specific regions: Sequence locations=1-384,407-476
atggtgccatttgaattggtgaacgaatggacgaaggaaaagctgacattggccaaggcaaacgaaaatgaatgggacgacatttggataatgaaacgatgcaaaattattggggagacagcggcggtcaattggaaagacggaaattggggcaacaattgtaacaatgtgttcatttggcttgatagtgacactaattgcattgggtgagcaaataaaaaaggcatttaattttgtttaaataattcaaattgcgcttaattaaggccattgtctccgccaccggcagaagaaacgggacaaagcatcacaaaagtggcgtcttctgctgacgatgaatgagtgacggacaaaagaacgaaacaatggtgattagtggaagaagaaatgaattatttaagaatggccaaccgatcataattcatcagtgatcaaatgcaatttatgatgaaaacctctcaatttcggtaaataaa

SEQ ID NO: 57846 - DNA, 100 bp, Heterodera glycines
  Genomic contig location: Contig_ID=SeqID_5384; Location=957..1056; Strand=+
  SCN-specific regions: Sequence locations=1-100
ttcttaactttttaattttttatttcttacggctagtatcttctacaataatttgtcagtttggtcggatgtgcgtcaaacggaaaaaataattaaaatt

SEQ ID NO: 57847 - DNA, 803 bp, Heterodera glycines
  Genomic contig location: Contig_ID=SeqID_5385; Location=5..807; Strand=-
  SCN-specific regions: Sequence locations=1-227,250-600,624-803
atgaaccgacggtaaaatattttaaaagtcaaacaaattagtcatttatttgactaaactgtttttccataatttcagttggatttgcaacgacgtttggatggacattttcccatcctttgaccatgctcaactcggcctcaaattggcacttctttcgccacgtttcaatgcgttggtggacaaacatttcgatggcaaaagcgaattgacaatttggagaacgatccaaattagcaaggacaaaggaccagaaccgaaactatctgtgctgatggattataaatttgtgccatttccaatgcccaacgaccgtccgttgcccagcaaaatccgttttaagagccttgagatttagtaattaaaaatcagagagctatgacaataaaagcattcattccctttttgcagttacattgatcacttcgtcatcgcttttcttcgttccaatcaccaaatttttgacaaaagaggcatcgatttacatttgtggattccttattcaaacgccacgaatggccaaccaatttgggacatttttgttcgtgaaatttggcccatttttgcgccaaacattggtcatttgaccatttcaaatgctgagcatttggacaatttgcttcgtcgcacttcgccgacaattctcatcgatctcaaccaattgaattcaatcaaatcatttgatctgttgcccgctgcgattggtgatggttttgatgggccaaattcaacaacttcggctggccaagcgttgtccaaatggttgcactctccgagaaaagatggccaacccaagcgattgc

SEQ ID NO: 57848 - DNA, 239 bp, Heterodera glycines
  Genomic contig location: Contig_ID=SeqID_27143; Location=440..678; Strand=+
  SCN-specific regions: Sequence locations=1-120,142-239
atgagttctgctggcgttacggaaactctcatttccccctcgtcttacatagaaaaacagtaagggtcgtccattctccgtttttcatttgttttcttttttgcatttttagcacattgtctgggttgctgactgaggatgtgcttcattttgccattggaaagaatataacgattaatgtggaagaaaaggcggtgccgcgggtgcgggacagtgcccgcgcgaaatggaaaaagtag

SEQ ID NO: 57849 - DNA, 1518 bp, Heterodera glycines
  Genomic contig location: Contig_ID=SeqID_27147; Location=330..1847; Strand=+
  SCN-specific regions: Sequence locations=1-138,160-213,239-254,276 -514,536-657,681-694,716-861,888-966,988-1094,1129-1187,1220-1518
atgtgcgtcatttttgaacagacggatcgaacgcgcgaaatcgtagtgaatttgcaggcattttctgccgtcggatatagcgaagctacgcaaaaaaatatgcaaaacggaaaatattacaaaatttttgtgcccgattttattttattggatgttgttgagtgcaagtttggcatttttataaagccaaaagagcaaaacgaaaatggtaatgagaaaaaggggaaaaagaaggcaattattgttgaaaaccaaatggataaagatgaacaaaaaatgtggacaatgcaccgatcagtaaagcttaatctgagcgatatacacactttgatgaagaagccaattgtggtcaatttgggcaaaattggtggccccgagctttttttgaagcgacgaatttttgtggagacgaataacgatttgggcaattaccatgcatttttgtacgcaattatagagggaaatgaacagaacgccaacgaaatgaacgaaaaaaaaagaatttttattggtcatgccccatttgtgaaatttgatgaggaagcatcaagctcaagtcaagcaaatcacaagaaaaaatctttgctcaaaaatttcttatccggcaaatcaaagcagatggaaaaggcattgcccgagggacaacaggtgaaacagtaattaaattaaattattaaatagttttttgttaagttaattgaatatcatttatcaattccaattgaagagaaacgcatgtttggacataaaatttgtgatttaattttggctatttttcatgatcaaaaggtatgaaagttcggagtgatgtacgagagtggaaaaatctgtgaaatttcaatccgatagcataattatttcaatcttttcggaaatcccttttttggattcccgggtttatttatcagtttcgcatctgacttaaaatgggttatttcttgcttatctaattgaaattcagggggataaaattgaagaagttttaaatgttacgaattttgaagaaacagaaaagtgggaatgttcaatttgcaaagatcaattgaataatgaaaaatcgttaataaaaatacacgggcaaaacattcaggtgcaaaaattataatttctttaatttataaaatttttctagcatttatttcacaaaccatgcatctttaattggtaatttggaaataattagtaagattttttaatttaaaaaaaatatatttttataggtttgaagcacaaccaaaaatacgctgcccaatttgcaattggcaaccaacatttgtcatggtcggtatttgatgaatgaatctgcatgctttttaatcagaaatttaggatgctagattgaatgcaatttttgatggacctattggattttcttcgatttttgccataaattcgctgggcattttatttaaaattgccaacggtcaactggaaattgggcaatttaagcaaaatcaggcacaaaactttattagcaaaagcaacggaaatttaaaaacatttgagcatgagctgaga

SEQ ID NO: 57850 - DNA, 56 bp, Heterodera glycines; identical to SEQ ID NO: 52733
  Genomic contig location: Contig_ID=SeqID_27150; Location=243..298; Strand=+
  SCN-specific regions: Sequence locations=1-56

SEQ ID NO: 57851 - DNA, 123 bp, Heterodera glycines
  Genomic contig location: Contig_ID=SeqID_27150; Location=874..996; Strand=+
  SCN-specific regions: Sequence locations=1-123
tccaacgcagaataaagtacaggctatagggaagctattcccgaaggattcggtctccccataaatctgggcgcatcggttcgggggggactgccccgaaaacaaaaaaatcgatttttttca

SEQ ID NO: 57852 - DNA, 211 bp, Heterodera glycines
  Genomic contig location: Contig_ID=SeqID_5386; Location=485..695; Strand=-
  SCN-specific regions: Sequence locations=1-106,132-211
atgcccgacatggttcgaattatgggtttgcttgcgccattgtcaattccttcaactccaattccggacaatttggtccgcgttataagtgtcagatttgagtaagtgctaaaatattttaaaatttctccactttcttatataatttaggtgccttaataacaacgtgctcactgtgatgcaccactttcaccgtctatttttcacttga

SEQ ID NO: 57853 - DNA, 2358 bp, Heterodera glycines
  Genomic contig location: Contig_ID=SeqID_5387; Location=1188..3545; Strand=-
  SCN-specific regions: Sequence locations=1-224,246-335,357-441,463 -590,613-927,949-1049,1072-1267,1290-1496,1519-1569,1593-1595,1617 -2203,2227-2358
  Gene Ontology: Mol. function=copper, zinc superoxide dismutase activity; Cellular component=cytoplasm; Biological process =neurogenesis
atggatgattcggttggttttcctagcataataaatcttgcttttgggtggccgtccaccccttatgacagtaaaattagtctgttccgttcgtttacagttatcctctcgacggctcccttccgacttctccttctaaaaatttcatccaatcttctgtataatttttttctatttccgtatgattaacagctgtaaattcccaaaaattcatcctccaagtttgtgggaggggaattcaaaaattgatatggattttgaaactgaaacacagggtagaacattttggccgacgaccaaatgggaaggaaactcccagccgaacttttgttcgaaattgttctctgtgttcgaagagaacatgcccacgcgagcatttgcctctcgtcccttgttttatgcaatttaatgctacctcgtgcttcattatggcggaaaatttgggtttcagtatgattttggatgtttccgcttttttttttaaattttcgttgttgctgtttggacttgtctttttatttttgcactaacaattctgttattttatttttggtatttatttaaacgtttttgtctgaatgtggtgattaactcttcttccttccttttctcatttccattagtttttattggtttttttgtgcgtttccttttgtgttcggtgttcgctgtttgagcctttttgagacggtttatttgaaattcaatttaatttaggcatttttcaagctcaaagagaactatcaagacgcgatagcagctggacaagattggaacattgtgagacagacggcgcgtgatgatatcgcatgcaacaacgttatggtggctctggacagactgatggatgtgccgcaagtacgtacagtttgagggaattactcgcatcaacatgaatttctaagaaagcgacactgaaaaggagacttaattgttttcatatttaacacttttccttaacaggcacccgacaagaaggcaatttgcgtgctcgcaaactaccgggcagactcaaaagagggtgtgggaaccgtcgtgtttcagcaggcaatttgcttttattaaaataatccaaaataaattctaaaatttagaaagatggagagtatgtgcatgttacggttgtaatcagcggcctcgggccggaccagcagcatgcgctgacgatcaatcgttaatttgttcttagattttctgacaaatggtgtttttttcagagttcggcgacctttctgtgtcttcgggcaatttccattcagttggaaagcatttcagtcatcctggccaaaaacatgggccaccggaggttttttgtcaaattatttaattcgtgaacagcgacaattctcaaacttcactttgatgtgtttaataagtaacctgttttgaaatatttacaggccgtcagtcgtcacgttggagatcttggaaatatcaccgctgatccgaagggagtcgccaaaagtaattggtctgacaaagtgatctcactgtatgggcagaataacatcattgggcgctcagtcgctgtacatgcacgaaaggatgactttggtaacaattccagtgaattcatttattttttgcttttacaattttaggggaggggacacaggacgtgataaggagccgcgagagcggaaatgccggtcccattttgtcgtgtggtgtcattggccttgcttttgatacgaacatgtcaactcgttcggaggattttcagcgcgtaagttttattgggaccgccgtattagagcagggtgcggatcgaaaattaatcaattaatatgtatcaaatttcatattttttgcctcctatgatcatttttaacaattttggtgaggaaataagcaaatcatttatttgaattcaatcagctcaaaaaatcagatttttcagactttttgggaataagtggggcgtaaggcgggcggtaccgataggcgccgccgggaaactttttgttgaaaatttgagttaaattagttaacagattttgtccaaaaattgtcgaaatttttacgtcataaatttacaaatttttgatgcattttgttttaaggagttccttcaactgacccaggcatacagagctgcggagacgactaaaaggtggaatatggtggtgggctgtgcgagtggtgacgacaaatgtggagctctgatcaaatcgcttcaacagctcatggaactccccgtggtaagttttgacaagaaaaggaaattaaattgatttacattctctgtttaagcatccgcaacagtgtgattcgggtcccaggaaggctgtgtgttggttggcatgcccgaaaatgaaggacacgaagggggccattacattcaaacaggtctgttga

SEQ ID NO: 57854 - DNA, 210 bp, Heterodera glycines
  Genomic contig location: Contig_ID=SeqID_27152; Location=297..506; Strand=-
  SCN-specific regions: Sequence locations=1-166,188-210
atgaaaaagattaagttgaacccgattttggacattggcgcgaatgaattggtaaccgtcacaaaacactcattgtcaaaggcaatgaaaagggtggccagtcacttggatggacgttgccatgctggccaacggtcccatgaacggatcggtgctggaaaagatgagaagtgttgtcagacagagcagaaaagtgcacaaaaacgctaa

SEQ ID NO: 57855 - DNA, 1034 bp, Heterodera glycines
  Genomic contig location: Contig_ID=SeqID_27152; Location=182..1215; Strand=+
  SCN-specific regions: Sequence locations=1-138,160-972,995-1034
  Gene Ontology: Mol. function=adenylate cyclase activity; Cellular component=plasma membrane; Biological process=G-protein signaling, coupled to cAMP nucleotide second messenger
gctttctctccctgctctgttctctgatgctttggttcaccgcttctgtccattaccaacgcttttaccttgttttgggttgaatttcgctttatatttaactcttggttactttttagcgtttttgtgcacttttctgctctgtctgacaacacttctcatcttttccagcaccgatccgttcatgggaccgttggccagcatggcaacgtccatccaagtgactggccacccttttcattgcctttgacaatgagtgttttgtgacggttaccaattcattcgcgccaatgtccaaaatcgggttcaacttaatctttttcattccctaatagcctaaacatttattatttaagtgatagaaagtgattgtgtctgataatttgatagttaataaattgttgaaaattcagaaactattcaaaacgcagaattaatgctcctatagaagattgtgttttctaaattttaatccttttaggctatagggcttcaaaaaaaaactgttttaatctgattttggcatagacgcaaatgtcttgacacggtgtgtgacagccttattgcaatttgcaaaattaaatatttcccgggcacaaataatctcgatttgatttgactgttcatgtcgttcaggttgtccttctcgtttacaccgtcattcccctgcctctgtacctttgcattctcatttgtgcaatttgtgagttgttttttggttttggatgggttttttccatattttcggttcattcccccacttttcccccacagattcgctgctcttagaattgctcagttccccccaaagtccgtcttcctctttcaccgcccttctccgtcccggcacaaaagcgacgctccatttctgtgtccatttgctcggcattcatttgtacattctgacccaagtgcggcagcggaaaacctttctgaaggtcggccagtcgttgttggccaggaaggacttggagctgcagacgcagttcaaggaccacatgatccagtctgtgatgccaaagaaagtgcgtttt

SEQ ID NO: 57856 - DNA, 619 bp, Heterodera glycines
  Genomic contig location: Contig_ID=SeqID_27154; Location=171..789; Strand=+
  SCN-specific regions: Sequence locations=1-79,101-188,210-330,354 -479,501-619
gctcgcattgccgtcagtcgcaactgcctccatcacaaccgttgccgttatatgttccgccagtgattacgggggtcagtttattaaaattttagaattgtttaaaaaaaatgtttttccaagtcaattagaattaattcaaaaaaatttcccaggtcaatcgtcaggagcaaatggaagtccccgcaatctctgtggcagtggtcaccgaagtgccaaaagttgagcaacagggtggagaggatgagcaggaattggacttgcgttaggacatgtaaccagagaaaattttagataaggggaagcaactgggtggaaaattgtggaaaatatttttgaattattaaaaaagaattttctctacaatgccaatcatggacaaaggttttaagttgattacaggaaaaaaagataaaaattggaaattgttgaaaaaaaaaagtttttaaatttacgacgatagtaaaacagatttacgatgtatctttctctggttacatgtctaatggaaattattaatccgttaaaaatgctattttttcattggttatttaaagcatttaaatattcaacgcctttacttatttttaacattaaattgatatgctatcattaaaca

SEQ ID NO: 57857 - DNA, 294 bp, Heterodera glycines
  misc_feature (273)..(273): n is a, c, g, or t
  Genomic contig location: Contig_ID=SeqID_27156; Location=32..325; Strand=-
  SCN-specific regions: Sequence locations=1-21,43-50,83-294
atgcgcccaaagtcagcgcccaaaatgaaaatgggtaattaatgcaataataattaaattaattaatcaattaattaattaaaataattgttttcctatcattttttagagaacattctccgaaaaaggttcatgtcgagctgccagcagttgacgaatatggcgatgacccatttgagggcgtcagcgaatggcccctgcaggaggaggggcagtaaattcggaaaaattcaaatttattatcattattggcattttgtacaaaaaatttanatttcgcgaaaaatgattaaa

SEQ ID NO: 57858 - DNA, 742 bp, Heterodera glycines
  Genomic contig location: Contig_ID=SeqID_27157; Location=28..769; Strand=-
  SCN-specific regions: Sequence locations=1-180,203-298,320-742
atgcttgtgccattaatcagtaatgagcttttgagtcgccaatttcggatgggtattattgttaaatgctttttgactgagatgacaattaactgccgccgcttttcggctgttgtccctcggctgatggccataaatcagtcgtcgtctcggagggtttggggactttttggaccaaagaagggcgatgggaaggcaatggcaatgggagagatttatccatccccgaggggcacggggaaggaaaatgttattctaaggccaaagcacccgaagaagcgatcaatcaaaagtgagaggggcgaaggggtgggagaagtcaattggcggggtagcaaagtttgggtgggggaaaaggaaaggtaatggggaaacggggagaggggggggggagaaaggatcggttctagattaagattttatcgaaggcatttgcgcctaatgttagaaaatacctaattacgcaatttcatatttttatgattttagacttttttgctcgtgaattccctttgctgtacgactcctactatttaccaacagtatgttcagataaaagtcgaacaaaaattgacaaataaatgtgattgatgatgatgatctccatagatagtttgagaaaatttacaaagaaaattgtaccaaaaatgtaatttcctcaatgatttttaattggtgattgcatgtttgaaaagagaatcgcagatcatctcttcatttttggctattaacctgaaataaa

SEQ ID NO: 57859 - DNA, 1029 bp, Heterodera glycines
  Genomic contig location: Contig_ID=SeqID_27158; Location=133..1161; Strand=+
  SCN-specific regions: Sequence locations=1-75,97-277,348-348,370 -403,425-474,521-558,590-745,767-946,968-1029
atgtggcacgtgacaagcgctgttgaagaacgaacttatcagcagcagccgttgttattgtttcatgaaattagtgcaataaaaataaatgattacgaaaatgcggataatgagaaaaggcaacgaccgagggtaattagtagcaattaacggatttatatttaagcataaaaaagaagaagaaagaaagcaagactttagcagaaatgaataagaaaaattaaaattatttgcaacaaaaactaaattctaaaaaatttgatatttatatcgcaagtttaaaataattttaaacaaaatgatattgaaaaaggataattagttaaaatatttcattaaaaaataaacaacccaaattagcaaaaattaatttggtagttgaattgatgcaagattatctgtgtataaaaaaataaattaaatacaatccgggacaataaacgcaaacttaaaaaaaagtttaaattttccacctatttattattataaaatataattgaaattaaatgataatttaaatcgacaaatttggaaagttacacaaaaatattttggttgataaattacaataaaataataataattttttcataaatgatccgtcgcccaatgaactttcacactcaaatgcacacactgaattaatttgctcgccatttctgtcaattgatcattttcacctcgcgcacattctgtccccttttggtcgtcacacgcgccacggtcattcactccgtcgtcacattaaaaaataattacagaaaaagtcattaaacaaatgccgttcgccacaatgcgttaaggcggttggaggggttggttggctgatgcaccaaacaatcgcgcacattcgttccttcgataattgggcgcggatgattagcgctaattaatcgtaattgcatagattgatgcaaagaatgtagataaacacaggcatttattcaattaataatgtgatcatgttatgcgttgaacgaagaaagagtgaatggaaaggagattgtttgcatgcatattgtggtggaa

SEQ ID NO: 57860 - DNA, 601 bp, Heterodera glycines
  Genomic contig location: Contig_ID=SeqID_27159; Location=294..894; Strand=+
  SCN-specific regions: Sequence locations=1-166,188-244,276-411,468-601
tccacattctgagccgtacggtgcaaagcatttgtacaacgggcactgttggcggcacatttgactatgaccagacatggatttgcgcgttgtaagtttttctcatatttgccaaaaatttcgaaaataaattttcaaaagaaattctgctcaagtggttggcacgaaaaaatttttgagttttattctgctagttcgtttttaaaattccttaagtgccccacgccaagagagtaagaaattgattataattaaaacaatttaattaattaattctatgacatcgaaaataaatattcttgaagtcaatcactcgacagttttagttcttaattaccctgtaaaatctcaaaagaatttgacaaattccaaaaaaaattgtgctaaataaaattcaacaaaatatttgacaaattttaatttttaaaattcgatttaaatttattttatttcttttttttaatattcaatttgcagatgcatgctgaacacggtgcagcatcgacatgtggccattgcgcgactgtcccatccgacaaatttgggccgtaccatgcaagacttgcgcttcatcattattgtgattgcaccgtccagagcg

SEQ ID NO: 57861 - DNA, 658 bp, Heterodera glycines
  Genomic contig location: Contig_ID=SeqID_27161; Location=80..737; Strand=+
  SCN-specific regions: Sequence locations=1-310,332-609,631-658
atgttgggcctcaaaattcaacggcattcccttggcaattggctgaccaaagtgtgccgtcctttggcaaagtgccgttcctcgacccaccccttttactgcggccttttcctcggcttactcttcgacttggccatcgtttggcttttcctcccctctttgtctcatgcgccgaccaaagaaaggcaatcgtcgatcagtgaaatggcaaaaactgtaaaattgccaaaacaactgatgggctacgaggcgtatttcaacaaaaacttcacttaccctttcgattgtgagttgcttttgttctaagcggattaattgtccgggaagtttgcccgatttgccattttttgcttaaaagaggaaatgaaaaataatttaattgtgttcagcccgagggaccgttgcgcaggaaattgcgaggaaagtgcgcgtgttctgttggattttcacctacgaaaatttccacgagagtcgcgcgcggcacgtgaaagcgacgtgggcacagcactgcaccaaattcatgttcttctcctccaaggaggacagcacacttccggcgattgacctgcaaattccgctcggaaggcaattcatttggcggaggacgaagaaaattgccaaatatatttacaaggaatatttggtgatgggaaaatga

SEQ ID NO: 57862 - DNA, 2382 bp, Heterodera glycines
  Genomic contig location: Contig_ID=SeqID_5389; Location=40..2421; Strand=+
  SCN-specific regions: Sequence locations=1-5,27-112,134-171,193 -229,251-288,310-310,332-627,649-727,749-1356,1378-1538,1561 -2078,2100-2184,2206-2243,2265-2359,2381-2382
  Gene Ontology: Mol. function=protein kinase activity; Cellular component=nucleus; Biological process=embryonic morphogenesis
atgtgtcaagtttgccgtggttttccgaagatgtctctgaacgttctgggagttcttctgatgtgagtgccacccagtgatacaccgctccttaatgtatttacttgctctgtttgtatatttctgtgtatttgtgataacactgctccttaatgtatttacttgcctctgtttgtatatttctgtgtatttgtgataacaccgctccttaatgtatttacttgctctgtttgtatatttctgtgtatttgtgataacaccgctcctcaatgtatttacttgcctctgtttgtatatttctgtgtatttgaataaatttcatttaatttgttttgactaatacgtccatgcgtgatgaaatttggccaaatttattgacatttccttccccattcaaacaccgaaaagtccttgccaaatgatttgcaactagaggcgaatgaccttttgaaggcgggggccttaaatatcaataaggctatacgccttatgacaagcgagatttctgccagcactgatgcttggaagtcatcgcacgtgcgaaagaggccattgatttgccggaagacatcactttgtggtaaattttggaagtgcggcaaaagtggggccgacttttaatgattcattttggtttccaaaatccattggtatttccaattactatcagttttcatttttggcacttttggaagtacggcaaaagtggggccgacttttaatgattcattttgggttccaaaatccattggtatttccaattactatacatatttagtaacctttcggacatcagacaagattttgacctcacgaccaaactggcaaacccagtgtttgaccagacgatggtggaaaagcccaaggacgcagccaaccaggttttggaaggccccaaggactcagccaatccggtttttgatggccccaaggactcagccaatccggttttggaagggcccaagaactcaaccaatccggctttggatggccccaagaactcaaccaatccggctttggatggccccaaggatttggatggacccatggacgcagaacattcggaatttttggtaagactaatttttgaattttttttgaacttttgaattaaggaaaaattgaaaattatcatcgaccggaagacgtcgcaccaagttgatatggagaaagttcatatcttcaacgaaataatggacaaaaaaaaaaatttcgcgccgtgctgtatgcagcacattcaggaaaaaatttgtgccgcgtgaactctccatttggcgccagttggaccatccgaacaccgtccgcatgcacagggatttccgagagtctggctatctgttcgaggtgctcgactacgcacagaaaggcaacctggtgagttcgatcaacgcggtggtaatcactacactggactgtttgaaaatttcagcatacctacctggaacgacacggcccacttgacgagacgatctgccgggcgtggatgcggcaactgaccaacggagtgtcctatttgcacgaaaatcgaatcgcgcatcgggacttgaagccggagaacattttgctcttcgaacgtagcgttctcaaaatcaccgactacggcttcgcgaaacaggtaatgaatgccacgcttcaacacaaacgttcaatttcctttttcagtgcgatgatggcgacatgtcttcaaccttttgcggaactaagctttacaaggccccggaactgctgcagaaacatgaatatgacccgttcaaagcggacgtttggtctgtttttttttcgtttccattcgctgcttttttcatcttcccttttcatttcaggtcacttggcgtcatttgctttgttatgcggaccaacacaatgccgttcagcagaggcgtgagccgaacacacatggtggaggaacagcgaaacagtcaatatcgattcccttctcacttggtcatcagtttgcagtgtcgcggcgccattgacacgattttgacgtttgatccggagcagcgtccggtgagcactttttttgtgttttttgaattttcaatttcaattccttttttcagagtgtcttcgatgtgtcaagtttgccgtggttttccgaagatgtctctgaacgttctgggagttcttctgatgtgagtgccaccagtgatacaccgctccttaatgtatttacttgctctgtttgtatatttctgtgtatttgtgataacactgctccttaatgtatttacttgcctctgtttgtatatttctgtgtatttgtgataacactgctccttaatgtatttacttgctctgtttgtatattgctgtgtatttgtgatacacctctccttaatgtatttacttgcctctgtttgtatatttctgtgtatttga

SEQ ID NO: 57863 - DNA, 676 bp, Heterodera glycines
  Genomic contig location: Contig_ID=SeqID_5389; Location=4137..4812; Strand=+
  SCN-specific regions: Sequence locations=1-80,103-676
atgccgaacgacctgccgggcgtggatgcagcaactgaccaacggagtgtcctatttgcacgaaaatcgaatcgcgcatcgggacttgaagccggagaacattttgctcttcgaacatggcgttctcaaaatcaccgactacggcttcgcgaaacaggtaatgaatgccacgcttcaacacaaacgttcaattttcttttttcagtgcgatgatggcgacatgtcttcaaccttttgcggaactaagctttacaaggccccggaactgctgcagaaacatgaatatgacccgttcaaagcggacgtttggtctgttttttttcgtttccattcgctgcttttttcatcttcccttttcatttcaggtcacttggcgtcatttgctttgttatgcggaccaacacaatgccgttcagcagaggcgtgagccgaacacacatggtggaggaacagcgaaacagtcaatatcgattcccttctcacttggtcatcagtttgcagtgtcgcggcgccattgacacgattttgacgtttgatccggagcagcgtccggtgagcactttttttgtgttttttgaattttcaatttcaattccttttttcagagggtcttcgatgtgtcaagtttgccgtgttttccgaagatgtctctgaacgttctgggaagtcttctgat

SEQ ID NO: 57864 - DNA, 2071 bp, Heterodera glycines
  misc_feature (22)..(22): n is a, c, g, or t
  Genomic contig location: Contig_ID=SeqID_27165; Location=164..2234; Strand=+
  SCN-specific regions: Sequence locations=1-66,105-2071
atgagccttgctacatccagcnccattgacgacggctcagttcgacaacgtgcatcgattgctgttgacaacgacgattctgacgacgacgacgacgatgaagaattgccgcttcgtctgtgcttctttgacgctgagacgtcacaggatacgccattacagctgaacaaccgcaccgtccagaagcacgtgccgctgctcatcgtcgccgaagtcatctgcgaacgttgtctgcaggctggtatcagcgtgagcgatggccttggaagacgggctcctggctgcgtctgcatgacaggaatggtgagaggtcaactgtttcgccagtggtcttcgccaccatttgccaatgcaccgggagacaacagcgcttcgccagttggagcaccagcgttcaaccagcgccgcttcttcttccattcgtttgacaacgacggcaacgacccagtggaccaatttttggattttttgctgcagcatggcccaaagaaggcacacacggtgtgcatcgcccacaacggtggaaagtacgatttccatctcgtacttgaggcactacaccgccgaaaccgtccacccaagcatctgtgcaccaccggattgaagatctactcgatgcgtctgtccgggcgtaaccaacgacgaatcacgttcaaggattccatcaactactttttttgtgccttggacgcgttggtgaagagcttccaagtgccggaccatctggcgacggtgaagcccttctttccgtatctctacatacgacgacaacatctgtcgcagcgcctcaacggtctaccggctcaagagttctacgcaccggacacgatgaaggcagagaaacgggcgcaatttctccgttggcacgccgacaacaacggcaatggattccagctacgcgagcagctcataatgtactgcgtcaacgacgtggccattttgagggagtcggtcatccgattccgccaactcatcgccgacaatactcaaggcctcgacccattcctccacgcgtcaacagctgctggtcttgcgctggcaacttttcgccgctgtttcctgcccgccaatcgtctggttcactcacccgagggcggctacttgcgcggacgccgtgcttcggcagaatcgcagcgctacatccgcttcttcgagctggagcacccggaggcgcaagtgcagtgcgccagctggtccgttggtgaagcgcacatcgaagacagtggctaccgcgtggacggactttggcgacgagaagcgcctctccgtcccctggccattgaatggcttggatgctattatcacggtaattaatttttttttcgtttccaaaatatcttaaaattgaggctgtcgtgtgtgctttcccgaccggcagcaacaattggcggcggggcgaacagcggaagatttgtacgaacggacggagcggcgcctctttgagctggagcacgaccacggctgcgatttgcacgtggtgtgggcctgtcagtgggcggagcggctccgccacgatccggacctgaagcgccgttacgatgctgtgttcgtcccttgcccgctggacccgcgcaacgacgcgttgaggggagggcgcactgaaccgttcaagctgcaccacgtgtgcagtgacgacgaggagataatgtgcatcgacattgtcagcctctacccatacgtcatggtaggtttttcttttaaacattcgcatattcatgatgaataccagaaagccaatcgcttccccgtgggcaacccacgggtcctgacgcgcgaggtgctgctgcgtccgccaacggtaccgctcccgtggaatgcaccggaaaacaacatcttccgggggctgctgctcgcccgggtgctcgctccacgcaacatccgggtgccgttgctcggctaccgcacaaaggacgggcgattcaccttccctttgtgcgcgtggtgtgccgaccgtcggcagcagcggccgtgccgacatgacgacgacaagcgctcgtgggtgaccgcctacacgcacgtcgagctcaacaaagcgctccagcttggctatgtggtcaccgaccctatttga

SEQ ID NO: 57865 - DNA, 694 bp, Heterodera glycines
  Genomic contig location: Contig_ID=SeqID_27167; Location=46..739; Strand=+
  SCN-specific regions: Sequence locations=1-355,544-694
  Gene Ontology: Mol. function=extracellular matrix structural constituent; Cellular component=membrane; Biological process =extracellular matrix organization and biogenesis
gtgaagcaggctttcccggaattcctggcgcaaaaggtgaagctggcttcccgggtctgcatggcgccaagggcgaattgggattcgatggattgcctggccaacccggattgcaaggtgggtggccaatttacagacgtttcgataaaaaatttgaaaaaaaattcaggcccacctggactgccaggttttcctggcgaaaagggtgaggctggcacacccggctacggcgtgcccggcttgccgggcgagaaaggcattcccggaattccgggaaaatcgggcagatcaggaccacctggcgagcgtggcatggacggaccacacggattcactggcataaaaggagaaccagtaaaaataaaaaaataattatttaaatttcattaaaaattatataaagcaaaacttgtttctattaatttttctaattttaaagctttaaaaattttataataattaaaatttcgtataattggttaattctcataaaattatgtgtataaagaaaatttttattaattttaatatttaaaattaattctccagggttttcccggccaagacggactgcccggacaggatgggctgcccggactgccgggcccgaagggcgatgctggtctgcctggctttcccggcatacctggccaagaaggacagcccggtctcgtccgccctcctggacttcccg

SEQ ID NO: 57866 - DNA, 753 bp, Heterodera glycines
  Genomic contig location: Contig_ID=SeqID_27168; Location=3..755; Strand=+
  SCN-specific regions: Sequence locations=1-548,570-664,690-692,714-753
atgtatgaagattgcaacaccgtttttgcacggtcccttgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccaagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcttaatatacgacaactcacatgtcgtgccgtataatccaggtccaggaaaaatccaggttgccgaaaaatggcctggacctggacctggatccaggaaaaatccaggcctggatccaggtccaggccgagctctaatcacatcattttcggtcacataa

SEQ ID NO: 57867 - DNA, 60 bp, Heterodera glycines; identical to SEQ ID NO: 52045
  Genomic contig location: Contig_ID=SeqID_27170; Location=280..339; Strand=+
  SCN-specific regions: Sequence locations=1-60

SEQ ID NO: 57868 - DNA, 786 bp, Heterodera glycines
  Genomic contig location: Contig_ID=SeqID_5390; Location=465..1250; Strand=+
  SCN-specific regions: Sequence locations=1-187,209-216,238-452,613 -691,713-725,748-786
atgaacagaaaaataatgtacaccgaccggatccgaacttgccccccgccccctcaaaatgatgcctcagaatccccaatcacacagggattctgaggtcttaacgatgtcaaaagtaaaatctgattgcgtattcgtgatcagcggcccaaataacccataaagacatatttttggatgatttttgatttttaattaataaaaatatgtaaaaacagcaaaaaatacaaagaaaataatttacacagtccggactcgaacttcgcccccccccccaaaaaagatgcctcagaatccccaatcacacagggattctgaggtcttaacgatgtcagaagtgaaatctgattacgcattcgtgatcagcggcccaaataacccataaagacatcttttttgaaggtttttgtgagaaaaatttttccactcaaaaatcctggtcacccaacatgatttaaaatttaataaataaggaaattttttttattaaatattaaaaataaaatgcattttaattttaaattattaataaaaaacaacgttgaaaattaataatatttattttatttaaaatgaaattaatttttttacaaattcagaaaaatattaattgaagcaaaatattcgatattttataaactttaattttgaccagaagcagtttcaagcaaatatgaaaagatgtttatcttattatttgttacatgaatttataaaatgaatggtatttttaatattaaaaaaaatgagtacagcagttgattcataaaaaaagtattaattaaa

SEQ ID NO: 57869 - DNA, 148 bp, Heterodera glycines
  Genomic contig location: Contig_ID=SeqID_27172; Location=775..922; Strand=+
  SCN-specific regions: Sequence locations=1-148
cattaaatattacagcataatattagaaagaatattcgcgaacgaagtaaatgggaggaaaacaccacagaagcagcagcaagatgagggcggacctatctaatccaaataaatcctacccccactcttttcataaatccatcttctc

SEQ ID NO: 57870 - DNA, 174 bp, Heterodera glycines
  Genomic contig location: Contig_ID=SeqID_27177; Location=466..639; Strand=-
  SCN-specific regions: Sequence locations=1-174
atgttcaccaaattggagtggttagtttaaatttatattcaatttttcaatgttcggaaaattgcaggagcgataagcattcttttgaagatcaggaagaggccgctgctgggttagcgaatggtttagcagatggaaattaatatttttttacccatttttttagtaattaaa

SEQ ID NO: 57871 - DNA, 1071 bp, Heterodera glycines; identical to SEQ ID NO: 27178
  Genomic contig location: Contig_ID=SeqID_27178; Location=1..1071; Strand=+
  SCN-specific regions: Sequence locations=1-546,568-960,992-1071

SEQ ID NO: 57872 - DNA, 624 bp, Heterodera glycines
  Genomic contig location: Contig_ID=SeqID_27181; Location=206..829; Strand=+
  SCN-specific regions: Sequence locations=1-308,330-624
atgcatccaaacatatcagtactccgcggcgtgagttgcccggcacttcctcccatttgttgcgcaatgacactgggcttggcgtcaatgtgagcagcaccgaatcggtgaaggtaaattatggccaacaaaaccaggaataaaaatgcctaaaatagcgcttttgatgaattttattaattctaagtataattccatatttcagatcattgcctcctccccctccgatggtcgccaatttgagtgttgcgccggccaatacgtcccgatggaatgcgtcgcttcgtcggcggaatcgattcgcgagatcaactggcgcatgaaggaggaccagcgccaaattcagctccaattggcattttccgacccggacacggaacgaacagtgaacatcgctcggacggagaaacagtgcgtccatttgccaagagaggcggattcgggtacgaatttgtacaaaattggaatattcattccgctcaaatcattaatttttatttcattacaggtaaaaaatggacatttgtcgtggaaaccgtgaaggaagatgctcgtcatgttgttacgctgaagtcattggttacggttggtaaacaatcaaaatacaaaacaaatcatttgtga

SEQ ID NO: 57873 - DNA, 1145 bp, Heterodera glycines
  Genomic contig location: Contig_ID=SeqID_5392; Location=132..1276; Strand=+
  SCN-specific regions: Sequence locations=1-326,352-447,471-715,738 -757,779-847,874-918,942-1050,1072-1145
  Gene Ontology: Mol. function=protein serine/threonine kinase activity; Cellular component=integral to membrane; Biological process=organogenesis
ggcaatttgcgtgattttctacgttcccatcgtcctggtgcggaagagaacaaacaaaaccgctctctgccaaccgctgaacagtatttcaattgggctgctcaaattgcggacggaatggcctacttggagtcgttgcggttttgtcacagggatttggcggcacggaattgcatggtaagccaatcccaagtgctaaaaagtgccaagattattttgatttgttttccaggtccatgctgacgagtctgtcaaaattggcgacttcggaatggccagggacatttattaccacgagtattacaaaccggccgggaaacggctgatgcccgtgcgatggatggcacccgaggcgctcaaagatggcaaatttacgctgaaatccgacgtttggtgagtgtgggttggctaactgtgtccatttttcacacgattttcaggtcctatggaattgtgttgtacgaaatgttgacacttggtaagcgataaaaatttttcaacaattttacggaggaaacataatgcctccgctcaataaaaagtgtattttattctaataaatgggtttttcattaaaggacagcaaccgtacgctgggcttggcaatgaccaggtgttcaactacaccggtgtgcaaaggcacgtgttgcacagaccgacggattgcccagacttttggttggtcaatttgaatgcatacgcaaatttcatttcgaatttttataatttatttttaaggtatgcgctgatgctgtcgtgttggagatacgacccacgagaagtaaataagactcccaaagcaatggcgtggtcaattccgtgcctctgggaggcatccatggcgacgaattttttctatatacaaaaaataaagaacttaaggggtaaagcactgtgcctataggcgtagccggaaaactaagatttttaatccattttaaaatcctcacaattttcaactttgttttctaaattcaagacattttttgggccccaaatcccctgacaacgccatttgtcataacagccatttaagaagtttaacaaacgaatcacatttatttttaaagcgtccatcattccgtcaaattgtcagacacctcacaaccagttgttcagattttattgatgaagagttcaaagtg

SEQ ID NO: 57874 - DNA, 736 bp, Heterodera glycines
  Genomic contig location: Contig_ID=SeqID_5393; Location=798..1533; Strand=+
  SCN-specific regions: Sequence locations=1-119,141-697,719-736
atggtcgacctgtaccaaattgtgatggaacggctgctgaaagtgctggacggttgtgacctgttacagattgattccagccaattggtgtgatttgcgaagatttaaaacaagtaaataatctttttccatttttaaaactaaggcaagggcactcgtcttcgcactgcaccgaacacaaaacagagagctgagggaaatgattggaaaatgtgttggcaccatcggactgctcgaccttgacggccgaacagcatcctctcgacgaagcaatcccattgatgatgatgcaaatgcgactgcaatggccgaaattgtttctgttgacaacaaagtgcaggttgcgtaacggtaaatgccaaaatagtttaaaaaatttcgtttttcagttcaccgtcaacttcatccatggcattttctcaagattggacgaatgcgaacagtccgagacggccgtcaaactgcacgccgtcatctcctacattctattggtgccgctcaaagagcacgggatggacgaacaaatttggaagaagttggcatcgaatgtcgtcgaggcattgaacgcgtcacggcaaaatccgttccaagtggaccaatcattcaaaattgacgacctcttcaataaaaacattccaatggggggacaggagcagcaacatttgtacgcactttaatttaaaatgtcgccgggttctttcaaaaagccaaaattttcgaattttttgtaaatcaa

SEQ ID NO: 57875 - DNA, 3255 bp, Heterodera glycines
  Genomic contig location: Contig_ID=SeqID_5394; Location=346..3600; Strand=+
  SCN-specific regions: Sequence locations=1-429,463-912,940-1053,1075 -1380,1402-1594,1618-1738,1767-1995,2027-2054,2076-2155,2177 -2671,2693-2970,2993-3135,3157-3255
atgatcatccaggctttggtcgaacaaaacgacgcaattcttgacaaagtgagagagaacacaaataacttctgattaagaaaaagtttgatcgcatggcaaactgctgcctcaaaaatggctaattcggatagctaatctgccattttcgagttttttttttcagtttgagcaggaggcacttgcggtgttttgcgcggtggttggaggccaaatttgttgggccaacgacgcgatggtcgctatttgtgccatagtggacgcaatggaacgcttctttgttggccgcactgctgctgcaattgttggcacgaggccaaaggacaaagtgagttttggacgaattttgatcaaaagtgaatgggactgatcagagaataatccgcaggactttttctttcatcaggcttaatatttcagtaattaataatactgaataatgcttttcataaaaatccaattttaaagttgacatgtttcttccaggatgtcctttccgaacggtttgatgcgttgatcagcaaaatccttgcccaacccaacccggacagtctgacggtggtgccgttgagtgtgttggccgcccaaaagtgcaactaccactttcggtcattgcgttggcttgaacaattcgccgcgtcacccaaaaacggcacagatggcgacaacggcaattttcgacatgacttttattttcttttggaggtgcttccactttgaccccccccccccgtcgtaagaggcctcggacacccccctcccccctgtcccaatcgtccgtcgtatggtccttgggtgagacaccccttgtacatgtatgttatagcatgagaaatgcaaattgaatgggtccaacacatctccgccggaacctcgccgcaaaaaaaacttgctttttcattgaattcttagttaaaaaaaaaaaaaaaaattaaattaggcttgataactaaatttttgatttttccttgatttttttcgacgacgatatgttctttttgtccagctctcaaattgaatacaattgaaaattcatgaaagaatccccaattttattcacccttcatccattcattgcccatgttcttttatttttttgacattctctctgttcagcgactgtattcccacttgggcaattcggacggagtgttgggcaccttccaaatgattcgcaaccgaaccatgccggagccatttgagcaaattctggcactgaaagtgcagggcaattatgtggacgcgttgccgttgtgccaacaattggtgggacaggaagtgagtggaaaagaattcgaaactcgggataaatgaatctttgggcgtagaatttaggagaatttacctcccaaaataatattcagaccaattcgaaaaatcaaaaattattggacaaattttgtatttgtgccatttaaacgttaaatatttttgcctgttccagaatgagatagtcaaatgtttgttgcgctccaaccaaccgttgttggctcaaacattcattgagcgcacattgcgacacattgaacaacaacaacatccgaaccatgaaaatggggaggcaattggcgccactgacggggaaaatggtgccgtaaatgctggagatgatgccaaaatggccgcaggcgattgcagcaaaagtcggcgactgcgcgagtatcaaatggaggcggtgtgcaagttgggcgactgggaccagctcgccatgttgcatcacaatttggtggaggaaggtcgaaacagaaacaacaacaacaacggtggaccatcccaaaatgtggaaagcgatgcgcaaaacggtggcagtattgagaaatggggtgcaaaaatggcagcaattttctgtaatttgcgccaattcgacttgaaaagctttggtgacggcattgaacgggcacgcgcttcgctggtcgatgcgttggagcgaaccacgctggaggactcgagcacaattgcgcaggcgcaccggaacatcatcaagtgattggacgcaaaataaaattttttatttaatttattatttgcatgttgaaacgtaattcaaacgccattaaattttaaaaaattctaaattgacaagctgcttcgctatatcccaccttatcttcttattgcaaactgatagactttgattatttgaaaatgcaatttgctatttcctatatttagactgaggtcgctgtacgaagtggagagtgtgcgggccgtgctctactcgggcggtgacaaatcagcattgttgcggaagaccatcgccgattgggaggtgcgtcggggttggggatgagtaacccaatggacgttgagttttacctctgtactacttcaactttttggccaccaccgctttagcgccagtccgacaattcgctgtccttcgccggtcgttcggagcgtgtgctttcactgcgtgcggaactgttgcgcgtcatcgacttgccaaacactgcgctcacccaatgccgtctgctgctccggtgctccgagttggcacggcaggccaactatttgcaacggtcgtggacatacattgccgaggcgaaggcactccgccgaacgtcggcggtgatggaaaacaccaaacaaacggagggaatggaagcggacacggccattgacatggaggaggccaaatatctgtttcaaaaggcaaaaaatggcagaaattcatgaggattttttaaacatggagcagttcaattttcccatcaatgaatttttaatttttttaactaaacaactcacatgcatttaaatttaactaaaattagtaaaaattgggttttcttttacaaacttaaggaaatttaccaaaataagaaaaatattttttccttcaaattccttttttgaaaaatttcaacaacattttaactttaaatttcttgttgatggggaaaagttcaattgcccctgacaaaaatatgcatttaattttcgacgattatttccattttcgaaaaaaactgttttcagggtgaacagttccaatcaatcaatttgctggagaagaccattcacacaaattttgcggaactgtgcaccgaactgaacgcacttaaagtggacatcggcggggggatcagcgacggcagtgccacggcgaaaaggcttaggaaatgtgtggtgctacaacagaatggggaacaggacggaggaggagcggacattgttgaggttgctcaaccgcaacagcagcagcgcagggaaaattttgttgaggtaactgtcgtcaatttaatgtttttttaa

SEQ ID NO: 57876 - DNA, 156 bp, Heterodera glycines
  Genomic contig location: Contig_ID=SeqID_5394; Location=3773..3928; Strand=+
  SCN-specific regions: Sequence locations=1-156
atgctgctggccgagttcaatgagcgcgctagtgccaaacaaatggacgacttgctcaacacgtacaaacggttggaaaagtttgggcagttgaccgagtctttctactaccgatatgcgaccttctacgacgtcaagggcgagtcggccaaggag

SEQ ID NO: 57877 - DNA, 1412 bp, Heterodera glycines
  Genomic contig location: Contig_ID=SeqID_27185; Location=289..1700; Strand=-
  SCN-specific regions: Sequence locations=1-3,36-55,77-339,362-975,997- 1187,1215-1290,1328-1331,1354-1412
atgaaactgaaccaaaagtaatttatatattcaatagccctaccaattctctatttatatttacacttttaaaaaatctcattgacgctcacccaatatcagaacaaaaaatgctgacttaagattttttgcaatttatgagacaataactctttctatcttaagtaagaaatcctgagaagagatcgtattgctgatacaactctatgaggactatccaatgctaccatagaataatatttagagtgaactactgaaaccctatgacttattacgcgttatcccttgcagtgttttcttctacaatattttttcttagcaccggcatcacttcaatcttgctgtgatgcactaacctctaactatccccgcaaacgttcccaatagaacctaatccctacatttaatagccctatgctgaatgcttgaataaattcttatacccactaagtacaccgcattgacaccctgcaccaaggggtagctcgagacggcgcatccgggaaaactataggttttttggtccgaagtccaactgagtcccaccggcgctaaaactgactttgctggcagtctcagtgttacgaaaatttttcctttagctcagatcgaaaaacgcttgcaggtaggaaactaagttggactatgcctgacattattgccagcaacccctaacccctacctctaaccccctggtctgtacgtttctacaactttttgaggtcagaaatgtacacttcagtaccaggccaatactgcatcagcgtttgatctgagcggagggttgccagcagacttattgtagagttcaaaaagctcgattttttgaaattttaaaatttagaaaattttcagaaattttcgagttaggcctaaaattcggttttttggtttttgaattttatgattttttacagatttttccgagggaaacggagaacacattcaaaacatcgtttttcgagccctatcgattggtgggatttttagaaaaatttcgattttttcccggaaatagaaaaattttttggcctaagcgggacatttgagtcccgggcccgtaactctttaaggttcggttttagccaaaaaatgccttagaacaaaattgtagagcttttgaaactctatcgaacggtgtgctgtatgttcggaaattttcagaaattttcgagctaggccccctagaaattttcaaaaaattttttaaggtcgaaaaggggagtgaaaattatttttcttgggtaaattatggtgctgatcacgattatgatgtttgtattaagtttcataattttttaaattttttaaaaattctttatttttaggaaattttttggcccttggaaatttgggttaaaatttgaaaattcgtaactcacttctatgttggacgattttaatacaataaa

SEQ ID NO: 57878 - DNA, 1181 bp, Heterodera glycines
  Genomic contig location: Contig_ID=SeqID_27188; Location=60..1240; Strand=+
  SCN-specific regions: Sequence locations=1-213,235-279,302-498,520 -786,823-1181
tcccgcttatcattcggcacttgccgacggcgtcaaaggctacccgggcataaaggcgcggatgaatccccgcacttttcaatacctttcggacattgccctcggagttctcagttagttaactaaaaattgtcaaaaataattttatatttgcaatttcagactaccaaataaagcgagctcgtctccccaacataaatcagtgccttccgcaggtaaaaaagataattttaatttaatcaatggcaattccaactttggcttaatgttcaatatttccaatgcttcatctccccctcccttcagttgaacggttgtgtccaggtgtacaatttgtatgtgtcccgctaccgatgcccccaaagtgagcatttcgccacgattgttttggtcaatgcctttctttcctcccccatccctttgtaaggggtcaccgtttacccggctcccccgaatctcattgtgttggatgtgcaaaatttggacattgggtgagttggggttcctctggcactattttcctcgactgagttcatccgtgcctcgcccccccccccttaagagtcacgggaaatctcggcgggcaaattgtcattttgttgccgttggcattgtttggcattatccaagtgaacgcgtatcaggtgaatggtttagctaatgcttcatttaacagtccgtttttaatgtgttaactaacagctgaatattcgcgtcggcatttacctcgtccgtggtcccaccggatgtccgcagattcgcgtggccagctgtcagtttgggagctattttatcattttaaaaatattttaacaaaattttccatttgggtaaggtgccgccagtgttggttatgtcgatgtttacattcaaaacggcggtcttttgggtgacattgccaacagtcaatttcgagtgaatttgtttcttttttttttgctcattttacccatttaaatttcaaagggtaaaatcagcgaaatggtccgccaacaaattccgggacaggtgccatttgccattattattgccaattaattagtgataacatgataatttttgcagatttgccaacgtttaccgtccatgttggatgaacaggcgaaccccaaactttgctcaaagatccctcagtttatccctgtccggaaaatgctcgaagtggcgatcagtgccaccgg

SEQ ID NO: 57879 - DNA, 259 bp, Heterodera glycines
  Genomic contig location: Contig_ID=SeqID_5398; Location=1124..1382; Strand=-
  SCN-specific regions: Sequence locations=1-47,72-259
atgaatgaggttggtccccccgaattcagcgcattgatcggttgtctttctttcatttgtttctctttgtcaggtgccctcccgcgattcgcccttcgtccgcactttgctcgtccgtcgtctctgtcctccgacccttcgccatttgtcgctgaacgctttggccttccaaattgtgattcgctggtcacaggaaatgaacgcgcgcaaaatggcgggtgccccggaaagtgcggccgggacacttggccgaagaatg

SEQ ID NO: 57880 - DNA, 158 bp, Heterodera glycines
  misc_feature (11)..(12): n is a, c, g, or t
  Genomic contig location: Contig_ID=SeqID_5398; Location=1904..2061; Strand=-
  SCN-specific regions: Sequence locations=1-77,102-158
tgcaggtcacnnttttacacttgtggaagcgcagaaaaaggtcgagtaatgaatgcatttccatgttttaaggttgttttcttttttagattctttgtttcggcggactcgacaccgccggaaggcctttgagcgacctttgggagttggacatcgcg

SEQ ID NO: 57881 - DNA, 829 bp, Heterodera glycines
  Genomic contig location: Contig_ID=SeqID_27194; Location=119..947; Strand=+
  SCN-specific regions: Sequence locations=1-53,125-285,331-508,556 -558,581-829
atgacaaactccttttactatacaaccgaagaattgttcatcaatttttggtgattttttttttaatataatttttgtgacatttcaataattgaaaatatatatttttttattaaatattaaagtttaacaaatttaggtggacacctgagcgtggccaattgtcttggtcaccagacccgcgtaccacggagacaccactccatgatttacgtggacgcatttggaccgatcgtaaattggaattggagccagaaaaatggtcaaatattttcgcaaattggcaattaaattgaattttttgaatattttttaatttaaatttaaaatcttcttaatcctttaaatcatcataatcttccagggaaattgtcaacattttaaaatttctgtcatttaaaccccttattttttggacttatttataaatttgcatgtccatgcttaaatttcaaattttcataagttacatattccagggaatattcaaattttgaaagtttctttcatttaaatcttaattttttattatttttttttatttaataattttttcaagtccatgttttaatttaatttctttaattacttttctaatttacaaaaaatacatcttaatttttttttgtctttttaggtaccctttcccctattactaccgtccctttcggccctaccgtatcacccgcgatttgaccataatgcccggtgccacactgaccattgagaagaatgtggaagtgcatgtgtggccaaatgtgcgcattttggtgtacggaaatttaattgccgatggcacactttggcaggtgccgtggagtggaaatga

SEQ ID NO: 57882 - DNA, 736 bp, Heterodera glycines
  Genomic contig location: Contig_ID=SeqID_27195; Location=295..1030; Strand=+
  SCN-specific regions: Sequence locations=1-64,86-273,347-375,400 -448,470-481,503-588,615-644,668-736
atgaaatttccattgcctgaagaacaatccatcgctgttgtggacctcaacttggaaactttaattgatgatgccatccactgggctcatatcaatggaatggtcacaagaacgaaggaaaaccgactcaagtataattaaataatctaatataaaatgaaacaatttagtttttctcgaatttttattgttcgagtcggtacttttcggtttcggggcctagaatttgatttaaaaaagcaacggtacttttcggttttgttcctacacctcaaaatttaaaattaaatattaaaaatttcataaaatttttttattaagattaaatgtattaattaataaatttggtactttgcagttttgttcttacatctgaaaattttaaaaagccaaaaagggcgtgtggaaagccatttttagctcacgccgctattttggaggcattgacaaaaaatttcaccaaaatattaagccatttaatgatgctgcatcaatttaattttgcttttttggaatgaggatataaaattgagtgccgttttcagtccaaaaataggataaatagaaaaatgaaaccgattttatgcgtgtcttttgttgctgttgttgttttatgcattttgaggtgtaggaacaaaaccgaaaagtaccaaaaacaacaaaagacgggcagaattgcaaaaatattaaattaacgaaagggcatttgcttcccacttcactattctaattgaaa

SEQ ID NO: 57883 - DNA, 137 bp, Heterodera glycines
  Genomic contig location: Contig_ID=SeqID_27195; Location=1099..1235; Strand=-
  SCN-specific regions: Sequence locations=1-137
atgatacatagaaaagtaattatagaaatctccacctttaaaatacttgctaatttcagttcctaccgtatgaactggctgcgcttgttcaaaaattacgcgtggaaaaggcgttaggaacagtgaaaatggcttaa

SEQ ID NO: 57884 - DNA, 54 bp, Heterodera glycines
  Genomic contig location: Contig_ID=SeqID_27196; Location=66..119; Strand=+
  SCN-specific regions: Sequence locations=1-54
atgagggcacagctacgcgaacttgctgagaaaatgacggacaaagatcctaag

SEQ ID NO: 57885 - DNA, 347 bp, Heterodera glycines
  Genomic contig location: Contig_ID=SeqID_27197; Location=844..1190; Strand=+
  SCN-specific regions: Sequence locations=1-156,184-347
atgtctccccctgttgatcagagtaggtaggaatttcgagcccaaaaatgtttcgaatttccataatttttccagggtcgaaatcgcttttcataatttcactgttctcccagcaaattaatgtccacaaatgccgatgagtttcgttttggcctgccttccctccctttcccctccccatttgtccattttcatcccttcttcttcttctatctcacaaaccacagaattctgctcctaatgctaacgtgattttttgattgtttttctttttttcattttccttttgtccgatcaaaacatttaaatcacaaaaatataatctaattgagaatagaaacaagcaa

SEQ ID NO: 57886 - DNA, 163 bp, Heterodera glycines
  misc_feature (47)..(47): n is a, c, g, or t
  Genomic contig location: Contig_ID=SeqID_27197; Location=1201..1363; Strand=-
  SCN-specific regions: Sequence locations=1-71,93-163
tagaggagtgatcagaaggactgatcagacagacggaccaatcactntggccaacaaacgatcactcgaattaagccattaataattaataatccgaccaattaattaaattagcatgttgtgtataagaattagcagtctttacgcatttacttcacagaaa

SEQ ID NO: 57887 - DNA, 710 bp, Heterodera glycines
  Genomic contig location: Contig_ID=SeqID_27198; Location=198..907; Strand=+
  SCN-specific regions: Sequence locations=1-318,340-422,444-447,471 -553,575-710
  Gene Ontology: Mol. function=non-membrane spanning protein tyrosine kinase activity; Cellular component=nucleus; Biological process =regulation of cell cycle
atgaaacagtgttcacacaacaaccttgtccgcttgtttgccgtttgcactaacgaggaaccgttcctgatcatcacggagttcatgccgaacggaagtctgcaaagttatttgcgcgcacaagagacggacgagaagggcgtgaacattggtcgacccaaaaatttgctcagcatgcaagcgatgatcgacatttgtgcgcaggttattccgacaagaaaaattaaaaaatatcttcggtcgtttcataaaaaccaaaaaaaaactcttgttcagtttgtgcgtacaatagacttatttttagttggccaaagcctacatttttgtcataaatggaaagcttaaagtctcagaaatttataaatgcaagaacatagcaaataatggtattaagaaaaaattacattgaccaaatcaaaccatggaacttgaatttttcttttaagcttttttttattaaattttattttgttaggcatttcaagtttgttaagctgaccaactcaattcatttcaacaactctaccatagattatttttttatgacgattgggaaaggattaattgttcattaaaattggatgaccaaaccctttgattgatacaatacattaatttttcaaaagattttttttcaggttgctaacggaatgaaatacttggaggagcgtaaattggttcatcgcgatttggccgctcgtaatgttttg

SEQ ID NO: 57888 - DNA, 81 bp, Heterodera glycines
  Genomic contig location: Contig_ID=SeqID_27201; Location=1818..1898; Strand=+
  SCN-specific regions: Sequence locations=1-81
catattctatcgcatgaatttggcaaagggtcgctgtgcaatcggtgtgattgtcccgggttcggacatgcacttttggcg

SEQ ID NO: 57889 - DNA, 713 bp, Heterodera glycines
  Genomic contig location: Contig_ID=SeqID_5399; Location=254..966; Strand=-
  SCN-specific regions: Sequence locations=1-420,457-543,568-713
gtcacttggcatggcaatgatctcatttttccaattgccgaaaatgtgagacagaaaagccgtgtaaaataattgaatttcaaaaaaaataattttcagccaaaaccaatcgccgaacggtcggccaaatatgacaccgaaattgtctaccacggctcatttctgtgccaacttgatggccaagtggcttatcagccaacacccggcaccaattggacacactattttatattggtgcacaattttggacctaagtttttccgaaattttcgattaagcccccccccttccccctcatgagcgacggttattttttgctcatcggtcttaatcatttttaccgattttttcacaaaaagttctgccggaagggctggggtccggcagtggctttgggctccgccagagaaattttttgacaaaatttattaaaaaagagatatttttttataaattccattaaaaaaattcttcggttcggggaacgagtctttactcccccctggctataaccttagtgtcgagagtctcgatcaagttagtattgattgattgatagataggtttttccgtttgaggttgaaagtcccgtggcggaaactcacgccgtccgcttcagtcccggccaaaccgcagttgtggacgcatttgtcaagcattcgatgccaattccgctggagggccaattcgaatttgatgcgtggcacagaaat

SEQ ID NO: 57890 - DNA, 945 bp, Heterodera glycines
  Genomic contig location: Contig_ID=SeqID_5400; Location=211..1155; Strand=-
  SCN-specific regions: Sequence locations=1-182,216-782,804-945
atgccaaaaagaaaaatgccgaccgaattaaatgtcgaaattgtggcggcacttccctttgatattcgctgggcaaatgtgcgaatttcttttgcatttgaccattttttgtacaaaaaacaagcccaatggatcagaaatgaattgatcagacaaaaaattgtggaagaaaatgttttttcaattaatttttaatttatttaaacaatttttttggatttagaggcaacggcttggacaggcaaaacgtcggattaaattaatgtcgttccgtctgtttgaaaaccgcttgcgcaacatgagggatcgtaagttttccagtgctttttcttttttacagtacacttttaccgtatttttggttatttactgcttacagtatcattcgactgtaatttgccattactattatgacaaagaaataattttccatattttcagacatcgcctctcacttccgtctcgacaactcttttggcttgacagaagtccaatttcgcggggaacttactccggagattttcggaattcaatttgacgccatttttgcgactattgaccgcaacaatctccaggacatttcctgggcacaacaatgtaaaaaaatgccaattaatgagcgataatgtggataattaagtcatccaaacgcttgccaattactctgagggctatgtggacgaatatgtgcaggcaaatcagtagcaaatttaagatggtttgatgtgaccttgttgacatgaaaatgctaaaaaacgatttttttaaaattttcagtgttgttattttaaaattaaaatttagcattttcttagtggtgtaaatgcagactaacggtgcaaaaccgtcgctctgatcataaatttctcaaattgtttgctaatcgacccacaatacctttcttctgttcctttaacgttgcgctgcttataaatgacaaataaa

SEQ ID NO: 57891 - DNA, 647 bp, Heterodera glycines
  Genomic contig location: Contig_ID=SeqID_5400; Location=2249..2895; Strand=-
  SCN-specific regions: Sequence locations=1-484,506-647
atgagggatcgtaagttttccagtgctttttcttttttacagtacacttttaccgtatttttggttatttactgcttacagtatcattcgactgtaatttgccattactattatgacaaagaaataattttccatattttcagacatcgcctctcacttccgtctcgacaactcttttggcttgacagaagtccaatttcgcggggaacttactccggagattttcggaattcaagtggacgccatttttgcgactattgaccgcaacaatctccaggacatttcctgggcacaacaatgtaaaaaaatgccaattaatgagcgataatgtggataattaagtcatccaaacgcttgccaatatctttgagggctatgtggacgaatatttggcggcaaatcagtagcaaatttaagatggtttgatgtgaccttgttgacatgaaaatgctaaaaaacgatttttttaaaattttcagtgttgttattttaaaattaaaatttagcattttcttagtggtgtaaatgcagactaacggtgcaaaaccgtcgctctgatcataaatttctcaaattgtttgctaatcgacccacaatacctttcttctgttcctttaacgttgcgctgcttataaatgacaaataaa

SEQ ID NO: 57892 - DNA, 1364 bp, Heterodera glycines
  Genomic contig location: Contig_ID=SeqID_27202; Location=471..1834; Strand=+
  SCN-specific regions: Sequence locations=1-791,813-823,855-1148,1180 -1207,1229-1235,1260-1364
atgacgataatttggtgccgttccgtcgttttcttttacgaggaaagtgccatttccgccgtggtcggtggtgccggtgatgccgacgatggttcttcgtcttcggttggcacgggcggcggcgatggccaaaattgtgtgctgaactccgagagtggggacagtgcgccacaattttttgtggacgaaaccgaggcattggtggactacgcgtcgtttgacgactgttaccaattgggcgacgctgctgacgctgacgccgacgacgccagcggcgttcaaggcacagtcgctgctgcggccgcgacggcgactgctggcgagaagcgatcaatggcggcgagtgggacggacaaaatgggcatggacagcgacgccggcgggagggcggcgagcaatagcagagcggacgtcgcagagtcgcgcagcaggccgcaaaaggcgattgcactcgacaggaaggtacggtatgccgaaaggaactatacggtaaattgctgagaataggtgccatttagtaccggaaaagaaaattctcaatgtttgctgtaactgttaccgtaaaaggtcaatcccaatgtttaccgtaaccattaccctactaaaattgcaatttgtccagctctaatatatatttgcagaagagcgcttccaaaattgcacaaattgcgtctattccggaggagcggcaacaacaacaacttcaccaacaacgattgttgcttggccacgatcacgacgaggctgtgggcctgaaaaacattggactgaaatggccgcgacgaatgggcggccaaaaaattgtgtttccatcggacaaaaatgtgcagcaacagcagcagcagaggaagccaattggtgctggtgatggccaatttggcacaaacaccgctaatggccgtgggcaggcgccattagcagcagcaacagtagcatcaattagtggcaaacagccaccgccgagggcagcagcaatacaattaacggcccctgtggcggagtcggcgacggcggcggcaaaacatcaaatgggcaaggcgatggcggtacaacatcaaaggggtaaaggcggtgaaggggggcaacaacaacaaattgtggccgagctgagcgccgtctattcagtagaggaggaggaaggggcgagaaaaattaataatgataatgataataatgatggtgtaagcgggagagtagcggcagtaacaaagggtggtgaaggaggagaaagacaacggcatcagcagaggcagcagcagacgatgagagtggaagggcagacaaaaatggcacaacgccaacggcacaggtcagagaaagaaatgcctgcggcggggatactaggagagcatatttatccttga

SEQ ID NO: 57893 - DNA, 332 bp, Heterodera glycines
  Genomic contig location: Contig_ID=SeqID_27204; Location=698..1029; Strand=+
  SCN-specific regions: Sequence locations=1-123,145-191,214-244,268-332
caaattgtccttcccgtcagtgcgcggctgaaaatttccgctccgtcagctgacaatttcaacggaacttttataaaaagttcaaaaggagaagaaatggaagcgccgaagtcgaaggaggaggagggacagcaaatggaagtgatacggcagggaatcgcagttgaaatgccaattaatagcaacagcggcagaggatgaagattttaatgatatgatgataatgatgggtaattacaatagtaaaacaataagagaaaaagaaaacaattatgcagagattggacaataacaaagaaaagactattaaatgttaattgaaatgaaaaaaa

SEQ ID NO: 57894 - DNA, 441 bp, Heterodera glycines
  Genomic contig location: Contig_ID=SeqID_27205; Location=239..679; Strand=-
  SCN-specific regions: Sequence locations=1-300,339-340,362-397,422-441
  Gene Ontology: Mol. function=protein binding; Cellular component =axoneme; Biological process=N-linked glycosylation
gcggccgacttttataacatcaatcgtttgatcaacgatgattacattgacaatgtgtacgaaatcgtaaaagtcaaatggatcaatggcaaaacgccgcaggaaattcgcaaggcattcggcgtcaaagagccgtacccaccgggacatccggaatgggcacgagttgagaaggagaaccagtgggaagaatcggacgaggaacgtgaggcacgccatgcaaaggaacgagaggaggaagaggagcgtgagagaaaggaagaacagaagcgtaaggaaaaggaagcggaacgcctccgtcaggaacaactgcaacaacagaatcaggaacaccaacctcagcagggagaacagcatggtgaaggacaaggacacgatgaagacatgaatgatgagtgggaagaggaagatgatgaggagagcgaggaagatgatgaatga

SEQ ID NO: 57895 - DNA, 1380 bp, Heterodera glycines
  Genomic contig location: Contig_ID=SeqID_27208; Location=107..1486; Strand=+
  SCN-specific regions: Sequence locations=1-115,151-243,280-539,561 -586,611-1380
atgcaatttccttcttatgcacggatttctgactggaaaaagggtacacttttgatggacattgaaaaagtgtcggaatttgcacgagaggaggttgagagcagtcggcacagccagaaagtgtacataaatggaatgccatggaaaatattggcacaaataaaaacgaaaacgggatacactgacaatgagaaaagtttgggcatttacctttcgtgtgccgttcccaaagaaggtggatggaaattaattcttaattaaataataattaatataaatcgattgcattgagcagaaaattggagctgcaaatgttctgcaaccattcgaattgtttcacaaaagtgcggtgtggcggatttaaggagaaaatttgatggaacatttataagcaatcaaaatattgactgtggattctattatttgatttcctttgcggtgagtgccaattaaactttcggtgtaaactttcccctaatattggcccaattatgaacaattaaggaattgctggacccgagcgaaggcttttacagcagaagcaaggacaaagtgaaattggccatcaattttattatgcaagaagcaaaaagggaggaaaaaacaagcaaaggcttttacgacaaaagcgaggataaagtgacattggctgttgatgtcattgtggaagaagcaaaaactgaggacaaatgataatcaatttggcatattatctatttgaaatctccattaatgtcacttatcataagggccgcgatttttagtgaaaaaatatcgaaatagttaaactaaaatagtataattctcatccgaaatcggataaaatagttttaaaatttttgtcaattttggaaatgaattttttaagaaatttttcatttctttggagtgtatttttctgaaatttggggggggggccgattcttaggagtgcgattttattttttattacatttttgttgagaaattttgagtaaaaaatagtaattttcactaaaaatcgcggctttgatccaatcaattgacaatacctgctttctatacatcgtattcgaacaaacccaatctttttggtattatccgaaagcacaaagtctaaataatgtaataatacaagaagccaagagaattttaacatttaaagaaagttacaaacgaaaatcatcaacaattactaaatcaaatccgaaaatatgtattcttcggttttctgggtcgctaatcacgaacatatctgagaaactgatatatctgaaatattctgactttgggatagtgaccaaattttgttctgatttcttaaatatagcgtcaaggttacactcttcatcatgggcaaaagaacattaaaaattggggccaaatacaaaaatggtagaa

SEQ ID NO: 57896 - DNA, 94 bp, Heterodera glycines
  Genomic contig location: Contig_ID=SeqID_27209; Location=860..953; Strand=+
  SCN-specific regions: Sequence locations=1-94
atggaagaactcgtggcgctctcccctgaatccgcgtcggccgctggacgatcacaaagaagctgggcgccggagcattcggagccgtctacct

SEQ ID NO: 57897 - DNA, 174 bp, Heterodera glycines
  Genomic contig location: Contig_ID=SeqID_27210; Location=25..198; Strand=+
  SCN-specific regions: Sequence locations=1-150,172-174
ttcacggacactccgttccattcaaaggcgatcaagccaatgcttgagaaaaatgtgccgaatttgttggcatttgtaaagcgcatgaagcaacgcttttggcccgattgggacacaattttggacagtttggcactcaatccgccggtgtacgaagaaaagcaaacaaaatga

SEQ ID NO: 57898 - DNA, 669 bp, Heterodera glycines
  Genomic contig location: Contig_ID=SeqID_27211; Location=72..740; Strand=-
  SCN-specific regions: Sequence locations=1-669
  Gene Ontology: Mol. function=oxidoreductase activity, acting on the aldehyde or oxo group of donors, NAD or NADP as acceptor; Cellular component=cytosol; Biological process=carnitine metabolism
aagacacgccaacgaaattgctgaatgggaagtgcgcgacaacggcaaaccgatcagtgaggctaaagccgatgtgctttcgtgtgccgacacttttgagtgagtcgcttcgattggttggttttgtggcgaatgtttccattaatcattcaattgcaggttttatgctggtgtcaatttgtccggcgaacacattccgtacggaggcgaactgtcggggcgttttgcgtacacgcgacgcgaaccattcggtgtggtgggggcaatcggagcgtggaattacccaatacaggcaaacggaaaacaacgccaaaatggggctaaacgggcgcagatttgagtacttttcggttttgttcctacacttcataattttcaacaaaaaaaaaggacaaaagggcgcacggaaatcacaaattttgcctaattaccatagcacaaattggttgggcgacaaaacaaaatggatctatcaatattcctacgtgaaaatggcataataaattgaaaattttttgtgtaggaacaaaaccgaaaagtacacagatttgtttacaattagcactctccgtccccccttttcagaccgcgtcgtggaaaattgcgccggccatcgcttgcggaaatgccattctgtacaagccgagtccgttggcaccgatcacaagc

SEQ ID NO: 57899 - DNA, 1765 bp, Heterodera glycines
  Genomic contig location: Contig_ID=SeqID_5402; Location=1769..3533; Strand=+
  SCN-specific regions: Sequence locations=1-249,277-313,335-624,647 -1462,1484-1765
atggcattttttattttttccatcagtaagaaactgctttccgcaccaatgctttggtttggcctttttctgtcgctgtttgcggcaataaacttatcgagtggtcaattgggcacaaacgatgaaagcaaaaaaggtttgaacaatattttcaatagaattttaaatattattttgttttgtttttaggtctttttttgatggcaaacgaatttctcgaatccgggaaaatgcttctcgacgaactccaaaatcaaacaggaaacaaacaggaggagaatgaatctgatgatggacttaaatcacaaaaagcgaatggaaaggcattggaagagaaaagtgacaattttcagcaaaaagcctttgagtttttgtgtggaatcgaaatgaaagcaaaaaatgatgagaaaggaaatgagaaaacaaagaaagatgacaatttgttagcttttaaagaattagaagaaaagcgactcaatttttgtcaaaattggaaaaatggcaaaagcatttggaaaggatggaaagaggcagggatttcaatagtaacatcagtgaacaatttgaaactgaatcagcaaatatacggagaaagtcttcgaacattggcgaaaatggaaattttcaacagcaaaaacaaagaagaatttggaaattttgcgaaatttggcatcgatttgctaatgaaagtaactgaaattcttaaaggtaaccaattaagttattctaaacaaagaattttattccaaatggggtaattaaacatttaattgaagatgcgagaattagttcactggctctggctgatcagtctgatcataaccaaaggaaaggcaacaacacatcacgacgaaggaaaagggcttttcatgggatttttcgccgagagtttagcctggaaaagtgttttctgtacttgctgttgacttgcatgtccgccggccttggcactgacatggtcgttcgtctcgcccagcacaaagtgcgggtcgtttcatttggcaattcggcgcctccgcctcccttttctaccgaaggccatcacacaaccccgcttgaaggatttgagattttcgtagctattttttgcttccttaccactttgattagtcttccaatgacaatcattgaaggctttaaaatccgtcgacactaaaaaggcgcgccgcctttgatttttttttcagttgccgagtgccgtgtcaaaaataacaaattacctaaattttgttgtgatctgtttttggcgctacaaaattagcccagtttattaattaatgccgttctgagcataaaatttagtaaaaaaaaactcagagcaaatttttatttataaatggcacggcattggaaaatcatttggtgatcatcaactaattttatcttttattcaatgtaatgatcacaagggttatgtttttttctattttttgcattcctttaacctttcctctgttcagcattccttcatttccttttctaatggagattttttttattatcggattcttctcaagaatttgctttatctggagataacctaaaattctgtgtctgacaggtcgggccgaaacagaagaatgtttttgaggaaggagccaggtgatagtcgaagagttcagttgcataaaaaaaaatttctttgacaaattggcatttgttccgttaccttttgtcgcagcgattttaacagtaaatttaatttcagctgtctaagcgttaattaatgtttgggtgttacctgtcaaaatgcactttgattata

SEQ ID NO: 57900 - DNA, 956 bp, Heterodera glycines
  Genomic contig location: Contig_ID=SeqID_27212; Location=695..1650; Strand=+
  SCN-specific regions: Sequence locations=1-96,118-196,250-263,286 -451,537-656,688-851,922-956
atgaaatgtaattttaataagagcaaaaaaattcaaatgagttttacattattgattgataatttaatacatgcaaaaataaaaaaccgtaatcagttattaaaaattaattaaaaagtggtaaccatattacttagtacaacatatttgaaggaacgagcgaatcgcacggacacacaccacaaactactatttgaaataaaaataaatgtttaataagaaatttatacaaaaataaaaaaatattttgcaaattgttgtttgaatatgtttaaaaatgtaaataaaaattaatatgattttgcctaaatttatgtaagaaaaactgacttattcaaaatgtcagagagctcactaaaatcctttattttaaactatctattcaataattcaaaaaaaaaaatcggcttacatacattacctcaaaaatattactacgttaaggcatgtcaaaaattaatacaaataaatataaaaaattattaacttgtgaagaattttataataaaatttctaaatattcttattttaaaattgaacattccaaattgaaaattatatcatgaaaaatcattctcataaatatttgcttatatattgacttttcaataatccattaatagactacttctatacatgaggaatgattaaaagacataatatgataaaaataataaaataataatacaatttacagatgaacaaaagcataattaaaggtataaatattataacactttcagtgatcgcgctgtttgtttccgcatgcattttgctgcttcgttggcttaagaagcgtttatccaatcggtcgtccgccttttttctctgtttctgtgttggctcgatgtccggctcagccagcttccatcttaattaaaatatttttttataattaaacaaataataacaaattaaaaacaacattcacattataccaagaaatacaatcaaca

SEQ ID NO: 57901 - DNA, 343 bp, Heterodera glycines
  Genomic contig location: Contig_ID=SeqID_27213; Location=474..816; Strand=+
  SCN-specific regions: Sequence locations=1-100,122-185,207-343
aaaaattgaagaaaagtggaaatttcaatgggaaagtcaaacaaaaattgagaggaaaatgaaagaattcattgaacgatttgatgaatttaaaaggttgtataaaggcaaacaaaaaggatttgcgaaggaattgggcatttctaaagaacattacgaagatggaaaaaagaattgatgccaaaatatcataaaagtgagagaatttgttttttaattagtttatctttatttttaagtacaagttaaacattcaaatgaggacaaattaaaaaagatgaaaaaatattttaaaatcaaagaaagaaacctaaaaattagcgatgcaaaaattgcaaacata

SEQ ID NO: 57902 - DNA, 377 bp, Heterodera glycines
  Genomic contig location: Contig_ID=SeqID_27215; Location=133..509; Strand=-
  SCN-specific regions: Sequence locations=1-167,190-377
atgcttaaactttgcttgacaattattttggttaccatcggatacaaatcattttcgttgtctgagcatatttcagaattttccgaatgcggcatttccgactttgaacccgaatttcccattgcaccaaaagtggaaattggcacaaatcatgtaaaaataactagtaattaaaataaattattttaacaaatacaatagatattcaaaggaaaaacaattgtggatgacaaatcattgccgtggatggcaagaattttaagtggaggtacagttctttttaccattcgagataaccttaattcagggtgaccaaatgtcctgatttttcagatcctgaattggtgggtacctatctgaaaaacaaattgtcctga

SEQ ID NO: 57903 - DNA, 1443 bp, Heterodera glycines
  misc_feature (75)..(75): n is a, c, g, or t
  Genomic contig location: Contig_ID=SeqID_27216; Location=2..1444; Strand=+
  SCN-specific regions: Sequence locations=1-62,105-362,403-541,563 -631,654-779,808-956,1054-1443
atgagtgaaaatggaagaaactttcggcatttgcttatcgcgacaaaattttgggcaaaaagtaaattaattatntaaaaaaacatttattttttgaaattattcttaagacaattacatttactcaaacaaaatgggctttttgaacggaatatctttggccataatggttgccaaaattgggctgctctttccaaattcgtcactccaatttcttctggaaaatttttttctcatttatttgacacggtaattttaaatttttgatttattcttatttattctttggcttccaaatttcactggtttttgaaagtctgattgatgttgatatttttgtttttgataatcgactcataccgaaatttttaaaattaaaacattttagaaaatatttttataggaaaacaacgtgaaaaattttgaaatttcccgattatcttgcattaccaaaattagatattttcataaaaatctttttttacccccttaatttttacgttttgttggaaaccaaaatttggaagtcataatttattatccaaatgttttttcggtttgcctttaggcctcaacaaattccgattcaattaacaaaaattgacgcacacaatttcaatttgtttgttgcaatgaatgaaaaagaattggaaatgcccgtcctcacgcccgaattacaatttcacccgctgcaaaacgccacgcgatttgtcacacattcaaatgccaaagtgattcgacgtgaaatggcacaaggcgaattttcatattttcttgcgaatttatcattttttaatttaataaatacgattttttagcgctccaaaaagtaaattcattgaaaaatgacaaattcaatttgggagcatttctgagtgagcccattccattcacagagaaggtaaaatcgaccaaatgaacttgaattgttatgataaagcaatttttgagcaacgaaattttaattaattttttttaaaagaactaaataataataattgtttgttgaatatcaaaaataattatttaatttaacatttaatttaaatttttctttttcagttccaaaatttcctcgtcattcattgcatctccgagcagaaagaattggccgattccttctgcgattttgtcgagtggagaatgcgtctgcaaatcatttttagcatcgacaaaaaagacgccggtggccaatcggtggcgacgcatttaaagccgaacattcaccgggaaaagtgcaatttgacaacagcaaaactgctgggcatctcatttcggtaaaaaaagtccaattaggtctcattttcaaatgcacgaaaagaaatcaaattaactaaaattaacaaaaaatactctttaatggggtcaagacaatccgtcagttatggacattccgtcagtgacaattcgtcagcaaatttttttttttttgagaaatattta

SEQ ID NO: 57904 - DNA, 128 bp, Heterodera glycines
  Genomic contig location: Contig_ID=SeqID_27219; Location=868..995; Strand=+
  SCN-specific regions: Sequence locations=1-128
atgggggaaggtataaatttggtatttctcattttcccaaattttcagggtggatgggaggggatgaatatgggatttcccattttcatgaacatacaatttcattttttattgattcaacaaactaa

SEQ ID NO: 57905 - DNA, 597 bp, Heterodera glycines
  misc_feature (552)..(552): n is a, c, g, or t
  misc_feature (571)..(571): n is a, c, g, or t
  Genomic contig location: Contig_ID=SeqID_27221; Location=26..622; Strand=-
  SCN-specific regions: Sequence locations=1-266,297-597
atgccgcagccggaacgggcacagatcactcacatgagccgagagggggacaaaatgccagagaaagaaaaagtgccaaattcaaaaatgaaaatagaaaattaaaaatcataaattaattaggcgaattccaactccgacactgctgaacaacaaccaaagcatcagcacgaactcgaaattggtcagttcagaagtccgacggcggaggaaaacgacggaagcgaaggattcgaagtgataacgcgagaagagaacggaggacaccaaacggaggagggagaagaggaacagaaggccaacgaaggcgagaaaatgccaaagtcaaatggaaatgccgaaaacacaggtcaaggagaggggactcagtcggctgcgaccaccacaacgccgacattggcatcgacgacaacgacaagcggaactgaaacggcaaaacagatggagcggacgacagagcaaccgcaatcgtccccaagcgaagaaggcgcgggcggaggagcggccaacggatccgcggacacagaagtggacattttggcagctcggggncctcccgccgcgggtttgncagaaaccaagaaagggacaaattaa

SEQ ID NO: 57906 - DNA, 235 bp, Heterodera glycines
  Genomic contig location: Contig_ID=SeqID_27221; Location=678..912; Strand=-
  SCN-specific regions: Sequence locations=1-127,159-235
atggcaacacaaagtaaagacgagaagcaaagtgccaatggtaaaatgatcagcagaagagctttttaattgtgatgtaatttactataatttagtaggcgaaagtgaaaaaaaaagccaagggtcgaacggagaaggggaagaaaaagccattgttttcccaacagaaaacgcagaaaatggcacaacgccagccactccagaaaaggcatttttggcacttttccaagattaa

SEQ ID NO: 57907 - DNA, 1424 bp, Heterodera glycines
  Genomic contig location: Contig_ID=SeqID_636; Location=15..1438; Strand=-
  SCN-specific regions: Sequence locations=1-1424
  Gene Ontology: Mol. function=ATPase activity; Cellular component =extrinsic to plasma membrane; Biological process=synaptic vesicle priming
attcagccgttttcgttcccttctgatcaatggattatcacttcaatttcactaattgtcgatttccaaaagaagcagaagccgtaaagcccggggaggcgaattaattagtccaatttgtctttttctttcaggtcaaacccatccgaaccattggacacaaatgcaatggcccaggaatttctaatgcaattcgccaacacggtattcaccgtcggccaggaatctcccatggaatatgtgcagcagaagcggggcaccggaagaggaaaattgcctccgggaaaagtaaatctgttggacaacaacaacacgacgacgacgtacacactgaaattggtggtggaacggatggaaggcgccatcaatctgaacacggcaccggaggaggttctgatattcaattaatcgatgacctagagggtcgtttgtttgatcattagttcacttaatttacatattttagctttcgttcggtccgcttagtccgaatgccgtggtcattttcgatcggcctgaaaattcacagatgaatttgatcggccgtagtatagggtgcctaatctcgttcagtgctatttcttgatcatttcccttttcagaaagtcgtcccatcgtgcgctggtcaatcccgattgggactttcaacagttgggcatcggcggattggacaaagaattttcctccgttttccgccgcgctttcgcctcgcgcgtttttccgcccgaattcattgaacaaatgggttgggtgatttgtgccttgcagttttttggattccatttgtaactttgtcttcagcgatgaagcatgtccgtggcattttgctctacggccccccggggacgggcaaaacgctaatcgcgcgacagatcggcaaaatgttcaacgcacgcgaaccaaagattgtcaatgggcccgaaattctgagcaagtccgaccgaaactgttgacatttgtaattagaccagatagatttgtcggcgaatctgaggctaatatgcgcaaattgttcgccgacgctgaggaggaatggcgacgatgcgggcccaactcggggctgcacattatcatttttgacgaaattgacgccatctgcaaacaaagaggatccatggtaaaaaacagtcaatcaccatttcggcagtgaaagccattttatccgcttaaacaaacggatttgtacaaatttcttagggcggatcttctactggcgtccatgatacggtggtgaaccaattgctgaccaaaatggatggggtggagcagctgaacaacattcttgtcattggcatgaccaaccgcaaggatatgatcgacgaggcgttgctgagaccgggacggatggaagtgcaactagaaatatcactgccggatgaacagggccgtgtccaaatcctgaacatacgcacggcaccgatgag

SEQ ID NO: 57908 - DNA, 441 bp, Heterodera glycines
  Genomic contig location: Contig_ID=SeqID_637; Location=1781..2221; Strand=-
  SCN-specific regions: Sequence locations=1-114,158-196,231-441
atgacatatttgttgtcgatttgtccacaacaattcatcgaggcgcatggaacggccagaaatactgtaagaagcgccgctacaaacgacacgaaatgcatcttaccctttagcaattatttaaaattaaaattgtaattagagaaaatttatatttcttatcaaggcatatccggctaatttattagtgagtgaatttgttgtttttaaaaacaaataaacaacaaaatcacatccggtgaatattaattaaatttgaatatgtatctatacaaattaaatgtttagatgtttttcacatttatattccctataaaatgcatacagctgaaagaaattggaatcgaaaacataaaatgtcggtgttgcttctattgatgcaggtcgaatctaaaaataccaatggggcgaacctaaaaaagcagcactaatattaataaa

SEQ ID NO: 57909 - DNA, 576 bp, Heterodera glycines
  Genomic contig location: Contig_ID=SeqID_637; Location=3074..3649; Strand=+
  SCN-specific regions: Sequence locations=1-413,436-451,473-576
atgtatgaaatttcagctgacccaactgacaaaggagtgaaaaatcgtgtcatctatacggataacggtcaatttaagtggaatattaggaatgctgtgcgagattttgacactaatgccaagattacggtgctcttgtgtttgggcgatgagtaccgtgtgtatggccaatttgcggattatgatgcgatggaagatgagatgggtgaacggttccacgaagtgtttcaagtggtgtacaataattaccccatttatgagattgacgaaacggtgccaattgaacacgacgtgccgattgagtacgaagacgaaggccattcgacatgcacaattcaaaagtcagtttaatcaaattcaaaattaaattcaaattcaaaaattgttaagcttattttttaggtgatcgaatttttgacaaatattaggaaaataatttagaatctttaattgaaaaccaaagaaaatgatgtacaacgaacggattattcatttgaaatatttaccccaaaatgagcatggatttaatttatttcatgtcattttgtaaaaattgtttttttttactctatgata

SEQ ID NO: 57910 - DNA, 217 bp, Heterodera glycines
  Genomic contig location: Contig_ID=SeqID_638; Location=2373..2589; Strand=+
  SCN-specific regions: Sequence locations=1-159,183-217
atgtttccgttccgttttctcttcgttttcgctttcgctttgctcactttgtgcggcttttctcacatgacattggcacagcccggaagcaatgggccaattggcgaacctaacaaaatgttgcgcatccgccgttagtgattattaagcgacgaattgtaaaaaattaattaaattaaaaagtttttcaggggaaaatgaacgcaaggaaaattga

SEQ ID NO: 57911 - DNA, 839 bp, Heterodera glycines
  Genomic contig location: Contig_ID=SeqID_638; Location=2654..3492; Strand=-
  SCN-specific regions: Sequence locations=1-87,181-326,348-839
atgccgaaacaggcggaagagaccaaaatgttgttggagcggaaaatgcgcgagactgaaatggccgcacaacgaatggctgcgcttcagcaccaacaacagcaaaaacagcagcaacagaatggcatcacaacgcccgggacggcaacagttgcgcagcaacaacaacagcagcaacaggtgttttttgtggttgggcacaaattgcaaagcaaattagccacaattaatgacccctcaaactgaatttgatcaattaaacgtggtctatcggaatcttcacagatgcagcagccacctccgtaccaagaagtggtcgagaatcggcaacaaacgcagcagcagcaaatgccattggccaatggtgtcggcgccgcagctcctgggaccgtccaagtcaaataaagtaattttgttctctcatgctgaaattttcacagaatgcttattaacgaaaaaaaatattgaattcgattgtaaatgactgctaaaatggtgtaattatggagctttaatgactgagctttttgtacaaaaaaatcacaatcatacgtttctattggggaattgaattaataagcactataaaaattaaaaagagcaaaattttgtaaaaaagattattcctattttcctaaaattgaaggtccctccggcttcataaaaacttaccactccctaaattaaagctcaaaaatttatttaagttatagattaatccaagtcaccacccattttcatttgctgttcatttattgccacattggtcattagtgatcaaccttttgattttataccaaaacaccaccctaaaaagtaacaatgaaaacggaatttaa

SEQ ID NO: 57912 - DNA, 175 bp, Heterodera glycines
  Genomic contig location: Contig_ID=SeqID_638; Location=4307..4481; Strand=-
  SCN-specific regions: Sequence locations=1-18,66-175
gatcttttaggccaaaccaaaatttttgtttattaatatattttgtttattttaatttttatttacaacagtgtccaattttccggtgtccaaatttccattggtgtccaattttctagtgtccaattttcggtgtccaattttctggtgtccaatttaccgggagccacaattt

SEQ ID NO: 57913 - DNA, 1205 bp, Heterodera glycines
  Genomic contig location: Contig_ID=SeqID_638; Location=3789..4993; Strand=+
  SCN-specific regions: Sequence locations=1-112,134-238,261-362,384 -628,676-742,764-1076,1098-1205
atggttcagttctgcgcggtagcggtccctctcctgctccgcctgcgcgcgctgctcacgctcgcggtgcaaccgcacctgctcctcctgcaaaggtttaaaaaaatcatacaaaaaataatttaaaaccccggatttaatcagggaactttttgctttatgagtttctgctatatcatttttattgcttgtacaataatcgcttatttgttagcaatagctaatcattaataaaatgccaaatccaaatgaccatcaaactaatctttgatcagtgtttttttattggtcattttccactgatcactttttgctgatcgactgttctctgatcagttttgcctttaccattctgcgccttcgctgctcgtctgcctgctgcttcatctgttgcacctcgagcaggtcgggctgtcgtctgcgcaggtaaaggttatgcgtgccaacacagaggtcgagaagtgactgaaacatggggagggcaaatatttaaacaagcttcttctgtgatccgctggaaattgtggctcccggtaaattggacaccagaaaattggacaccgaaaattggacactagaaaattggacaccaatggaaatttggacaccggaaaattggacactgttgtaaataaaaattaaaataaacaaaatatattaataaacaaaaattttggtttggcctaaaagatctttatcttaatctgcacatatgttgtttataagcgtaaataatatggaaatgaatttgttattatttttgtaacatcagcaggagaagaaaaacatcatatcattcataaagaaaaagttttattacccatttttcgtgcattatttggcacattgatcaatcaccccccatttttggtgcattcggagttagagggaaaggaatgaagcgcaaacagctttatattgagcaagatgaaaatcttcgggaaatatttgcaacgcgtgccgatcgtcatcccctccaatatttgagggcaattgcctaccgaatgcctgatccactctaagtgccttaatcatttatccacaccatttaattttcaacctaattcctgggtttattttttaaaagcgaaatttggtgtccaattttcctttagtgtccaaaattccggcggtgtccaaatttctgtttggtgtccaattttccggtgtccaatttaccggtccccggaaattgttccaaatta

SEQ ID NO: 57914 - DNA, 1223 bp, Heterodera glycines
  Genomic contig location: Contig_ID=SeqID_639; Location=565..1787; Strand=-
  SCN-specific regions: Sequence locations=1-371,404-427,449-736,759 -776,798-962,1034-1089,1111-1145,1167-1223
  Gene Ontology: Mol. function=protein binding; Cellular component =adherens junction; Biological process=negative regulation of cell proliferation
atgggccgaatgttggaatggctaactgagcatggaaagcctctcagagtgaaggtgaccacgatggacgctgacctgaacgagctcagcattgaggtcaaatataattatttttatgtgaatatgcgattttaaatttaaatacgaatattaaaatctctcatttttcagagggattcgctgggccaacatctgttcgacaccgtatgcaaaatcatcggccttcgggagatatggtattttgggttgtgcttcaccaaccgcaaaggcttcacctgttggcttcaaatggacaaaagggtattcgcgcaaaaaagcgaaaaataaatgttttatcaaaaaaaaattttattgtttccaccgaaatccagcaaaaattccaaatatatttttaaaatgtttaagtttccatgataaaatcacggcgattaattataattaattaattggctttgcatttgcccattttccctccccaacagataaaagaccaaagcgtgccgaaacaggaggacggctcgctgcacttcctcttcctggtcaaattcttccccgagtcggtgaaggtcgagctgatccaggacctgacccggcatttgttctttctccaaattcgccagtccattctctccatggatttgtactgtccgtcggaggcggtaaaaaattgctttttagaatttcaattttggttttcttttcttcttttacatgcgtagttcacccgccccattggtttaaatattttttttattattgtaatgtcaaccgggactggtcccgggacccaggcttttccggtcccggcccccctagatcctaatcctggctttcaatgttcctgtgaattcgggcactgtttttccaaaaatccctatcccggctaactctgccattttccaatgttctaggccattcttttggcttcctatgcggtccaggcactgtacggagacattggccaacaacaacagcagcagcaaccgcaacaacaacagcaggccgatcagcaacaacaacaacagcagcaacagttggatttggccaaactgttgccggtgtcggtgctgcaacaatacgaactgacggccgaaatgtgggaacagaaaatccgcaattggtgggccaacaacagcggactttcaaaggaggaggcggaagaggagtttctgtgtgtggccgaggagttggacatgtacggcacacaatactatccgattagg

SEQ ID NO: 57915 - DNA, 1367 bp, Heterodera glycines
  Genomic contig location: Contig_ID=SeqID_5405; Location=767..2133; Strand=-
  SCN-specific regions: Sequence locations=1-183,205-298,320-325,358 -372,394-911,933-958,1025-1042,1068-1367
atggaccaaaaaaccatttttaaccaaccgtgcaactcattgtcgatcctttccctttgtcgtaatgtgccccgaggcaatgaaattcgcatatttgaggccctgtaacttttgaaggaggcaaaatgcaccgctaaaattaaaaattcacaatagaagtcgaccctgctctatccaatgatatgtcatttatatgcattttcttagttacagctcggaatgttcccctgtgagactgacaatgaacaattccctcccacttcccgcactcatgcacagcccaattttgtgcttctgctttcgttggtgttttgtttttgctcttccaatttccgcttttttggcctttccctccccgaggggatgtgtggtggcggcggtggacggacatcatcaacggaggacaacggggattccccccccccccgccttcctattctttctttgctctgctcatccatctactaccaccacctttccaactggtgctaggtcgatcctaaaatagtatcaatggggcgttcctaaaatagtatcaatgtgggcgatcctaaaaaagtatcaatgtgggcgatcctaaaatagtatcaatgtgggcgttcctaaaatagtatcaatgtgggcgatcctaaaaaagtatcaatgtgggcgatcctaaaaaagtatcaatgtgggcgatcctaaaatagtatcaatgtgctaggtcgatcctaaaatagtatcaatggggcgttcctaaaatagtatcaatgtgggcgatcctaaaaaagtatcaatgtgggcgatcctaaaatagtatcaatgtgggcgttcctaaaatagtatcaatgtgggcgatcctaaaaaagtatcaatgtgggcgatcctaaaatagtatcaatggggcgttcctaaaatagtatcaatggggcgttcctaaaaaagtatcaatgtgggcgatcctaaaatagtatcaatgataataattaattaaaataattattattcaattaaaattattaaatttaaattatttttaaataatgtcaaattacagtgaataattttaacattttgttaaattttttgcataaattttggcttccattagaaatacgtcattgtttgagttccgtaataagatacgaaaaaatgcggcgaaaaaaaaatgctaaaaatgggtgggaaaacaaacattagcgtttcaaagtgcatatagaaatctgtatgcctttatgcataagttgtccatgtagttcatcaagtgtctttatttcctttttttcatagcttttgacaagtgatattgcttgaggattttttacgaatccttcaaatccggatttatggccttcaaaataatcaagtaaaattaagggaaaaataaa

SEQ ID NO: 57916 - DNA, 701 bp, Heterodera glycines
  Genomic contig location: Contig_ID=SeqID_27222; Location=102..802; Strand=-
  SCN-specific regions: Sequence locations=1-308,349-367,396-492,514 -678,700-701
atgtatgtttatcagaagaaaaacaatctgcaaagaatatattttgttgaatggaaagaaggtatacttgatttatttaaaattttgagaaaacaattttttagaagttaaattttttatgctaattaatttgaaattctctaaatacttggattagattatacattgatgaaaaaaaaatcaatctttaaataagaatataacataccgtatttgctctaattatccaccatgggggattatttttcaatctcctcagaaaggggtggataattagaaaaatacggtatataccttgaaccataatcaatttaaatacataaatttaaaaaataattttatatttaacttttcaatatgaaatgaaaattcattaaatgttgattttaaatcagggcttacaattgaatttatttctcaaaattgtgctcgaataaaaaaaccataaataaagccatttttttgtacaaaacgattcataaaaatagtgccaaaaatttaaaattttcaaaattagataacgaaacacattcatgctgggtcctaactgaagacactgaggcacttgaactggtagccaaattcattgaggagtgctcaatgagttcggcacttgatgcctttttgggtgctccagtaatgagccacgtggcaaaactacttcaaaaaaatgacgaagcaatttcatgtacttaaataaa

SEQ ID NO: 57917 - DNA, 498 bp, Heterodera glycines
  Genomic contig location: Contig_ID=SeqID_27223; Location=641..1138; Strand=-
  SCN-specific regions: Sequence locations=1-12,35-46,87-93,115-191,301- 424
atgtgttagtccgtccttttctttaaaaagctgtagcaatcattggtaattttatttatttattgataaattaaaaaacattttttgctttcaataaagattaaataatgtaaagattttaatttggagattccgcatatagtttaaattaattaaataactgaaaaaggttttgaaattcttgtcttatctaaataaaataatattaaaatttaatcaattaaattaattttgtaaatttaagctaaattacaaaattatttaatttaaaaaaaataaatttaatttatagattcaattggaccgtttccaatcgggtcggttatcggcttttcgattcttaaaagtcggtcaaggtcccatggaccgggtctagaaaaagccgagtatccgggtctggcccgggtcagctacatggactcggaattaaaattaaaaatttagaatcgttttttaatagttattttacaatataatgtataaatttttaaaaataaa

SEQ ID NO: 57918 - DNA, 132 bp, Heterodera glycines
  Genomic contig location: Contig_ID=SeqID_27224; Location=305..436; Strand=-
  SCN-specific regions: Sequence locations=1-132
atgccttatgtggatactgtacgccgaatcagcagagcgagaagtgaacggggtgccaagcgagtgcttgtccagaaaggcgcaggatttggcggattgttcgctgccctattgacacccgttctaatggaa

SEQ ID NO: 57919 - DNA, 657 bp, Heterodera glycines
  Genomic contig location: Contig_ID=SeqID_27224; Location=1386..2042; Strand=-
  SCN-specific regions: Sequence locations=1-155,178-357,384-614,637-657
atggcaattaatatttgcgacaagaaagcgcttgtgaatcaaatcctcgggcaagcggacattacagtgacaacaagcggcataaccgtgagtgggccacgtctgtccacaccacggttcattccgttcgatgaatgcggccgttgccgcgcatgtaaagctacagaggttgaggtggacacaatggtgaccaaagaggggatcaccttgtggtgcagccgggtcagcaagtcccaattcgtcccatttgatgccgtttatgatctgccgggccactgcttcttccgtgtgaaaaacaaggccagggtgttcaacgtaccctacggtgacctgccctccgacacgtgcaccactcctactcccaccaccaccaccactacaacgcaaggaacggaaaccgatatgcagcagcaggacctgaagcgcaaagctaaggtagcacttgatttagtggaagccgggctaatggcccgatgccatgcaggacggcgtgcgttggaagaaggccaaaaccgcaatcagtgtactcgggaatctacttttagcggaatcgttggacaacaaagtgacaaacagtcccgtggaggaacagaattatgtccaggaagagcccagaaaagacgaagagaaaaacaaggaggaccttggcgacattga

SEQ ID NO: 57920 - DNA, 126 bp, Heterodera glycines
  Genomic contig location: Contig_ID=SeqID_27230; Location=740..865; Strand=+
  SCN-specific regions: Sequence locations=1-126
atgagagagtgctggatctcagtcccagtcatacaaaacatttttgatgaaggaggtagagaaaacaatttcaatagagagcgcaatgggaagggagttcatgtctcttcttcgctgattcttttg

SEQ ID NO: 57921 - DNA, 100 bp, Heterodera glycines
  Genomic contig location: Contig_ID=SeqID_5407; Location=23..122; Strand=-
  SCN-specific regions: Sequence locations=1-100
atgacgattggatcatcagtcattacctacgtaatccgtcatgacggaaaggcgcaggaaaaaccagacgataggataacccgtaatccgtcattacgac

SEQ ID NO: 57922 - DNA, 777 bp, Heterodera glycines
  Genomic contig location: Contig_ID=SeqID_5407; Location=218..994; Strand=-
  SCN-specific regions: Sequence locations=1-214,236-621,643-719,744 -752,774-777
atgtcacgcggtgcaccgttcatcccgaagaatgcggtgctgatacagaacttgaaagcagcgatggctgccggcacattggcagcgttcggctcaattcccaacaatgcgttggaggaaattgacaccctgctgactggcgcattcaaaaaggattttgcagcaatttatcgtaattcgcgaaaagttaaaaccaatgcactgaagctggccgaattggacatagaaaatctcattgccaagcatcatccgctcagcaattttacatggatggcaataccatttatgctgccagccaacattgtgaggagagcggcgcgggcaggcaccagaggagggctggtcccagggggggggggggaccctctccaaaaaaatttgctaatagagctaaaaacatccgaccgaaaacaatggtgtttggctacaccattggtcccgagcgacatccgcgaccatttcattttttgaaaattctacaattttgcaattaattagttggcaaccgccacatcggccgcaatgattccaatggaaattgccgacgcggaagagaaaaccgtagagaatgtgctcagactgatcagaaacggcatattagccgggccaacccaggccaaactggagaaagccaaggaagagttagcggcagaggagaagtggaagcggagaaatgtgttcagaccgatcaacatggtcaaagaaatcataaaaaagcgtaatgaggaaaaagaaagaaagacaatggtgaggaaggagagcaggaagaggaagtga

SEQ ID NO: 57923 - DNA, 2509 bp, Heterodera glycines
  Genomic contig location: Contig_ID=SeqID_5408; Location=572..3080; Strand=-
  SCN-specific regions: Sequence locations=1-85,107-194,224-279,317 -1321,1343-1414,1436-2140,2164-2187,2210-2509
atgtggagtacgcacacaaaaaatgagtccaatgcggagttgatagaaaatgtaatcaaggagcatccggaaatgctgaccgaacagaaaagaaatgaaattgaaatgaaagcggacaagtgagcgcgaacagaaaatttgtcccatagaaattgagagccgaaaaattcagttcctcaaaaaaggatcagtagaacaatttaacacatttgaaaaatgcccaaaattttgcacaaaaaaacacggagcagggcaaaacaccgccgccgaaattccgccaaaaatttttaagaaaaaaatattagaaaaattttttcttagaaaattcgaagaaaaaattctaaaaaatttccagcgattttttcaaaattaatgatgaaaaacaaagttttttcaaaaaaatttcaaaaaaatcgttggaaaattctttgaaaatatttttatcttcggattttatgtgaaaaaatttttctaagatttttttcttgaaaaatttctaagtttgaaaattttttgcccggcggagttatgtctcggcggaatttcagcggcggaatttcggcggcggagatgggagaaccacaactagagacagggaaagatataaaagtcggtggatcgggaccgagacgtgaaactatcggctcagggttcgggaggggacgaataaaagttctgatcggggtcctggacgcgaaaatattgggtcggggttcgtgtggcagcttccaaaaaaaaagttcgtgtcgggatttgagacgagaaaatatcgggccgaggttcggatgtgaacgtccaaaaaggctcgggtcgggctttgagacgcgaaaatattgggtcggggttcgggtggcagcttccaaaaaaatttcataatttaaaaaacttttcacagaaaaatcgaaactttgaaaaaattggaaaaagtgcaccaaacaatggaagaggagcaaaaaaagttgagaaaggccatggagtttctacggccgcagaaggtgcacccgttcgactttttggtcggcactgttggcattgataagaaaggcagtaaaatcccaattggtggactacggcacaaaataagcggacggagcgtcaatgaaaagaaatatttggaaatgttagacatgccgagagccaaagaagcgatggagagtgagaatgagacatgccaagcattggccaaattggtggaacagacactgtacatagatgacaacggtgtggtcgacccgcaagtgggtagaaaaaaatcaaagaattttgaaaatggaaaacagtcaagcatagaattggcattttaaaaaaagcctgacatggagctggattccaagttggacccggactgggatttctagacaaaattccagcaatattccatgccaaggaacagccttgttaaagcctgtacccaggcctgaacctggggaaaaacacagtctcagtaaatcctgccttgttaaagcctgttgtacctatgactggacctgggaatttttttttcactagttttcgggcgaaaaagatacgggcgagcggaggggatatatgtattttttgaaatttaggcctgttcctggtaaaagatttttaaatgattgtacaaattttagggcgtcgaattgcgcggccgtttgggtgcgcaaattgtgaactatgtgatcaataagaaggatacagtcgggttgctgaagcagttgatgtggagcgtcattggcacatcagcaatcgcattgttcttcgatctctttttgtggcctacaattatcagtaaggatttatcattgaattgatcactactgattagtgtgaattaaaatgtcgggtacttttgcagtttacctgacagatttcacatacattttcaaatgcctataaatgtgttttagaaattagtgaaaataagttttaaggggttttgggggtcgctgatcacgaatcatccgggctcagatcagcactaccgttcactacaagagctgtacaaggacaaagaatttataggcttactgtaccaataataccctcattggcaagatgcccatgaggatatcatccatacaaatttagaattttatgattcatttaccaatgttaccctcattggcaagatgccaatgaggatatctatcatccatacaaattttctaattttatttttgttcgagtccgggtcaggggttcgaaatttgcaaaaaatatggatttattcccacaaatacatggaaatccatatttttttcctggactgtgggaggcctgaaacgcacgaaaaacatgtttttagcttggtttggagcttctaggatggatttctatatccatatttttccatatttcgcgatttatgtccatattttcgcattttcgtccatatttttgggatttttccaaaaaacctctattagaacggctcccagcagctaaatttgcccttttgagcccaaaaaccgaaaaattttacaaaaaattattttttcgccaaattttctcgagaatattgaataaa

SEQ ID NO: 57924 - DNA, 1674 bp, Heterodera glycines
  Genomic contig location: Contig_ID=SeqID_5408; Location=3482..5155; Strand=-
  SCN-specific regions: Sequence locations=1-892,928-1515,1538-1674
atggcaaatccatcggttcagcaattgatggacatggttaagcaactgcttgaagcacagcaaaatgcgccaccagcaggccagcaaccatccaatgtgccgtctctaccgaatgtggaaaacttcgaatttggagagcaaagcaccgacatcgaggactggctgcagcaattcgactttgctcttgactgtgccgcaccgaatttgcaagatatgctgaaggtgaagcttctcatgacgaagctcagcaaggaagcgtttgccgaatacaaaaagtcctgcataccgaaaaatgtgacagacttcgacttcgcgaagactgtggagcagctgaagagtttgtttgccaggcctcagtccatttggattgacagatacgactgcctgcgtgcatccaaactggaagacgaggaattcagagcatttgtgaaccgacacaaaaggctgttaagggatttcaacttcaagaagctgaaagaggagcagtttaactgcctgatgcttctgatcgcaatgaaatcgccgaaggacgcggacctcagaaagcgaattttggcaaagttggcagcagatggtgacctcgttcggtacgacaacatggtggaagacctgcaagtgtacctgtcgaccattgccgaggctaaagcgcttgagcagccggtgtcttcgagaaatgtttatgctttgaaaaagaagcataaaattcgaaagaattccgactcgtcgaaagggagcagcgaatcgtcagcaagccaaaggagccatggatcgcaaccgaagtgttggcgatgcggaaaatggcactctcccaagcgttgttcgcatggaaagtccacctgccgaaagtgcaatgaaattggacatttggagagaatgtgcgagaagcacaaggcttggcttaaaagaaatggggagaaaaaggatggaaaagccgtaaacacatttcggcttggaggaatttttctgccggactcagaaagtcggagaaaattgatcgagatcccgctgaagatggatggcactgaagtggaatttgttgctgattttggcactgaaagaactgtggtcacgaaggacgcacaccgccaaatcggaagtccatggttgagccgttgcactgaacgggcaaaataccacgacggatccactcgccctcttttgggaaaagggcaggcaaagttctcgatcggtgatcgctcatgcgatggacaattctatgttgccaaaggaacaaagaatttgcttggcatagacatgcttcacagtttgggactgttggatagcttcaggaagagcctggaagggaatgtccaagtggcagaagcaaacacgaagtccgattcaactgatgctcaaagtgaaaacccgaagaataaacaccgcggaaataagccaaaatttgctttgggagcaaaggtcattgctagtttgggactgcaaccttggcgcgctggatacgtcgttaaccgtcaagggacgatgtacgaaatccgttttccagatggaacaaccggcaaattcccagaaaaaggtgtagaggcatgtgttttggactcggacgaagaaatttttgatggtttggacctaagagaggcaccattcgatggaaaaacgtcgaagggcttggtcggcattgattgtgaccagcgaaagcgtgaaaacgtgatcgcctga

SEQ ID NO: 57925 - DNA, 1103 bp, Heterodera glycines
  Genomic contig location: Contig_ID=SeqID_5409; Location=126..1228; Strand=-
  SCN-specific regions: Sequence locations=1-673,695-892,928-1103
atggcaaatccgacggttcagcaattgatggacatggttaagcaactgcttgaagcacagcaaaatgcgccacaagtaggccagcaaccctccaatgtgccgtcgctgccgaatgtggaaaacttcgaattcggagagcaaagcaccgacatcgaggactggctgcagcaattcgactttgctcttgactgtgccgcaccaaatttgcaggatgtgctgaaggtgaagcttctcatgacgaagctcagcaaggaagcgtttgccgaatacaaaaagtcctgcatgccgaaaaatgtgacagacttcgacttcgcgaagactgtggagcagctgaagagtttgtttgccaggcctcagtccatttggattgacagatatgactgcctgcgtgcatccaaactggaagacgaggaattcagagcatttgtgaaccgacacaaaaggctgttaagggatttcaacttcaagaagctgaaagaggagcagtttaactgcctgatgcttttgattgcaatgaaatcgccgaaggacgcggatcttcgaaagcgaattttagcaaagttggcagcagatggtgacctcgttcggtacgacaacatggtggaagacctgcaagtgtacctgtcgaccattgccgaggctaaagcgcttgagcagccgatgtcttcgaaaaatgtttttgctttgaaaaagaagcataaaacgcgaaagaattccgaatcgtcgaaagggagcagcgaatcgtcagcaagccagaagagccaccgatcgcaaccgaagtgttggcgttgcgaaaaatggcactctcccaagcgttgttcgcatggaaagtccacctgccgaaagtgcaatgaaattggacatttggagagaatgtgcgagaagcacaaggcttggcttaaaagaaatggggagaaaaaggatggaaaagccgtaaacacatttcggcttggaggaatttttctgccggactcagaaagtcggagaaaattgatcgagataccgctgaagatggatggcactgaagtggaatttgttgctgattttggcactgaaagaactgtggtcacgaaggacgcacaccgccaaatcggaagtccatg

SEQ ID NO: 57926 - DNA, 1206 bp, Heterodera glycines
  Genomic contig location: Contig_ID=SeqID_5409; Location=1915..3120; Strand=-
  SCN-specific regions: Sequence locations=1-424,460-1047,1070-1206
aagctgaaagaggagcagtttaactgcctgatgcttctgatcgcaatgaaatcgccgaaggacgcggacctcagaaagcgaattttggcaaagttggcagcagatggtgacctcgttcggtacgacaacatggtggaagacctgcaagtgtacctgtcgaccattgccgaggctaaagcgcttgagcagccgatgtcttcgaaaaatgtttatgctttgaaaaagaagcataaaacgcgaaagaattccgaatcgtcgaaagggagcagcgaatcgtcagcaagccagaagagccaccgatcgcaaccgaagtgttggcgttgcggaaaatggcactctcccaagcgttgttcgcatggaaagtccacctgccgaaaatgcaatgaaattggacatttggagagaatgtgcgagaagcacaaggcttggcttaaaagaaatggggagaaaaaggatggaaaagccgtaaacacatttcggcttggaggaatttttctgccggactcagaaagtcggagaaaattgatcgagatcccgctgaagatggatggcactgaagtggaatttgttgctgatatgggcactgaaagaactgtgatcacgaatgatgcacaccgccaaatcggaactccatggttgagccgttgcaatgaacgggcaaaataccacgatggatccactcgccctcttttgggaaaagggcaggcaaaattctcgatcggtgatcgctcttgcactggacaattctatattgccaaaggaacaaagaatttgcttggtatagacatgcttcacagtttgggaatgttggatagcttcaggaagagcctggaagggaatgtccaagtggcagaagcaaacacgaagtccgattcaactgatgctcaaagtgaaaacccgaagaagaaacaccgcggaaataagccaaaatttgctttgggagcaaaggtcattgctagtttgggactgcaaccttggcgcgctggatacgtcgttaaccgtcaaaggacgatgtacgaaatccgttttccagatggaacaaccggcaaattcccagaaaaaggtgtagaggcatgtgttttggactcggacgaagaaatttttgatggtttagacctaagagaggcaccatccgatggaaaaacgtcgaagggcttggtcggcattgattgtgaccagcgaaagcgtgaaaacgtgatcgcctga

SEQ ID NO: 57927 - DNA, 160 bp, Heterodera glycines
  Genomic contig location: Contig_ID=SeqID_27232; Location=314..473; Strand=-
  SCN-specific regions: Sequence locations=1-56,78-125,150-160
attttctaagaaaaaataggagttttgggggcgcggcggtgccgataggcgccgccggggaaaaaattggaaattttgatcatttataaacagtttttcactgaaaattagccaatttataggtaaaattttgaaaaattttatgggaatttaatccaat

SEQ ID NO: 57928 - DNA, 704 bp, Heterodera glycines
  Genomic contig location: Contig_ID=SeqID_27234; Location=828..1531; Strand=+
  SCN-specific regions: Sequence locations=1-55,90-260,282-298,320 -626,651-704
atgacaaaggctttgcgaatattaacaaaaattttagccgcggtaattagtttcgtttaaaattaattttcatttttatttttattatagcaaagtgtcattggcttggctaacggttcctctaatcatccttgtcaatctacaaatgtagcagataaaaaagcgtgtcacaatgctttaaacctaattccgagtcaatgtaaattttgcataaaaaatttgcttaaattgagaattacatattcagacaaaaaaaaaattgctgaatgaaatcattatagatggaaaaagacaattttttagaaaaattatttttgtggtttttttgacaaaatttacctaatttatgagaaatatgtttttgatattatgagaattttttttagaaacttttctgtctttatgggtccaaggagctgctttaatagaagggccgttttaaaagagatttttttttaaatttacaattctgcagataaaatgtgcgcgaaatgtctaatatctacaaatatgcaaacaatgcatataaaaatccaacccaagcaaaaaaaattttttcgtgccttttaaactgtatccaatgcagaaaaattgcatgagtaattccaaaacctacaattactctttatatatatatatatatatatataaaaaaatatttttaagctaactttcgaacaatttattctattcactatgaataa

SEQ ID NO: 57929 - DNA, 486 bp, Heterodera glycines
  Genomic contig location: Contig_ID=SeqID_27238; Location=57..542; Strand=-
  SCN-specific regions: Sequence locations=1-79,103-130,157-274,331 -447,469-486
atgtcgtcaaaacccgaaactttggtggagcggatgaagcatttgttgagctcgggcgatgacgcggacgttctctttttggtgggggaaggagagggaaaggaggcgagttttaaggggaaattgttacaaatttaataattttaatttaatattgttttctttaagcatgtgcccgcgcacagagcgattctgaattcggcttcggacgtttttgaagcgatgttccgttttgacaccacaaaaaatgcgactgacaatgaatcagcgggtggagaaggtgtgaaaaaacaacaaaaaattttatatttaaaaaaaaaaatttaatttgaagcgaagggtcccgtagaagtcactgacatcgatgcgcatgtgttcaaagtgatgctcaacttcatttatgcggatgatttgagtgaattgaatggagacaacgcaatggcagtgctttacacgggtcagaaaattagttttttattatgttga

SEQ ID NO: 57930 - DNA, 860 bp, Heterodera glycines
  Genomic contig location: Contig_ID=SeqID_27239; Location=359..1218; Strand=+
  SCN-specific regions: Sequence locations=1-447,476-515,542-860
  Gene Ontology: Mol. function=transcriptional repressor activity; Biological process=negative regulation of transcription
atgcttggctccgctggcggcgccgcgtcggcggtggcgtcgcgccaccgacgcatcaccacggagcggtcgctcttgccgctgtccacggacattgcaaagaaccgcgagttctaccgtacccacgacgtgcgccctccctacacatacgcctccctgatacggtaggtgattacggtgggagtcaaaaaggtttccgtaaattgcgtttggctctgatcaggatcagcagcagatttaatgaaacaatttgccgggttaaatcagaggcccctggtcgggttagacacaaagttcaactttttggaaaatgcgggatttgcgtgattttgcgggattggtccctgcgggatcccgtcccgcaataaatttgagttccaatcccgcagtgggacccgcaaaatttgaaatttcctggctctaactgtcagatcagacgaaaattcacccaaaattccccttttttaaatttttgtccataatattaaccgcttcaaccagccaattggatttccatcatttgtttgctttttgtttcaggcaggccatcaccgagtccaaagagtgtcagctgacgctcaacgaaatttaccaatggttcaccgacacttttgtgtactttcggcgcaacgcggccacgtggaaaaacgccgtacggcacaatctgtcgctgcacaaatgtaaacaaaaacgaatgaatgatgtgccatttttggggctctttgttctccccgagtgtttaatcattcccgaaattcgcttcccgaattataggaaactgtagaaattatttccccttactcgataaatttttgtcataattcttcacgcgttcattcccgacaattatgtagccccaa

SEQ ID NO: 57931 - DNA, 487 bp, Heterodera glycines
  Genomic contig location: Contig_ID=SeqID_27240; Location=650..1136; Strand=-
  SCN-specific regions: Sequence locations=1-35,57-188,211-458
atgccctcactaatcgatgttttgttgctcgtccttttcttttttgtcttaattggacctccgttccctgatgagcccgtatttgagcggggtcttcaaaattggatggatgcgcgcattcaacatttgcaaaacagttagttttgtttgtatattccaaaaaatgaaaatctatgcagccattcacgcgccgccaccgccgcctccccaagcggagggggaggaacagggcgaggagttggacgagaacgactgggccaacccatggcccgaaaattgggatccaaagattttttggtaataatgttatcccctcccccatttcaaacaaaaaaaaatttagtgagatggaccgacgaacgaaatggggggacatatcgaatgatcgaaacagaacgacgagtgatcactggtgatcaatggtaatattatttattaattatgaaatttcttactttttctccgtttgtttttccttttgaataaa

SEQ ID NO: 57932 - DNA, 2816 bp, Heterodera glycines
  Genomic contig location: Contig_ID=SeqID_5411; Location=9..2824; Strand=+
  SCN-specific regions: Sequence locations=1-6,28-224,246-272,294 -1055,1077-1468,1497-1514,1537-1810,1832-1853,1875-2697,2719-2816
aaatcaatgaagttgtcataatccatgatgagaccccaagagcaatgtggaaaacaggaattattaaaaatgtcataacaggaaaagatggtatcataagaggagctaatgtcgagttaccaaacaaaaatgtcattaaccgtccattaaaattgctatatccgttagaaattaacaaaaatgacggtgaggagaatgagactctcacaaatttaatcactgatcacgaacaaattggtacagttcaaaagagaaaacaagcaagtgtcttatcatcaccaaaattaagcaaagtatttttaaacacactcacgtttcttctattatttatgcaaatcttaccgtgcttatcatacccatacgaatgtccaagaaataatgaaaaatggagaactaaatatacaacattttgtgtaaaaaatggatttaccatcagacaaaataaattaacaatggaattttgttaccgtaaaatattttgtcacaatcaacacatcataaaaaatcatccaccctattgtggaccacaatgcaaatgtcctgattggacaattttttgtagttttgcctcatatcaccgaataaaaagagaaataactgatcaggagaatattcaaaatattatttcattctttaaaccaaacgtttgttcattcaataaaacggtaaaatgctccctaatggataaaaatatatttagttcaataatgctttatgataatagcattcattcagttaaaagtcttaatttacttcatacacaagccaattctcgaattgattatcgttgccttggggagggcaatctgacgattggtacacaaaaattctgtcaagaacacgaatgcactgacaaacatggaacaaaattttgcttttacgagccacacgaaaaaacttatcttgtgaaatcagaccgagaaattatcccaataaaagcatggggaagcatcgaaagaattttttatttggctaatgacacattaatggatgaactcaaacgtaaaaaaagagaattcgatccgttcgaaaacgaacaaatatccgctgaatgtataaaaggtggaataaaaataaacccaactcatgctaccacggaattagaaattttggttgataaatattttatcctaaaacgaagtccacagagtgaagaatttatttctctacctacaaaaattactatgaacgagtataaaccagtcattaaatttattaaaggcacaagctcacctgagtacaaaaacttaacatgctctccatcaccaatctgtgaattaattatatgtcgtttctgcatggaatacattcgaaacccacaatgcgttggtcaaatgcattgggctctgatactaatcatgataatgctcacactttacgtcattactctttgtcttaaaattataagaatactataccgcttcatcgtttttatttttctatcagtctacaattgctgtagaaaaagaaaattaaagaaaataaaaataattaaacggaaacaatttatttatttaatcatgattagccttttactcaattcaccgactattttttcatgtgatgaagtcactaacatggtagcaggaacaaacgactgcgcaattgatcaaaacggaaagattgaatgtatttacgatcaaacaacccaaatttcaatcacaccggaacacaaaacgtgtctaaaacttgacaatgaaaaaatgcacagtacgatagagacaattgaattatctgttgaaagtctgacaataatttgtgcagagagatctgaatattttatgcgagattatgaattactatcgagttcgcaaaagcgatgttcaggcgccggaaaatgcaccggtcaaatatgtcaaactttaacaatgaaagaaaaaaatcctgaaatcggtgaccatgccaataaacaaccaggatattcctattgtgtgccttcctgcggtggttggcactgcaaatgttttcttgtcaccgatggatgtttattttatagaacatataccgagccaatcaatagaaacatatatgaagtggtcaaatgtccgacttggacgattttagctacaatcaaaatttcgcttgatccaaaaaccatacatactgtggaattaaaacctggtgtcttaacacatgttaaagactcgaatttatctctgacactcacctcaacttcaattccaccaacgccactatttggatcaaaatttataattgatcgttcaaacgcaaaagctgtaatagttgataatgagaatttacttaagaatagcctacggtgcgaaactaaagaaaaggcgacaaaattcagttgcacattcccaccagaagcttgtcaatgtcacggaggtgactccgttgttcactgcgaatgtgagaaaaacccgctcactgaaatgttcacaagaaaagataatattttgcctctcgagacacaaggaagccaagtattcttcgacactttattaagggcaaaaataaaattaacaacttcactacaagtgcaagtcacgctaaaaggtcacaaagtcaaagcaatttacgacaaaaataattgtactgtaaaaacaaaatcgttagaaggatgttactcatgcaccaatggagcagaatttaaatttacatgtacaactaactttggtaccgcattggcaaatgtaaaatgccatagtcagaattttcaaataccctgtgacacaaaagggaaccaacagcaaattcagctttcctttaatcaaccgagtgtaaaagaaaaatgtgaagttatatgtccagatgaaaaaagtgaaataacaattgaagccactctgaattat

SEQ ID NO: 57933 - DNA, 566 bp, Heterodera glycines
  Genomic contig location: Contig_ID=SeqID_5411; Location=4343..4908; Strand=-
  SCN-specific regions: Sequence locations=1-325,347-566
ggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtcttgaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatac

SEQ ID NO: 57934 - DNA, 983 bp, Heterodera glycines
  Genomic contig location: Contig_ID=SeqID_27249; Location=667..1649; Strand=-
  SCN-specific regions: Sequence locations=1-259,281-316,354-457,479 -593,615-809,831-952
atgcttctcacatttttgaaagatcgaacggaatttgagcaattgtgtaaaaaattagagacacaaaagcttctaaaaaacattgaattggtcgcacaacgtaggggcaatggtgtgtacgatattggaggtactgtagaatatttggcacaaaaatacagcgcttattttggcgctgtgtcaatgatgagagataaatggcaatgcgacgaaattgagcaggaaaaacggcagaaagaatgtgaacgatttaagaaatatttgacaattttgtataaacatttgttcaatgtgtacattgaaggtatgaaatttgaaaaataatttaattattaaaaaatttaaaaattaaagtttctgaccccgaattggcgcaacaaattgccgcggtaaggccaaattttcaaattgccaactcgaaaaaggctgcaacaattgtcgatgttttggacagtttgtgccaaatttgggccttttatttcggcacgaaaaacggcgaaaaaaacgaaaataaattggaaaatttattcaaaaattcgtttgaattgaaattgctaaatgagaaggaattggaaaatgagaagccaacatttgggcaaaaaattgaagaaattgttgaccaaatgaacattcctgagggttttaagcaaataattaagggcaccaaaacaaatggagaaaagggaaaaagcgaatttgaagaaagggaagggcattttggaacaaatgaaagccgaataaagtcattacgggagcaatttgaagaaaagatgagcgaaatgacaaaagatcgaaaaatataaatttaaagggagggaaaaattaatgaaaacaaaccaaagtaaaattgtatttgtatctttgtgtttaattgaactgtcaatgcttttttatggttttcaatggctttctttctataagcactttttgtttcctttttgttgtctttttgtaataatataataattattctttttaataaa

SEQ ID NO: 57935 - DNA, 599 bp, Heterodera glycines
  Genomic contig location: Contig_ID=SeqID_27250; Location=143..741; Strand=-
  SCN-specific regions: Sequence locations=1-11,38-102,124-279,302 -326,353-566,591-599
atgccattggtccttctgtcctttgtccttctccctctgtttccctttctgattgtcgtcgctgtttcccgattatactttaaccgaaggcggtccgttctcttttcttttaaaatgttttcccggaactgaatttgaactatcgaaaaaccaaatttcacgaatttcgcattaatgtataaaaccagtcaaatcgggactcgcaaatgtacttattctctgtaagatttgtgcttatttggagtgaccaatctaaaaatttaaaatacccctatttctaattgtctttattttgaggggctggttaatcattttgattttgttggatttttaaaatttatttaaattatttggtttggccattttttcctaaaaacacctttttcggctttctaaaattctattttagggtctctggcagttttgccttttttcacccgttttgtgacgcgagcggaggcggagaacgtgttttgtggttggcaatcaacgcactgcagaaaaagttaatcacaaaagcttatttttcaaatcatatttagttactttaagtttgcgcggttgtgaattttaaatttattttatattatcacattaaa

SEQ ID NO: 57936 - DNA, 789 bp, Heterodera glycines
  Genomic contig location: Contig_ID=SeqID_27251; Location=360..1148; Strand=+
  SCN-specific regions: Sequence locations=1-252,276-623,646-646,676-789
atgcgaaactctaaaaatttgaaatttcgactttttgttcgaaatcgggtccatggttaggatttgggtcgaaaggatatcagaatcggattcgccgatcctaaaaacccataaaatgactttaatctctagaaaacaatttctttttttcgaaagggggggggaaccattggcactattaccgggctctggctggttaaaagtatatacagtaatcaaattctgctagtctaattttggtcgaacacttctaaaatgaaaaatgtttttaaaatacctaaatgataattgtaagcaatttgacgcatatgaaaaaagggatacttacgtaaatttatttcagtggtataaaacaaagttggaaaatattgatcataggccccaaactcaaaaatgcttaaaaacggtcagaatcgatgtaaaaaggttcgaaatgggttggaaaaatagaattaggggcgcgcttgccctttttcaggctgaaaaagtgccggaattggagtgccaaactcagctgggactcaagtgaccgcactataaaaagcactcaaaagacattttaaataatctttctatggtaattttttttcgctgatcacgaatatgacctttattttgcaaaattccaaaccccgaacccaaattcgaacaaaaacttaaaatttttaaattaaacgaaaacatattatagggggttttgaggttgctgaacacggttatgacatccattttgaccaaattcgaaccccgaaccctaattatgagcatgttggtcctcaaaatcattaa

SEQ ID NO: 57937 - DNA, 1080 bp, Heterodera glycines
  misc_feature (958)..(958): n is a, c, g, or t
  misc_feature (1004)..(1004): n is a, c, g, or t
  Genomic contig location: Contig_ID=SeqID_5412; Location=451..1530; Strand=+
  SCN-specific regions: Sequence locations=1-237,259-759,805-828,864 -1045,1067-1080
atgccaaaatatggacataaatatggaccaaaatgccaaaatatggaaaaatatggaaatatggacataaatcgcgaaatatggaaaaatatggatatagaagcttcaaaccaagctaaaaacatgtttttcgtgcgtttcaggcctcccacagtccaggaaaaaatatggatttccatataattggactccctagttatcaacggcataaattttctaaaaaaaactattttttgaaaaattctgagtgaaaattatctactcaaaaacaacgtgcctccccccgtggtcgaaattcgaaaaatcgttttattttatttcatacataggctaggcataagctttagacctaggcttaggcctaagctaggcttgtttgggcctacataagattaggcattatttagtaaaaaaaaacacgaatacacatatttattttacatatatgcaaccgcgcgaaaacgacccccgcgcgaaaacgacagcgcgaaaacgaacctggcgcgaaaacgtcagcgcgaaaacgacggcgcgaaaacgaccccgaccgcctcctttcgtccctaaaaacgagaggcgagagtccaaaaaatggcgagagttggcaagagacgagaagcgagagttgtcccgcccctgttatgatgtacatatttttatacattttttggagtctttcgtacatattttcattttttacatattttgagatgatacatatttctggatttttgtacatattccatatatatttgtgggttttttttatatatttatattctgtaattttttttacataaaattcccatcccaataataatgctaaatgttttcttttctatttttaatcagtttatttaattatccttttcaatttgatattttagtctcaaagcgaaactttgtcagttgaacatttcgccatgctcaccatgtacatcagtgagaatacgtttanatttgtcaatttcattcaaaatacacgcggggcagcgacgcgcgtncaaaaactaattggagcagcgaaaattaaatcaaattttatggaaacatttcagaagaaacttcgaaatccattat

SEQ ID NO: 57938 - DNA, 156 bp, Heterodera glycines
  Genomic contig location: Contig_ID=SeqID_5412; Location=43..198; Strand=-
  SCN-specific regions: Sequence locations=1-156
atgattgcacataattgccgaaaaaattcgagaccaatttccgaatgttgaccgactaattgccaaaacgaaagccgtctttgtcaaagcgccttaccgagtcaaaaaatttggaaatgtatctcatatgcaatttcaaccaataaatttgaagaa

SEQ ID NO: 57939 - DNA, 6389 bp, Heterodera glycines
  Genomic contig location: Contig_ID=SeqID_5413; Location=368..6756; Strand=+
  SCN-specific regions: Sequence locations=1-68,90-682,704-765,788 -1166,1188-1696,1719-1842,1865-2312,2334-2437,2459-2912,2941 -3073,3095-3828,3854-4367,4418-5294,5316-5943,5973-6111,6133-6389
  Gene Ontology: Mol. function=protein tyrosine kinase activity; Cellular component=integral to membrane; Biological process=transport
aaacggcgtcgttttatattgcggcaattatatagcagcagcacacttttgtcgtaagttgtgattgcaacaaatgtcaaaacaaaaaatgatgtgcaaatttttgtgcttttgagtgagattcgatggagtataaaagcgatgcatttgttcccttttcccattattcattctccgcttcgttttccgccagtgctgccgccccccattttcggcaatggtaacagaattttttttctttaaattcttttgaatgcaaattattttttctttttcaactttaaggaaaatgttgttgctcctgccgatgctgcggtcgacaattttgagcaacgcactcgccaattcttcgccttcgtcaacgagggaaacatcggacaattgcgtgcgctggtcgactcgctggatgcggacgaactgagcaatttgctgcggatgaaccaaccgaatgtccgaccgcctcgacctgctctcattaacgcaattttaaagcagcacacggaaacggtcgttttcttggtaaaagaaagggtttagtcttattcggcagcgattgatttcccccatttttcattcagttggagaagggcgcagatccgcatcagactgtgcttggccgactgaacaatttggacatgagtgagcagcaacaaaagcggaattccgcctcatttataaagttttgtccccaattttgcagatgtgacgccgctttggactgctgtcagtatgaccaatttggagatgtgccgtgcgctgatcgcccatggtgccaacatccacttggggacggactctggcgagtcgacgctgctctgcgcatgtttcgaaggcaattttgagattggtgcgtcaaatgcatggatgatgctgccgtgtaattgccaatgttttcccatttctcagtcactcttctcgtcgagaatggcgccaacgttaatctcgcggacagcgacggaatgacgccactaattgccacttgttactttaccggaaaggtgtgcaaagttgttgcataatttgtgactgttttttcgcgttcttagattgacattgtgcacctgctgcttttacacggtgcaattgttggacagacggatttcacgggtgcaattagtctaattgccctaaaattattggattaatattcccttttttcaattttagggatgaaatttgctcttttgggagccgccagggcgggctatttggaagtgtgtcagctgctggtgaacggatgggcagcggatgtcaaccagcaaacaatccacggcaccacagctctgatacgcgcgagcggtcggggacacgtggacgttggtgagaaaaattgtggcaaatttgaaatgtttcctcattttcagtgacttttctcgtcgaatatggcgccgaccttgaccacaccgacattgacggatacaacgcgttgatgtgcgcagtgaagaacagaaggacggaaatggcacgtcatttggtgaccatcggcgcgaacactgaccagattggcattgatggtgagcagaaaagtggttaaaccgcacggcttttatgtaattttctcgcatttacaggcaaacgggcgcgcgacttggctgaagaaagcggacttgccgaaatgattgacattttccgtgccgcggctgagcagcgggaaaacgccgatgggtaaaataggatgttttttgatcaaaaaaacaacaacaaattttcaggcatcagaacgaacactaacagcggatgagagggaatcgcggctcaaaagaattggacggatgtgccattcggaggatattctcatgcacttatgtattattgcagtgtatttgttcatatttgaattcacttgtcgtgtttgtctgctctgattgtgtacataaataacattgtttgtatgataaatagggatgcaatttttaggttttttttcggagctcccgtggcctgaaatgcatgaaaaacatgtttttttgggctgttgttaagctacttttcgagttattagtgcctattttctaggcttttatttttagagcctaaaaagtagagttgagggtaatggtgaagatcattggtcccataaaaaagggaaaaaaagcccgattttaatgattttgcacttcacccgggggttatcgagggtgctgagcaagaatatggtcatatgacgacatcaaatctatgatttttcgacatgtctatgatttttcatcaagtattttttccaattctaactcaattatttagctcaaaaatgagctcagcttgtttattgcacgaaaaatgcacgatatttaagcattgacaacataaaactgaccaatatggtcaaaaatattttcgaacgccaaaagcgttttttccccataaaactggcgccacatatattcgtccatgtatcctggcaacaaatcacgttgtgtgcccgacatcgctttattcttcattttcaaattcttccaaaagttttccacgtgattggtgtgagtgccggtcaatggatcgacaaagttttgagcatggttaacggactggtggacatacggcgggacaacgggaattgcagctattgcgcctcccatataaggagcccactggtcggagtgtattgtggtgccagggaggacatattgttcaatgatagggaggagagtgttgcgcgtacgatctggtacaagttgcacaacaccgacgtgggcgtgcacgtcgtacatgccgaacacccattgctcacgcaccctccggcccctatgatatttccggcgagcgacgagactctcgtctatttgaacaatattcccaataccacccaaacttaaagatcgccggttacggtagaaatacaaaaaagtataccggatgggatgcgcaagcaaccatcgactacaatccattgataatttaaagtaaatgctaaaagaatagcaaaattcttaaaataattttgtggtgaatgtcggggagatgcagtatgttgtgatattcatagtctcatttgcatgtaaacaacattcattatttcaacattccattgtttaccttttatgggaaaaaaacgcttttggcgttcgaaaatatttttgaccatattggtcagttttatgttgtcaatgcttaaatatcgtgcatttttcgtgcaataaacaagctgagctcatttttgagctaaataattgagttaaaagtggaaaaaaatacttgacgaaaaatcatagacatggcgaaaaatcaaagatttgacgtcgtcagatgacaaatctgatggcatattcttgctcagcaccctcgataacccccgaatgaagtgcaaaatcattaaaatcgggctttttttccatttattatgggaccaatgatctccaccattaccgggttttcgcaggcgttgaatattaatatgacatccatttcgacctatttcgaatcctgaacccgaattcgaacatttttttgtaaaattttgaaaaattgtcaaaaaagtctctttggttttcggggtcgctaatcactaacctaacatcagttttggtcaattgcgaaccccggacccgaatttaaacaaaagtcgaaaattaatttttcaccaaatttcttgaactctgcttatacatatctgttttagcgtttatgaattttcttttatatcgtcgtcaacaattacttgctgaaattttggctgcaacccgccgactcaatgtgtttgatgctaacttggcgactgggaacatgggcacagaggaacgtgagcaagccatcgccgaccgtgaacaactgtttgaattcgtccgcgaacttttgcgacaactcgacgctgttcgggactcagaaaggcagctgcgagagagtcagagagacaacgacaatgacaaaaattctgaggtttattcacactggttttgggttcctctagtctgactgacttaactaattgtttccaccctttttttgacaaaaattagttgtatgaaaattcggggttgtccaatttgcttggccaaagactgttgcgatgagtgagtcaataggctctattcaatttacgcgtccaatcagtgactatcctcatggacaaaagcaacatacaaaaagtttttcctgaactaacccaaattcaaacaataagtcgaaaattcaaatttttgaacttcttaatattgccataaaagtgattaaaaaagctaaaaaataagctatagttagaaaacttcaaacattttaaatgttgtttttttcaacagggaggaccgggttcgttacgacgaagcaggagccattcgcaatgaagcggcgacagaagcgacaaaattgaggtttgttcgcattattttgaagcaaaatgccattaacagtacaaaacagagcaaattgacataattaaaaagttaaatctatcaaatttgaaaaaaatatttaaaaaaaagcgggcggttgataaaagaactgtaacgagcaaatttgggggcataaagcaataatagtaaccaaaacatgtaaataaaagtcccaactttttttcgcaaacacaaaatgaaaaattttttccttctcattaaaattttagagctatttacataaaaaaggaagccctaataatgaatggtccgagactaactgtctcgggaaggaaaagtcccgcattgattgacttatctcgatttgagcttaaagaaaaataatttctgcaattgcagcaatcggacgggcacaaaagagggcgatgtgttcagttttgcgactatttgtgtggagatggtgaacagagagacggtttggaatgggacggagagggacgacgacgtggacggtgggcaatggcattttagggggaattattgggagctgaccaaagtcgagttttcatcctaattacggaccacaattctaaattgagtttattggatttgttgtgccgtgcccattcattcctttggctcatcgactttttctcactcctcagaaatcctttatcggctcaaacgcaccaacaacacaatccctcaccgtcctcagctccgcccccgcgaagacaccaatcaaagtttggtacgatttgttgctgctgatcgccttttctttccaattcatttgtgcttttcctcaggtccatttgatcagagactgttgggctgaagtgccggccgaacgcccgcgcatggatatgatgcggacgatgcttaagcagatggtccaggacgggtgggagacgcaggagaagaagaagcattgcccttttgatgttcagaaaccaaaacctgatggactacgtgttcggcatgctcgagcagtacgccagttcactggagcaggaggtggaggagaagcgcaagagcgacattctgctcaatcggatgctgccgcggcaggtggcggacaaactgaagctgggcgaggcggtggagcccgagtccttccaaatggccaccattttcttctcggacgtcgtctccttcactactttggccggcaaatgcacgccattacaggtgacaaaatcagtgatcactgtctgatcagactggggaagctgagtgatttgggcagaagaaatgtagttggtgataacgaatgggattagtctgactattgtgatcaacatccattctgatgataatatgattcttacgtcctccccctctccgccgtttaggtggtgaatttgctgaacggactgtacaccgcctttgacggcatcatcgacacccacgactgctacaaaattggtcagtcagcggccgatcacttccattttgatcattttaccaacgcatttccccgcacagaaacaatcggcgacggttatttggtgtgttccggcattccgaagcgcaacggcgaccaacacgcgaaggaaattgcggaactttcgttcgctttcctccgcacggtgtccaacttccgcgtcgaccacctcccctccgaacgcgtcaatctgcgcatcggcttccattccggtccctcccctcccctcccatttcaaatttggcattttcagggccagcagtcgctggcgttgtcggtctgacgatgccgcgctattgcctttttggggattcggtgaacaccgccagccgaatggaatccaacggaaagggtaaaattgggggggggggggagaaaacaaattcatttcccattttagccggcaaaattcacatttcatcaagttcaaatcgcttcttgaccagcgtaatcggaggatatgtgacggagccaaggggcgaagtgattataaaggtaattagggggggggggggaatttttgttaataaattgcctgattaattcattagggcaaaggtgtgatggagacattttggctgttggggcgaattggcgaagtccatttgccggaggggccatccgtgtcggaaaatgcgggacggaagagccca

SEQ ID NO: 57940 - DNA, 521 bp, Heterodera glycines
  Genomic contig location: Contig_ID=SeqID_27252; Location=481..1001; Strand=+
  SCN-specific regions: Sequence locations=1-131,160-482,504-521
atgccttctcgcccgtgtgttgtgccccgcatcagaaatggcctcgtgctcgatttgaatcgtaagcttggcattttgcgcttccgttgcaatttcgggttggcatttcatatgttctttcttcttttagctaatttttttaaaatataatcatttttagttttgctccattggaagtacatcagtcaatttgcaaatcgacgtcaggcgaatggatcccgaagccaaaatgtgttggtaatgtgtataattgtcaatttaattccaataattatttttaattttagcgattcgttgtgccttccctccgcgcattgcgtcgccaaatttggccaatttccctccgtctgatcgtttcgtgtcggcaattctttctgcttcaatccccaataattcggacatttccttcggcactttggtggcatatgaatgtgccaatgggacggtgccgaggggaggacaaagtgtggcacaatgcgcagcgaatggccaatggacaaaggtggcaatggcatgccaaa

SEQ ID NO: 57941 - DNA, 293 bp, Heterodera glycines
  Genomic contig location: Contig_ID=SeqID_27253; Location=322..614; Strand=-
  SCN-specific regions: Sequence locations=1-112,145-293
atgacaactttagcgatcttcgtggtcagagtataaaaactaaaaataagcctaaaaataattgattaattttgactataaaaaatgaatgggacatttaaaataaacgattgataaatgtttaaaataatttggaaaatatataaatactttcagaaattattaattttcttgaaaaattatgttaaaactgttcataaactcacatagtttaattaaaaggaatgaaaaaaatgattaaatatgcagaatatattatatgatagacatcctattaacagcaattaaataaa

SEQ ID NO: 57942 - DNA, 582 bp, Heterodera glycines
  Genomic contig location: Contig_ID=SeqID_27253; Location=715..1296; Strand=-
  SCN-specific regions: Sequence locations=1-28,50-327,352-582
atgaaagagtttttcacaaacttttttccacagtttattctgcatatttcgcgatttttttgcatttctttcatggcgattgcgaagaaggactggtaaaagttccgttatgtcgtacccctataaaaatgtgatgatcccgacaaaaatgaaagcacttttctgttgtaattttaggcactaatttgtaagcaagaatctgggatcaatactgcaaaaatctatgtttgtatctatgattttcatcaataaatttgtcgaaagctttttaaaaaaagccaaaaaaatatttttttagggggtaacgaaaaaaaacttattggaaacaattaaatattatatataatttttctctaattaaattcgcccaataatcaacaaattgtcccgccacccatatttggtatatacacatttaggtttgttttccttaattatgaatattgtttcgaatcttttgtctctaattacgccccgtttgccccttcgccttcctatgccctccttttttgccgtgccattcatcaatttatttgctggcgattgacccgaccaatgcgacccctccccatcaacaataaa

SEQ ID NO: 57943 - DNA, 1245 bp, Heterodera glycines
  misc_feature (1234)..(1234): n is a, c, g, or t
  Genomic contig location: Contig_ID=SeqID_27254; Location=50..1294; Strand=-
  SCN-specific regions: Sequence locations=1-808,831-1245
atgcacttgtcattctctgatgacatcgacttggatgccattcggaaggtgaacaatctttcaaaaaaaaaaaggcaaactttctacgttttcactgatttctaacttcggcaaataggtaattaaaaaaacatttaaggacttcgaacgccttaatccgctcccatcggccgctaatgaaagtgaagtttttgctcgactgcgctcaaccgccttcagactgcacactcagaacgctttttggtgccaatttgatcttagcgaggaaacaaaggcgaagatggagcagtgccggatgggcaacaacccaatggcatttgtcaagcgatgcattgtgctgcaggaattaaaaaagtccaccgaagcaatggagcagaacaatgaacagatgccatcgcaaatacaactcgatttccatgtcttcacacttccctatgtcctaccgtaagttaccataaaagcaactctaagaaaattacagactttgtttagacattacgcctgtttatcgttattcgacggagaaattcatcacggcgcaattgcaacctcaaaacaaagggcgaagatcagttgtgcagcagtgttatgtgaagtgttggtgaagatgggctgggcggatgtgaaaagggccaaaaagagaaaaaacgccgacggagagaaggcattgaaaaagaaaaaacggaagggagaaaacggacagacggaagacgttgaggaggtgagtcactcacgaaaggccaccaaaggaaaaggggagcaactcgtctcccccggaaagaatttaaaaaactaaagttaaagcaatgaaaccccaaaggcaaaggggggtacaccccaaatttcgccaccgaattttttttttaaatttccaacatcaattgaaacttcgtctctgcgaaatttcagcggcaaaattttgtcctgttccgaaggcaaagcgtcaaaacaaacgtatagatggacagttgctattaatttataaattatcttcccttttataagaaaataacttacaattaactaaaattgcagggaaatgtccgtttgtctcatcagttccttttgacattgcatccaaatgaatcgcttgacccaagaacgcattttttccttgcttcgtctgctaaaagcccaattcaattgctcaaagaagtggcggatcgtgaaagctttgaagtttcgtatacgaaagggaatggacgagtactttcacaagcacattgtccacgtncacacaattga

SEQ ID NO: 57944 - DNA, 969 bp, Heterodera glycines
  Genomic contig location: Contig_ID=SeqID_27255; Location=338..1306; Strand=+
  SCN-specific regions: Sequence locations=1-346,377-826,849-969
  Gene Ontology: Mol. function=protein binding; Cellular component =ubiquitin ligase complex; Biological process=ubiquitin cycle
atgcatctgccgcagcagcgctttaagcagtgccacggtgatcagctgatcggcctgcaacttccgctccgattgaatgtgctcatcgatctgccggacgattactcccaactgatcaaaatgacggtcaacttcaggtgaatgttttgggaaaataaaatgcccaattcttaattttttttaattgcccagaaatttcgacccctcgagtttttcccttcgtttttttgttatctttttgaataatattgattttatcagatgccccgagatcaaagagttgactaacacagtcgcgacactttgtcttaattgcggacaaatgctttgtgagtttatctctttgattttaatttacttaatttatatttttttaggctcacaaggctactgttgccaaaaagtggtcagtccacacgaacactaatttaaaggcttatttctccatgacgattttccgattaattatcttcaaaattaatccaaaattaattctcttaattttgttaattgtctttgcaattttgtttctataggtcaatggtcgtaatgttggtgcgtgcaccgcccatctgagcaaatgtcgcgggtcgtctggcgtttttttgcggtgcgtttccgaagagcgaaatcttttgaaaataattgctttgttttcccgccgcagaattcgcgagtgccaaatcgtttgtttgcttgtgactaacggtggggagctcacccgcggctgcttcaaggcggcaccatacgttgacgagtttggcgagactgatcccggctttcggtccgtacttttacaaaagccttacaattagccctctcacaaaaatgctttccttcgcttcagtcgcggcaacccaatgcatttaaatcgtgagctttactggaggatacagcgcctttggttgtaccaagaaattgcggaggaaatcatcaaccaatacgagctcagcagcaaccgcaacatcg

SEQ ID NO: 57945 - DNA, 1242 bp, Heterodera glycines
  misc_feature (640)..(640): n is a, c, g, or t
  Genomic contig location: Contig_ID=SeqID_27256; Location=145..1386; Strand=+
  SCN-specific regions: Sequence locations=1-72,94-571,593-1054,1076 -1242
atgctggtggtgcggatgcttatgctgacgaggataggtaataaatacaaatggtacctacatctgtaaaagtcttatgacaacataaaataactacttactcaagccctagttaaatttttccagactacgatgaagtatttcacaatgtcactgatgcatcatcgactgcactaggaggacttttactgctccatgatgccgagacgcgaaaatcccaaaccgatcatcaattggcacgatggctcattgaattacaaaattatcaggtcaaaattgtccacgtggcgggaaaagccaacactttggctgatgcactttctcgtgccgctgaagacaagcccttgtcggagatatacaatgtggatgaactcgaggaaattatcgaatttccggtctgtctcgctttggcagcacattccagggtggtcgcggacccatttttgcacactttgaccatccgacacgaggatggaaacacttacgaagttaatttgttggaagagcaggcaggagatcctgaagccgcagcctacattgcgtttgtcagagatggggaatttccagctgatttggatgagaaagaaaaagagttatttggtggactcatttttgaatcacttcactcgtctctttttangtggtggtcatttgaattacaggaaaacaattgccaaatgcaaaaaatatttttggcccaaatgtactctgacgttttaacttgggtcaaattgtgtgtcacctgccaattgagacacaatccaacacccgcgtaccgggaagagatgctcatggtggcaggcgacacactttttgccaaagttgggctggacttggccggcccctttccagtcactcaaaaagggaataaacacattttaaatatcgtgtgttggttcaccaaatatgtgatttctgtcccggtccccgacacaaaagcacaaacaattgcccacgcttttcttaccaattgttacttaaaatacggtggttgtgttgaattaatcaccgataatgcctctgcctttacttccgaattttttaaggaattttgctccatgctttacattgacaaaaagtatgcctgtcctcattggagtcaaggcaatgcgtcaactgaacgcacttttcggacatttcacaacatcttggccaaatacatttcgaagactcagcccgacttcgatgaatttttggatgctgccaatttttgctacaacacgtcagtgcatgcttcaacgg

SEQ ID NO: 57946 - DNA, 429 bp, Heterodera glycines
  Genomic contig location: Contig_ID=SeqID_27257; Location=119..547; Strand=-
  SCN-specific regions: Sequence locations=1-95,118-301,323-357,381-429
atgccaaaagaaccttcgtcccgcgcatttcttttcaaaaaatgggtttccaattacatgaacgatgtttacacaactgattcaaagataatttattgtcaagcatgtcaaataaaggttttaaggaatatgcatttggaaattaatactttaaatttatatttgaagacccgggatttgatacaatttgcgatattggaaaaattctttctggtcaaaaaatcaatttcggtatgccccccaatctgatttcactttacaaatacgctcccttgacttcatgtgatgttgaacgatcattttcaatttacaaatctattttgactgacaatcgctcacgtctatcgcccgaaaatcttgaaatgttacttatttgcaatgtgaatctcaataatgatttggcataatattttttgctttttgaataaa

SEQ ID NO: 57947 - DNA, 1269 bp, Heterodera glycines
  Genomic contig location: Contig_ID=SeqID_27258; Location=243..1511; Strand=-
  SCN-specific regions: Sequence locations=1-338,360-381,404-406,429 -680,702-929,1057-1220,1242-1269
atggccaagggcagcgacaacactgatggaggaaaaatggatgaattcatcaaaaatgccaaaactatgcgtgccaaaattagaacaggtaaatttccaagccgtcgccaggggaaggaggaaattttcataacaattaccattaatatttccataaaattttaaattcggtcctataatggctacaatgttctagcgaaaaaggctataattgcctgttttcgaaggattttgagttattttaaatggcaccaaaatacattaatcattttaaatcgtacttttagatttaagtagatcaatttatgaaagcgaactaacggtgcaaaactgtgatgaaaagctaaaagaatattttgaatgtaaaggcgcagaaaatcctgaatttttcaagcagttttttggtttaacggaaatgaacgaacttttatcaaaccttcagaaggtaataataataataatttgtacacagaaaataatatgtactaaaaaatcataaaatttgaataaaaacttctttttaagggaaccaattggctaccaaatttgctagcaattgaaacatcggaaaaaatgtcggaattaaaaaatgttgcggaatcgaaaaaagtagtggcataatgtcgtacgggctctgttgcaccttttggcgtccaattgctttttttcaactacattcagagaaataatttttgtttgttgcttttaagcccagaatttaggtaaagaaaaaattctataaacttttagctttcgtttgaatccaagaatgttggtataagaaaaaagaaaaaatggacgcctaaaggtgcaatagacattcgtagtaacccgttggtggtggaatttgtgcagagagatattggggtagcaaaacgatgaatcttgtttgggagtactactggggatcagggatggacgaaatttcgtttcgttttcgtttttgtctaccaaagttttttcgtttcgttttcggttttcaaaattttgtttttcttttcgtgtttcgttttcggttttcaaaatttcttttttcgtttcgtgtttcgttttcgtgtcgaatgccctttttcgtttcgcgtatacgaaaaattttttttgtgattttcgcacatccctgctgggggggggggatagggatgagaagcaggggtgggcaaagctcggcttagtagccgaagccgaaggcgaagcccaatttttattcgaagccgaagccgaagtttttgaaaaaatattttgtaacccaaacaatttatgtaaaataaa

SEQ ID NO: 57948 - DNA, 911 bp, Heterodera glycines
  Genomic contig location: Contig_ID=SeqID_5415; Location=1837..2747; Strand=+
  SCN-specific regions: Sequence locations=1-66,88-229,272-432,454 -484,507-599,653-710,732-911
atggacttcccatggcatttgtggcctcgttatgttgttcgtgtttttgtgcgcgtggtccgttttatgaaaaacaagaaccaaaaagaaactaattattattcttttaggtatgatggcaaatttaatggcgaatctgccatgccggcaatttgggcgggaattatgtgcgaattttttgcatacattgcattaaacaaaatgtgagataaaaacttgaattacttgcaaaaaaatattattgtaatataattaaacaattttttttttactttttcttcagtttatccgttgctgaagggcatcaaattgacgaattggtgaatgagataaacaaatccgagctcgatgtgaacgctcaaatcggaatccaatttagggaagtgctcggaagaatgcttatttcttatacttaatttatgtctccgaatcttcatttttaaattggtttatttctaagattgtgcttatgttcattcttaaagaaatttttgaaaagtttttcatctttgaacaaaattgtttcaataatattcaaattacccggcgggattcattcataatcgaggaaatattctttttttattttcatttgacggatttttattcaaaatcataataatttcaaaaaaaattttttttttgtttatttgttcttataaaatagcaatcattcgattcctctcaacatgtaaagcattaatccgaaagaatttttgacaaaaaagaaattgacaaaagctatgggtcctcaaaagcgttaacttgttgataaacaagttcagtcagaaaaatgataaaaagtcaagtttaaaagattgagttttgattattgcgctaaaaacaaggcatatgcctcaaaccccggtctttaattatatgcaatattatagtttcataccaactataaa

SEQ ID NO: 57949 - DNA, 1209 bp, Heterodera glycines
  Genomic contig location: Contig_ID=SeqID_5415; Location=3340..4548; Strand=-
  SCN-specific regions: Sequence locations=1-237,259-518,680-771,793 -963,985-1023,1045-1049,1080-1209
atgcgcggactgcacttggatttgcaaactggcggagcagtgcaatggcgagacgccgctggtggttacgaatacgcaaaacaaacactccttaattggcaaccgaccgatttgaacaaaattaaacgtaacggaatgccagacggcacgctgatgtacccggactttgtgctgagacgtattatttacatatcattttcgcaataattcgcttttcaagctgttgatcaaacggaattttttgttggatttgttcaaatacatttatttaccttcaaaaacactatgaatggtctaaggaggaggatacggtagttgccccccaattggctgcggttggcttggcaattgcctacattggcgcacgggggaacacgaaagtgcaaattggcaaagtgttgttggatgcgggtaatcattttttaaattttgagtgggatgtgaatttttgggaacccggagatagcaaagtgccggaattagcttaattttgtcatagtgacattcgcacaataatcaaaaaatatttattaatttaaaaaagaaaaattttaaaaatatttgtaatacaattttaatacaagaataatcttaaaaaatatcttaacattaaatcttttattaaaaaagtaacttcaaatatttataaaaaaaatctccaaaatataaaaatattattgtacgaataatttgccatctattctggctgggccgacagagaattcaaaaacattcacggttaattcctggcaccgtgcgaccaaaaatttatttatgttggtgcttcattttgtaacattaaataaatcgtttagattcgtctgaacaattaatgcacgataacaaccgtcaatttctccaagaaattcaattgatttcttctaatgatgtttttaaactgaaaatggccagcaaaatgtttttgtcgggttcatttgaagttttggacaaattcaattcgaaaatcaacacattttatgggagcaattttgagaaaatcaactttcgtgaaggaatcgatgcggcaaatgtaaaagaaaatattttgcatataattaaaatatttttaaatattttatgcaaaaatttgtaaccggggctgggttctttaaaattagagtcaattctaaaaagtttaaaattttctatttgggggtagcacctaaagaattttcggacgcgaaaaatttcttaagaaaattcaataaa

SEQ ID NO: 57950 - DNA, 917 bp, Heterodera glycines
  Genomic contig location: Contig_ID=SeqID_5415; Location=4970..5886; Strand=-
  SCN-specific regions: Sequence locations=1-74,102-131,153-535,557 -747,778-854,904-917
cccacccgacttattcttttggcactcaacgggaattttttgatttagaaactgggccaggtatttagtatttgataaatttatttaaataaatattttaaggccgcctaataaatgttgcggctgacgggaattgcttttataattctttatcagttttgcttactggatctgagttgaaagaaaatgctgggattatacgacgcgcgattacagagtatattgaatcagaggttgagcttaacgaaatgggaattccatggcacggatggtgggaaatgtttcatcccggacaaacattatatgattcaagtgggaatgaggtacagtatttttttaagtttgataacgaaatctttctatagataattagtatacgtacatatgtccagaatcataaggagccggcaaaatctgcctccgaaagacataagtggggcagcaatgttgattttctagcagctgcaaaattattccaaattaatgttatcgtatgtagtccaaaccctcagagaaaagaagattttggaatacaatatgtatggaatatttatactccggatatgctggatacggtatccatttaaatacgataaatcaaaatattaggcatatttagatgcttgttggccagtcgagagaatataagtcaatttttatattttttgaattgggacatttccaagcaattatagatcctgcggagttaaagcaaaactagcttattataaaattaaaagcatttgcataaattttttaaaataataacaaaaatttgctccttaaataatcaagtataattttattaaaatagtaaattgatttgctttttaattggttgattaatcatattcaaatataattagttaaaagattaaattaaaaaccaatataaaatatttagtttgcttaataaa

SEQ ID NO: 57951 - DNA, 49 bp, Heterodera glycines; identical to SEQ ID NO: 51181
  Genomic contig location: Contig_ID=SeqID_27263; Location=830..878; Strand=-
  SCN-specific regions: Sequence locations=1-49

SEQ ID NO: 57952 - DNA, 446 bp, Heterodera glycines
  Genomic contig location: Contig_ID=SeqID_27264; Location=198..643; Strand=-
  SCN-specific regions: Sequence locations=1-266,288-306,347-446
gtagcaaatgtgtatttgtgcccaattactgccggagcaacaccaaatgtcgagactgaacttgccgagcaacgcaatgttgccgagtgcaagcagtactcaaccaacctgtggtatgacttctacgagatcaatggggttgacaaagctggcgaatatgtgctgaaattgaccgaatccaccaaaccttcgttgatttatgtgtacgaacagaaaacggtgcgattttttttttaatttattgaaaatttcgaaaatttaaaccgaaataattacaaaagaatttttatgaccataatttttgtgaataaaaaaatattatttatttgtttaaatttgattttttgttttacaggttcttcaagagggcatccgaattttgttcatcaatgatgaagccaaattgccaaaccttgagggaagctaccatttccgtgctccatttg

SEQ ID NO: 57953 - DNA, 77 bp, Heterodera glycines
  Genomic contig location: Contig_ID=SeqID_27265; Location=1134..1210; Strand=-
  SCN-specific regions: Sequence locations=1-77
atgggcagccgaagcaattgcgattccacaattattcgagcccaccaaacaatgaatggcacaacaatttcaaagag

SEQ ID NO: 57954 - DNA, 556 bp, Heterodera glycines
  misc_feature (519)..(519): n is a, c, g, or t
  misc_feature (552)..(552): n is a, c, g, or t
  Genomic contig location: Contig_ID=SeqID_27268; Location=53..608; Strand=-
  SCN-specific regions: Sequence locations=1-222,244-556
atgagtgccaataccgacgggcaaaggctttctccttcgccggaggaccagctgcaattcgacgagatcagtctgaacatggcgcccgtccacccgatgagttacgtgctcactcccgcagaggatgccattctctcctcgtcgtccgccgaacaatcccccgcctcgggcacttctccgaccgcgacagtgccgccggtggcaattgccgaaagaatttatcactgccaacagcagcagagacagcaaccaactgaggcgacagattccgtgaagattgaggcgacagattccgcaaaaggcaatgttactctgccggagacattgccaaatcccagcagaaacactcagcaaatgcccccagcgcaacagtcgccgcccccaatttactcggccatttacccgcccggcactcacccggccgtcccctcggggcacattccgcaattggccaattgcactccgacgtacatcatcgacgcgagcgcaattcgaagtgggagggcgactgattgtgangtgtcgccgacatttttggtccatgggactgcnggcg

SEQ ID NO: 57955 - DNA, 355 bp, Heterodera glycines
  Genomic contig location: Contig_ID=SeqID_27268; Location=1259..1613; Strand=-
  SCN-specific regions: Sequence locations=1-149,181-355
cacttttgtgctgctgaatgtgcccaactacgccttccgcctttacgaggccgtgttcgacgtgcagcagacccacttgtggcagttcgccttcttcatcacttacctcctctattaccttcaccatgccgtcctcttctacatgtacatcttttggaggtgcttttctctctgtgtttggccttttgactcattcgaaacattcagtccccaaatgaaaaagcaacttatgccgacagcactcaaacttttggagtgttactgcttcaaaactgtgcctgaatttggtcatcgtcagtcccaaatgtcttttcatcccgcgcaacattcaaaattggtcgccaatcgctcttaa

SEQ ID NO: 57956 - DNA, 804 bp, Heterodera glycines
  Genomic contig location: Contig_ID=SeqID_27271; Location=341..1144; Strand=-
  SCN-specific regions: Sequence locations=1-315,337-502,524-726,749-804
atgaaatttacaaagaaaatgttaatgattcccgaggcggaatatttggctctacggagtgtaatgaatagtggtgattatctccaaaatgaaaaagcgagtttagatgcaaagatttctcagaatttacaagaccccgacataaacgaggaactcaaggcgaagagacatgattggctctataaagaaagacgtacggtaaaggggatacttgaaaatagaccacagaaggtggtgattgagaatcatgtacccggtccgaacgttgcaccatatctaggcctcaacactcaatccaaaccacaagagaccgatgaaccacggaaaataattattcctaggaaaagacttaaagagcaaactcctgatcctgaatcagatactgatacacttgaggagttaactagggaaccccaaacaacacacacattaaaaacacccattccgatcaaaactattatacacccgacccttttaaacggtctttttaggtacgtaaaggaaaacaaagatttatttaaaattacggcggctggaaaggtccaatcgaacatgaatttgccgattgaaaacagtaattatagagatgttttgttgtatctcgcggggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccgggatagcacgagagaagaaacccttcaaaccactaatatgggcaagactgtag

SEQ ID NO: 57957 - DNA, 556 bp, Heterodera glycines
  Genomic contig location: Contig_ID=SeqID_5417; Location=91..646; Strand=+
  SCN-specific regions: Sequence locations=1-56,79-137,159-217,239 -358,380-505,536-556
ttgaaaccaacgatccaaatgccttttactttacatttacgttgcgtaaatatgtcaatgttaatgaaaaagaaaatcatgaacaaaatgtcgaatgtgtggactatgccgaagctaaggacccaaagttggagcagttgtttctggagatgaagaaggggttggagcagttgtatctggagatcaagaaggtcgagcagaagtttgacgcgtacatttatagcaaggagaaaatggaggaggagcttatccccaaaatggaggatgttgtgccgaaaacggaggatgttgtgccgaaaattgaggaggttgtgccgaaaattgaggaggttgtgccgaaaatggaggaggtagtttcaaacagatgttcaacagcagcccacggtaggtgagggtctggaggcaatttagttttgcagtggaactcggacagaactagcccaaccgcagtgggacatttgcgacggacatttgcggacaattttggggaaaaaaaaaaaattcgtaaagaaattttaaaaaatttctgaaaatatggaatgggactgaaaactaa

SEQ ID NO: 57958 - DNA, 2621 bp, Heterodera glycines
  Genomic contig location: Contig_ID=SeqID_5419; Location=461..3081; Strand=+
  SCN-specific regions: Sequence locations=1-52,123-313,336-793,815 -2030,2118-2444,2473-2621
  Gene Ontology: Mol. function=protein tyrosine phosphatase activity; Cellular component=extracellular; Biological process=regulation of cell cycle
atgaagacgaactgttgctggtccaagcggtacattcattcaatattttaccaattaataataaatttttctttttttaaattgtccaaaaattttttaaaataattgttttaattatttatcgattaaatgggaattgcgattctttttcgatttcactaattatagggccatgggatataattattaaaaaaaatcttctatcaaattaattagcgctaatggctaataataaattgtaattaaatttggaattttccagaggcccttccaaattctcaaatccctgtatttgtcccgaacaaatgatcactcaccttgacataccatttcttgatcgcaacattttacagctgtggcgccatggcgaccgttccccgcttggcacattcaaaaacgatccgaaccaagaggacgcatggccccagggatggggccaactttcagcagttagtcattcattcatctattaattgtttgccaaattttttggcatttggcagtgccaaatttagacctaatcctggcagaaggaggatcaggtagtttggttatggcacagcaaaaacttttggcaccgccgccagttttctcgtgatcccgatcccgttattctcatgggttttgtttggttgcgaatcgagtccagaatttgaaaaaggcgggatccggatttgggattggcaaaatgctgcattgcctctaagtaccccataaagcctcgagaaggggtggcgggggggggaggggtgagtaaaaccataggaggcttagaaacaatacggtagcaccaattctttaaaaaatttctatacagtagcgcttaatttttaatggacacggtagaatcaaatcctgtacggtagcattaatttttatttatactttttaacggatatggtgcagcattattgaatttaaaacatttttttacaataattatatgcccattagtagggatgggatttttaggtttttacctttttttttttgcggcttagttatgatgagagatgcccaaaaatagcattttctcctaacaattttcgatttagagcgactttttagcacctaaaaacacctattttggcgttttggcacctaaaatagtttacaacctattttggcatttttcgaatttttagcacctattttgggattttcccagaaatttcatagtaaaaatgcaataaaaacgaaaaatacacccctaagaatcgatcccaaaaaattttaaaaatatacccctaaaaattgaccaaaatttcagaaaatattcccctaaaaaatgaaaaattttctcaaaaattcgtctccaaaatttatttatttattttcttgaccagttgcaattgtgcgggcgaaattgataaaaaattagtcacattttgaattgttgtacataaaaacactggattttttcaatttttaacacctattttggcctttttggggctttttagcacctattttgcacttttttagcacctattttagtacctattttgggatttttagcacctaaaaatcccatccctacccattaggcacctgaaaaaaatgaatgccttcagaaagggatggcccaacatgttaagcttggcgccaagctgaaagcacgttacattgacgggcttaactttgtcaaccggcgctatttgagcaaagaaatttatgtgcgaagcaccgatctgaaccgcacgctgacaagcgcaatcgcaaatttgatcggcttttttgaccgcggcattgccggcacggattacccgagtgagcggcaggcacagtggtggccacacgggtgggtgtgtatcagggatgttgctcgtcttgtgcctcatattctcgtgtttttgggggtgtctcgtctcgtctcgtatctcgtattttgtttttgtctcgtttttctcgtgtctcgtattttatttttctattcgcaacatccctggtttctaaataaagcggatatggaacgcggatgcggaacgcgcaacaacaaaaaaaacggggaatgcggtctcagtccccagaaaaattttaaaaattgattttttataatggaaaacattcaaaaaatttcataaaatttaaaaataaaaagatttttcaattttttaccggaaagaggatctgcttaattaaaaaattaggggacgcgacacgcgaaaaaaaaacacaaaccatatatgtaccagaaatggaacggtattccgatttccgatcgtttttaccgtacatttttcaaaaaaaaaaaaaattacgatacttagcaacttacagtttcacaccggtggccgtgcacacccgtgaagcctttaaggatcacatcatcccggacgtgccggatgtgccgtgcccacggcaaagcaaaattttgcagataatggcacggacatttgagtaccgacagctgacgaagcaaaagaaagtggggaaatttttggaaattttattaatatttttaaaattttacagcaattttttgccgatttgtccaatttgacaggcgaacaaattgacctgtttaacttctatttaatccccgacacacttttcattgaggtcaaatgcaccagggatagaagagaattataggggggatttaaggcaaattaaaaata

SEQ ID NO: 57959 - DNA, 1389 bp, Heterodera glycines
  misc_feature (73)..(73): n is a, c, g, or t
  misc_feature (126)..(126): n is a, c, g, or t
  Genomic contig location: Contig_ID=SeqID_5420; Location=35..1423; Strand=+
  SCN-specific regions: Sequence locations=1-73,96-602,631-686,732 -1053,1075-1263,1285-1389
atgggttggtgagtgatcagaaattgttgtgggtgatcggtcattttctcgtagggttgacacgattttctgnaatttttctattaaaattttttctaggttttttttttttgaaaattttcgctntgagccagtaaaccaaaagtaaatccagattatataatctgtgacccatcccccggtttctcgaataacaatgcttttgtgatcaagctacccgcactacactgcttgtgtaacggttgagctatggcggaatgtgacgaatggaggggagccatatgtgaaggtaagggcggcaaaaagtgcctccggggatttaatttgttagcatttttgccaaaaaattactttttaatttgtgctaatcgtcgccggggatttaagcaaaattcgttagaattttttccaaaaaaaaaacttgctaggcgccgcaggagattttttagcatttaaaaaacagctaatttttgaaaatcgcagctggaaattttgacaatttttgtccaaaaaaaattacaatacgctaaggcagacatgaatttgaaaacaatttttgttcttttttttacacataaaaacgaatttttgcgccaaaacgcaaaaaatatcaatttaaattaaattttaggtaatttaaaaccgattttttttattgtccattttggaattaattttaaagagaatttcaattaacttaaaattttgcatttaaaaatattcctttttattgtctttttagggaatttttcgttagaaaattttcggtaaaaatttcttatccctgaaatgccattttctctatatgcccacaggttttgtattggccacccgaattggccggcttcaaggacataacgcacaacatcaccgggtgcgaaacaaatgccacattgaaccaatttgtggcacgttcgcgcattttcaagccgatgccgtcgccggatgagtactgcaaggacacatatttcccatcaaatactattgttgatccaacatttgatcagcaactgtgatcaaaatgataaagtgtagggctggcaaaattacttgaaaatccgggattttttaaattggattttgggaggtctaaaacccataaaaaccgtgtttttagcttgacaaaaatttaacaaaaatgtaattgataaaataaccccataatatttgcaaaaatggtgaaaaaaagctataatattttgaaaatgttgaagaaaaacgaaaaaaaattatatatggtatatgtttttgccactttttggtccaaattttgctattttatatccattatttaattgccagccctaaaatgataaaagttgcactcgcaaaatggactaaaaatgaatacaaagaacggagaaattgttggacgaaaaattgtataaa

SEQ ID NO: 57960 - DNA, 837 bp, Heterodera glycines
  Genomic contig location: Contig_ID=SeqID_27273; Location=111..947; Strand=-
  SCN-specific regions: Sequence locations=1-64,100-150,175-183,205 -443,516-524,546-735,757-837
  Gene Ontology: Mol. function=GTPase activator activity; Cellular component=COPII vesicle coat; Biological process=vesicle-mediated transport
atgaagtcgctttacaacagtacaaatgggctcgtggtgatggccgattccttcgattcgactcttttcaaacagacattccaaaaagtgtttgaaaaggacgctgatggaaatttgaaaatgacttttaacgccactttagaggtgacgttattatttttattttataaaaatgattattcgggctacaggtcaaagttagcaatggactcaaagtcgaagggattctcggctgttgttcttcgatcaatgccaaaaattcgatggtttcagacactgaagttggcattggtggcacaacacaatggaaattttgctcccttacccctcggaatacaattgccgtggcgttcgaagtgtctggacaggttcgaaattatcagagaaaaacgagttactccgcataatgaaaagataaatttacaataaataaaaaaagtattacccctggcgggagtcgaacccgcgtcgccggtttaggagaccgacgccttagtccactaggccacaggggctccggttgagacaattttattttttcctaaatcaatcttttttttcttcctcttttagcatggcaccggcattcctcaaggtgcacgtgcgatgctgcaatttatcacccaataccaacattcggatggacatcggcgagtccgagtgaccaccacttgtcgttcatgggccgacatggaagcgaataaacagtcgattgggtatagctttgatcaggacgccggcactgtttttatggctcggttggcttcttggagagcggctaatgagaatgattcgccggacacattacgatggttggacagaagtctcattcgattg

SEQ ID NO: 57961 - DNA, 300 bp, Heterodera glycines
  Genomic contig location: Contig_ID=SeqID_27280; Location=42..341; Strand=-
  SCN-specific regions: Sequence locations=1-15,39-300
atgagatgggaggaaacggacgacgaggagggcgaggaaattgagacactcggcgacgatcggagcataatttttggtgatcagggtgagtgtgacgagcacccattacttttgttgtttgaataactaatgattgttttttcaataatcacttgtctatctaattatcagacacaatcactttcaatcgcttatttaatgctgcttaggctatttagggattgaaaaaacttaagtttgaaacccgattttggacattggcgcaaatgtcgggtaacagtgagcacaacggcaattaaa

SEQ ID NO: 57962 - DNA, 1238 bp, Heterodera glycines
  Genomic contig location: Contig_ID=SeqID_27281; Location=14..1251; Strand=+
  SCN-specific regions: Sequence locations=1-259,294-299,321-503,536 -643,666-1099,1121-1238
atgggcgttagtcaaaaaaccttcaaatgaaaatattttttcatataactttgctcaaaagcaaccaaattttaaaatcatttgtttcattcgatagtcctaagtttttttttattatcctacaaattttcaaaaagtttcgttaagtttcaaaatagttagaccaaaaatgttcaaaacttgattgttcttttttgaaacttaatgaaattctatgaaattctgcaggataatagaaaacacttagggctatcgaaagatatcaagtattttaaaatttgattcattttgggcgaagtcatgaataattttttgtcaaaaatttccaatggtttttgatcagcaccgtcaaaaccgtcgacccaacagatcatctcacttgttgaaccatgctatagacatatgttctattcgtaaaaagcatgatcaacgccttttaattgatgctatgtcgttttataaaacccatcaaaaagagggcattatatgaaaaaaaaaaccatcaaatggaaaattttaacaaaaaattattacccataattttgctcaaaaacaattaaattgtttaattcttgatataatttgattgccctaaatgtgttttctaatagcctgaaaagtttcaaaaaattctccaattttgacaaaattatggccaaaaatacccagtcaaccagcaggttttcaaacatttttggccttaattttttcgaaacttcgccagatttttttaaactttgcaggctactagaattcaattagagctatcgattgataaacaaaatttaatttgttagttttaaaaaaattttgatcagaatttttgatggcaaaaatttcaattaaaaattttaaagccctatgtgttttcctaatagcctgcaaaatttgaaaaagttggctaagtttcaaaaaagttatgagaaaaatgttttgaaaacgtgactccctgtacacttttttttgccataactttgttcaaacttgacgaaatttttgaaattttcaggcaattagaaaacatttagggctaccaaatgatatcaatcaaaaaatttatcattcagaggcccctaagtggcaaagatatgggtaaaaatttatttttgaaattttataacgccaaccccctttttgatggattgcttacaaaaacggcataacaccatagcaacaacatctaacacaacaagcgcaaagcgtaaacaccacatgataaacaagtacaatgagagtga

SEQ ID NO: 57963 - DNA, 57 bp, Heterodera glycines
  Genomic contig location: Contig_ID=SeqID_5421; Location=239..295; Strand=+
  SCN-specific regions: Sequence locations=1-57
aattatcagaactattcggacgcttaccagaattttcagaactgttctggtctgtaa

SEQ ID NO: 57964 - DNA, 1060 bp, Heterodera glycines
  Genomic contig location: Contig_ID=SeqID_5421; Location=4091..5150; Strand=-
  SCN-specific regions: Sequence locations=1-54,76-495,528-598,620 -650,672-941,963-982,1019-1060
tactcatttaattattatgggaccatcaccaaagaaatttacacgctggaacaatgacaacattagcagaaattcgtaaaacatattaggatccccaaaggaagaagaattgttgaccaaataaggaaacagtgtttctattgcaaaagatataacgcaaaaccatatcagcaaccaaaaatgccgcagttgccaaaatcaagagttcaaataacagagccttttcaaaacgttggcctggattacatgggtccacttcaagtaaaaagtttcactgaaaaatgttggataatccttttcacatgtttcaccacgcgtggaatacacctcgaattagtgacatcattatcagtacaacactttctcaatgcatttcgcagatttatttcaagaaaagggacacccaaaaatatttggagtgacaatgcatcacaactgaaacttgcctcaaaagtattacctgaagtcctaaaattaaaggaaatgcttaaagacgaatccattaaaaattattttgaaaaggaaaacataaaatggattttttcaatcgaattagctccttggcaaaacggagcaattgaacgtttaaatcaaaatgtaaaatcagcaatgaaaaaagcaattggaaggaaattgatagaatttgactcatttcaaacacttatttgtgaaattgaagccttagtaaattcacgaccaattacattcatttatgacgaaataaattcgtaccaaattcttagaccaatcgattttatactcccgcacaaaaatctatgcattcccccaattttggaagtaaatgaaactaatgacccaacatatttaccaaaaccaacttattatgaccaaacaatagagttatggaaaaagacaacaaaaattttggatgactattggaaaatttggatagaagaatatttaccaagcctgagagaaagatataaaacagaaaataaaaatccaaagaattgtgtaaaatcttttccagaaatcaatgaagttgtcataatccatgatgagaccccaagagcaatgtggaaaacaggaattattaaaa

SEQ ID NO: 57965 - DNA, 1908 bp, Heterodera glycines
  Genomic contig location: Contig_ID=SeqID_5421; Location=1069..2976; Strand=-
  SCN-specific regions: Sequence locations=1-284,313-330,353-1513,1535 -1584,1607-1716,1739-1908
atgaacgagtataaaccagtcattaaatttattaaaggcacaagctcacctgagtacaaaaacttaacatgctctccatcaccaatatgtgaattaattatatgtcgtttctgcatggaatacattcgaaacccacaatgcgttggtcaaatgcattgggctctgatactaatcatgataatgctcaccctttacgtcattactctttgtcttaaaattataagaatactataccgcttcatcgtttttatttttctatcagtctacaattgctgtagaaaaagaaaattaaagaaaataaaaataattaaacggaaacaatttatttatttaatcatgattagccttttactcaattcaccgactattttttcatgtgatgaagtcactaacatggtagcaggaacaaacgactgcgcaattgatcaaaacggaaagattgaatgtatttacgatcaaacaacccaaatttcaatcacaccggaacataaaacgtgtctgaaactcgacaatgaaaagacgcacactacgatggaaacaattgaattatctgttgaaagtctaacaataatttgtgcagagagatctgaatattttatgcgagattatcaattactgtcgagctcacaaaagcgatgttcaggtgcaggaaagtgcactggccaaatatgtcaaactttaacaatgaagggaaaaaatcctgaaatcggtgaccatgccaataatcaaccaggatattcctattgtgtgccttcctgtggtggttggcactgcaaatgctttcttgccaccgatggatgtttattttatagaacatataccgagccaatcaatagaaacatatatgaagtggtcaaatgtccgacttggacgattttagctacaatcaaaatttcgcttgatccaaaaaccatacatactgtggaattaaaacctggtgtcttaacacatgttaaagactcgaatttatctctgacactcacctcaacttcaattccaccaacgccactgtttggatcaaaatttataattgatcgttcaaacgcaaaagctgtaatagttgataatgagaatttacttaagaatagcctacggtgcgaaactaaagaaaaggcgacaaaattcagttgcacattcccaccagaagcttgtcaatgtcacggaggtgactccgttgttcactgcgaatgtgagaaaaacccactcactgaaatgttcacgagaaaagaaaatattttgcctctcgagacacatggaagccaagtattcttcgacactttattaagggcaaaaataaaattaacaacttcactacaagtgcaagtcacgctaaaaggtcacaaagtcaaagcaatttacgacaaaaataattgtactgtaaaaacaaaatcgttagaaggatgttactcatgcaccaatggagcagaatttaaatttacatgtacaactaactttggtaccgcattggcaaatgtaaaatgccatagtcagaattttcaaataccctgtgacacaaaagggaaccaacagcaaattcagctttcctttaatcaaccgagtgtaaaagaaaaatgtgaagttatatgtccagatggaaaaagtgaaataacaattgaggccactctgaattatgtgagccaacaagacaaaataattaacccatcgaataacaaaaaggaaacacccgtacttggaacttccctcgaacaattttccgatatatttaatttcatatatacattaatcaaaacaaatctttttaattttttaactatactttttactttgattgtgatgataacatttataatttgtatatgtccaatgatttacccacttctttttaaatactttcctttccgtcgcgggaatgtcgcgactacgcgaaataggattatctatatataa

SEQ ID NO: 57966 - DNA, 378 bp, Heterodera glycines
  Genomic contig location: Contig_ID=SeqID_5421; Location=3102..3479; Strand=-
  SCN-specific regions: Sequence locations=1-378
atggacaaaaatatattcagttcaataatgctctatgataatagcattcatgcagttaaaagccttaatttacttcattcacaagctgattctcgaattgattttcgttgccttggggagggcaatctgacgattggtacaaaaaaattctgtcaagaacacgaatgcactgacacacttggaacaaaattttgcttttacgagccacatgaaaaaacttatcttgtcaaatcagatagagaaattatcccgataaaagcatggggaagcatcgaaagaattttttatttggctaatgacacattaatggatgaactcaaacgaaaaaaagagaattcgatccgttcgaaaacgaacaaatatccgctgaatgtataa

SEQ ID NO: 57967 - DNA, 314 bp, Heterodera glycines
  Genomic contig location: Contig_ID=SeqID_27284; Location=861..1174; Strand=+
  SCN-specific regions: Sequence locations=1-89,111-314
atggccggcaccgccgtgggctccgccgccactccgatgataaacggcgcggtgcgcggcgaacttttggtggaggaggaaatgcgacggagggaagaagagagaagagacgctcaaaaagcattggaaaagctgaagaaagaggcgcaaaaagcggcggagagaggcggcggggaaccgccgcagcaattcccaattccgtgggcattggtcattctgctgatgtggacgatgctcagcgcggcactcttttgcatttgggagaccgagtggggctacatgacctccatctacttcttctttatcgcgatcag

SEQ ID NO: 57968 - DNA, 411 bp, Heterodera glycines
  misc_feature (353)..(353): n is a, c, g, or t
  Genomic contig location: Contig_ID=SeqID_27285; Location=1..411; Strand=-
  SCN-specific regions: Sequence locations=1-113,143-277,307-411
ggaaataatcttaatagggcctagttaaactgtaaaaaaaattggggcgatttgaatgagaatagaaagagccaggttcgatgaagttttggtaaggcaaaaaaaatccaaacatttaaaaatctataaaaaatttaaaaatgagaattcatgcgagattttctggaaataagcttatttgggcctagttaaactgtaaaaaaaattggggtgatttgaatgaaaatagaaagagccaggttcgatgaagttttggtaaggcaaaaaaaatccaaacatttaaaaatctataaaaattttaaaaatgagaattcatgcgagattttctggaaataagcttaatagggcctagntaagctgtaaaaaaatttggagcgattgaatgagaatagaagagccagttcgatgaag

SEQ ID NO: 57969 - DNA, 211 bp, Heterodera glycines
  Genomic contig location: Contig_ID=SeqID_27285; Location=812..1022; Strand=-
  SCN-specific regions: Sequence locations=1-60,94-211
atttgaaagagaatagaaagaaccaggttcgatgaagttttggtaagccaaaaaaaatccaaatatttaaaaatctataaaaaatttaaaaatgagaattcatgcgagattttctggaaataatcttaatagggcctagttaaactgtaaaaaaaattggggtgatttgaatgagaatagaaagagccaggttcgatgaagttttggtaag

SEQ ID NO: 57970 - DNA, 387 bp, Heterodera glycines
  Genomic contig location: Contig_ID=SeqID_27288; Location=7..393; Strand=-
  SCN-specific regions: Sequence locations=1-387
atggcaaatggcacttttgctcctcaacagacgccgtttgtcctcccgcactttgccaattcggacaacattagtgttcagacagttggcacagatcaaattcacttgggcacagcgacaacacggacaccgcgtcagattggagtccgactcggagtcgacaattatcctgaaaattcggggcaaagttagtttaatttttgaaaaataattaattcagttttatttagtactccatctgttgtgaggtcgagcaacagctcgattccgactcgaaattggcgcaactcagccgaaactgttgcatttcatagcgctggagaatgccagcgacagaagccgggcttaatgtcgttggttggggaatggacgaatgattttgtgtag

SEQ ID NO: 57971 - DNA, 196 bp, Heterodera glycines
  Genomic contig location: Contig_ID=SeqID_27288; Location=225..420; Strand=+
  SCN-specific regions: Sequence locations=1-196
gataattgtcgactccgagtcggactccaatctgacgcggtgtccgtgttgtcgctgtgcccaagtgaatttgatctgtgccaactgtctgaacactaatgttgtccgaattggcaaagtgcgggaggacaaacggcgtctgttgaggagcaaaagtgccatttgccatctcatccagaacgcactcgccgacgaa

SEQ ID NO: 57972 - DNA, 1783 bp, Heterodera glycines
  Genomic contig location: Contig_ID=SeqID_5422; Location=1..1783; Strand=+
  SCN-specific regions: Sequence locations=1-350,372-460,483-656,680 -719,743-1398,1420-1783
  Gene Ontology: Cellular component=plasma membrane; Biological process= muscle contraction
tcgctgcttcaattttgacatttgtcagaattgtttttcagtcaaaggactgccaaaagtcacaaattgtctcacccgatgcaggaatattgcacaccggtgccaatgagcatttggccaaactgagcaaatgccaaccattcgttcctttagacaagcgcgggcgatgacatgcgtgacttcacagtgatcatcaaaaacaaagtgcgccagggcaaaagtcgaattggctatttgccggtcgaacaaataaacgaaggaccgccgctcgaatgcaacgaccaaacgccacagaacgcggaaacagaggcaatgcaccagcgaatgcagctgatagccgcgagattggacaagcggcaaaccgaagcggccgaggcttttccgaatgccattgtgccgtctgaagaaggtcggaaaatggcaaattgggggaagcaaatcggcaatgatgacatatcagggaaagtgaagaacggaaagggggacgaagtggcggcgcaagtcggccaatttggcactcaaaatgcgcaaatgccaaccgcaataggcccaaggaatttgccaaatggctcggcatttgcatcggaaagccaacgagccaatttcttggcgcaccaacacgaggcgaagtcgcccaatcagttgatttcgcaggtggagcaggcgagcaaggaggagctgggacagatgctgcagaagctacaatacgaacatgagtaaaaagaaaagcacaccaaataaataagaaaattatcattggaacagcgaattgaaaagggcaattgacgagcggaagatggcactgaaagcggcgggaatgccattcccttccggaacgaaatccacgccgaatttattctatcaacgaacaccaatgatgggacaaagcataaacggaacagcgtaagaagaagcatttggtcctaatcacttctcttgtaatgaagaatgccatcggatggccatcagtcactcgaaatgggcgaagaatcgcggggaaggacggcggcctcaggtggaggatcaaactgttcagcgactgatcggatcatataaaattggttttcagtgccgcgcagtttgccgcctcagaattcgtcgtcggcttttcccgtccagcaacaaactgtgcttccgccgcccatccaaaggcaaatccccgcctctattcatcgtcaacattccctcgcggacgcttcttccacggcttttgccgcctccgctgtgtttcctgatgggcctcgttcgcaagcggaccaatggcaggaaatggccgtgctggcggaggcacaccatttgagacaacaccaaaaaaggctggaagagagagggattgtgctggaagatcaaaacagacaattgcaaatgcaattggaaaggcttcagatgctaatggcaaaggtggacaaacccaaaaaaggaagggagagaatggaaattggatgattaagaagggaaacgccctccaaacactgccaacaacagaagagcaacagtctcacaatcagcccggctttatctcctcaaccgacgcggaagacacggacatggaaatgcttgcgctggcgatgccaatcagagagattaaagcgatcggaataagttcaggccaattgggcacggaaatccgtcgcaatcggatggacaggtgaaaaagtggggaaatgagagaatggaaaagcattgaatgttaaggctgagagagacggtggacgaattgaacagggccatggagaactttgtggttttcacgcaaaattgtgcccagaaggagcagcagcag

SEQ ID NO: 57973 - DNA, 513 bp, Heterodera glycines
  Genomic contig location: Contig_ID=SeqID_5424; Location=1445..1957; Strand=-
  SCN-specific regions: Sequence locations=1-513
atgctcaaattctgtccatcattcgaaaggccaatgcgcaacgttgtcaaatgcgcgtgatcagaaggaggtgatcaaaggatgactgacttttcattttccatccaaatttgcaaaaaaattccgttcgaatttcgttctatgactttggcatttacagaacaacgggagaaagccgtggcagcggcacaacgaccagcgacggaggcggacggaatggtttcgcgggcggagtcattcagccgaaacagtcgctgctgaaaggcagcacagcgcagcagcagaaaaggccaactcagccgccgatcatcagaaggaacgagcgcaaatcggcaacaacagatgaaaaagcgaatgccaaaggcactgaaaacggaaatgccatggcaatacgcagcttctccctccaccagcacgagacgggctcttccctctcgaatgcgttggactcgcgctgcaccaaaatggcggtggttacaatcgccgctttcgtggcattcaattggttggccg

SEQ ID NO: 57974 - DNA, 1077 bp, Heterodera glycines
  Genomic contig location: Contig_ID=SeqID_27292; Location=1..1077; Strand=+
  SCN-specific regions: Sequence locations=1-80,192-214,246-391,413-1077
ctcaacttggccctaagaaatcgctagaaaagggcaactgcagccaaatggccggttgacggaccaccgaacaacagacattcattttggtttttcagattgtgtaagcgtcaaaattctgaatgccggagcatggtcgaggagtcgagaccgttcgcacctgactttgccacgggaattggaggatttgatcccggaagttgaggacttctacaaaaagcagcactgcggacgaaagctgaattgggcccaccattggtccacggggacggtaattagcaaattaacattgaaacaaagttcacaaatgccgaaggtttcgttcaccagcaaagcgggaaggttcgacttggaagtgaccactcatcagatggccattttgttctgttggaacgacagacccaacgacaaactttcctttgcgacgattcgtctcgcgactgaattgtccgagggcgaattggcgagaagtcttttggtccgttctccgttttggctgcttttcactgctttcctttctttcagactttggtgaatttccccaaagtccgaatgcgactgatcctttgcgaaatcgcccaacaaccgttgatcccgaaaagcttcaacgactccactcttttttggcttaatcacgagttttgcctgatcaaagtaaaaaaaagtaacaattgacggacgatgcgattgatctgtgcattgtcagaatgagaagccgcaaagccggggaaagattaatctgatcggccgattgcaactgaaccaagacgcaggcattgagcaggagcacgaggagatactccaactgaggactttccgggttcaagaagcgatcgtcaagataatgaagacccgaaaaaggctgaaccaagtcagagacacgagcaaagggagggagggacaattggcacgactaatgacccaattaaggctcaattgcaaacggaattggtcgatgtgctcaggaatatgtttttgccctcccggaaactcatcaaggaacaaatcgagtggctgatcgagcagaaatttctgaagcgggacgacatggacatgaacactttcatttacgttgtt

SEQ ID NO: 57975 - DNA, 772 bp, Heterodera glycines
  Genomic contig location: Contig_ID=SeqID_27293; Location=759..1530; Strand=+
  SCN-specific regions: Sequence locations=1-141,186-215,243-394,427 -605,627-772
atgtttgttgttgtacttttctgcttgtggtaagtgtttgttgtttaacggtttggaggtacaaggagtagcagtgacagagttggccatcggttgggcttccgtcgtattgcgggaaatgacaaggaagatttgaataggaaaataaaataaaatttatttttatttaaaaattaaaaaaataacatgtattaagtggtttttgatgtatatttaattaagtaaatttaaaagaaaatccgacaatccttaattcagatttaaagtttcaaaaattttgtataatttctatttttttcgcaaattagtgctaacacaaaaaactcgaagcacatagatcaatttcggaaaattaaaaagaagaagaatcaatagctcaaaaaatgaatgaaagaaatttaaatatttttacaaaaaataaattatgaatttgtggctttttgaaatacgcggaaaacataatgccaaaaatgtatacaaacaatctttagtcactcattggcaatccgtccttttttgggccagtttgaccaactccttcgtggaggcactgcggctggccggctcattcatcccgtcatctccatgggtaaaatgtcaaattgttaattttaaaaataattatagcataaaaaaggaaaataaaactttggcaaattggagtgcaattgtaccaaatacggttctcagctgcttgctgctaattaatgagttttttcaggcgtccaggccgcgtgtcgttcagtctgccagtgccaagaaccgtcactga

SEQ ID NO: 57976 - DNA, 642 bp, Heterodera glycines
  misc_feature (551)..(551): n is a, c, g, or t
  misc_feature (584)..(584): n is a, c, g, or t
  Genomic contig location: Contig_ID=SeqID_27295; Location=1483..2124; Strand=+
  SCN-specific regions: Sequence locations=1-95,120-642
atgataattattgttttaatatgctatgtgattagtaatgacaaagaaaaggataaagcccatacgagcattggtaatagtaaagctcataaatctgatctatattctgataaatctaatcttcaacctgaggatgctcaaattaatcaacaacatcttaatgctaatcgagatagtaacaaattcgatcataatcataataatggaactaataccaattgtgatgctaatcaacatgaccaacatcatcatgctaatggagttgatggtgattcggatgataatcagcttgatcagctttatgcaaatcaccaactcgttcaattacatgcaaatgggaacaatgatcaccccgaaaatgacaatctttatgataacaataacagtgataagtcaaaaatagttgaccttgacgatgaatttcgggatcagttccctgagctcaccaaattgccagaattaaatggagtagagtttgttgggaatcatataaaatacaccaatcaaccaaaaagcgacacgcataaagacaaggaaaattataacagtanaagaacttatcttagagaatttaatatttattnagttttcgtaagatggacggacacagcagaatcatttgacattgaaaggaagaaatag

SEQ ID NO: 57977 - DNA, 1140 bp, Heterodera glycines
  Genomic contig location: Contig_ID=SeqID_27296; Location=82..1221; Strand=-
  SCN-specific regions: Sequence locations=1-409,439-560,582-823,848 -1140
atgaaggcaactgaaatgttggagaaggcacaaatactctacaatgggctgatcaccggtaaaattgaccgtaattcggctactgtatgggtcgaggaaaatgcaatggttggcattttatgtagcattgaaatcgctgatttgaaaattgatgccaattttcgggaattgttaatgaatttgtgtcaacaattggtgcaaggaaatcatattgaagccaatactgtaacaaatttggacattacagtaacccaattgctggaaaatgttgacgttgaccatataattgatgaattgaagcagaaaatcagcaaaagcaaatttattggcgacaaaattaaagaaaatttaaataaacttttggcacacttcaatttggcgttacgcatctttttaagtagtaaacaggtaattaattaattatattttgtaatatttcaagatttcaaaaggtgcacattatattaataaacatatttctgttaggctaatacctggaagcccatttaaaaaagtcttaaacaggtaataagtgcacaaaaacaaaaaataacacgcgaaaatcgaaaccaaggctcacaaacagcgctaattattttagataaaatccttgtataaatgccaaaacccatgtgcgatgccaaaagagaaattgtagtctcccaaacagcgcaaattaaaatattcaaaaaatcacgaaaacgtattcggcataccaaaagctaaaattgacccccgaataagcgatagcgagactcacatacaggctaattaattaaaacaaaaacttaatcaaaatgccaaaacgttttgcgtcatatcaaaagtaaatttaaaatttagaaaactgtcaccgccgcctcaaatgccattgcttctggtcaacccatggctggcgaacgtcgtcaaaaacggatgaacaacaacaacgataacgggaacgattggtttcggcgacgcctctcgcttaccgtgctgaacgtgcacgaccgatcggcgggtggaagcgatgacgttagtgattggccggcttgggtgaaatgtgccttccgtgccttggtctgtgccgtgttacttttggccgtgatttacgtggaacgccgtcttggtgccgccactgtttcgacgagtgttgcgtaa

SEQ ID NO: 57978 - DNA, 249 bp, Heterodera glycines
  Genomic contig location: Contig_ID=SeqID_27298; Location=63..311; Strand=-
  SCN-specific regions: Sequence locations=1-107,134-249
atggagaaggcctgcaaaatttggagagattatatcgattttagtgcgctaggttagatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgataaaaatttatgaattaattttgcaaaaataaa

SEQ ID NO: 57979 - DNA, 399 bp, Heterodera glycines
  Genomic contig location: Contig_ID=SeqID_27298; Location=687..1085; Strand=-
  SCN-specific regions: Sequence locations=1-399
cggtctctccataaatctgggggcatcgcttcgggggggcagccccgaaaacacaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttt

SEQ ID NO: 57980 - DNA, 759 bp, Heterodera glycines
  Genomic contig location: Contig_ID=SeqID_27301; Location=61..819; Strand=-
  SCN-specific regions: Sequence locations=1-759
atgcctgcaccaaacgacattccatctctgcgatcatttcttggtatggtaaaccattaccaacaatacgtcaaaaacatgcggttcattcgaaaaccgctcgacgatttgcttaaaaaggaaattgattggagttggagtgaaggatgcgaaaatgcattccgaaaaattaaggaaattttggcatccgatttgctgctaacgcattatgatccaaaaatggacatcattgttgcagcggacgcttccgaattgggcatcggagcggtcatttatcacaaatttcaggacggaaacatcaaagcaattgcccatgcttcaaaatcactcgcccctgcggaaaaaaattattcgcagattgaaaaagagggcttggcgttaatttttgccgtacaaaaattccataaaatgatttatggacggcatttcacattgcagactgaccataagccccttgtcagcatttttggcagcaaaaagggaattaggcagtgcagtgccaatcgtcttcttcgctggtctttaatcctgttggcctacgattttacgatcgaatacatcaacacaaaggattttggccaagccgatgcgctctcgcgcctaatcgccaaaggaaatgagaccgaagacgagaaaatcatcgccatgatcaatgccgaaacggattttgaaacaaattttggccaaacaatttcaaaattgccattaaaattttcggacctagtcgctgcttctgagcgcgatgaaaatattattcaa

SEQ ID NO: 57981 - DNA, 1429 bp, Heterodera glycines
  Genomic contig location: Contig_ID=SeqID_5425; Location=1092..2520; Strand=-
  SCN-specific regions: Sequence locations=1-106,149-486,516-1070,1115 -1429
atgactcattcaaagtttcctccaaatttacagctcatcgaggaactgaagcagaagaacaccgaaattgatgagctgcgcaaccaattggccgagtcggacggtgagaaatttctttaattttttcaaaaacaaaattagtgaaattttagaagtgatcagtggcctcgagagggaacgcgacttttactttgtgaaatttgccaaattcgaaaaagaaataataatttctgtcttccattttaaggccaaacttcgaaagattgaggtgctttgtcaggtcattgtgcacaaatgggggaaaatcgacgaaattttccctttgaaaaaaaattaaaatttgcttaaggacagtgaaaatgtcggcagtttggaggtcgcttcggtgctgcaaattctctacgagacggaagaaggtgaacatattttgagtttagagttgcgttgtttttagaatcattcacatttcgaattcttcaactcctcaatttttaatttttatttaatcaaatttacagcagaaaatttcaaatttgcggatcctgttgcaggattggaattcaaaaatttttgcaggaccggatccggccggattaatcctgcattttaaatttgcaggatcccgcgcaggattgcggattcttagaaattttgaaaaaattcgaatgaaatttccaaaaaaaaaatacctgacaagaaattgtaggggttggcgggatgcgttaaaagggcgactaggatttttcgaatgggtcagacggtaaaaagagatcggaaatcaaatctgttaatggtcaataaatttgactattttttgcttttcaaaaacgctttttttcagcgcaattttttcaaaaactaggaacaaaggggtccgtctatgcagataggcgccgtctgaaattttttttgaaaattttatcaattaattaactgattttgaccaaaaaatgaccaaatgtcacaccttttgactcaattctacaggattaatgtcgatccagtggtgtcgataggcgccgccgggaaatttttttgcaaattctaggtgaaatttgagatgaaaattgaatttattttgattgattttattataaatttattcaaaaattttggtattccgtcttttaaaattttcaaagaatgtatgcggatcttgccggatcccgcacaaaaatcaaatttgcgcatcctgttgcaggattgtaattcaaaattttttgccgggccggatccggccggattaatctgcaaatcctgaattttccaaaaaatgcaggattgcgaattcgaattaacatttatttgccgagaaatgactgactcaatccacgcattttttgcaggatttgcccctccgacggatgacggcacaaatggcaccagcaacgacgaaagcggagacattggcactcagctgaaggactga

SEQ ID NO: 57982 - DNA, 1661 bp, Heterodera glycines
  Genomic contig location: Contig_ID=SeqID_5426; Location=482..2142; Strand=-
  SCN-specific regions: Sequence locations=1-397,419-481,508-548,570 -661,683-1062,1084-1130,1152-1268,1290-1418,1463-1661
atggcgctagtcacgaacattccagtgagttttttgaacggaagtttcccacccaaaaatcttgagggcgttgatgtgcgggaatttccgaatctcgacttgaaaaaaccggttctgctgttttcgtatcccgaaacatcccttagacagtgagcgggttctcaatttcgaccggctaggaaaatctaatatttgtgtatttttcagttaacctccgcaaatgttgagcccctgtcacgccatgaaatgttgacgtgggtcaacctcagtttggcggtaaaattgggtgaattcttttggcatcaatttttttttacattttcagtccgaatttgccaaactcgaacaggtgaccagacaattattactaagcatattcgtttccggattaattaaatgaatcccattgttttaaattcaccgattctttttcagttgcacaccggcgccggctattgccttttcacagataaaaacaatgaaaatttataataaattaaaaaaaaacaattgtcccttttcacagattctcttccccggcgcacttcaactgaagaaggtgaagttcaacagtcgtctcgaattggtaggccaaaattatattaatttgtacgggccattcacttctaaaatatgcttttcacccgttttacgggttgtgcgtctttttgttgttgttatttgccccattttcatgaattttgctggtgaatatttcatatctgtgcacgggggggggtcttagtcgatcataagggttcaggacagtcgatcgtaagaggggggtgaagggagaagaagaaaaaggagtgagagagaaaaaaatccacgaaaaagtcgatcgttaatgtgaaaaaagaaaatttacaaagaaaaattgccttatttttttaacaaacttcattaaaaattccaaatttttacgatcgactaattccgatttgtgaggaaaattcgtcgatagtaagaggagagggggtaaaaaaaatcccaaaattttgcctattttttaaagaattccaaaaaaaaaattcccttgcgtcgcctataaaaagccttaatttttcctaaaaaacttgacttaaagtcgcaaaaatagcaccgtttggtgaaaatttgtcaacaaatcgcactcaaattttcaacatttacccggcggcgcctatcggcaccgccgtcccccccccccggttcattaaaaggtatttggaaaaagcgcgccgcaaaaaaaggtgttttgagaagcaaaaaaaaaaaggtctcactagaaaagaatttgaaaaaatggtcgatcgcaatggaaatgggctctgaccaccccatggggggggggtcaagtcgatcgtaagacctcttggctgacccccccccccttgcacaggtatggaatgtttacctgaatttggaaagatttctttggttttctaaattattttaaaaattggggggaggctcggattttcgaaagaatttatatatttttttaaagttgtttcttaactgtgttgattcccttttcttttcgtaggattggctgtccaattggaaaattgtgcagacttcatggtatattcaaaaaaaaacatacctaacatttatttataccgaaaatttgtttcaggaaacaattgggcatcgaaaaagtgatacccgtggaaaag

SEQ ID NO: 57983 - DNA, 1032 bp, Heterodera glycines
  misc_feature (1006)..(1006): n is a, c, g, or t
  misc_feature (1026)..(1026): n is a, c, g, or t
  Genomic contig location: Contig_ID=SeqID_5427; Location=1..1032; Strand=-
  SCN-specific regions: Sequence locations=1-125,147-691,713-971,994 -1032
  Gene Ontology: Mol. function=protein serine/threonine kinase activity; Cellular component=cell cortex; Biological process=protein amino acid phosphorylation
aagccgcccaaaatcattgagggttatttgttcggcgatctgatcggcgagggttcgtacagcaaagtgaaggaagtggtccatgtgcggtcactgatgaggcgagccgtcaaaatcatcaaggttttaccccctccttaaaaaggcactcgaaatggtgacaagaattgtaatttatcgacattttttctgatttatttcaaaataagttccccaaaagcaaaacattttccccgttttttcaaccaatttccgcttttatgacaccgtttccatcaaatttccaatgcttttgaggacaaacggttgcgcaaaattccgggcggtgagcaaaatgtgcaccgtgagattgacgtccttcgccggctgaaccaccgaaatgtggtgaaagtgttcgacattttcaggtcctttgacatttttcaattattttatttaacttctttttcaatgttttgtccttttcaggatagaggagaagcagaagttgtacattggtcagccatcagtcggacattttcaactgatttttcttcaaattttcagtgatggaattttgtgtttgcagcctccaacaaatgttggacaattgcactgagaaaatgctctcagaatttcaggtaaaagcaaaaataatttcttgatttaattttgtttttcaggcccacctttacttcactcaactgatcgatggttggtttttgggttttcagaaaattcaaaaactgtttttgtacataatgtgtttggtcttccgattctgacataaaaatgtgttttttacaaataaatggaggctgcaaaaatggcttctccacaaaatccatccaactttcacccttcgatttttaggtttggactttttgcacaccaaacggatcattcacaaggacataaagccggccaatttgctgctgagtctggacggcatactgaagatatgcgatctgtagggacaaatatttatgtgcaaaaaataataattaaagagcacactcaaattccnaaatttatatttagagttanatttga

SEQ ID NO: 57984 - DNA, 286 bp, Heterodera glycines
  Genomic contig location: Contig_ID=SeqID_27304; Location=65..350; Strand=-
  SCN-specific regions: Sequence locations=1-178,200-286
atgacaattaatgaagcattttctatttccaaggcacacgacgatgagaatttgcagccacccgttgctgcgttcagtccttttgccattgccgacacttcgcaagaattacattactcgcaaccggcgccgtcgtcagtcgattatttcttttggcaatcggacgaagcgtcgtcatcttctgtttgtgcagaagaaagacgacagatgtacgaacaatacggcggacaaaagcaaatgagacggaccgaaaatgacaaaaacacggaacaatgccaacggaacg

SEQ ID NO: 57985 - DNA, 408 bp, Heterodera glycines
  Genomic contig location: Contig_ID=SeqID_27305; Location=172..579; Strand=-
  SCN-specific regions: Sequence locations=1-346,376-408
atgccgggattttgcttgggacagccaaattcaatggatctggatccgggattccggagtaaaaaaattcagacggaggaacactgttctagacaatccctagtagtagtaatgctcgagaccgaaaatttcccgagactcgagaccgaggcccaaaaaaacacgagacccgtgacttgaatgtaagcggaatattcagttaagttgaacaaaaaaacattaaattttttcgaggcatggatgcttccaacgttggtttgtcaatgggccttgacgtcctttcaaggatcaaaaatgataagtttgggtgtaccaaaagatcaaattaagttgatcagaagtttttgaatatttttgaatttcaaaataatacagtaaccattgggctatcgaatcaaaaagaataaa

SEQ ID NO: 57986 - DNA, 114 bp, Heterodera glycines
  Genomic contig location: Contig_ID=SeqID_27308; Location=939..1052; Strand=-
  SCN-specific regions: Sequence locations=1-114
aatctattccttttgtcttaggctacaaaataaaaaacgaaaaaacatgcaaaattatttgctgctgaacaatttaggctaaatctgaaggcttcctgcttagaggaacccaaa

SEQ ID NO: 57987 - DNA, 513 bp, Heterodera glycines
  Genomic contig location: Contig_ID=SeqID_27309; Location=682..1194; Strand=+
  SCN-specific regions: Sequence locations=1-325,350-350,372-513
atggttggatagagctcgtcgagctgtacaaaaaagccgcttacaccgacctcctccgatcaaaccccggcgagttattcagccggcgctgaaatggcccaaaaaagtatgcaatttttagccagtttttcggaaaaactgacaagaccttggggtccggtcaagaaacaaaaaaaatccaaaaaagtccaacttaaaatcctatcgaggccgatttttcaattaggcctttaaaaaatttttgaatcccaaaaacggcaaaaaaaatttttaaaaagtgacttttctgggtcccaaattccaaaatcacttttatttctataacttttttcaaaaaagtgataaaaagctaaaataaaatttataaaatagagcaaaaaattacggattttttgagtatattatttttataaaatactttttcagaagggagttaggaatttttttctgaaaaatcgaatttttccagaaattctggaataacttttttatttttgcagatagaaattccaa

SEQ ID NO: 57988 - DNA, 1561 bp, Heterodera glycines
  Genomic contig location: Contig_ID=SeqID_5428; Location=197..1757; Strand=+
  SCN-specific regions: Sequence locations=1-506,537-550,588-810,834 -1050,1072-1198,1225-1393,1428-1476,1532-1539
atgcgcggcttctcctttgacctgtcgcttgcctccgtgttcatctttctgctgtcctgtttgctcggcgtgctcggttccgtggtcggctttatgcacgcccagcagcagcaccagcggcgccatcgacggatggacaggcaaaaaaatgaaataaatataaaatgccatcaggaatgcctgccattattttcaaactcaaaaaccgaacaaaatgccggtttctaggccaaaatggcactcccgagagtgccatggggaggaggaggacaccaagatgggccaggccgggttttgtgacaatttatgtacttagtgatgaggttgttgggtacggatggatcagtcactttggcacgggactttttttggcacaaaaattttcaaaaaaaggtcgaaaagttttgaaaaataatatgttcatcaagaattttcagataattaagttctttttgtttttggttttttgaaaaacctacaaaattcaggaaataaatccttcatataaattctttacaaaatatttttaaagttttctctattagcctggaaaatttcatataaaattatcaaatttattatattttcatacattttttcccaaaattgaccaaatttttttaaattttctatgacttacattcccatctcacattatcattatcattaagtggattaattatatacccttattgatatccaacttttgtcctcgttcaattaatccaatttttttttgtgaatttcagcaaaaccttcccgaaaacggagctcagtacagtatcctcgtcagccaatgaccacaacagtaaccaccaccaccatcatcacaacgagcacagtcagctgagcatgaccaacatggccaaccaaccccatctgatccgcatccgtaacgaaggcgccggtgcctcggtgattcgggacaattccatcggcgtttgaattagcgcgctttttcccccatttttggcatatgatcttggcactttttttttgcattggcaactttcatctccatatgtttataccatttattctcttaaaattgtaaatatttctttatttattattcatacatatattcatgagtacatttatacaaatatatttttttggtcctgtcctcccacggcattttttaaaggtctaacaaaatgcaatttgttttggcacatagcaaacttggctgggtctgggatttttgaaaaagccatggccggcatggagccgggatcctagtcaagttttcgggatttgactggaaaatagattaagtctattttcggcggggatctgatccccgaaccccggggtaatcacaaaaactaatgggtttaaatcccggagatggaattttacctcttttttccgtttgcattttcatctttcatttaatttaatgcatttatttaaaaattctttttaaccaagatcaatttgtaaatgtattcaaattgataaattgaaaatcgctttaaattttttttaattttaagattacttacatttttttctattttttaaaaaacgttgccaaaatttctttaaatttttaaaa

SEQ ID NO: 57989 - DNA, 1468 bp, Heterodera glycines
  Genomic contig location: Contig_ID=SeqID_5429; Location=476..1943; Strand=-
  SCN-specific regions: Sequence locations=1-133,157-737,759-829,896 -1078,1100-1135,1239-1245,1298-1299,1321-1468
atgggtttttttcctcccacaattaaggcagatgctgaacctcccgctgtcaagcgtaagtgtcagacaaaattgttcagaacgccaaaaagaaattttttttgcgcgctaattcaaaaaacaccgataaatgccttttttgtgttgtttcttttgatcagccataactcgcttcattccccactaaaccgaacaatttttgtatcattcgaaagcttttgaattatagaatttttccttagctaatgctaagcaatttaatgcatattcgaaaatttatgagtctctaaaacttttattacgttataactcaagtcctaaaccactgacttcaaccaaaattttaatatttctgcgccatttttttgagttgaaattcataaaatcgaagagctttttatttttttaaatgtccaaatgaataaaaaaggaaaattgtgcttaattgtaagaatttatttaagaaatatatattccaatgttgaaaaagaagcaaacaatgctttcacagaaagccaactataaatcttgccggataatgccaattttctcgatacaaatctcggagattgggtatcattcaaaaacacaattgaattcgggaaaatggccggcaggtgagacctcgagatctcacagctaattttggggcccatggctaaatcccaatgggttcgaaacctcatgaacgaatcccgggttaatcaacggtaaaagttttagaaaaataacataccacgcaattaatccccttttaatcaacaaaaagtccaatcgccaagcacaaatgcaaacaaactgatcagttgaagaacaaattttcagggagaaataatgtaaataaaatattataaaataattaaaatttatgaaaattataataaaattaaaatttgtcagttaaaataggaaaaatatcataaagaaagaaattgatgaaaaatttaaaatcaaaaaattgacaagaaaattggggggggggatttcgcacttttaaaagggattaactaaagtcaacaacaaagtgaaaacagggccaaatgttgacggacgaaagcgaccaccgattaaataaatatttatttcgtctatttttgttgattttgttggcccaactcacattttgtcaaccatgaaaatattaaattttaaaagtaataaattctaagcaataacaaaataatttttttaaataattaaaaatagcaaaaattatttttaaaaatttaagaaattttggcaacgtttttaaaaaatagaaaaaatgtaagtaatctttaaattaaaaaaatttaaagcaattttcaatttatcaatttgaatacatttacaaatttgatcttggtaaaaaagaatttttaaataaatgcattaaattaaatgaaagatatgaaaatgcaaacggaaaaaagaggtaaaatccatgccatcagaattgtttttcgaattatcaggaaagaaaaataaa

SEQ ID NO: 57990 - DNA, 2426 bp, Heterodera glycines
  Genomic contig location: Contig_ID=SeqID_5430; Location=184..2609; Strand=+
  SCN-specific regions: Sequence locations=1-553,576-1442,1464 -1820,1842-1890,1919-1927,1977-2016,2051-2067,2099-2174,2196 -2274,2302-2426
gctaccggtcttcgtccgtcgctgaactcggacctgacgctgaccgtcacattggaaaatgacgaatttgtgcagtccgattttgactttctcgtcctgcattttcccgacgaattcatgcgaggccatggtaacagttttccaatagatttttttgacgttttagtgattttttttttgatatttgggagtttttagtgggttgtccatattttttggctctattccaaattaatggaatttatgaccgtttaaaaaaaaatattttggccccaaaacggaggcgccgtggcggagggagtcgcacaccaaattctggtggcacaaatgccgttgttgaagaccatgccgtcgtggacatggcctcttctctgctgaccaaaatgaagatcaaagcggcgcgcgatcaaatgagccgtgccgtggcaaagtgagcgatggtgcaccggggacggtcccacgtgaaattatgaaaaaaaataatagacctaagttttttttatcatagtacgcccatcccatccaggcaaaactcacactgttttaacttctcgcaagcacaaccaaattcattttttccgcataattcgatttcctatttctctattagcatgcgtaatgtcaagaaaaaatatggaatcaatttcctgatgaatggaaaaattattttttttcgaatcgggcataactttttttttgaactttattcaaactttgaacttgaattttgtgtgctaatataaaaagtgcaacgaatttacttaaaataaaatgggcgaatttaaaaataagtcagaaatattttaaaattctcctccatatttaaattccattttttgctagcattttcaaattttcgcccgcctcgcttccatgcacttgcaaatccgtcactttggagcggttgccgttgttcatcggcggtcgctattgcaaatactcgcgcgcactgccccagtcgccatggattggcgccagcgatgaagaagcaccgccggcggcggtggtggcgacaaatgacggtggtccagcgactgttgaggggatagcgattccggcgactgttgcggatgagacagcgacgccggcgactgttgaggggatagcgattccggcgacttctgcggatgggacagcgactgttgaggggatacaattccggcgactgttgcggatgggatggagactaaggctgcgcctgccgtcaaaattggcactctgccgacggcagcacggcacattctgccgcacagttcggtgagacaccaaacgagctaaacaaattattgaaaaaacgcttttttctaaaagatttccgagaaaattgcgggcgcaatggtgcgacactttggcgccgatgggagtcgtttcattgcgtccggccgtgaggacattgacgtgcgaatgctgggcaatgggcgaccattcgctgtacaggtgtggtgggtgtgggtgtttttgtgtactgcttgaaaatgtagtcgttttttatggaataggcccagagatttcgtccaacaatagccaaaatacgcttttttggaggacattttaagtaaattttaataggatttgggtccgacacagtcgtcatgctgaggaagtttggattacattagaagttctgtcgcgaaaattcactgaaaattttgctttaaaataatccacccgttttcctcagttgctcaacgcgcgcaaaaccgcgtgcctgcgcacgcgtgcgtctgccgccacggcactgtccgcgctggccgcccaaatcaatgcgtcggaggagcgcacgcgggacatcagtgtgcacgcgctggcccatgtcagcgcaaagcaggcgcagcagctcaatgttggccaagaaggtgagcgttgggggggggggggggaggcgtaggaaactttaaaaaatttcatttaaacttaatggtttttcaaataataagttttaaaaaaaaaattcttttttaattttttttaaatttcttacaattaggaaggttttatagtaggtaaattattttttacaattttcataaaaaggaattaaaaacccaagtttttttcaaaaacaacaaaaaaaaaaataatttttttttaaatttttcttgtcaatagaaaagcgcaagacgtactccgcgctgtgctgcacacgcacaccgctggtggacgacgtgccgttgcgcacgctgcacgcgcacccattccctgtgcaggtggcacaacgcaccgtggtaaaaatgggggggagggacaaggcggcccaattagtcttagaattgaattaggtaattattttttaaaacatttgaaaaggtgcgcgtgctccggcggcgtccgctcatcgaccgcacgcgctttgtgtacacaatgcgtgcgttcgcgttggaccggcaccattttgtgctgcggctggagacccaggcgggcacata

SEQ ID NO: 57991 - DNA, 106 bp, Heterodera glycines
  Genomic contig location: Contig_ID=SeqID_5431; Location=1392..1497; Strand=+
  SCN-specific regions: Sequence locations=1-106
atgacgtatttcctctccgcccacggagggcgatggtttggcggtgccaatgccaacaaatccgcggatattgccctctgcccgatttgcacaatgccaaaagggg

SEQ ID NO: 57992 - DNA, 905 bp, Heterodera glycines
  Genomic contig location: Contig_ID=SeqID_27312; Location=50..954; Strand=-
  SCN-specific regions: Sequence locations=1-36,88-223,245-343,373 -392,414-614,636-659,685-800,822-905
atgagtcactcgctaattaaggcaagttggacggatggaaagccggtggactacttgagcccgaccgagtggggcgcgtacaaacggccgttgacgatggacaacgcaggcggggccggctacaacaaagagaacgaaaactgcgttttccttggccaatggccgcgcaaagtgaaggaatatctgtcgctggagacggcgctggacaaaagcggcgtggatgtgctgtggatggacgtggtgtgcgagaagccggaggagtactgggcaccgcacggcgccgtgtgcaaaatgcgcgccaaggaggaggagaagggatacggtaaagacaagtacggtgcaaaggaggaagaggaggaggaggacgaagagcttcgcaagatcaacaagtacgtcaccatcggctcgggcaacttcatctacgccaacaagaacacgtacatggtgagcacagaatagaaatgttaaagagttcgaattcagaaatgacaagcatgtactgcttgaaaaggatgattgaagacaaagggtatttaatggcatgggattcgaaaaacatttgaattttgaataacgcaagaccaatttgaataaaatcccagcttattaatacaaatcaaattcagattctcctcctgaaagacttgtacggcaagcagttgaaggaggagagcaggaagaaggtgtgcgaattgtacaatggcgaatatgtgaaggtcaaggacgagccgaaggaggcacaaggtaattatttaattattacatatcattacctaattaataatttgaattaattgattggtttgatctttagaatacctggacaaagtgctggccaaggaaaaggagctgtattctgactccagcgaccacatgttctgccgcttcaccggcatcatcggcgc

SEQ ID NO: 57993 - DNA, 67 bp, Heterodera glycines
  Genomic contig location: Contig_ID=SeqID_27314; Location=1084..1150; Strand=+
  SCN-specific regions: Sequence locations=1-67
atgccattcaccgcggcagtggtgcaaaacgcgggggaatcggtcgaggatgtcgaatcggccaaat

SEQ ID NO: 57994 - DNA, 205 bp, Heterodera glycines
  Genomic contig location: Contig_ID=SeqID_27314; Location=1..205; Strand=-
  SCN-specific regions: Sequence locations=1-7,36-93,141-205
cgtgccgtctcttccctccctccctcttactctttgcccatgaactctctctcgcccttctcttcctccgtcccccatttgccaatgccattctcttcctcttcctctccctcttcggcttcttcttctttctcttcttcatccgctgcccctagcgactcccttctgctcgattatcttttctccggctacgacaagcgcatcc

SEQ ID NO: 57995 - DNA, 390 bp, Heterodera glycines
  Genomic contig location: Contig_ID=SeqID_27314; Location=925..1314; Strand=-
  SCN-specific regions: Sequence locations=1-266,288-390
gggccaatgtttgagcggcaattggaggccaataacacaggcatttaaatttaaacaattgccaaggatggaatgaatgtttcattcgtttgagggtatttggtgggcgacaaactcacctgggtggacttttacgtggcgagttttgccgacttggcacttacatttggccgattcgacatcctcgaccgattcccccgcgttttgcaccactgccgcggtgaatggcatttttaattggggcaacaatttcattaatcgggcatagaaagtgccattgtttactttgtttattttctgtgcttttttagcggtgttttcacttccgcaactccaacagcacatcaagaacagaccggacactctcttctgatggttggcgtaacaaaa

SEQ ID NO: 57996 - DNA, 831 bp, Heterodera glycines
  Genomic contig location: Contig_ID=SeqID_27315; Location=419..1249; Strand=+
  SCN-specific regions: Sequence locations=1-831
atgcgtcggatttttgccacacatggactccctgagcaaattgtctctgacaatggcccacagttcacgtcgggtgaatggcacgaatactgcaattcgcgaggcattgagcataccttgaccccttcgtaccatccgatgagtaatggagaagccgaaaggtttgttcaaactttcaaacacatgatgcagcgtcaaaaagacggaggagtgccatgtgatgaggctttgcaccaggttttgggactttacagagtgacacctcatccagcgacaaatgcatcgccagctgaaaagctattcggtagaaaattgcgtaccatgcttgatttggcacgtccaaccgatgagaacgccgatcagaataagccaaaactcagtccgacatacagagatcgaatcaaaagaaattttgatcggggaactcgagatcgaacttttgaaattggtcaaaaggtttttgtaaggaattaccgagacgggcctaaatggttccgtggtctgatcattacgaaaaacggggtaatttatctcgttcggactttgagaggcgtttggaagcggcacgcttatcagcttaagccggatctgacggtcgaagatcagccggacaacgaatccgtggacagcgactcggacgccgatgatcaacaacaggaggctgaagatgaacagaataatggcccagctcctcccgaccttcgacgatcacagcggaccaagaagaaaccgcagatcttcgacccaagcagcggatccttgataaggagggagggatgtgatgtattcatccccttgttcatttatcgattattttttgctgtcccttga

SEQ ID NO: 57997 - DNA, 416 bp, Heterodera glycines
  Genomic contig location: Contig_ID=SeqID_27316; Location=196..611; Strand=-
  SCN-specific regions: Sequence locations=1-164,188-416
atggaccagcagcaaaaaattaaaacaaaacgaaacaaagttaagttagaacatgacggcgcactctatgttttcgaccaattgagcacagatggacttaagaaattttggcgatgtgagtttcatggcccgtcagacaaatgcaagggtatgttaatatattattttgaattttgcaaatcttttaaaattcaggccgtttgcacacggatttaaataacgttgtgcagaagttggtcggagttcattcgtgcgacatgaatgctgcgcatgtggaatgtcagcgacttgtaactggactcaagcgacgtgctgctgagacgtgcgaggcacctgcgactattcgtgctcaagtgctgcaaaacacatgcacacctgtgctagcagcttttccgagcaaaagcgccacaaaaaaa

SEQ ID NO: 57998 - DNA, 190 bp, Heterodera glycines
  Genomic contig location: Contig_ID=SeqID_27316; Location=475..664; Strand=+
  SCN-specific regions: Sequence locations=1-190
tctgacgggccatgaaactcacatcgccaaaatttcttaagtccatctgtgctcaattggtcgaaaacatagagtgcgccgtcatgttctaacttaactttgtttcgttttgttttaattttttgctgctggtccatattatataatttaaatagccttaatttagtttataaactcattaaattataaa

SEQ ID NO: 57999 - DNA, 306 bp, Heterodera glycines
  Genomic contig location: Contig_ID=SeqID_27317; Location=1039..1344; Strand=-
  SCN-specific regions: Sequence locations=1-81,111-306
agcgcgaagcgcccgtataagcccaacaaaatttaaaaatggcgcgagcgtccgttcgaggccgcaaagcggcctaaaagtcccagataattttttaaaaattccaatttccataaccagagctaatctaggtagcgaagctcccaaagcgcgaagcgctttttcgcgaagcgcccgtctgaggcctcgaagctgccttaatagcccaacaaatttaagaaacgggcgcgaagcgcccgtataagcccaacaaaatttaaaaaacgggcgcaaagcgcccgttcgaggccgcgaagcggcctaaaa

SEQ ID NO: 58000 - DNA, 526 bp, Heterodera glycines
  Genomic contig location: Contig_ID=SeqID_27318; Location=188..713; Strand=-
  SCN-specific regions: Sequence locations=1-526
atgtctcgttttttgactcggtgtgtttacctgatcttaactcatataagccttaacttcaggttggaagcgcctggatatcattcaatcgttgattatccgatgtcattttcaacaatccatgacaaaatagataataatatgtacttgaatttggatcaattcaaatctgacatttgtctggtttctgacaacgcaatgctttacaataacacaggaagtgtttatttcttggcagcgcaaaaattgaaagttttggcaaaatattatttttccgagaagtatcttttgttcctcgtctattcgttgccctttggaaaagccttaactgaggagcaacttggaatacgcttacggaggaaagaggagcaaacgccgagacaactcaaagagaaaagtggcagggaaaggccgttgccttttctgaggcaaagcctggcctttataagggtgaaaataatgaaacttattttagtgacagtcaaaaaactgaggaaatactaaatacagctccagtcaaaataaa

SEQ ID NO: 58001 - DNA, 411 bp, Heterodera glycines
  Genomic contig location: Contig_ID=SeqID_27319; Location=525..935; Strand=+
  SCN-specific regions: Sequence locations=1-411
atgcacaagttcgaagttgctcagatcgccaatttgtgtcccgagacggcggaggaggcaaaagcactgatcccgaggtgccattatttcgactttttttcaatttttcacataattttttttgtttaaatttagcctcgaaaacaaaatggaggacgaagaattggacgaacttttgaaggaattgcacgcgaagaaaacattccaataattttttttgtataatttctctatcttatcattttccctatttttttgttgcgtaaaagtttttagtttttcaaacttttgcaatttttttaatcaaataattgaatcataagttagttgagttgccattttaggagagtttcccgcaattgaggagggacccaaactttcgttccttaaaaatttatgataagccttcga

SEQ ID NO: 58002 - DNA, 1096 bp, Heterodera glycines
  Genomic contig location: Contig_ID=SeqID_27320; Location=739..1834; Strand=+
  SCN-specific regions: Sequence locations=1-42,85-302,342-419,443 -475,517-517,540-566,589-853,909-990,1012-1096
atgttcacaggcgatgcctacggcatcataagcagactaatattttttagtttctcaaaagtaagaaaaaagtttaataaatttgttgaattaatctgtcagcaaatcaattcgggatgtcaaaaatatgtacaaaaagtggtcaatatattttgaagtttccagaaaaaatactaagctgagtaagggcaatttttcaaacccatattgcgccaaaagtctttctttcccaaatgggctaaatttagattcatgctctaaaatatacccacaaaaattattagaaactagcccgagagtttcttgtacaatttagtttttaaaattttcctgataaaaatttccattttggagtttctaatgggacggacgcccaaaagaactgtgacggaactgacccgtttcgtaagaattgacccccaaaaaattcagaaaaatattcttaaatcgactttaaaattttcaaaaaaaaacacccctaataaataaaaaattttctcagaaattcatctcgaaaatttatttattttttctgacaagaatttttgattttaaaagcataaaagaaaaataaataaaataaaaaaacggaggtgcgaaattttttgtagttttgcgaatttttagcatttaaaaaaaaaggtttaaaggcctgtcttacaattttatgattgacttggcgaatgtgaaaaaatgatattttagcaattttttctcacaaaagataaagaaatcactgtagtgatcacttatcacaaatttgataaatttctgaacacatttttacttctagcacttttaaaggtaatttgtagtgaattttgttctcttatagatgattcgaatgatttttcatggcaaaattttccaaattaacgtgtttttctgaatttttcaccacctaaaaacttcaatgtatttgggtgacattcattttatccgcctaaagtaaactattaatgggatgtgttcgtgatgctgtcagtttgattcatttgatcaaatgttagaaacgatctaagcctaatgggacttaatttctccggaaattcctgtaaaactcagcacagtctgtcaataagatttatttctgtaa

SEQ ID NO: 58003 - DNA, 732 bp, Heterodera glycines
  Genomic contig location: Contig_ID=SeqID_641; Location=91..822; Strand=-
  SCN-specific regions: Sequence locations=1-518,540-732
atgatagtgcgaagtccgccattaactaggcagagagcacagaatgcgggaatcattcttaaccaggaagggcaggaaatctttagagaaaacagaaacaatacggaaaatggactgagacaaaatgaggacgggatgtcagagcattcaaatttttcagaaccaatgatgaacactgaacaaatccatgatgcattgttggacgtgggacaaagaaatgttcgtgatggtgaggaggacaaagaaaacgaaaacgaacaagtggacaatgcaaacggatttggaggtttgaatttcgaaaactttgaaaatttggaagagcgaacttttaatgttcacaacagaaatgtgagtctaacagattttgacgctgggcgtatgtttgaaaatgtgagattagaacgtcagcaaaatttactcccaatttcttttcctattgcgtcgaccccagtggaaaacagggtagcaaaccaaatgggtatggatcaagttcgagaaaattttagtgttattgctagattggaaaaggaattagtgataaacggagaaccgcaaattgtaacacgacagcaacgcaatcctacgtctgtagcacaaccacagagagttatccatcaaatgaatctgggacggcagaatgtacagcatcagaattaccaacatgagtatggtactccgagcgcaccgattcaacaatacgttcagtttgttgaacaaccaaatatgaacacg

SEQ ID NO: 58004 - DNA, 618 bp, Heterodera glycines
  Genomic contig location: Contig_ID=SeqID_644; Location=610..1227; Strand=-
  SCN-specific regions: Sequence locations=1-5,27-272,294-382,404 -553,575-618
atgtgtcagaagtatttgccaactttccctttgttggactgtgccgacttcgacggcgccttcgatgggccgcccaccgaagtggcgaaattgtcggccgaattcgcccgtcagaatctcagcccctccgaacgcgccaaagcgattctccgactcttttccgatttttccaggcaaagcgcggcgcattcatttttatttgtttttcataatcatttcagcaaatggtaattttttgaatgttttttagtgatccaacggaccctagggacgaatttgaggaggaggaaaagccgacaatttgtcaccaattcgtttgtccaatgctttccccgggagaaattgtggacgacgacagcgaaaatgaaattgaatacattggaacagtgaaaagataaataaacgaagttctttccctttgcaactgttataattgtaattttacagtttataattaatttatttccttttgcgatttaaacactttcacttttcagtttgaaaaaagtgtaaaatcaaatgttcaaatgcctttttcgccatgccaatcatttgtttggtcttttatgttttattcgctctctccggccatcaattcccaaaattctgtaaattaaa

SEQ ID NO: 58005 - DNA, 1922 bp, Heterodera glycines
  Genomic contig location: Contig_ID=SeqID_645; Location=1518..3439; Strand=-
  SCN-specific regions: Sequence locations=1-516,565-966,988-1009,1035 -1069,1094-1162,1194-1295,1317-1325,1347-1492,1519-1545,1677 -1681,1712-1745,1767-1922
atgaacgaaaaacgacagaaaaaacgccgcaaacgacgaaggtttaggagaaaatcgcaacatttgtcaaaaagtgccgtcggacagccccaagcgatggaactgatcgacgaaattcactcatccgccgaagaagaagaaaaggaaaaggaaaaggaaaacggtgccgaagaagtcgtttttgtgtgcacttcaacaacatcagaaacggaggacgaagcggacgaaatagaacagcaaaggcagagacagcagcaggtgggagagaatcagagagggagcggagactgtggggaaatgagagagcaaagtgtgatcagagtaactgagagggcacaatcgattaaaaactaaagtaaaaaaaaattgaaaaattgaaaatcggtcgaaattttgtaaaaaatgcaagtagaaatttggcgatttgtgcttttatatactgtttaaatcgattatgtcaatgtacaaatggcctagtggctaattttcagtctgtcttattttttccaaccttacaaattaaatatatttttaatccttttttaaattgaaattaaaaattttctctggcggcacttgtcggcccttccttgcccagaatttttttgaaaaattagctcaaagtcacacccaaaattcaaatttatcatttttcgaacaattctgttaacaaatgccattagatttttgcctttcgcatctgctggccgatcacaaattgtgtttttaggtttgatattcaaaactccgagaatagaattgacccgaactcaatttgtactctcttcagcctattttggccttgagcgttacttgcggagtttcccctttatttgcgcctttcccccgaattggtcatcgtttattaatcgtttattaatccttttagtcccaaatcccccccccctctccctttattctcacttttttgcccattcgttcttttctttcccattaatttctctgtaatttttgtttattcattcggtcattcgtagggcgattttcgcagtttttatttgtgttttctttaagccaacttcgttttttgatgatttctaaaaacattccatgaaaattaaaaattaaatccctttttgtgtgaaaaagcgaccacaaatgactgattttatgtgcaatattttttttctctacatttttcttatattttataatttttttttcaattttttcgccatttatttaaaaaaatccgccaaaaaacttttccttgctatcatcttaagaaactttacgatcaagcgaaagagagacatatttgtcagtctttttttagtccatttcattctctttcctttcgtccgtttcatttcccttttttccccgcgagggcgggaaaaaatgcacattttgttggaaaaaaacaatgcaaatgttttatttattttttatttacaaacacaataatttatttcatcgtatttgcacagacaatggaactcgtcgacgaaattcattcaaccgcagaagaattaggaggagaagaagaagaagtgatttttatgtgcacttccaccgcatcagaagagaaggaagaaacgcagcagcagaaaaagaaagagcgaaaggtgaaaaaggaggaaaaggaagaggaaaaggaagagaagggggagaaaaaaaggagcaaagagagaggaaaatgggagagaaagagagtaaaaatggggggagagagcaaaaaatatgcaaattctatcttttatttttttatattttcaggaaattgcatctgctgattgtgagaatggcggcgctttggtaaaatgcgaagcagcggaagagcagccaaaggaacagcgaatgtgaggggaaaagagaggggggggggggaaagacaccccttggccaatggcattttattttccatgggtccaatggcagtggaaacgaaacaaaataaa

SEQ ID NO: 58006 - DNA, 521 bp, Heterodera glycines
  Genomic contig location: Contig_ID=SeqID_645; Location=3954..4474; Strand=+
  SCN-specific regions: Sequence locations=1-132,192-301,323-332,357 -376,398-470,493-521
atgcctttgattctttgccaaatgcttttatttgcgccttgggcgaatttcagccgacattccgaaaaacatgggcccttaacaaaaagagaaaaaggttggaaaacggcggagtaaaaactgggctcccagataaaaatttcaaaattaatatttgaatttatttaaaaataaaaaaattaataaaatttggttttgttttttggtggaaataatattttgtaaaattgtgaacagataacatcggaattgacgttgatttaggctaacaaattcagtgtttcaatggcattttattttataccaaaatcaaagaaataaacacttaatttttagaaaaagtcacacatagaaaaacaacattcgccataaatttggaaatttgggttttttaaaacagatttttgagaacttttcaaaaaggtacaaaatcagcaaattagcatttaaaaaacagcattgcgtccttaaaaacaacaaaatactgataaatcagcacatctcatctctgggcttcctaa

SEQ ID NO: 58007 - DNA, 321 bp, Heterodera glycines
  Genomic contig location: Contig_ID=SeqID_646; Location=183..503; Strand=-
  SCN-specific regions: Sequence locations=1-87,301-321
atgtgtcgacatcaaagaccaaatcgaagaagtgacaatcgaaggacagagaagggaagtggcgcttttggaggtgcggcggggatggaaaaagaagcgaatgacaaagggaaaatggggaaaaagaaaaaggggaaaaagaaaaaggggaaaaagaaaaaggggaaaaagaaaaaggggaaaaagaaaaaggggaaaaagaaaaaggggaaaaagaaaaaggggaaaaagaaaaaggggaaaaagaaaaaggggaaaaagaaaaaggggaaaaagaaaaagggacaaatcaaaaacaaaatgggaaggattgatcactga

SEQ ID NO: 58008 - DNA, 2637 bp, Heterodera glycines
  Genomic contig location: Contig_ID=SeqID_647; Location=1..2637; Strand=-
  SCN-specific regions: Sequence locations=1-1413,1435-1758,1780 -1804,1826-2528,2550-2550,2572-2637
  Gene Ontology: Mol. function=protein kinase A anchoring activity; Cellular component=integral to membrane; Biological process=response to pH
atgttccgttgtgctcgtgtccagggattggacataatggagggccttttgctgtttgggaaggaccatttttacgtggtggacggattcactttgctgaagacgcgcgaaatccgcgacttggactttttgccagaacagtgagtcattttgtcctctcacctaccgtatgtatgttcttccccgttctttgcccctaccgtatcccccacctcccccaaaggttccacgacccaatcattccgtacattgcaatgggctgtcgctcgcggcccctcagcacaaaagtgaaccgccagtgcaacaaattcgcatacgacgacatcaaagaggtgcacaaacggcgctatttgctgcagcaaattgcactcgaagtgttcagcacggacgggcgcaactttttgttggcatttccgcgcaaagtgcgcgaccacgtttttcaggtggagggaggaaatggaatttgtggggggcgaggggccaattgagtctcacatttattttaggccatttatggggggcgagtggaaggaggggccaatttagtaccaaccccactattgtaagactaaatctactccttcaacataaaaacttcttccgcccgcacatttagaagttggtttcgatggcgaagaacgcgtccagcgacgtggcccagttcatgaacgaacagaagaagctgcggcccaccgagacgagttcgtctctgatcgcccaacttctgacgggacagcaacagtcaatcacccacaaatggcagcgaggagaaatctccaacttccattatctgatgtatctgaacactttggccggccgttcctacaacgacttgagccaatacccggtggcattttggccctgttctaattgggctattaagcaactaattagcgctgttcaggtgtttccctgggtgttggccgactacgactcggaccgaattgacctaaccaacccttccattttccgcgattttagcaagccgatgggtaagcgaatagcaataaataaccattaaatttaattggaattggttttcaggtgcccaaaaccctgatcggcttgcccaattccttaaacggttccgcgagtgggacgacccgggaggaacgccgccgtacatgtacggtacccactacagtagtgcgatgattgtactctcttatttggttcgattggagccgttcactcaacagttccttaaactccaggttctctctgtcccatccaaccctttccttctatctccatttttaattacccccccccccccccctaagtgctctaattgttctccccccccccagggcggtcacttcgatttggccgacagaatgttccattccgtgcgggacgctttttggagtgcggccagaaacaacatggcggacgtgaaggagctgatccccgagttctttttcctgcccgaaatgtttctcaacgaaaatgccttcgatttgggcatcaaacaaaacggcactcggctggacgacgttctgttgccggcgtgggctcatggggacgcgtacgaatttgtacgactccatcggcaggcgttggagtgcgacttcgtgtcggaacatttgcacgaatggatcgatttgatattcggctacaaacagacgggtgaatactgaatcggactgatcagccgaagtgatcactgatcattccgttaatgaaaaaggatggtcgtgatcattggttgatcagcaaaagaacagaatcaaaatgagaaaacatttttaagtgatcggactgtagccaattaaaaaaggggcaattaaacgagagaattaaccaaatttttgtcttttcttgtgcaggtgatgccgcacgggaggccaacaacgtgttccaccacctgttctatgagacgagcattgacattgagaccattgaggacccactgacgcgcaacgccacgctcggcttcattaataattttggccaaatccccgcccaactcttcaaaaaaccgcatccccagcgaaagattttgcgtatatatattcacatattgcattttaagtgctatgctttcccatttttaggtgcttctccgcctggcgttcccccgccggtgtcccccgtccccggtttgactgttccccgcctcttttaccattgccccgaggcgttgcgcgtttccgcccgtccggtgaaagaattgcggacggcggtaggtgaaattgtggtcggcgagcggggcaaccaagcggtggtgttggagcagaataaagtgttggtgccgccctgctatttccttgcctggggcttttacgaccgttccgtccgtttcggcgccgtgggcaatgaaaaggtgggcgaactccccaatcattcattctctgtccattgcaattgttccgttcagtcgtcctgcgttttggagaccaacgacgtctacgagatcacctgcatggcgacgacggacggtcgccaaatgttcgccggactgtccaccggcaattctttcgttttgcgcccttttcaaaatgccaccgtattccctccttaggcaccgttttcgtctggtccctctcgctttcccctgctccctcctccgtctccgcttctctgtccgtctccaaatcgttgccctccgcgcgtctcgtgcccaagcgtgcgctt

SEQ ID NO: 58009 - DNA, 2616 bp, Heterodera glycines
  Genomic contig location: Contig_ID=SeqID_648; Location=41..2656; Strand=-
  SCN-specific regions: Sequence locations=1-295,318-452,507-555,578 -1315,1339-1435,1458-1553,1575-1706,1729-2616
agatcggttgccgatgcgattgaacgtgcccaattttgtcccgaagtcattgtgtctctgttggccactattcgtgccacaattcacaggcaatttgaagcggaagagagcggtgaacaaaatgccaacgattggagcacaaattatcccctgagggtgtgtaaagcaaaatttaattttatcaataaacaaataattcagcttctccaactgttcaattttctctaccaaaattcctctcaattctttgccatttgtcacaccgaggcaattaattaattaccctaatgactattttaatatttaattgactaattaatgttaagtctttcgttgtcgttttattctcttcgctccttcccttgccaaattcggcacaaacgccaaattcggagagaacatttgctgaggaatatgctgcttcaacaacagctgcaggaggaggcaaacgcaaaaaaaactaaaaaaattaaataattatttaaaataaaattaaaattattttagacggcaaaaatcgctgtgagaaacagagtttggagctgctgacaaatattctgctgaatgacctttgtttggccaacgaagcgcggacggagcctttgttcgacgcactgatcgaggcaaattccattttcaaaaaacaccatttcgacttttttctcatttacttttgagtgcctttgtttgttttttaccgtatgccattctttaataacttgctacagtatgcccttcccctacagtacatggactgcaatggacccacccacaacaggcagaaccttctgttcaccgagctggtcaacgcctgtctcgaccatttcatggccagcaaaatgttctttctgaactcggcctcggctccgctggtcgttcccctgggggcaaaggcccaactgaaccaatcgtccgagtgcacttccgccagcgtcgtccgctttctgtcgcgtgtcattgacaccgtttggaattgtctgtacaaagggaacccaattcgcattttcaagtgttttctgaaggcactgtttatcacttttgtgataacactttgattattgtccaatgattttcagcttttggccgaggcccacgcctcaaacaaagcggcggctcagctccaatgcaccgacgcgcacatcgcctcactcttccgcctcattttgtaccttttgtcgcggcccattgacaacgtggacacgcaaatgtgtgtgttggacactttggccgaaattgtcaggtgatcgactagcggaaggcaaatgccgagtttggcataaatgttttcccgaaatgccattgtcagaaatcagcagctgtttctgacccccaagtccaacgtggacccgctgttttacgctgcgctcgtccatttggtgtttatgctctccgaccggcctcagttcgacttgcaggaccggcggaatcgcgaattggagcgtggcactgcgcaggtcggccaaaagactcaaaattggcaaaatcattggccaataggtgtccatttgtgcacaaagtgtttggggcattctttggcaacacaaaaaggcagtgctggaggagtggctgaagaagggcaacttggacttggacctgttcacgtcacgcgccaaatgcggcgaggcggcaaaccgcgcgtggcttcaattcgtcgactcacaaacagtcggcgccttttcgcaaagtcaactccaacaagcaggcacttgaacatacatacttttatttgtccaacaaaatgccaaataactgccaatttgaatcggtttgccttcctcgccaggattcgtccgctgtgcgtctgctgaacgcacagaaaatgttgccgacacaactgcagacgaagctgagccgagttgcgcggagtggcctccgcaagttgcgcaagtcaactgccatgtcgagttttgccaacacttcggcggacgacgtcgagtccaagcagggactggacgcactggcgcactttgacgacgcacggcttagggtagagccggagacattttacatgtggatcagggtactgtagtggatcgattgtctgagtgctacggtattcttgtgactgtttttaggtccatatcagtttggtgcgagaattgatcagaaatcgttgccagcgttatcacgaatggcattcgcatgtgcggaagtggtccatccaagaatggcacaacgcggagacggagctgatcagagagcgcggactttggggtccattcttggcacttgaacttcctctttttaaatttcaatttaggcccgaaccacggctccctcctcgacaaatttcagttggacatcacagaggggccgtgccggattcggcggaaacttgtgccaaaccccgacttctatcgccattatccctatcgtccgtatttggaagggcccaacgcgaaaccattgcgtgccaaagtggcaatttcacgcgatgcaaaagcctactgggaacggatgagcaaaacgagagcggaaacgatggacgaacgcattgtagactttaaggcaggattaatgccaagtccgggaggggcgatcactgatcagagcgtggaaggaatgggcagtgatcagtcacaaaacggaagtgatcagcaaccgatcgaatctgtt

SEQ ID NO: 58010 - DNA, 537 bp, Heterodera glycines
  Genomic contig location: Contig_ID=SeqID_5432; Location=927..1463; Strand=+
  SCN-specific regions: Sequence locations=1-439,501-513,535-537
atgagagcagtgccaaaggtgtgacgcaacagcgtgcgtcaattggtattgattttctaacagacacagaaaaaaaataatgagagagactgagagataacaaaagttatcggtgcatatcgattcagtgccgacgattcagtgccgacgattcagtgacgacgattcagtgtgaagacgattcagtgccgacgattcagtgccgacgattcagtgtacgttgaaaagccgacaattcagtgccagaaaatttggcaaaaaattttcaaaaaaacaactatgtagatgccaacggagaccggctaatttttgaccataaccgagcaccaggaacttgccagggacctagataatgccggataccgtagacctcagatcttttttccagaaccggaaccagaaaccgcaagaaattccggagaaccgctatctcatccagaaaaattttaaaaattcaaaaaaattaaaaatttaaaaaaaaattcaaatttaatttatatcaagtgaaaataatacaaaattatttggttttttata

SEQ ID NO: 58011 - DNA, 399 bp, Heterodera glycines
  Genomic contig location: Contig_ID=SeqID_5433; Location=348..746; Strand=+
  SCN-specific regions: Sequence locations=1-262,300-399
atgacaaaatcgataatgactcatgctggcggaggcttctcatcgtcattcattttttacaaagcgttaacgaaaatgtctccaaatgaaaattctgaccgtccctatcaacaaaccgacaatgttcaacctgttcaactgccacagcaacaaccagatgaagacaccgagttgagggcacaaattgaagacgctgaggaggatttgctcttgaactggtggcgtaaagacccgacaatggtaaacttatttcaatttagcatttttgatttcttcaaatttcagattcgttttctctttggacaccgtcgagcacctgccatcgaagctgcgcttcttcaacgcgccgaacgtgaggccgagattttgcgccaatatgccgagaatcaacaacaataa

SEQ ID NO: 58012 - DNA, 490 bp, Heterodera glycines
  Genomic contig location: Contig_ID=SeqID_5433; Location=1915..2404; Strand=+
  SCN-specific regions: Sequence locations=1-121,144-392,425-447,469-490
atgtttcatcctaatttcacacattctgtttcgaactcatcaacggtaaatttttagaatttaaacttttgagttttgttttacatctgattttatcttgccaaaacacctcaagctttcttctaattaatgtttgggttttaattatatttcttctagtgtttagctcattcccatgcaataatgtatataaacattgcttgctttctgacagcattttcatttttcgataaaaaaatttcgtttaaattattttttttgagtgcgtttttttaagaaattgtattttcaattcaaatttaaaattgatatcttgctaattttcaggatatgccttttgaaaattaaaaggtagattattaaggctgtattcttgggcattggattgattcatttatattttttgaaaaatataaaattataacgaattatcatatcacatcatgttttaaatcaaattcattcatttcatgcgatgactggatttgaa

SEQ ID NO: 58013 - DNA, 78 bp, Heterodera glycines
  Genomic contig location: Contig_ID=SeqID_27322; Location=108..185; Strand=-
  SCN-specific regions: Sequence locations=1-78
atgaatggtggtggagactgggcgataaacggagattgggggattaatggagattggggaataattagagaaaatacg

SEQ ID NO: 58014 - DNA, 76 bp, Heterodera glycines
  Genomic contig location: Contig_ID=SeqID_27323; Location=335..410; Strand=-
  SCN-specific regions: Sequence locations=1-76
atgtcgctagcctcattattaatcgtctcattctttcaactttacttttctcttaccaacaaatcattgttctccg

SEQ ID NO: 58015 - DNA, 500 bp, Heterodera glycines
  Genomic contig location: Contig_ID=SeqID_27325; Location=1..500; Strand=-
  SCN-specific regions: Sequence locations=1-27,49-160,182-283,323 -355,377-500
agattagaaattcgaattgctcaaattcgcgacggagaaggaacgcttgcaattaacaatagacgaaatgatccatgaaagttgtgttaggccgtgtcattgtcatccatttgttctgacgcaaagcttggctgattctgttgtagatcaccagacgaacagctggttttccttttaatgacatttcgttgtggttccgtttcattgttcgcgtgtcgcgccatttcactcaaacactgtgccaatgtacgagctgattccatgtgtgagagtgacagccaactaaagaaagagtaaaaaatgaaataattttgttagaattgcaattattttcaaaaaacaatacacaaatcaaataaatgaaaattagctctgtttaactcattgtcagctattgttttcctggtccatttatgccttttccctttgattggccatgtgtttttgttcacctaataaagctctcatgcgtgcggagtttgcgacgtccggcgacggaa

SEQ ID NO: 58016 - DNA, 309 bp, Heterodera glycines
  Genomic contig location: Contig_ID=SeqID_27326; Location=729..1037; Strand=-
  SCN-specific regions: Sequence locations=1-27,50-309
atgaaccgacggtaaatttgaaatctcaaatttttaatatattaattttcccgaattttcagttggatttgtacggatatttggatggatatttttcctcattttgactgtcctcaactcggcctcaaattggcacttttttcgcctcgtttcgacattttagtggacaaacatttcgatgtcaaaaacgaactgacattgtggagaacaatcacaatttgcaaggacatcggaatgccgaaaccgaaattttttgttcacggcaaatctgagggatttccattgcccgaccgtccgctgcccttatga

SEQ ID NO: 58017 - DNA, 1535 bp, Heterodera glycines
  Genomic contig location: Contig_ID=SeqID_27327; Location=273..1807; Strand=-
  SCN-specific regions: Sequence locations=1-44,67-221,243-310,353 -1034,1056-1125,1148-1334,1356-1535
atgatctctaacccaattgagcgcgttatttatgggtacggagagttgaacactaatattttgaatttgcaacgcactggtaaaattggctggcaatgtgccagtcactgtacacagtggcgtccatctgcggaacaggtacgcgattgcgccaaaaaacaaaacctcttgttaatattggatgatttggtggtggggatgagtcagcagtatttggacgcgctcttcacacgcggctcacacaattggggagtgagcgtaattttggtgacccacacctgtttaacaaagagttgcgcgtctctcgcacaaactcacattatttggtgttaatgagaaatccagcggacgcccttcagattcgcacaatagccacacacctcttcccgtcaaggaccgcctactttatggaagcctatcgtgacgcatgcgtaaaaaattttggctaccttttggttgacatgcacccggaaagcccggaaacaatccgactgagaactcatatatatatgatcaaaataaaattgcttacctaccaaaatgagagtatcacagctaatttcgaaaaatactccatttttgcagaacatttgtaatgtcaagaaggcaaaaattgttattcgagaggcgtccgatgaccaaatattatgcctggtcgaaatttgtctaaacattttaaagggccgagttccattggatcctcggcatttgaaaatgctcaaaaagcatgcacaggtgcttcgtcatctcacgcgcacacgctgctctcgatctgcaaagaaagttttgctacagcatggatacggtctatcagccattgtaggtctcattgcgcaattgccctccacttattgcggatgtcattgaaaaatataaatagtttttaaaaaaagttaaaaccaagaaaaatgcagcatacaaagcgttatctgctcgtccccgaagagatctatcaaagtttggctgcaccgccaccatctgacggaacaccaattgggttggtccgtaccagaattaaacaaataaaaaatgatgaccgtataaatgaagaggaaagggcagtcaaatatgagcaggaaattaagcgtctcaacaaacttacaagagacgaggctgaacgtcccgtaggtgtaaaattagaaaatttgagtgatgtggttgacgccgtgctaaaacctgtcaacataaaaagaccgattgttgtggctacgcgtcgccatctcaaggttgggcgtgcacgaaaagaaactgttgcagaactcgaagatgatgacgacgatcaagccccacggtcgtcgaactcaaataaacgacaacccacacaaacggaaatcttaaatttaatttataaaaatgcccaatctctgggtgtatctgcggaaggacaggtcttgagagcgggtgggcggccatttataaccagcattgtagatgatattgttagtcatctgctcaacaaagacaagcgtagccaaaacaaagagccaactgcattcaagaatttgttgaaagggcaaggcaaaatccactcttga

SEQ ID NO: 58018 - DNA, 1071 bp, Heterodera glycines
  Genomic contig location: Contig_ID=SeqID_27328; Location=355..1425; Strand=-
  SCN-specific regions: Sequence locations=1-142,164-271,293-321,388 -774,796-841,872-953,975-1071
atgacaaaagtcaacaaattgtctgtggatggcactgggaatggtgccaatgtgcagcagtgcggtgctaccagtggcggtggttgtggcacggaaaatggttatgggctaacagtaagggaataatgcaaacaatgctaagcttgaaataaaattttagaaaatcggattttttagtcaacaaatttaaaactttttgtttattgctattttttatgtatatttaaacttgtgtaaaaacatttattaaattttcgaataatttttcgtatacttttctatgattttctgaggtttttctattaaaatattatagctgcgtaaaataattatttttttaactttaaaacaaattccatgttattttttatttcattatttattaatgagaagggcaattgctgaccctctaaaaccattttttccagaaaatttttttagctctttctgaaactgtttgaatttttggtttatttttttcattttccatcaaaaaaatccaatcgttaaatatgtaattctgccaaaataaatttatctttttttccttctttaaacaggaattcaacagcaacgccaaatacatcgcgcaccagcaccaaaatgggggtgccgcaggcattggccaaatgttgctgaaccaatcgcaggaattccaccacacgccgttcacgttgcaaatgcagaatttggctagctttcatcactgaatttgaagggaatgaagccgaacattggacaagaggaggaggaggcgttaatttaaggaaaatgataaaaaaattaataattattcttgccatttaaatttaccatttttggattcaatcagtgctttgtcttattatttttttttaaatctttaaaaatagcttccccatttgtccttattttataatatctaaatatccataaataatacaaaatatggacttgtaaatttatgaaactaacttgtatttatttatatttttactctcaaaagtgaggaacacaatgccttttatttagcgattttaaatctgatttcgttgagtgttaccactaaaataactaatccgagccaataaa

SEQ ID NO: 58019 - DNA, 380 bp, Heterodera glycines
  Genomic contig location: Contig_ID=SeqID_27328; Location=1443..1822; Strand=+
  SCN-specific regions: Sequence locations=1-63,278-293,315-327,375-380
atgaatgcggtggcaacagttgccgaagacgaacacacaacagaaaaaggtgggccaactgagaaattaaattgaattataacaaaaaaaatttttaattgaaaattcaaattttgaaatttcataaatatatttataaaaaaaattaatattttattgcttttaatttttaattgtttaaaagggaaaaaatatgaaaataaaataaaaaatattctttttttaggaaaaaagaaaaattgaattattttgataggtatattttttaatatttattcagaaaaattgagtatgcaattaaaaaatattctttggtaaatagaaaggtattaaaaatttgttttttaaatattgttttattaattttttattttcgtata

SEQ ID NO: 58020 - DNA, 76 bp, Heterodera glycines; identical to SEQ ID NO: 53709
  Genomic contig location: Contig_ID=SeqID_27329; Location=609..684; Strand=+
  SCN-specific regions: Sequence locations=1-76

SEQ ID NO: 58021 - DNA, 872 bp, Heterodera glycines
  Genomic contig location: Contig_ID=SeqID_27331; Location=57..928; Strand=-
  SCN-specific regions: Sequence locations=1-58,80-200,222-693,715-872
actctgatcactttttgagtaagtccagccgggacagttttctgttcaaagcaatttgcattaaattgtaattgtaaatatttgaataaagattaagaaagagtcttagtcttttctctatctgtaaaagggacgctcaggagccctttcatacagatcattaagccattgacccacgttgggtcaaagaaaaggctttcaaaaggaaaggagaagcattttcctcctttcaaattgtcccttcagtaaaggagaggaatttcctccctttcatttgtccctttggactctgtgagtttctgtcttttggacagaaattcgctttgcttaaaagactcccccttctgccgggagagtctgcttccccttctgccgggaagtgcaaatttttgtggccttttgcccataaaattggagccccttaggggtcggcttccagtcgtaagcctaccctccaaccaaaccaatccaaagcgcggcctgagcgcttggatcaaacacacaacccaaaggggtttattgtgttttcatcaagcgtaagagcaatgagtgagctcttgcgcatctccattgcaccaatggtggtgcgtctcaagatgtacattgagacagcccaagaaaacttgggcaaagagctggcggaccaaagtgtccgtgcagatctaatcgcagagagacaaaatctatgcaaaacaatttctcttttggagaaatacaacggaaaatgggaagccattttcctgagagtgaagggacaagctcttcaagatgaagagcaaaattacagagactttaagcctgaagggaaggctttcatgcattgggttgaccaagccgcgagggcatgggcgacactattgaaggggctttag

SEQ ID NO: 58022 - DNA, 390 bp, Heterodera glycines
  Genomic contig location: Contig_ID=SeqID_5434; Location=274..663; Strand=+
  SCN-specific regions: Sequence locations=1-1,23-30,52-96,120-153,272 -291,313-390
tttaaattattaattcttttcttgttttaatcaaaaggattaaccctcaaattaacaacaaaaaacttttgtcattatattgacaatcagaaaaagttttttccgaatcaaagattttttaaatatgtcctaattattgtactaatagttcagtaaaaattttaattattttgtttttataatgttatttttgcattttaaaaattaaatttaactttgaaattaagttgaaataaactataaattgataatgcatttaaattatataattgagtatgtaataatatttacttttcattctttaaattatttgttttcttaagagaattataacatctgcatatttcaaaacaattattattgtttatttatctcttgcatgaattgttg

SEQ ID NO: 58023 - DNA, 111 bp, Heterodera glycines
  Genomic contig location: Contig_ID=SeqID_27332; Location=384..494; Strand=+
  SCN-specific regions: Sequence locations=1-111
gactttttcctgcacattgtctccgattccttcgtggacccgcgcactccaagttggcaaaaggaagttctcaccgttggcattgagtcaaaaaagaccatttctgattga

SEQ ID NO: 58024 - DNA, 970 bp, Heterodera glycines
  Genomic contig location: Contig_ID=SeqID_27334; Location=155..1124; Strand=-
  SCN-specific regions: Sequence locations=1-171,193-239,420-442,464 -500,622-655,747-751,811-970
atgatcagtgatcacttacggtcgtgtgccgtcggcagcaaaatggtgagcacacttcttggcactgctgtggcgggagagcgcgacgacggcatcggcacgcgacggaccccaaatgcgtgcggaaaacgcgcgggctgtgagcttggcgcggccaccagcacatgcacaatggccgtgtcaatgcggtcgatgctgttgttgacgcgatggcgaagcaaaacctgaaaaaaattaaataatttatataaaatggatttaattaagcataaatttcgaattttattttaaaaaatatatgatttatattaattaatatattataatgttaatttatcaaataatttcataatttcaattcattttaaaacaaatttaattgaggtaaatttaaaaaaatcaaattaaaaataatttaaaatacgaatattttgttggcatattttcaatttatataataattgcttacatattagaccaaaataattcacttttaactgttattttaaaataaattaaaattgtctttagaatttaattttattttagcttttatgtaaattttaatttaatcaaaatatttatttaaataaaaaaatatataataaaaattgaaatttacgaatattttgttggcatattttcaaaatttttataaattaataatcattaattatataacatttaaattaatgaacttaaatacaattgaaaataaattagcatttttaaattaaattaatttatttgcaaaaaatttttgattttgattaaatgaattaaatgtgaataatatattttaaaaatatagttactattagagatcggatacggaccggatccgtatacgtacttttacggatccgtagtccgtaatacgtaattttttcggccgatacgtatttttacgtactacggattttccgtttttttgttatcttgaattttgttgcttataattgataataaa

SEQ ID NO: 58025 - DNA, 961 bp, Heterodera glycines
  Genomic contig location: Contig_ID=SeqID_27335; Location=247..1207; Strand=+
  SCN-specific regions: Sequence locations=1-423,449-961
atgccaatgttcgcggagcaagcacataatgccaagatgttgttggagtttggcattggcattgggctaagcaaagtgagtcatcggaattagacattaatgccggaataaatcataaccattgcagtctcttagttttcgattgacgcgcaaacggtgtttgacggactgagtgaggtcagtgccgcgaatgtccgtccttcggtcgttcgattggcttctcctcctcccttttgcttcatcttttcccccctttttcagcttttacataaaccaaaatatgcccagagggcgcttaaacttcgtcatattttcttggaccgtccaatgaatgctttggatgaagcgaattttcgcctctcgcagattatcagacgaagcgacggatcgaaagggaaaggcgaaaaacggagagaattcgttgggagaaaagggacagagaaaggggcgatggaaagctttcatttggattggactttcattctgttggcagtgatcactttcttattccttgacaaatgatcagctgaattcaaagtgcgaagaacacatttaaagggacggagcaattcgaattgaaaattgggaatcagttcaatgcccacacattggcacattgacaccagtgccattcgagacggactcggaaatatctttcgggttttttcaatcttcccgctcataaaaaacatctctcgaactttttcctttttttctgatggaatattcaaaataactagagaccgacttttgagacatatgcctttttttctgcgcactagtttcgatatagtaagcataaataacgcattttccacttggtttgaggcttctccgttgacttttattatgcctttttttgcctttttcgggattttcgtgccttaactgccttttttgacattttgccgttttggtgcctttttggggtttttttctgaaaaattccattaaaaatgca

SEQ ID NO: 58026 - DNA, 245 bp, Heterodera glycines
  misc_feature (12)..(13): n is a, c, g, or t
  Genomic contig location: Contig_ID=SeqID_27336; Location=949..1193; Strand=-
  SCN-specific regions: Sequence locations=1-76,103-122,146-245
aatttcacccannatttctttggcatccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacattttgtgg

SEQ ID NO: 58027 - DNA, 267 bp, Heterodera glycines
  Genomic contig location: Contig_ID=SeqID_27337; Location=417..683; Strand=+
  SCN-specific regions: Sequence locations=1-267
atgggccgtgtggtgtccgcttttgtgaagaaaaagacggacggccaatggcaccgaattggcaaacggaatccccaatggccacaactgtttcagccacgggaagagccgggtgcacacaaagatttcgcaaagattggttaaaaaacgggcaaattttcaggcaaattggtgatcgaaaagggcgattttatggcgggcacttgtcgttacgattcaagcgacaaaaaggaaattgtgccgatgggaagcatgggaatgaacgaa

SEQ ID NO: 58028 - DNA, 202 bp, Heterodera glycines
  Genomic contig location: Contig_ID=SeqID_27338; Location=296..497; Strand=-
  SCN-specific regions: Sequence locations=1-5,48-202
atgttggaggaggaggaagaggaggacgaagaagaagacgaaggggacactttcggaaacaaaacaccgtccggagaaaggcaggaggagggggaagaaaggaagcggacggatgtcgaatttggaggacagacaatggccgacagtcccacgctttcggagggatcgctggcccaaatgggcaatggaaatgacaaggaag

SEQ ID NO: 58029 - DNA, 1190 bp, Heterodera glycines
  Genomic contig location: Contig_ID=SeqID_27339; Location=407..1596; Strand=-
  SCN-specific regions: Sequence locations=1-1147,1169-1190
  Gene Ontology: Mol. function=ribonuclease activity; Cellular component=extracellular space; Biological process=RNA catabolism
atgcgtcaagcctcgttttatgctgtcgcgcggggaagggctgtcggcgtattcaacacctggcaaaagtgtaatgacagcatcaatgggttttcgggggcaaagtttaagaagtttccaactttggagcaggctaatgacttcattgggaagcatcgtggtaagtgatgggcaatgtaaagaattgtggtcccgaattcgaaatatttgtgatcaagcacaaaacagaagtttaatttgtggccatgccaaagaatgggtgtagggaatgggcttccttaattggttgggctcgcaaaatgcatttgagccaattcactcaatagttttgtctgtaaatattattttagaaactctgaattctggcggcaaagtgatttcgaagaaagggccccccgttcgtacaatgattgtaaaatcggctgctacgacctttgctgagagacgtttgacacgtaatacggcaatgtttggggttgaggcatcgaactcattggcagcatccaacttggtttccgtggacgatggatttacgactgttgtctatacggacggcgcttgtagtcggaatggatttgtcggtgcaaaagtaaagcgatgagaattttcgacatcaattagtgatttatgtgaataggaatacttagttttgtcattttcactaaatcctttgtactatttaaggctggcttcggcgttttttggtctgatggacaccccgacaatgtctcagctccggtcaatggcccagccacaaataatcgtgccgaatatttagccgtaatttctgcgttggaaaaggcaaccgcgcgaaacattcggcgtctggtgatccgaactgactctgctcttctgatccaatcggtgcaaatgccatgccaattgaacgtttatgacgtggttaaaatagatgactaaatggctgcccaaatggcgaaccaatggatggaaaaccatcaatggaacggatgtgcaaaatagggacttgctcgaacgtctggacaatctgacgaagggaactattgacgtcaaattcgagaaagttgcgggtcattcgggcgattatggcaatgaccaggcggacctgctggcaagacgtggggccgagatgtacacggccaagaaatgaacgatctacgacgataacatatttttaaaaggattattgcgaaatattatatttaaataaa

SEQ ID NO: 58030 - DNA, 595 bp, Heterodera glycines
  Genomic contig location: Contig_ID=SeqID_27340; Location=1..595; Strand=+
  SCN-specific regions: Sequence locations=1-67,92-257,279-595
ttagtcaataaaccattgcaacatcaaaaaatagtcattctatacagatacgaaaataagtgaaacctataaatttttccacaaaaattttgaatttttttttcgaaaaggggaggttaccaccggcggcggtagtattacataccaagttgaatctcgtgttttcgctgtaagccaagctttccaatcttggaaaaattgaagaataccgccaattttgattttgtaaacagaatcgttcaaagctaaaaattcaaaaaatattgttcctttcgattcctctagggtaaaattgcaagctaagcagtgttaagtgttaaatttaaaaactaattcttaaagtcgcaaagcatcacgctaatggcgagcatgcgatgacgaagcaagtagtggggtgcccgagcgagcggcgccccaattactggccgccgtagtcgagtgtgcggtgtcttggccaaaatgctaagtaacgtcaacggttttctgatgattcggagtaactgggaaacgccaatttttaatgttcagagtgactggtaaacgacaattttaattgaacgatttttcaaaaaaatttacccaatcaaaagtgcca

SEQ ID NO: 58031 - DNA, 216 bp, Heterodera glycines
  Genomic contig location: Contig_ID=SeqID_27340; Location=687..902; Strand=-
  SCN-specific regions: Sequence locations=1-72,99-99,126-216
  Gene Ontology: Mol. function=DNA binding; Cellular component=nucleus; Biological process=protein targeting
aattccccccaaaaaaaagaatatttcgttacgtttttcattttttgtcaggcgttcgatgatgcgattgctgagctggacacgctcaacgaggactcgtacaaggactccactctgatcatgcaactgttgcgtgacaacttgacgctttggacatccgacacggctggcgatgagcaggaggctggtggtgaggcgggcgaagctggtggcaac

SEQ ID NO: 58032 - DNA, 906 bp, Heterodera glycines
  Genomic contig location: Contig_ID=SeqID_5437; Location=210..1115; Strand=+
  SCN-specific regions: Sequence locations=1-176,198-557,605-906
atggcgccaacagctgatccatcggcgacacgttgtgcacccgcttcattggcatcggcacaactccattccgccaatgcggcgcaacattcggccgaccatttgtgcttttttctctgtccaattgagcagggactgtgccgagtgcaggtggctggagtttggacaaaggtgtgttgtgctcatgattttcgaaatttcgtatgatggaaataacagttttagtatggacagccgggcccactgctgaatggcactgttgtgtcaatgacagcgttgccgtcactgttgcggcaaacgatttgcaacgtggcacgtcgcaaggcggccgaattggaaaggtagggagaatcggatagtcaaatcaatcaaaaataattgaggcctatgatctgcgagaacaaacagctaaatggtttttatatttccattttttagttaccaaatgacccacgttcgacgtcgccatgccattgccgaatttggccgacgatttccttcccggcttaattacaccgactttgttgagcaactgatcagcgacaattgatgcgcagaaggaactgctgctgctgctctttgccaattctttttcgttctgatcagtgatcactttacccaatttctttctctggtcactgttcccaaatacattctccttttatttttacgctagtgccttttcatgtcttcttccgcttcaaaaactttcattttttgttcaaataatacgcatagaaaccgttttgactcacattccgccctctgaattgtgtctcataattattgttttcaatcccactatcatatggtaaaattgttcggtttttaagtgcctaaaaatcccatcactaatgatttttattccgttttacacatcggtaaatgttcaaattgtaaagataa

SEQ ID NO: 58033 - DNA, 312 bp, Heterodera glycines
  Genomic contig location: Contig_ID=SeqID_5437; Location=2398..2709; Strand=+
  SCN-specific regions: Sequence locations=1-91,124-150,184-312
atggaacaggcgcgactaaccgtccaacaattgcgtcaggaggcaaatttgcagcgaaagaaagtgtgggtgaattactaaataaatatccaattatttatttgatatttattttttttaattccatttcccaattgtttcagctcggaagtggccagagagtttggtgtttgttttttgaatttgaattcattttggcattttgacagtctcgtcgaatattgtgaagggcacaaggaaggcgactgtttgttcaccggacggatggaccacaacccgtaccaggagaagaagtcatgcgtactgatctga

SEQ ID NO: 58034 - DNA, 382 bp, Heterodera glycines
  Genomic contig location: Contig_ID=SeqID_5437; Location=2806..3187; Strand=-
  SCN-specific regions: Sequence locations=1-135,157-291,313-382
atgcctttgatccgttcacctgacccacaacggctgattggaatggagcaatcgaaagccgacaagagaagtgaagtcgcaaaattgatcccaattcgatgtcaattctttgccatttttggggaccattttttaagattaaaaattgttttgtttctggtaaaatccttcttcaaacaattatttttcttcagcaaatttcccgaattcctcagctgtcatattgaggcgtttttaacgaattcggcgcattatgttattttttttgctaattgttgggtaaattcagttcaaaattgcttcatttttgttgaatgaagaatgtgattttttaaaagaggacattatttataagaaaatcgcatgcaaacagacaaattga

SEQ ID NO: 58035 - DNA, 943 bp, Heterodera glycines
  Genomic contig location: Contig_ID=SeqID_5437; Location=3401..4343; Strand=+
  SCN-specific regions: Sequence locations=1-190,243-276,305-430,459 -509,531-775,798-906
atgtttttgtgctcctttttcatctgtttccaatcgctttacttttgggacaaatttcgccaatcggcgggccaaagaattgcgacggtaacggagacggagggacagcccatgcgacagccgcggttcctcgtctgtgtcggccaacagagcgggcaatggaaaatgggggaggggggaaatggaaaataattaaattaaattaaattaaataaataaataaattttaataaaaaataattcgaaaaaaggtaaaataaagtgatgtgaatttagattattattttatttattttgttctcaattttaaagttcgctgctgcgcagccgcggcgaaagtgttgactttcgccaattggtttacaattatcaaatggaggaaaaattgaggcccgattttattaaacaggcaaaaaaagaaaaaatatttaaaataaaaataaaattaaaattaaaaaaggaacgaattaaaaatcctttttagcttcaaaacgaaatgggtttggtcaacaaattcctcagttcctcctccaattcttcgacgagtgttctccaatgcgcgggcattgtcctctcaaaaaacattcatttgcttgtcgaaattgggacggcacttcgagtgaattttaatttttgatttcgaaaaaaatatttctttcagttcgattacgcaaattttacacttccaaaaacgcccgacgaaattcaggggaaaagcgaaggaatgagcagcaaattacttaataatattctttgaaaatgaattacacatttcttttaaataaattaaatttttaggatttcgtttcgaaaggttacagtacgccaagttacggtcatcattggaccaatgtttggccaaatatttactggacgagatgctccagcaaaacaatgaaaatttggtaaaaaatattttttgtaaataatttaataattttta

SEQ ID NO: 58036 - DNA, 1440 bp, Heterodera glycines
  Genomic contig location: Contig_ID=SeqID_5437; Location=6543..7982; Strand=-
  SCN-specific regions: Sequence locations=1-12,34-130,153-436,458 -525,547-858,890-915,939-999,1022-1213,1252-1440
aatcaaactgaatgaaatgttctcattgtcagtatccttattcaaatgtttaattgtttccttaatttttcaattttcaaatggaaacgaagaaaaatttgggcgcaaaagaaaattggaaattcaatcggaagaagtggaaagaaaaaggattcattttggacaggaaaagcatcacattgggaacagtttggcattggcatctgctgacaatgagcagaagccgcaaaatttgcaaaatccgttacattttttatttaatccgccgaccgaaagcgaccggagggaattctgtgaggaatggcactatgtgtacgaacagggcactaatttcggtgccgaatttgactttccatctgaggaatttgggccgggcggagtcgtgccaattgagagcgatggcaactgcggcttccgatcgttgtcgtggattttgactgggactgaagccaatcataggcaaataagggctgacatcatggaatttttgaacagcgaattaattaatagtgaagatgatccagcaaaaagcaattggtggggtaagtgccatggattatttgttttttagggttagggattttcataaatgggccaatggtaaggaaattgaaatgcaaaatgatcaaaggcaatctggtagtgtaatgtgatcaaagctctaattagggatgtgcgagagtatcgttttcgattcccggctcgagaatttctcggatttttcgcttctcggttcaaagttatgggccaaaaaagaagttaatttttcattttgaaatttttttttggatttcgcagcaaatagaagcaaaagccatctgatgattttaagaatgcaaactatggttgaattttcagtaaaattataaaaataaaattttatttttttcatttttccctatttaatggcgtaattaggaaaagaaacaattattttaagtaattgagggccaattaagcgacaaataaataaacattggcactttgttaagaaatgtttttcactacaaaagaggaggcacggcaatatgccgaaacgaaaagaacagcagcagaaaatgtgggagaacaagcgaaatggtttaatgaggttgacgcatttacagcctcaaaattgtacggaattaatgtgataatttgcaaaaaagaaaaagaggacaataatttcacatggcaatattacagtccactaatgacgccggacaatgtgagcactaattacataattaatgaattgattaactaattgataacggaaagttaaagcgatggaattttgaaattcagttggatgccgcccaagaacgcactcgaatgtcggcattcatttacaattccccggcacattttgaagtgattttggagccaaaagaacgcaaaacatttgggcaacaagctttgaacatgcgaagaaaatttgtgatttatgaggaagattaa

SEQ ID NO: 58037 - DNA, 1465 bp, Heterodera glycines
  Genomic contig location: Contig_ID=SeqID_5437; Location=4595..6059; Strand=+
  SCN-specific regions: Sequence locations=1-68,152-201,230-505,527 -584,622-764,808-937,976-1065,1107-1197,1219-1442
atgacccaggcaaatggaaatggagttggcaagtggacaacggactgtgcgcattgggagggccacggaaaaggcaaaaaattgggggaggaataaaaatagaaaataaattagaaataaaaaataaattaaaatgggggtaaaaaataaatttggaaattgacaaaaggaagcaaataacgccggaggcgatgaacaaccagcaaacatttgattacattttggtgaaaacgaacatgctcgagtcgcacccggacagcaaaatccgcgtctttttggtgcacgaagagggcaccgacgacggtggaggaagggaacggcacacggcaattagggtaatttggtgggggtaattaataaatagaattggacttgtttaaacaggcaaattcaattgaactcaactcgggaaagcacgtggaagtgactctgcgtgggatgtccgagattttggcatgatcactttctaaacgttcgtttgactgatgccaatgccaattaggacgaagactgtgacagcaaatacgagtcgggctgtgtgccgtccaatttcacttattcgcctatggtaacagctgaaaaccaattaatcattttaattataatttgttattattttaacgccacaaataattaattatttgttaagtaattaatcaattgaggtgtgtcgctggtgcaaatccgaagtgcgcaaagcgtgcccatgcacagttaggcaattaaatgcactttgttttgtttttttcatattcaaggctctctttttaataaaatctttttatttccataattaattttaaaattcctccattttaaaatgccgacctctttctctctgaatatattggcgaatctgtgcacaactgttcactgctggaggtgctcaaatgcggacccattcaaagtgaactttaccaaacaggtgggcaaaatcataaaaatttaaaaataattttattttttatttaaaaagtaacgtcaattctttaaatgcttatcattaaagccctaaaaaagcattgtttgtgtttttggtgctcttaatatttggttatctctcactatttattcttatttattttattttaataatttatttttttgaaaatacccttgtccatcaaatgcctttaaaatttcaaattccccccccccccccattagtccatgccattcatttcattcgttcgtaatttgtcatgttttctgtgccatttcagctgattgtcccaacgcgtgtgtgtcggtcgaatacaccgccgactttgcggtccatgaactgacgctggagaagctgaacacgcgggtggacgacgcgatccaaaccaaatgcatggctgaacagcttcaactcgtggacaaattcaacgaacacaaattcccaaacggtggcggcaccgatccgtgggcgagggacggacgacagacaaaaatgtccgagaaaatgatgaaaaataactaa

SEQ ID NO: 58038 - DNA, 285 bp, Heterodera glycines
  Genomic contig location: Contig_ID=SeqID_5437; Location=8226..8510; Strand=-
  SCN-specific regions: Sequence locations=1-115,145-220,242-285
atgccaattgacagccaaatgtaaaagcatatccatcaatgttttaggaaatgaaaaaagaaaaccgttctctttaaacttatttgttaaataacttttataaagatttatgctcaattaaattatttgttttttatattttttgcaaaattacagccgaaaaagtgttgatttgacgatgctattccgatggacaaaaagtgtaaaagtaaacatttaatttccctatgattttttaattaagaaagatttattgcattataaaaaagagatatttgcaataaa

SEQ ID NO: 58039 - DNA, 370 bp, Heterodera glycines
  Genomic contig location: Contig_ID=SeqID_27345; Location=514..883; Strand=-
  SCN-specific regions: Sequence locations=1-296,318-370
aggtgaacctgctcaaaaagcgaccagcagtggaaaacaagggcaaactcaagagggtcagttcattggacgatttgtcaagacgaagccgcacaaaacgtgctaaggaaatagcgcggaacctcagccatctcttccgacccggtcgattacttcctaatttcttatttttataataactgctttattttcaggcattccagtacccgaaatcgacaaagttgtgcgccaggcccgtcaccaggccaatttcatctcgcccaaaaaaccgcccggaaaatggaccaaaaagggccgaacaaggagacaagaacgaatcagtccactcctggacatccaagtcacacttgttggatgtgttgatatttaa

SEQ ID NO: 58040 - DNA, 920 bp, Heterodera glycines
  Genomic contig location: Contig_ID=SeqID_27346; Location=649..1568; Strand=-
  SCN-specific regions: Sequence locations=1-430,453-581,603-920
atgatgggtacgacgacgatttcgaagaagaacgcgacctcatcaacttcgaactcggaaaaactcaaaagggaggcatttgtctttggtctgaaggtgggaaatttgttagagaattatgaaaagttgtcaaaggctttcggtacactcacgaaaaaaacgaccgatggaggtgcactgtgcgaattcattagacaaagaagaatttaggcggaaattcgacggcaaaaaatactcgagcgcgtgaaagccgaaccccgaatcaaaccgacacggcttctggcggagggcagcctgtgcaatttggcatcaactcgcccgccccctcaacactatcatggccgtcaacagtggaacagacctcgccgttggtgcagtactcattgagtccatcgtcaacgacgatattgcagccaggcacagcaaaacttacaaaattattcttttaaaaatttttaagcccgcccttgggaagaacccgtcgtccgtcgcgaactatttccaattccattttggaacgtgcactcacatgcggcttccgccctcgcaaggaccaacaatggactagaagcaactcaccttcatttctctgtatttattacttataaaacccacaaataaaacaattttagaaaggtctttgtcatcacccagccctttccgatttcatttctgaagtcagcggaagcatcgaccgacaggtcgacgcagcgaggtcagccgggaacttcatacacaaacgacacaaacgctacgtgctgcaggacgcagtcatcatgagaattttagcggacgccaaatacgacaatgatgccgaaattcatgatgctatgacggctcttggtctgcaggtcgaaggatacgcaggaaaattgaaggactacgaaaacatggaagattcaagcatggatgtcgcttaa

SEQ ID NO: 58041 - DNA, 911 bp, Heterodera glycines
  Genomic contig location: Contig_ID=SeqID_27348; Location=471..1381; Strand=-
  SCN-specific regions: Sequence locations=1-264,286-308,330-381,419 -618,640-834
atggccataaaatatggaccaaaaatcgcaaaatatggacataaaatggcaaaaatctcaaaatatggaaataaatggcaaaaatgtcaaaatatggacatacatttttcaaaattgagtgcaaaatttcttcaaatttattggttgaaatttcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaaacataaaagctaaaatttattaatttttttagcgcaaaatcaacaacaaaagcgaaattttcgcttttttgcttatttttgacataaatttattaatttttaagaaaatttaaatttattcaatattctcgagaaattttggcgaaaaaatgattttttgaaaactgtttcgggttttgggctcaaaaaggctaatttagctgctgggggccgttctaatagaggttttttagaaagatgccaaaatatggacataaaatatggacaaaatgccaaaatatggacaaatatggaaatatggacctaaatcgcgaaatatggaaaaatatggaaaatatggatatagaaatccttcctagaagcttcaaaccaagctaaaaacatgtttttcgtgcgtttcaggccctcaacagtccaggaaaaaaatatggatttccatataattggactccctatttatcattaaagtcggattttaatgacgaaatagggtcaggggtgggactgcggagggtaaacaccttaaagcggagttctttttttaaattaattaaaaggcatttttaagataaaaaaaataactataaatatatttcacaaaattaataataaa

SEQ ID NO: 58042 - DNA, 155 bp, Heterodera glycines
  Genomic contig location: Contig_ID=SeqID_27348; Location=1100..1254; Strand=+
  SCN-specific regions: Sequence locations=1-155
atgattgcacgtaattgccgaaaaaattcgagaccaatttccgaatgttgaccgactaattgcaaaacgaaagccgtctttgtcaaagcgccttaccgagtcaaaaaatttggaaatgtatctcatatgaaatttcaaccaataaatttgaagaa

SEQ ID NO: 58043 - DNA, 346 bp, Heterodera glycines
  Genomic contig location: Contig_ID=SeqID_27350; Location=595..940; Strand=+
  SCN-specific regions: Sequence locations=1-258,284-346
atgctgcttcttagcctggccaggcacctggtaaaaataagtccgagatcaattttaaataatatttgaaaattatgtgaaaattgagaaattattgttgctccttacgattctttcaccatttagcagttttctgccctatttaggagtattttctttgttttaatcctggttttcataaacattttcttcttaaaaaattttaacaattttcagaaaaaaattctaatgtctcaatttaactttgctgaaatgaagaaaaaatatatataaaataatttatgtttaaactttttgttgtgccggccgagggcaaacaataattaccaaatttattgaagacaaa

SEQ ID NO: 58044 - DNA, 361 bp, Heterodera glycines
  Genomic contig location: Contig_ID=SeqID_27351; Location=683..1043; Strand=+
  SCN-specific regions: Sequence locations=1-361
atggtaccacttatttcctcccatattaagcaaatttttcagaggtaattagcgccaaaaaaaaaattttacggtgtttatttttttataacaatttttttcagaacagtggctaacacatctaggagtgttagcaattggcttgcgaaagaaaaggaggcaattgaatccgctaaccagcagcaggatgaaagtagcgaaactgaaactgatgaacaaagtcatgaacacgcaaacaccacgtcaaatagggcagcgcagcgtgcacgcagcatgcaacgccaaacgcaaaatgctgcagcacgacaaccaagtcgcgcacagcggcaatccgctgatgaacggcatggaagcagttcac

SEQ ID NO: 58045 - DNA, 1156 bp, Heterodera glycines
  Genomic contig location: Contig_ID=SeqID_5438; Location=1..1156; Strand=+
  SCN-specific regions: Sequence locations=1-313,335-417,439-572,595 -1156
  Gene Ontology: Mol. function=ATP binding; Cellular component =cytoplasm; Biological process=insulin secretion
tttatttttttgattaaatttaattctttgaagggtaaccgcgcggagaacttttcaaggtcagttttatcttttacgaattgtttttcatttggtttggagttttcattaaactaaaacaggacattgttgcgcgggaatattacagcgaagccgacgcaaggttttgaattggatttaccagggaatctgatcagtttcttttaagccaatgcatccaacaaattcttgaatcgatcgcctattgccacgacaacagtgtggtgcacaggcaagtcacggcgaatcccacaattaataattgggcattttaagggatttgaagccagagaatttgctgcttgcgagtcgtgccaaaggagctgctgtgaaattgggtcctttgcttaacttattcgcgaaaatacgcatggaatttagctgattttggtcttgccattgaagtgcaagggaattccgaatcttggtaaagatcattttcattacacatattacaatatattacaacctattcttctttcaaaaatttgattagggaaaatcgaatttttattttttttaaccaaataatgtttaggaaaaatttaagtatttatgtaaaaacactatacgcatttcaaatcatgccaatatttaactattctttcattttaggggcgggtatactaaaaaattacttgatttcacatttaggtatggttttgctggaacgcccggatatctgtcgcccgaagtgctgaaaaaggacccttatggaaagccggtggacatttgggcatgcggtgagaatattttgtgtaaaatttgtttcaaagtgtcgtctggttttcccaggtgttattttgtacattcttttggtcggttatcctcctttttgggacgaggatcagcaccgcctttacgcacagatcaaaaacggcgcttatgacgtaacttttcctttttttctacataattcccattcctccacttcagtatccgtctccggaatggtaagcgttcggttaaaagggtacagtaagccaaattaaccaatcaatcgccagggatactgtgacgcccgaggcgaaaagtctgattgactcaatgctaacattgaacccgcagaagcgaataaccgcagaccaagcgctaaaagtgccttggatttgtgtaa

SEQ ID NO: 58046 - DNA, 4448 bp, Heterodera glycines
  Genomic contig location: Contig_ID=SeqID_5439; Location=132..4579; Strand=+
  SCN-specific regions: Sequence locations=1-234,261-399,424-721,744 -771,793-854,973-1233,1266-1841,1863-2028,2051-2067,2089-2442,2464 -2528,2551-2815,2837-2880,2994-3092,3114-3532,3556-3613,3635 -3798,3868-4448
gatcggtcgcgggtcgcctcggtgatgcaccgacaggacaccgtcgactgtctgcgcaagttcaatgcccgacggaagcttaaggtgagggcttttttggcatcgtacgggagcaaaatttgggaaaaggagaaatgtgtttttttcgcattgaaagtgtgcgtttgagtttaaattaaagcaaatgactttccttttccctttgcattttgatgtttggcgtacatttgtcattgtctttttgtggtgttttgtttttacaattaccaattaattggtttttgttcgtccctttccctccctttgccactaatagtcggagtgattttatcatttaattgtaaggcgctttcgacctttcccctcactaatcgatccaattgactttttccgttgagtgcctttccctttttccctttgagtggtttttttgattcctttccctccccaattcatttgatttctgatcagtgttcgtcttcgcttttattgtaggctgtcatttcggctgttgccattgtaaatcgtatgtcccattgtatgagtcctcaaaacagtcggacgaccgtcccaagtccgtctccatccccaaattcggccgcacagcccgacattggatggagtgtgaaggggccgaccaacaacaacggcatcgccgcttgtgccgattcatcgggtggcacttcagcaaataatggggtgggtggcgttgtgtgaattgtttaattgtttttgcactaatttttctaaaaactaaccaaattaactaataacacactgcaaaacgtccactttcttattcaaattatatttcaggattttgttccaatttctgtgctttttttgttgagtgatttattatttttgtttgtttgtgcgttcgttgctactttctttcttcatttcatttttttatttataatttttggtctttttatgctttatttacctttctttttcttttatgtttctaaaaattaaagtaaaataaacgaaacaaaaagattaattaaaaatgacaaatttcgaatgatattttaatcattatttacaatttatgcttatcacgcttgctggctgtttattgttaattacatatatttttccgtcttgttagtgacctgatcgactcatgcaaaataatatttgaattcgcattcgaaattcgaatgttttagtttattcgaaatgtgtgtcctttgtggtcagcaaactgacaagcagcacaaaaattatttaaaacttttgaaatttgtcatcttttttgtttccagattgtatataattctcgtcgtaatttgaacttgattttcagggtgccattctgactacgatgatcgccactcggaacatgtccagtaagttgttgtcgtccgaatgtcccctgactttctcacgcgtccctaattggtgcattaggccgtaatttgctgaacaaaaaggacgtgccgccaagcacaatcaaagaaagcaccgaatcctcgcaaacaatcgacgaaccggacggagtgggcaacgccgccggaggggacaaaggtgaatttggattgattgactaagcatttgcagtggacgaactcacactgactgactaaccgacccaatcattttcatttcaatgttttccctttaccatttgtcatcacttcttcctccgaactgaacgagccaaaaattcgtcaatattctgcaagaaattcttgtttttaacgactaaaaggaattctttcttttaacgaatttttactcgggtgtttttttgggtagaaatcttttttttgcgtgtgactaattaattaatttaattgcttgctcttcttcagtgtctgtccgttcttccctttaaaattaattcttaatttttaagcgatcatttctatcaaattgtcactgttaattacctgaatggaaatacctttcgagttttttcataaattaaaatcataaatatttcgtcaaaacacaatacccttcaaaatgcacttttgaatgctttttttggttaaagctaaagactaactgtcttaactttgttttcccccttttccccattaattgatttcgaaataattctgtttttcttcttttgtctgacactttttccgcttaatttcctttgtcccaccattagtgcgcttaatccatgtgctgacatttggcgcctatgtccaaaatcgggttgaaaacttaagttctttcaatcctaaaatagcctaatcagcattaaagtcaaacatattcttcgggttctgtttgaatattgatgattttttcaaaaatttgctgctgatcaaattatcggacacactcatttcctatcacttattcaatgctttttaggcttaaagtttgaaaccgattttggaataggcgcaaatgtcatgtaacccttaaataaactgttttggtttcatcattgatcattgagcagttacgctttaaacattggaattggttgccaaatttcgctttcttttggttaccgtattccgccttccaccagttaccgtattccgttcccctttggttctgtttgtctgtccatctgtcactgtctttctgcacaacttaaacacacttttctttcttcgctagcgcggatccaacatgagaacactgtggttgaacgggtccttagcaacagtttgaccgcgaaagcgtccactcagccgcagcaaccgcttgctgtggtgaccggcgccgcttccgccacgttctgtgcccactcgccaatcggcgcgtcggccggcacttcctcgcccgcgcctccgcttgcttcttgcgcctcccccgtcctttccggtgggtgctttctttgttcttctctcgaattttttggctttgtcttttcacgcgggagtggcaaatgcgctcagccctttcctctccttctgtttgctgcttctttctttcttgtgtttgtgtcgttgcttctttcttttcttccttttttgtttgcttgtccattttcggttacttttgtgcttattcgtcataatgccaatcctatgtatcaattgaccattatatccgagttttactaccccttggggctgtccttatgtacaaataatttgtcagtccatcgccactttctccccctttttgtttgctgctgcttcggtgtgtaatttgatgctttgcttttttactttttgcgttccgttcatttccccccccccatttttcttttaattttgcgtccaatcggccaaatcgttcgttcctttcccgtccatttaacttttgttgtgcatgacaaattttagtggtgtttagtccactgctgctccagtggatgcgggtgtaaaagtgtgagagtgttattaatttttggcccctcccttagacatacgccacacaaaattccgccttcagcactttcattccaaacaatccctcattttttttccattggcgccggaaacattttgtggggcggtgggcatgtggctgtgaaagttcgttttatcgattcattcaaagagacgggcatttaaaatttcgagaaaggaaattataaaaaacgcagtgttttaattttttgaaaaatgagtgggcatttaaattattaaaattacgctatcattccatgattaagcttaattggcggatgataaaaaatccaaataaatgctgaagggatttgtcccatttgggccgatggttaactctgaaaaccacactgaccggcctcccccgcacctccaaccttctcccactgactctaatccaaagatggcctccgcagcaaagagtaagggcttaatacataaatcaatgtttattagtagtagcagtggtgtgaacaaaaacttttttgcatgtttttcttaatttgtgtgtttttctctctttcctttctcattattccatttctttaaatgaatatgaaaaattcactgtgtgatgacgtagcgttgtataaaaatgttattattgttaaaatatacacaatccgttgaaaagctctgcgggataaaccatttacaatctcaaaattaagcacaaaagcaggaaatcgtgaaactcactcagcaactgcttaccagccaggactttgactctttttcgtatgtgcaaatgaaccgaacccattcggcaattgtcaaaacagagcgatttaggaaattgtgtgatccaaatttgacatgtttcgagccagaaacacttggcaatttgatcggtaaatgaatgggaagggaatgcacaaaatgcaccaccattcttcattttggcattttcagaagggatggacttccacaaattctatttcgacaacggtgggtttgggcgagggcggccaagggattttcaaagtgttcaacaaacggatgaataatctaaggccctcaaattccactaggcgtaacaaccgccgggatcaaacatcaccaccaccaaatccacacgaccattctgaacccgaatgttcacctgttgggtaa

SEQ ID NO: 58047 - DNA, 1514 bp, Heterodera glycines
  Genomic contig location: Contig_ID=SeqID_5439; Location=5281..6794; Strand=-
  SCN-specific regions: Sequence locations=1-695,726-759,781-1514
atgcgtttgaccgatgaacccaacttccagggtgaactcgagtcttccgaaatgttcggtgaaaacgaagggaagaaaattgctgccgttaaaaagggccaaaacgaatttgtggagtttgtggagccacgtcaacaccaaaacaaccgccacaaagaatggatggacaaacggtgaacatttattgttggccatctctttaacaattctttttttagtgtgccaaccgattcggacagaaaaacgcacgccttttatttcctgaccaattccggcaacattctcttcatgggtttgccacacttaccctttgtcctattttttcaccttttcagcttatctggccgtttgctgttttggcattgtcgcgggcgctgtcggcggtgtttactattacaatcagttggactaactcgaaactcattggcatatttattccctcttttttagtgtccgttcaagtcgaattgacgaccccttcaacgaattcactcgctattcccccgccgggcccacaaaagacaaacttaagaagtcgggttcgcccatattcggtcagagcggcgacgacactttgggtgagtaaaaaacaacggaaaccgaaggagtaatttgcatttttaagcttacaaagcgcaactgcaccattaccagcagcagaaacaggcgaggaattcgaaatgaaaagttggaaaattaaaaagaaagttacagaaaatactgggcacagcgtcggggccggtggtggacaatgtgagcgacaacgaagaagacacggacgaaatggaccacaattacagcgtttttgagtgtccgggtgagcggtgaatcattccattcgcttgtcaatggtcggccattcattccctcctcactttcctttcaggtctcgcaccaaccggtgatctcgaaatacaaaaccccaatttcgtgggcgctgagaagtcggcagccggcgaaacacgccgcacagaatgaagccaaggaattgttacccccttccaccctacatttattattgcgttccttcccaccaattcccttgtaaattaggcctcaaaatccccgtgaccgaccaaaacatccttttccccttccactgctctagtctgaacacttccgcacattccgaagttctgtccgattaaacattcctatttgagctattggatttgaatgtctacgctttggggggcttttcgataaacttgggcgcagtgttgtacagaaattgacgataaaatgttaattcattttctatttgcctaattaggtgtaattataacagagttcattttttatccattgtgatttgagatgataggaaaagaccagatgatagaccgtaaaaggtggcaaaaaaatgcggcaaacaaatgttttggaatactaattcaggaaactaaccccgagggtaggccaaatgataaaattttccatgactgtgaaaagaaacagaaaaagacaaagaaaatagaccagaaataagatgaacatttgcgacaaaaaataaa

SEQ ID NO: 58048 - DNA, 206 bp, Heterodera glycines
  Genomic contig location: Contig_ID=SeqID_27352; Location=194..399; Strand=-
  SCN-specific regions: Sequence locations=1-48,70-206
aatttatgaatgctataaagtgcagaaaatagtgcgaacaaagtacataaatcaaatcctgttgaaatggataagtacgatcaaacgcgtgtgtttaatggagttttcaggcatgacaaataatttgctgggacgtatccttgctgctgatcagtacagtgtctgtgttggcttctcttcctaaccaaccaccattcattgtttcc

SEQ ID NO: 58049 - DNA, 801 bp, Heterodera glycines
  Genomic contig location: Contig_ID=SeqID_27352; Location=478..1278; Strand=+
  SCN-specific regions: Sequence locations=1-580,602-801
ggattcgtttgtttggcataatccgaaaataaaagtcattaatttactcttatgtggctctttggcttaacagaacattcagcacaatgacagattccgtgttaggtcaaaaagaatgtttgttaaacagtgtcaattcggagggtcgggtgagcggtcgcatcggatgcctttctcttcttggccaggctgacgttgccgttcttcttcagcccattcagcaattgttccttcacatgattatactcaacgacacaagttcggcacaacgctctgtacaattcttgacctccgatcatttctaactaaaatggtcgggtcacccccaacgcatccatagacccaactcatccataacactgcgagtcatcgtcgtggcatttttttgattgtgcggtctgcttcgtggcaattttatgcatggatgagttgggtatggataagttgggtttaccccaaaatggtcttacatgaaaatgcaaaattatggttgttcagcatggattaataatgcatcattaacatgttacagtatgacatgctaaaatgtctgcgtacggtaagtcagaaagctacggtaccaatttaaaaaggaggaaattaattaaataattccctcaacactttattcagttgaatcagttagtggtgtcaaaatgctttcccaccttcgtgcattccgacattcgaaatgtgaatgaggcggactgtccacagcggcaaactgcgcttagtttctcaattttctcagccaaaggaatgagcatcgccacattttggaagggctggtaaaatcaaaag

SEQ ID NO: 58050 - DNA, 1067 bp, Heterodera glycines
  Genomic contig location: Contig_ID=SeqID_27355; Location=355..1421; Strand=-
  SCN-specific regions: Sequence locations=1-14,149-153,221-222,419 -455,657-675,789-816,1021-1042,1064-1067
  Gene Ontology: Mol. function=protein tyrosine kinase activity; Cellular component=chromosome; Biological process=embryogenesis and morphogenesis
aaaaggaaaagccaaaagggaaggaaaagcgaaggaaaagccaaaggaaaagaaaaggaaaagaaaagcgaagaaaagccaaagtaaaagaaaaggaaaagaaaaggaaaagaaaagcgaagaaaagtcaaagcaaaagaaaaggaaaagccaaaggggaaggaaaagcgaaggaaaagcggaaggaaaagccgaaagggaaggaaaagcgaaggaaaagccaaaggaaaagaaaaggaaaagaaaagcgaagaaaagccaaagtaaaagaaaaggaaaagccaaaagggaaggaaaagcgaaggaaaagccaaaggaaaagaaaaggaaaagaaaagcgaagaaaagccaaagtaaaagaaaaggaaaagaaaaggaaaagaaaagcgaagaaaagtcaaagtaaaagaaaaggaaaagccaaaggggaaggaaaagcgaaggaaaagccaaaggaaaagaaaaggaaaagaaaagcgaagaaaagccaaagtaaaagaaaaggaaaagccaaaagggaaggaaaagcgaaggaaaagccaaaggaaaagaaaaggaaaagaaaagcgaagaaaagccaaagcaaaagaaaaggaaaagccaaaagggaaggaaaagcgaaggaaaagccaaaggaaaagaaaaggaaaagaaaagcgaagaaaagccaaagtaaaagaaaaggaaaagccaaaagggaaggaaaagcggaaggaaaagccaaaagggaaggaaaagcgaaggaaaagcggaaggaaaagccgaaagggaaggaaaagcgaaggaaaagccaaaagcgaaggaaaagccaaaggaaaagaaaaggaaaagccgaaagggaaggaaaagcgaaggaaaagccgaaagggaaggaaaagcgaaggaaaagccaaaggaaaagaaaaggaaaagccgaaagggaaggaaaagcgaaggaaaagccgaaagggaaggaaaagcgaaggaaaagccaaaggaaaagaaaaggaaaagccgaaagggaaggaaaagcgaaggaaaagccaaaggaaaagccgaaagggaaagaaaagcggaggaaaaattaa

SEQ ID NO: 58051 - DNA, 226 bp, Heterodera glycines
  Genomic contig location: Contig_ID=SeqID_27355; Location=53..278; Strand=+
  SCN-specific regions: Sequence locations=1-226
atgaatcagcgattatttggtgacggattcagcggagccgcaatgtccgcagggcgacgcgtacaaagactaccagggaaattacttcacatgttcggtgagttgggcaaagggtcgaactgtaacagaacgctgaagttgcagaacacgggcaatggcaacacgtgccctgtcaattacgaatgttatttcgacggttacgtgtggggatgctgcccgacaaaag

SEQ ID NO: 58052 - DNA, 729 bp, Heterodera glycines
  Genomic contig location: Contig_ID=SeqID_27356; Location=431..1159; Strand=-
  SCN-specific regions: Sequence locations=1-729
  Gene Ontology: Mol. function=electron transporter activity; Cellular component=integral to membrane; Biological process=gametogenesis
actgttcgatgtttccgatatggggtcttggaacattcagcggggaagagaccagggcattcgaccttgcaaagactaccgccaaatttgtgggatggcacggctaaagtcttttcaggattggccaggtcgacgggggggggggggggggaaatgacaacaaaaacaaaagaaacgaattgcagaggcaaagggagtcgaagcaaagaaacgcgtgtcgattttgtacaacggcaaagttgacgtgagaattggggagggaacactaaaagggaaaagagaaagcgacgaaaagccaattactactaattgccaaattaggacatcgatttgtacgttggcggtttgatggaggagccggtggacggctcactgctcggccctacattctcctgcattatcggagaacagttcagacggactcgtgacgctgatcggtcggccatttgtcacctttgcccgccctcccccttaattgcctattgccccccccctctctaattaccccttttaattggctcttttccgttcagttttttctatttgaatccattgatgtattcgcctgatcaaatcgcctcgcttcgtcaaatcactttttcatcggttatttgtgccaccggcgaagattttcgcgccattaatcccagcgcctttctcgtcgaagacgggcaaaatgccgtgccatgcgcttccatcccccaattggaattaagcccatggcgagac

SEQ ID NO: 58053 - DNA, 621 bp, Heterodera glycines
  Genomic contig location: Contig_ID=SeqID_27357; Location=89..709; Strand=-
  SCN-specific regions: Sequence locations=1-247,293-366,391-621
atggttttccgcggtcgcgagagctgtcaattttctggccattttccaaagtcagtacgtaatgacaaacgacctttcgaccaaccgctgggtaagtcgcttctgtgatttggaaacggaccatcggattgttttcctattatttgtggattcttaccatctcccgctttgagtgtttcgattttcactggcattttttgtttgcgtcttataattagttttgctaaccaaatggaagtaaaattgctataaaaaagataaaatattttaattatttaacttaaaaaaataagttaggtatgacatactgttcattaaagaaattgcatttttaggcagaaaaaagcgcaacaggcgcaaaaattattattagtaattagtgattactagggtattggtatgtaattgcgcatattttttcatagactggaaacagtctgaaaactttatgtacctagatttatttcctaaaaaatttttttttgcattttttcgaaaaagtcctctattaaagtctcacccctttattaaagcctccctgcatattggtaaatttatgccaaaaataagtaaaaaaaaattgacgttttaggttttacttgattttctcctatcaataaa

SEQ ID NO: 58054 - DNA, 430 bp, Heterodera glycines
  Genomic contig location: Contig_ID=SeqID_27357; Location=586..1015; Strand=+
  SCN-specific regions: Sequence locations=1-190,212-239,261-430
  Gene Ontology: Mol. function=peptidyl-prolyl cis-trans isomerase activity; Cellular component=membrane; Biological process=transport
atggtccgtttccaaatcacagaagcgacttacccagcggttggtcgaaaggtcgtttgtcattacgtactgactttggaaaatggccagaaaattgacagctctcgcgaccgcggaaaaccattcgaattcactgtaatttctatgattattattctaacgaatcttattttaagattgggaagggcgaagtgatcaaaggatgggacgaaggcgtggccaaagttgtcattttcacatttcaattaaaattttcttttccgcagatgtcagtcggtcagcgggcgaagctgaccatcagcccggacatgggctacggagccaaaggaatccccggaacggtaagggggccgatcccatctcatttacaaaaaagcaacaattacagatcccagggaattcgacgctcatccttcgacgggggaattga

SEQ ID NO: 58055 - DNA, 90 bp, Heterodera glycines
  Genomic contig location: Contig_ID=SeqID_27360; Location=103..192; Strand=+
  SCN-specific regions: Sequence locations=1-90
cgacgcggcgaagccgcgtccctgagcgcgaagcgctttccccacggcaccagaactcaactgaatacaacaaagccaactgtgcaccta

SEQ ID NO: 58056 - DNA, 2114 bp, Heterodera glycines
  Genomic contig location: Contig_ID=SeqID_5441; Location=1614..3727; Strand=-
  SCN-specific regions: Sequence locations=1-147,235-276,303-569,605 -966,989-1841,1864-2055
atggtggcaccaattggactgttgcaccgaagacaaattttattggccgatcgaatgattcggattcagaaaatgctgcaattggaaggtcaattccaagcagtgaaagtgatcagagcaattatcaaactgatcacaatgaggtcgaatttttatttatgttaagtaaaatttaatttaaatgcccaaaaaattttcataaatatttcaaataaaaaataataattaaatattgaaaaaggtaaagtaaatttttccgaaaaaatacttgaaagaaatttttaaggatttgattttaagtttaatttggttttcgtcaaatactgaaaagtacgtttgaaaatttttttttccattattttttgcttttagcattccgatagttcaatttccgctgtttcaatgaaaagtgacagcgaaaaatcagacggagaaataaaagaaaaaatggccaaaaattatgcagaacattcattcaacaagaatgaccaaatgttggtgcaaaaatgggaagaaattgaacgaaatttgcgtgaacaatacgaaaaacggggtaaatgatttattccaaaaaaataatatttttttaatttataaaaaaaaagaaaattgccaaataattaggctaatgccgaggccttaggaatttcatgctcacatttttcattttattcccatttagttttccgtttattttcacgccccccttttcgcgacaaatgattgtttaatcactttacgcttttactgatcactccgtggtatcccccacccccctgcatcgttcgtgaagatatggcactttcccttattccctcccctgttgattggtaaaaaccaaattccctacgccggcacgaccatcgcgcacggctgcgcaactccatcaaattagaggcgctagtgtcaaagtgttaacttttgccctaattcggattagtgatttgaaaataatcaaaatagatgtcagatcgtgatctggaactccaaacctcctccctccgtgaacaagttttaacttgttattatctcaaaaaaatttgcaaacccccccccccttaagttttttataaatttcaaatattttgttcctcaaaattatgtaaaactcaaaaattaggcgcagaacactatagaaagcggcttgaaattgcggacccgtacgatgccggacaactaattgtgcgggaacatgggatgaagcggataattttgatcccaagagaagatgaaattgcccggacagtgtacagaattgaaagccgcggagcaggcggtgagatcaaagaaaaagcgcttggcaaaagtgttgaacaatcgtggcgaaatgccaagaaatgtttgaaatttgtgacaagcaatgtaaaggagcagcagggaaaaaatgatcggcaactgtgcaaaatgccaattttgactaatgagcgtgccgaagcttaccaacaatgggcagcaattggcagagagatgcaacgccgaggcatcccacccctttacgaggtaaatagtgacaaatgatcaattagggagacaattaattagtgcgaataattaagcatcccacccctttacgaggtaatcagtgacaaacgattaattagggagaaaattaattaactgcaaacagttggcgcaagaggccataattgacatatttaaaatttaaattgaaaataaagactaaaaaactgaaattttaaaatttggaaaaaaattctcaaaaaattttcgcgaaagaaaattcaaaaaaattcgttaaatttattttgaatttataggtttaaatattttttcgttatgctttcgacttcaattttgaaaaaaaagaaaaaatgaaaaggttttaaaaataataaattttaagagaaatggcgaaataatggatgagaatgaattgatgcttttacttgaaaaagcattcaatgcattggttaatggggagtcaaaaataccacgaatgcccaaaaaagtaaaacgaacagaaacattgacaaagtatcacacaaaaattgccaatgaaaaacgaacaaatgagcagagaatgccggaacaaagtaattaattaaattttttaatagaattatacaaagaaatttataaaaattattaataaa

SEQ ID NO: 58057 - DNA, 2604 bp, Heterodera glycines
  Genomic contig location: Contig_ID=SeqID_5442; Location=14..2617; Strand=-
  SCN-specific regions: Sequence locations=1-239,261-506,536-758,798 -952,975-1086,1113-1501,1523-1693,1715-1752,1790-1797,1839-1941,1963 -1987,2009-2287,2323-2482,2505-2531,2553-2558,2580-2604
atgacccaaatagcagcgaaacaagcagcaaagaaaagtacagtacacctgcttcaagtgtggaagtgttgaatagagcaggaacaagaatactacagtgtttctcgccgcttacttccggtacagatgcctactgtagccagccaagtgatgcaaatagcagtgaaacaaacagaagttcgagcacagaaacttacagtagcccaacaagcagtcgaaatggttaccataccacaaaaaactcatcctcatccgcatctttgccatcattagagacaattacagatactacagtaaccgaggaagaggcgagtgacaatgacgagaaatattacactttaccatcatcgcatgatgatcggacacggtcacaaaagcccaaatttccgccaacaataagtttgacaacggaaaatgaggaggtgagagaacgggggaaaatggaattgaaattttttgaaatttcgaaaacactatagggataaagtccccaagaacacaaaaagaaaattttaatataaaatatcaaaaatttcttcaaaattatccaatgaattattttcatggaaaacggatttcagccccctaatagaaacaaaaaaaaaatagagaaaatcccccttgaaaaaatttaaaaattaaccaaaacttaattaaaatttacacttcgtaaaaacccagatatgggtcctacccgtatacgatttctgatataaaaaaattgaaaaataatccaaaagttaattcaaattaatctcttttattgaaaaataatttaaaataaaaatgttatttttgtgtacatacatattaacatattccaaaaaatgaaatgtttttacagctgcggaaattgaacgatttttcggccagagacccggacttgtggttaaacgaccagcagaacacagaaccgccaaattggcattgcgcaagattaatggtaagcctcttttaaatttaaataatattttctcaaatttttgaccagttttaacaaattttttctcaatggtttcacaagttttgggccgtagaattgatataaaatcttaaaaaataatcatatttcgggaggcattactcaaattttttattttttttattttttacaaaaaagtgccattttcgcgaaattaaattgacattttgagttttttttggattagtctacctgtctcatttctgggtatcaataaatttgtgcaattggcaattttgggctcatttagggatctgaaaggcgcctttgtgaggaatggaaagcaattcaccgtgccattgtgcgcttcatcatattttttgccatcaaaaacgcaaacgcatttgtgccaaaaattgtagttgatgaccaattgttggccactgttgcagttcggccccgattatggccagcacatgcgcaaattgacaccattcaaacgggcattggcacaatgccaaattttggcaggaaaccgccatttttgaatggaaaaccagcttatgaaaaacgcggtggcatggcactcacatttgccatgctacgggtcaaagatgcgtacaaatggcacggcacatttgttgaggacgcgctcaaattcaccaacaaagccatggttgaaaaagttgagggatgggccaattttgtgggcaattttttgcacacaccgacctatgtgtgggcatatcactacaagggcacggattttgaagtaaacgatgtgccaaaggtggaagaaatattgaaaatgtaagcctttttaaatgtggtttaaaattatttttaaaaatagtaaaaattaaaattggtaagggaatcatataaaaaagtgaaaaatataacccatttttggaaaataaattaagcgtaaatttttttaatgtaattatttcaactttcgggaagaaaaagtcggcgatcggagaggaaatttctcgacaaaatttatcgggatggctgggaaaaattttaaaaaatttcggggagcaatagccctaattggggagtttgtattttcaacagaaaattttccaaaacaaaaaaattcttaaaaatccatttaaagacaattcagcagaagatttgggggtgcaacagacgactttcgcattagtccttttttggaaaaacggctacgaattcttgttgttttttttttgctctccggcgctgaaattaaaaaaaaataacagtggagaaaaaaaatttaagatttcgtatttcctcctcggctttgccgaaaaatagccaaaaaattctgtcgctgctttgggtaattaattggtctacatattcatgccaatgaattaattaataattaaaaacaaatctaaattttagtgcacgtgaactgctagtcccaattcttcaaaacaatttggtccttgacggaattgttgatgatgacccaaatttccctgaaccgccattgcctatcgtagtcagaaataccgcaaatacgaaacaaattaagaacactttgcttcccaaaactgatgataaatatgtaaatacattagtattatccatggatatctaaagccacggattttgggaaaacattgaaaatttaagcaaaattataaaaaaaaataatcgaattagcattttccattaataaa

SEQ ID NO: 58058 - DNA, 108 bp, Heterodera glycines
  Genomic contig location: Contig_ID=SeqID_27363; Location=144..251; Strand=-
  SCN-specific regions: Sequence locations=1-108
atgcgtctcccatttctgtcgcccgttattcaaaccacatataatatttcagcaagtcacacgcccgatgacgatatgtcgccaccaaattacagtatggcacacatg

SEQ ID NO: 58059 - DNA, 101 bp, Heterodera glycines
  Genomic contig location: Contig_ID=SeqID_27363; Location=485..585; Strand=-
  SCN-specific regions: Sequence locations=1-101
aaattagtcaaaatacatgtcagattcgtgattagcgacctttaaaaccccggataacaaattatcatgcttttttatcacaaaaaatttttgcaaaacaa

SEQ ID NO: 58060 - DNA, 282 bp, Heterodera glycines
  Genomic contig location: Contig_ID=SeqID_27367; Location=152..433; Strand=+
  SCN-specific regions: Sequence locations=1-109,131-282
gtatggcgcgagacaattacgcgcaccgaaacccaaatttatccgatttggacgttccggacaaaaaatgatacctttcagcagaagtttttcaacagaaactgtaattttactaaataattttctttgaggattaaatgcaaaattaagcagtacggcgacgaagggatcaaccaattggacgcgttggttgatgcggtcgataagctgtatcaatcatcgccagaaattagggcattcaaaactgcgccaaaaagggcacaaaagttcatacgattcggc

SEQ ID NO: 58061 - DNA, 639 bp, Heterodera glycines
  Genomic contig location: Contig_ID=SeqID_27368; Location=1115..1753; Strand=+
  SCN-specific regions: Sequence locations=1-639
atgtcgagtgactgtggcctgcataaataccaaattattgtcattgaaaaatcagttttgggattgggctgggatggattttgggctgataattggacggctttttcgttacttctaactttaatagataataaaaactcaacagcaacaaaaaataaaataaattcattcaaaagaccaaatcaaactatgatttggccttttgttttggggctgttaatgtccctcgggcattcggctcccgttgtcaatacccgcaccgaactggcgctgcaccaaagcatcgccaaaggacaaggcaccaccgcatccactgcaaaaagcaccatgactacagcgattgctgtcatcgaacaccattcgaaagtgacttaaaggcttaacaaatgcaagttcgcacactttttttccaaatttaaggaaaacacccgagctctgacggttttcaaacgtgaagaaaagagctggaccagcattttgctgagcttgctcaaaggaattggcgggattgggacatttatcttggatttgggtaaagacattatcaaagacgtgttgaaaaccgtcaccgaaaagttgatcgaccacgcgctgaaggaaggtgttggacaaggggtgataattaagaatatgctataa

SEQ ID NO: 58062 - DNA, 626 bp, Heterodera glycines
  Genomic contig location: Contig_ID=SeqID_27371; Location=25..650; Strand=-
  SCN-specific regions: Sequence locations=1-317,357-480,502-532,563-626
atggacccatcaaatggtttttacaacagagaagcggacaaagtgacattgaccattgatgccatcacagtgaaagatgaaaaaatggagaaattcgtttccgaatccaacaaatcggagtggacactttctttggaaattgaaaaaatgtcggaatttttgcgagaactcaaatggactgaacgtaaaagcgaaacagtcacttatataaagggattgccatggaaaatatttgcacaaataagaatgaagtcggaaggcaatgacaatgagaagtggttgggcattttccttttgtgcactgctccaacagaaggttaaaattaaatattaattaacaatttaataattaatttgcattgggcagaaaattggaactgcgaatgttcggcagtcattcgaatcgtttcacaaatattcggtgtggcagatttcaggagagaatttaatgcgcatgttataaacaatgaatttaatgactggggattccccaatttcattacatttgctgtgggtggcatttaaaatgactgttttaattttaaataatttacaattaagaaattgatggacttggaagaagcccttttcaacaaaagcgaggacaaagtgacatttgccattga

SEQ ID NO: 58063 - DNA, 380 bp, Heterodera glycines
  Genomic contig location: Contig_ID=SeqID_27371; Location=1020..1399; Strand=+
  SCN-specific regions: Sequence locations=1-282,306-380
atgtacaaagttttgctgtatcgactgctctcaacttcctctcgtgcaaatttggacacttttccaatgtctattattaatgttccaaatgtccaaattcgccagtgtttaggaaattgcactggatacagtaagtcaccggaaatcccacagaaattcggattggtatggtattgttcaatgccgaccacttcttctgttgttaaaatgccgaatggaactggtaaataagagaaaggctgtgaatatactaatttaaatagtcagaaaaagatttgacccaaaaataaatattattttttttaccaatattttcagaaaattcctcttttgagaaaagcggaaagcgaattttgaacaatgccgggccaagcatttga

SEQ ID NO: 58064 - DNA, 569 bp, Heterodera glycines
  Genomic contig location: Contig_ID=SeqID_5444; Location=707..1275; Strand=+
  SCN-specific regions: Sequence locations=1-70,93-117,190-284,313 -395,444-447,469-569
atgaaaattgatggtaaaaatgtgcacataaatttaagaaattggcatttgccttattttgtgtataaggaaaaagaagatgaatttaaaatggaagaagcggaaggtcatttttgaatatgatttcatatttattatattaattataatattatttaaatttaattaattatataaaaatattatttttttaatagtggaagtgaatatacgaaaactgaatgaattggtgaacttggtaaagccagacgatgaaaaagttatgggtaattttgaaattgttcattatttatatatatgtttttattaatagtgaacaaaattatacaaaaattgcatgtattactaaaattgcaagagaaaaaacgaaaagtgaaaaaggacgaagccgaaggtatttttaaaattatttttaattgattaatttgaatatatttttaatagtggaaatgctgagagaaaaattatggatgagctagaagaaaaattaacaaagcataaacaaaaaaagatggatgagaaaaacaagaattgagccgaaaagaaaagcgagagaataatgagcaaaa

SEQ ID NO: 58065 - DNA, 1258 bp, Heterodera glycines
  Genomic contig location: Contig_ID=SeqID_5444; Location=1488..2745; Strand=-
  SCN-specific regions: Sequence locations=1-592,638-667,689-890,912 -997,1019-1258
atggcgattttgctcaaaccgactccgaccgaatacaaccgtcgtcaatgcccggccatctccaagccagtgcgcggtgctgttcaaccaagaccggtcagcctcagctttctcagcctcggccttcttcagccaagggatttggcagcctcgccccgcttgctgcagacgcggagggacaacgctcgccgtgaccataggcaagctctaacgctcaagcgctcggcgagcataattcactcgccacaggtcagcagcagcgaccagcgagcgggaaacggcgccggtgaacaaatcgcttatcaagcaacgtattatttcttttttatatatagttgaaaacattggcagcatttttagatgggctgtaaaagtggcgaggaaagacagacagttagttgcactatgttcattatactctcgtttcttttattcatgtactatatcgcctttttctttttactaattgtcattttttcaaatgaaatgcaattaattcgttgaatgaaatgcttgtatttgtatgcttagggatttaatttactcaatttaatcattgaatagaacgtggattttcatataaaaatacctgatatatttatgtatttaaaatttaaaaaaagttgtattaaattttgtgtgggttgcggaaaatattgattttaactataatggtggtttttaaatactgatttttatgatgttttttaaataacgacagagcacctttgatttgaatcaaagttgattcagagcatttttccgttttgtgcctacaccaggggtgtgatcgaaaatttttaaaataagatcatcaaggccaaaaaataaggttttagggtcaaaataagaacattttgcaacattactttaaatcgcttttgtaacaatttaattaattaataagatcaaaataacaattttcatgggtcgagcaatgtaaaaaaaggttttttttttttttttttgctttccaaaccaccttttttcggcgcactttttccaaaattaaatttttgtgcctttttagtcgtttttgtattctttatgcaatttcaacttttttatgcctgagccctacatattacccatatatgtttttaatccaattgaatgctcaactttatgccaaagatggaaaatgaaattgacagaacccaatttgtccaatcaaagtgtgcccccagggcataggctgtacggttcgccaattttacccattgtatatgtatgctttgcatgggtattggtaaataaa

SEQ ID NO: 58066 - DNA, 1327 bp, Heterodera glycines
  Genomic contig location: Contig_ID=SeqID_5444; Location=3944..5270; Strand=-
  SCN-specific regions: Sequence locations=1-340,363-390,413-423,467 -480,502-545,567-613,643-650,672-821,873-997,1019-1303
atgattcgtctactcgacgattcgtctactcagccaaaaagtgacgattcgtctactcagccaaaaagccacgattcgtctattacacgattcgtactattcaacgattcgaatacccaacctataggagaaacgatcgggagggatcccgggatcgcacatcccgaccgaatcccgatctatcccgaagattttttttcgggatgccgcgggattttcgggatttgctcaaacctattttttttacatttttgtgccaagtttttgttcaaatgtttatctaatatttataattgatcaattcgattgaagaaaaaaaaagagatgtgaatgatatcagatttttatagaaatttttcaaaattggaatatcatgcccaaaaaatcagattttcaaaaatgagaacatttaacaacatagccttaaataatttttttacaatttaatcaattaatatcaatttttgtattttcgcctcagatgatcatttttaataatttagagaaacggaatcaaaaaatcagatttttaagatttttttttgctgcaaattttttcaaaaactttaggggaaccgggggggaggtcggcggtgccgataggcgccgccgggaaaattttgaaaatttgaaatgtaatttgttaacagaatttatacaaaaactgcccatattttgtgattttgaactaatttataagaaaataatgggttcttgggtctggtgatgtccgattggcaccgaaggaaaaatgcgtagacaaaatttttattctgattattggacaaaattcttagaaatcgttgtgccataaaactacctaataaaatttagaataatgttttagaaattaaaaaaaaaattctttttatgaagaaataaaagtgacaaaatggccaacttttgcgtcaaattttgaaaattttagtggaattttggagacctgtaaattttttgggatttttaagggattttttacgaaaaattagcaaatgacaatattttttaatttataattcaagatcttaatttaaaaaatggacattttttgaaaaattatcgtgacttcaatcccgcgggatcccgcgggattggtaaatggtcgggagggatcccggttcgggattccgatgaaatcccgatcccgatcaatcccgatgaatttaaaaaatcgctcgggacggatcccgaggtcgggatcccgaatttaatcccgcgggatcccgaagaaatcccgcgggatcccgatcccgtccggtctctaatatttacctcgtttttgtaatcatttcaaagtaatagattaatattttattcctttaataaa

SEQ ID NO: 58067 - DNA, 207 bp, Heterodera glycines
  Genomic contig location: Contig_ID=SeqID_5444; Location=5698..5904; Strand=-
  SCN-specific regions: Sequence locations=1-207
atgaatgcccatcgtgccgtaaatgcttattcgaatcgtgttcgcaactttatggccgagctggatgaagcggatttgtggaatgagcaaaatatggccagagttgcaatccacgaatgcggccacacgttggtcgtatggtttcttcgccattccgagcggctcatcgaagtggatttgagatttgatttggatatgatttgttaa

SEQ ID NO: 58068 - DNA, 785 bp, Heterodera glycines
  Genomic contig location: Contig_ID=SeqID_27372; Location=211..995; Strand=+
  SCN-specific regions: Sequence locations=1-373,396-785
aatcaggttcgaattcgaaggccttaaatacaaaggagagcttcataatattattttccgcttttgttgcttagatttggagtacattcaacacatcgccttgccctatgctgaatcggcctttttcgattatttgaggagcgaattcaattgcaaaggagtcaaaatttcggcagtccccgaggtgtttttcgtttttccattttcattgccttccccaccctctttttaagggttcaatcgtttttcctcgtgtccctttgattatcgtcgaaggtcccttggcggtctgtcaacttttggagactccgttgctaaacctggtcaattacgccagtttggtgaccacaaatgcggccagattccgattggtctgttttgtttgtttctcctttaagtgttttcggcttaggctgctggcgaatccatcggtctgttcgaatttggccttcgacgtgctcaggggcccgatggcgctttgtcagcgtcgaaatattgctttatcggaggtggggaggcgaggagagatatttataaatgagaaagattttcaggctttgatagcaccagcaatttgttggccggcaaattgtacggcattccggttagtggaacgatggcacattcctttgtcacttccttcgaggtcttacaattagtgtttatttcttatctcattatcatccattttcagcccgatgaaaccaatgaaacgtccaaaatttgctgcttccaaaatgacaaaatggtcgacctattcccactgtcccaaggaccaaacttga

SEQ ID NO: 58069 - DNA, 580 bp, Heterodera glycines
  Genomic contig location: Contig_ID=SeqID_27374; Location=429..1008; Strand=-
  SCN-specific regions: Sequence locations=1-352,398-451,474-580
atgcgcggggcgcatgggtcggaactctttcgagcagcacacggtggctgggttactgtatcgtcgtcattatggttgttgaaggtgttcagttgggcaccaattcgtgaacaaatgccatctatttgcaacaattatatataatacaaagatatttttaattgtgaacattttttgaataagtttaagaggtgaaaatttgtgaaaaaaaatttaattttcgaaagggcttgaaataattcccaaataaattaatccccattttcagaattatcttaaaagccaaaaattcacaaaatgtttttaatagttaattaatttgcatatttccgttatttgttaaaatgttgagattaattattattaaaataaaattttatttttattttttaatttacagacagattgtaaagagaacaaaaccatacaaaaccgacttggacagccaaagttgtactgctgctggtgctggtattggttgttgttgcctcttgacacaaatacgggctgaattggcaaaccgttgggcgggaattgcaacggggccggctgacgatgatgacctatttaaaaaattaaa

SEQ ID NO: 58070 - DNA, 93 bp, Heterodera glycines
  Genomic contig location: Contig_ID=SeqID_27374; Location=1324..1416; Strand=+
  SCN-specific regions: Sequence locations=1-93
atgaaacgacggtcatgcaaaagtggtgttgatgaccaatgtgttgggccaccaattgaatcgcgtccatgtaatgatgaacaatgcccctac

SEQ ID NO: 58071 - DNA, 607 bp, Heterodera glycines
  Genomic contig location: Contig_ID=SeqID_27375; Location=280..886; Strand=+
  SCN-specific regions: Sequence locations=1-270,292-607
atgccaatgatgccatttgaatgtgtggtgaacgaatcgacaaaggaaaagctgacattgaccaaagcaaatgaaaatgaatgggacatcgattggataatgaagcgttgtaaaattggagagacagcggcggttcagcagcacaaagagggcgattggaacaatgtgttcatttggctttttgctggcactaattgcattgggtgagcaataaaaaaaggcatttaatttttatccgaatttgaattttgcgcttaatttaggccattatctccgccaccaccagcagaagaagatgaagcgggacaaagcatcacaaaagggccgtcttctgctgacaaatgagtgacggacaaacgaacaaaatcaatgatcagacgcagaagaaatgaatattaattgaaaatgaccgagcataattcaaatcagtgatcaaatgtattttatgaagaaaatttttgtttcaaaagttggctaaatatggtgttaaaaattattttagaggaaaaaaacaagacgcagctaatactcatttttagcgaaaaatcaaattgaaaagcgaaattttcgctttttgcttatttttgacataaatttatcaatttta

SEQ ID NO: 58072 - DNA, 379 bp, Heterodera glycines
  Genomic contig location: Contig_ID=SeqID_27378; Location=350..728; Strand=-
  SCN-specific regions: Sequence locations=1-120,143-379
tttgtcctcgatttccgctcattttcgctgaattggtctcgcggtgtttttctctccaaattattctcccccaaattcgaagtgttgtcgccgaacttttgctttggctcgaccggagtgatcagaagcgaattatcattttggccaaagcacttcgcgcttatttaagcgcacttaacgaatggtttcctaatttgaagccattggttacgaatttgagcaaaacgaacgagaaatatgccaatttggaggagacggaaggggagaaagatggccatggagaggaagaaagggcggagaaagtggacggacacaaaaagcaatgggaaggagacccaaattacccactggtgaaggacgtcgtgtccatcctgaacag

SEQ ID NO: 58073 - DNA, 1040 bp, Heterodera glycines
  Genomic contig location: Contig_ID=SeqID_27379; Location=8..1047; Strand=-
  SCN-specific regions: Sequence locations=1-4,30-94,127-290,316 -547,569-581,620-750,774-880,902-982,1013-1040
atgcaattttataatttattttttatattgtcattatcattcataataagtccaatcgacgaaactttgttagttaaatcttttggatttaatgcaaaagtttggccaacttttgatgaaatatttggccaaggatgggaaaatgaaaaaatggataaaattcaaataacaataaaaatgatcaatgaattaaatttcgctgattcaaacaatgttttgaacaacaaccaattggatgatcaacaaaaacgcgaaattgttcataaatttcatgcaataaaaaaaggaattaagaaaagggggaaatattctcaaaaaatttggaatagaattgagctaaaaattgcgaaaaaattgggaattagtcgaaataaaatttataaatggaaaaaagaattaggaataaaaataaaaaatgaccaaaattattatgaaatgaaaagaaaggaatttattcaaagaattgatgagtttaaaagaatgtcagcagtaaatggaaaacagaaacaatttgggaaagaattgggcattagcgaaagaacattccgaaaatggaaaaaggaatttggcataaaatggggttaattaaatttaataaattttttatttttattttttaggaggaaatcaatattcgaatggagaaaaagcaagaaaattgaaaatttattataaaatgaaaaatgagaagaattcttcatttagtgacaaacaaatttctgaattcttgaaaatctccgaacgaaccctcagaaattggaaaaacaaaaatttgtaagaagtagatgatgcagcttatggaatgagagacaatttatgggatttagtgcctatttcaccatttacgatgaatttttccaaaaaaaaaaaaaaactaatctttttttatatacatatttgacatacatattttggaattttttttagatatttatgtatatgttttggccatttttttgtacatattttttccatccctatgataaaaaattaaatatttaaattatttttacagtccattagaattcaaattgtcctga

SEQ ID NO: 58074 - DNA, 1152 bp, Heterodera glycines
  misc_feature (13)..(13): n is a, c, g, or t
  Genomic contig location: Contig_ID=SeqID_5445; Location=1..1152; Strand=+
  SCN-specific regions: Sequence locations=1-49,72-486,509-1069,1093 -1152
  Gene Ontology: Mol. function=receptor signaling protein activity; Cellular component=plasma membrane; Biological process=oviposition
tttttgcggacanaattcagcgttcgccgttgactgtgtgctttcccgagtacaaaggtgttgttttttgtcagtatctttgttctcgactagggaaattttttttttaatttttgttgcgtttttttcgaaattgaaaacaaaaaaaaggggggggacatggcacggcatggatgtgtcgtcggaatgccgatttatgattgctgctttccgatattttgagggcgtcggcacaaatctctggtacacgtttcactgcccccaaggggagaaaatcctaaatccaaagacgtcggcacatttggggccaaatttttttaatttaggccaacaaaatcaaacggaatgcataaattatatccagtggaattttgagcatatgaataggtcacggcaacgggaaacttattgccaccacacatgcgcaacggacacaaacgtaatttactagtggccaaatcggaatctcgggacacttggcattactggaaaatcaaagaaattttccgagtcgagacattccgagattcccgaccggtcaacatccattaggagcaattagtgacagtctgtgttcgggactgaaaactccgagtaatattattaccaatcaatcatcatcaatcatttatacgcataagcgtgacgcccaaaaataagaaataatgaaacaatatcaaataaaacaaacaattggtcacttttggagctggggtggcaaagaaatcaacaaattcagatcagatctttcaagaagtttggcaaactcattagaatttagtaatctcgtctctttaggcaaaagtctatagagacgagaggttcgaataaagaacgaattgtatctagcattggttgagcaataagctgttcttatagtgcagggctcccatccgtccttgaatggcaaggacgtccttgaaattgggccctctttcttgaaaataaaaaatgtccttggatgccaaggacgtccttgaaaatgaacatttagaaagttttaaaaaaattcaaagaaatttgagaaatctttgtaattttcaacgatattttgattatattatggcattatgtaaataaaatgcaaattttcaaattttctcatgcttgtgaatgaatttgttacgcaatttttcgcgtttgcgacataat

SEQ ID NO: 58075 - DNA, 525 bp, Heterodera glycines
  Genomic contig location: Contig_ID=SeqID_5446; Location=499..1023; Strand=+
  SCN-specific regions: Sequence locations=1-140,162-525
atggtttccaagcttcttccggtcattctctgctgcttgtttttggtatgtttaagcattcggtataaaatactgtaattcgagtagaaaatcagggagtacggtatctatgatattattaatttctaaaacaggcttaattaaattcagttaaatattttaaataaagtaataaagcttaaactttcctttttaggcttctttcgccctctgctcgcccaaggctgctgatgtgctggtaaatggctcatttttggcattatggaaaatcaaaataatattaatatcttgagacctaaaaactcaatttcacggacatatttgcaggattaggattcaaaatccgttaccggatgaatccgctttattaatccagcaaaatgccaaacaaatgcacacgattgtgggcccaataaaccctacaaattcttccgtctccactattatccatattaaaattgattttttcagaaatttaaacgagaagcggcgatcagcagttgtggagctgtaagacatatttaa

SEQ ID NO: 58076 - DNA, 1197 bp, Heterodera glycines
  Genomic contig location: Contig_ID=SeqID_5446; Location=2658..3854; Strand=-
  SCN-specific regions: Sequence locations=1-4,27-218,242-552,574 -938,974-1197
atggttaacgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactccggcacagcataaagtagcagaggatagagccttagccgacattgattggcggctccacaactttggctacagttgtgtccattttggcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaacgtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcgctgacttcaaacagtcgctgccggtcgtgcctcatgaaggcttaaccgctcaggtgacagcctgttttcaaacgtctccgttgtttggtcagttcaccacgatgaaattgaccatcaaccagagactgggccaaggtcagcaagcgttcttgcaaatgtgccgccaaatcgggcttggagaaaccggagagcacttctggattcctccgcagttcctcgttaagagcaaggaagagctgatagattatgtctatcctaacttccaacaactccttggcaaatga

SEQ ID NO: 58077 - DNA, 1251 bp, Heterodera glycines
  Genomic contig location: Contig_ID=SeqID_5447; Location=31..1281; Strand=-
  SCN-specific regions: Sequence locations=1-764,787-1119,1141-1251
atggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaggcatataagcaggcgcgtgagcagctcactgagcttctccaacaacaaactccggaagagcttcgcttctttcgcatgactttgttgaatgagcgcagggctccagctggtctgaaagacccaaaattgcacccacaccaaataatcaccccttctacgggtgaaggaatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcgttaaatatgctaagccaccatcgcgtaagcgaaaaggtgctcagaatgcatctggcctatttgactcggaagccgagtcagataatgagtcgtgcgagactcagtcaattgcattatctgatgcggggtcagtcgcagattcagatgctgaatctgtagcatctgtttcatcgcagcaccggcggattgacaaatccaaacaatttatctccctgcgagattattgcaagtattatctcgcaataagggatgaaaatgtggagttgcaataccaccacattctttcatgtggtggaggacttggtcagcgctggatccttgaccaggctgcaaaaattgattggcaaatagcaacatttttgcatagacctgacatggatctgcggatcagcactccaaaaaatctgctgcagtatttggtcaaccaatacaacaggcagaaagcacggcaaaaccccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcaccaacaacagggaatggcctgagttcaaagagaatatatataaaaacggtcaagtatttactgaccgttttgacatgtggatgcgtgtctggagcagcaaaatcgctgagttccgagaagaactttatgacaaaaagttcttcggaaccatcccttgg

SEQ ID NO: 58078 - DNA, 1411 bp, Heterodera glycines; identical to SEQ ID NO: 27382
  misc_feature (837)..(837): n is a, c, g, or t
  misc_feature (929)..(929): n is a, c, g, or t
  Genomic contig location: Contig_ID=SeqID_27382; Location=1..1411; Strand=+
  SCN-specific regions: Sequence locations=1-188,216-361,383-891,922 -1106,1164-1411
  Gene Ontology: Mol. function=protein binding

SEQ ID NO: 58079 - DNA, 761 bp, Heterodera glycines
  Genomic contig location: Contig_ID=SeqID_27388; Location=203..963; Strand=+
  SCN-specific regions: Sequence locations=1-225,247-393,422-761
atgacaaccaaagaaatcgcggaatcggatgacggtcgagtgttcaaagtcgacttgggaaatctcacacaagtgacgtcactgtgcacgaagtggaaggcgcatttcgtgagtttggcatttttacaggcgaatcatctatttctgctttgttgtttcagaccaatgttcgtcaagtgatggaatcaggcggaggcggagaaccgtgtgtgtctactcgtacttcggcggcgggcggtggtggttttccagtttggctgatcgttttgatcgtcgttatcgtgatttggtgagtgctgcctttcattgcttctttcaacctttctcatttttgtgtgttttcagtgttttgggtgctggtgcgggcatcgctgtgtttatggtccgtcgacgaagtgctgaagcagaaggaggagatgcacctgcggatccaatcgggactttcacatcgaaggcggacaaaactgatgaaatggacaacatcccagcgagcaaggatgacgacaccgctcctgccgccagcatgggggtaaaaagaagcggagaagtgatgataaaaatttatcactgcctttttagggaatgcaaatgagctacgccgccatgggagcgtcgacagcgcccgggaaatcgatggtatagagcgaaacggatgcattatgaagtgatgacacaacatatctacgatgacaaatattcgatatatttatatgcgtgctgataccattgtgatgtgtaaattgtcgatatattgtatttga

SEQ ID NO: 58080 - DNA, 468 bp, Heterodera glycines
  Genomic contig location: Contig_ID=SeqID_27390; Location=593..1060; Strand=+
  SCN-specific regions: Sequence locations=1-174,219-468
tgtgatgtgtgtggaaatttcacggaacaaattgctgaccaattcctccgggttgtcagtgattgtctcgaagttgatcggcttccaattgttgatttggatcagacctgaaaaaatcaaatctcttttcaaattgcaatttgattttttttcagtttaattctaacgataatattgtttcaaaatttctatatcttaaaaactacaaatttactgttgtcagtgaacttttttttaattactccctacaaagaattattttaccttttttatttatagttttggcccaattcactccaatgtctttaaaatattcgaattcctttttttttcatttttccccgcgcaaatttctcttttctgtccattttcggcggaggtgcgcgggtgatccaacgagaaattctacaccacaatctgccccagtagatctgtctcaatccaagccggacgaccctttctttgcta

SEQ ID NO: 58081 - DNA, 1028 bp, Heterodera glycines
  misc_feature (4)..(4): n is a, c, g, or t
  Genomic contig location: Contig_ID=SeqID_27391; Location=48..1075; Strand=+
  SCN-specific regions: Sequence locations=1-24,46-156,179-243,265 -283,307-374,396-563,587-618,640-694,761-892,914-919,941-1028
atgnccaagtgtttgctgctgttttttgcctatttgcctccagcttggtctattggacatggcaattattttggacatcatgaggggttgggcgtgggcttggcacataattatgtcagcaaatatggcattccgatgaatttgaggtgcttctccattaaaaatttaatatttttttgtgtcttattctcggcatttttttaaatttaagtgaaagacattgctaaaaaattacaacaattacattttaaaagttcgaaaaaatttttatacattagaaatatttataggcacattaaaatgaaatatttttgaaaaacggcggtgggcaagcaaacattcaaacaatatattttcacctattcaagtgacgaacaattggatgaactcaaatggcgccccaaacggcacaccaaattggatggcacccaaatgatcaattcttcagggcagcaaaattgctcagatgagaattttattttgtccacattgttgagggattacgacaaatttcgcatccctggcggcggaaatgtgcgcgtggaggtggaggtaattaagagttaattaaaatttttaaaataaacaagtgtttattttggaaagcttagattgaatgaaattttgaaattttattttaaacatattctgttttacagtgcagattattatttggggttgaccgagaatcgggattttttaaaaataatatatcatttaaatatttttaaataaagaattatttaataattttttaattgcgtcaaattttcgccagatttgggtccaggaagtgtccaaaatcattgagatcaccagcgaatttgaactggacatttatgtcactgaaatgtggacagatccttttcttgcatttgcccatttgaatccgtgcaaaaagttttaaatttttatccgattttcaatttaaattcatttttagaaatatttctgtagacggtccgcgagtgttgccacaaatttggaacccattaggatgttttgtgaacagtaaggtggctttcata

SEQ ID NO: 58082 - DNA, 192 bp, Heterodera glycines
  Genomic contig location: Contig_ID=SeqID_5448; Location=1133..1324; Strand=+
  SCN-specific regions: Sequence locations=1-192
gaagaattcattcaacgatttggaagacaatttggcataacggaggaatttatccgctccaactcgcaacgaatgaaggagttcaagcagcaagtcaccgagggaaaacagcgcgaggaatatgccaaattgctgcacgagcaaatggaatttgagtcggcgcgccgtttcagagagaaatatggactctga

SEQ ID NO: 58083 - DNA, 361 bp, Heterodera glycines
  Genomic contig location: Contig_ID=SeqID_5448; Location=3751..4111; Strand=+
  SCN-specific regions: Sequence locations=1-14,37-361
tcccatggctatccgtttctttcgtcccctccccctcattaacctaagttttgcgcctcattctcggccttttctttatgtggcgtcattagcaacgtaagcaattagcaaagcacaaatcggagcatcaacggacggaatgccaattaaaatttggcggttcggtgcctttccttttatttgaaaactttttgtgttttccaattctaagaacagtcagtcttttgagagtttgtcaacacattgaggcctctgccttcatttgatagtgttgctttgataaggtgcgaattcgcttcccttttggtcgttcgtttccgccgtttcggcgtgccattggcacttcgttgcgctgttccct

SEQ ID NO: 58084 - DNA, 459 bp, Heterodera glycines
  Genomic contig location: Contig_ID=SeqID_5448; Location=3986..4444; Strand=-
  SCN-specific regions: Sequence locations=1-148,214-459
atgacggcgaatcaaacgcatcgccactctcaccaaaagcgacgattttctgttcgttttttgggcgtatttttgatgggaaaagataaatggacgacaacttacggaggagaacaaattgggagccaaaagaacgcattcgaacgaaaggaggaggaaaaagaggagaggaaggaggacaaagaagcgggaggaagacatggagcaaaaagacaaaagggaaacggacaaattgttaaactgaggggacaaaagggagacggacaaattgctaaactgagaggggagagggtcagtctcgacgaagaggaagggcacggattggcatttgaaagggaacagcgcaacgaagtgccaatggcacgccgaaacggcggaaacgaacgaccaaaagggaagcgaattcgcaccttatcaaagcaacactatcaaatgaaggcagaggcctcaatgtgttga

SEQ ID NO: 58085 - DNA, 444 bp, Heterodera glycines
  Genomic contig location: Contig_ID=SeqID_5448; Location=6658..7101; Strand=-
  SCN-specific regions: Sequence locations=1-130,152-327,351-444
agcagcctcgcgcagtccttttggatctgatccctaccgaacttgtggagaataagcgatcgccgcgacactttgcctttgccaaacgcgccagatcgttcgcttttgcgaagcgaaatgccaacggatggggaagggcttttgcctttgccaaaagaacggcggaattgccccaatggaatgagtgggcatttcctccccttaattagttacgcattttcaattttggtttttaagaaaacgctttgcttttgcggacggcggcgccagccgaaggttcgcattcgcaaagcgaaattatcgaaatttcgcattcgcttaacggagagagaagggaaagggcagaagcaaaggacggcaaactgagaaggacacgcgccgtttttgcaagcgataatatccgctttaatctccacttttatcccctcgtttatccgcccttct

SEQ ID NO: 58086 - DNA, 1486 bp, Heterodera glycines
  Genomic contig location: Contig_ID=SeqID_5448; Location=4501..5986; Strand=+
  SCN-specific regions: Sequence locations=1-1023,1045-1126,1148 -1358,1382-1486
atggccaaacggaacagtcggatggtcaacgcattgagcaccattctgaacaaacggaaagaattgggcaccaatgtgagcgaaactgtcaatgtttttaccgcctaatggcgccatattttaggatgcttttcgagttcgaatccgatcattggaccaaatgggtacgcttttcaaacacttatttataaaattgacttttcaggcaatacgaattgctacttttcgccggttcagtgttatttctttgaggaacggtaggaaaaagtgaaccgacgatggaagagaagaaaagaattggaacagacaaaatgaaatgattgttttgggaatgagaagcgatgccctttttgtgatttgccaattaaattgcgactcaacgaattttcccgcgttaaacgcccattttttatcaattcgataatttaaacgatttcatcggtcggattggtctgtctttgctgtgctaaatccaccgcttaaaatgcgaaaatgtttcaattcgctgttttttttctttccctccatccgccgttagtcaatccatcactttttttatccaaaacaaaaacagagaaagcgatgtttgtgaggcactgattcactgtttacacttagcaaagagtgatcggaagggttaagcgatcggatgagagcaggcgaagggcggagaagtcgccctttcactgcttaaccaaagacaaatgcccgcgaccgatcaatggccgacaaagcaaagtttggccgccaaatgtgagcagtgagcacgagggattgatcagtgagtgggctgcttgctgatcttctgcttttgcagtgaatgtttcttagctgctcagcaaaggattttcgcattcatcgaatgccaaatccccgccgggctcaaatctttacgcccattgcttttgggtttggccatctgtcacttttcttccgatcacttttattgccatatttttgctgataaaagagagcaaatagctcctcattcattccactcgcttttactcattcatttttaagccaaatatttaaaatggaaaatatcgaaattacgcacgaatggagcggccaacaatgggattggcccctgcaggttggcagtggcaccaaaaaaaacactctcaaaatggcacttttcattttacagcataatgacggggtggtgaaggttcacaacactccggaaaaatgggaagttgggttggacgtggcattcttcacgccaaacgaaattgaggtgggaaacgcaacgaaaaggacaaagtgcgcattttgacaggtgaaagtggtcgcggaccatctgaacatccattgcaaagtgagcggaaaggcaaaaaaacgaaagagaaatgccaaaaagggaaatggaaaaagaaatgattaattattgtgcccttttaagcacgaggctcggagcgatgtgcacggctcagtgagtcgagagattaaccgctcgtataaattgccgaacgatgtgaacaca

SEQ ID NO: 58087 - DNA, 90 bp, Heterodera glycines
  Genomic contig location: Contig_ID=SeqID_5449; Location=264..353; Strand=-
  SCN-specific regions: Sequence locations=1-61,83-90
atgtgtcgtcttctgccgttgtttctgacgctctttgctgtcctcgtcgcactttgtgtttctgtggaggggcagcagccatccgccgag

SEQ ID NO: 58088 - DNA, 445 bp, Heterodera glycines
  Genomic contig location: Contig_ID=SeqID_27393; Location=136..580; Strand=+
  SCN-specific regions: Sequence locations=1-66,88-210,232-256,292-445
atgcaactgttggaaatcattgtttccgaaaagacgtccaaggaggcactcgccgtggccgccaaactcggcctggaccagaagaagctgattgtcgtggtcaaggtgagcgttgcgttcttttaactagaaattttatggtaaatacagtgagtacaggggatagcacggattccgacttccgacattttggggtcgtaatccgattccgaaaattttttgggcctcgggttatttaatcatttacaatttagcctattaaaaattttagaaaaaaattatcttaaatttgcgaattttccgttatccgaaaatatttgagatctcaaagttccgtttacggcttccgcaaaattttgttctcggaatgccacccctggtacgtattttctacatggtcggtgaccacgaatacggcattcaaccggacaattccattccctga

SEQ ID NO: 58089 - DNA, 272 bp, Heterodera glycines
  Genomic contig location: Contig_ID=SeqID_27394; Location=1070..1341; Strand=-
  SCN-specific regions: Sequence locations=1-74,104-228,250-272
atgcgcattaacataactggttctgacaaaatcggggacgggtcagtgaatgaatgattgaatgcttattcaaaaattcaaatttatttttctgtttatttttaggcttctcaacggattgctcggcttaagtgaatggaagttaagaaatggacgatcggtttgaattaaggaatttaaaaatgatttttgccgtgctcataaaatgttttctttttttgttggaatgatcactttgcttatttttaaaagcactaccgaaaaaaaataaa

SEQ ID NO: 58090 - DNA, 829 bp, Heterodera glycines
  Genomic contig location: Contig_ID=SeqID_27398; Location=216..1044; Strand=-
  SCN-specific regions: Sequence locations=1-154,178-184,206-217,284 -773,795-829
  Gene Ontology: Mol. function=transporter activity; Cellular component= integral to membrane; Biological process=transport
gctttttgcagtggtcgaggccaacttttactactttgttgagtgcgcaattgcgttatgctgcagcttcttcatcaatttgtttgtggttgcggtgtttgcgcacggactgttcggcaaaacgaacgctgacattgtgcgcaattattgtatcaataaattaaataaaaattaattgtaccacaaattttatatttctcaaaatctaaccacagggaattttatttttttgtttatttttaattctttagaaaattatttttattttttaaagaaaaaattacttcttctgaaagttactttttaaatctcattcttgctaacgccaaatttaatggaatttctttaaaaattgttaattttttgatttttggtccgttttaagtaattattttaaatggctttaaatttaaaaattatcaaataacttatggaagaaagagaagccataaaaatgggaatcgaacaataaaatgccagatttcatattttggatgaaattaagccactttttacttactctcttcctcaaatggattgaaatttcccaaacagttcaaaacttgcgagaatcagccgctggtgcccgacaggcaactgttcccgaacaacacggacctggtggaggcggacatttacaagggcggcattttcctcggctgtcagttcggcatgttcgcgctatacgtgtggggcgttggcataatggcggccggacagagcagcacaatgacaggtcagtcaattaatcaattttggctgtctgtttttttgatgttctgagaattcctacgatgattaaattggttaattaaattcaacaacggca

SEQ ID NO: 58091 - DNA, 505 bp, Heterodera glycines
  Genomic contig location: Contig_ID=SeqID_27400; Location=713..1217; Strand=+
  SCN-specific regions: Sequence locations=1-41,98-311,334-505
atgacaaaaataataaaagatttttctgtttatctaatgactataaattttgaaagtaaatttttatttaattggaatatttaataaatttattaatgaaaggaatgatttctgatcagaatctaggtagcttttatatggaattgttgaattggaatatccagtttttgtttgtgcttttccactatcgtggcgccgctgtgcgtgcagctgaacacaattttcggatgaagcacaacttaacccgtcttcagctgctgttcaacagtggacacataatgtcatcgaatataacctgattgtttagcccaatttttggggttaattaatttggctcaattggctaattgttggaatttgatgactttcttaatggctgttgaagcggcggacggacaaatgatttattttttcatgacaagttttccattaacaaaaggattaaccaactgatcagcagaaactgatcaattttgcctaattaaataagggaaaaagttggaca

SEQ ID NO: 58092 - DNA, 296 bp, Heterodera glycines
  Genomic contig location: Contig_ID=SeqID_27400; Location=266..561; Strand=-
  SCN-specific regions: Sequence locations=1-93,115-124,147-296
atgtctgccttctttgtcgtcgctcttcctgttctgcttgcagttttaactgaagcacaaaattttggcggccaaggaggagcgcttaatgcaccattgccatttggagggccaataaatcccgtaaattaaaaaataaataaatagctcaaaagtttaatttgcttgcctgtaagggctttgtacaggaacagttgccacacatgcttcatcacccaaatttgaaaagcggcgaagacattgaagcagcatttcaaaacggaggaggacaagtggcgggagtacagcaccagcag

SEQ ID NO: 58093 - DNA, 1321 bp, Heterodera glycines
  Genomic contig location: Contig_ID=SeqID_5450; Location=910..2230; Strand=+
  SCN-specific regions: Sequence locations=1-16,39-208,230-236,259 -345,376-405,450-617,640-902,938-1051,1073-1219,1241-1321
atgttcagcgatgtttggatgggcattttcccactttttgaccgtcctcaactcggcctcaaattggcactgatttcgccccgtttcgatgttttagtggacaaacatttcgatgggcaaacgcgaattttttcaaatttcggtaagtcttttgtttttgctttttttgtaagtgattggtttttttttgtttactttattgaagtcgtaagtttcattttttcaaattggccatgaaaatattttctatctaaaattttgattggattcggtgcttaaaaaggaatttgtaatattttttagaaatttgcgattttacttatgtttcagcatattttatctatgttttaaattattttatttgataattaaaaacggtaacaccttaagggaaacttttttctcttaaaattaaaatttttttttggaaatttgatatttttaatttagttttatggccctttttactcaattaagactaaaaatggattttctatgaacaaattttctcatttaactaacatattttttcaaattttcagttgggtttgcaatgatgtttggatggaaattttgccctgttttggccatgctcaactcggcctcaaatcgggcactgtttttgccccgttttgatttgctggtggacaaacatttcaatggtaaacgcgaattttttcaaatttcgataagcttttttgtttttactttttttgtaaaagtgattgattttttggttacttaaactaatagtgttttaatggaatttaggagccccaaacttttcttggtttcaaaaaatggatgaaaattattatttttccaaaattcattattctttttgatttttttattagagtgtcgggtttttttagggtctcgccgggacaaaatctcgccgcaaaaatttaaaaaaaattcaaaaattgaattttttcaaggaaaaaatcttagaaaaatttattataagaaaatataagaaagaaaattattgttaagtttttcttgaaaattgcgcggccaaatttggaagttccatggcataaaaaagcaattttttctaaattttgaaagtttttacttttaatagaaaacttttggttttgtgtagcagtctctaagagattttggtcaaaaacgttttgtcaaaaacttattgtaaagatttctcattcgttttttggtgcaaaagttccctttttagggtttttgcttttttgttgaaatttattagaattttcacaacagcttagcaaaggaatagtttttttaaatattgtgtgcccaaaaaacgcgctccagttttaaataggctatgaaa

SEQ ID NO: 58094 - DNA, 129 bp, Heterodera glycines
  Genomic contig location: Contig_ID=SeqID_5450; Location=2336..2464; Strand=+
  SCN-specific regions: Sequence locations=1-129
atgacgtttggatggacattttcccttttttggccatgctcaactcggcctcaaattcgcactgatttcgcttcgtttcaatgcgttggtggacaaacattttcaatggcaaaagcggatgctgcgcaa

SEQ ID NO: 58095 - DNA, 697 bp, Heterodera glycines
  Genomic contig location: Contig_ID=SeqID_5451; Location=334..1030; Strand=+
  SCN-specific regions: Sequence locations=1-304,326-697
atgtttggatggacactttccctttttgaccgtcatcaactcggcctcaaattggcacttctttcgccacatttcgagcttttggtggacaaacatttcaatggcatatcgaatttgggcaagtttttttgagtttttgttgtaaaattgaatacattttttggttttttgttgtttttaaggatttaatcccaaaaatgggccttcaatatcaaagaatttttgcctaaaaacccctgaaaataaagatttctcattcgtttttttggtgtaaaagtgccctttttagggtttttgcttttttgttgaaatttattagaattttcacaacagcttagcaaaggaatagtttttttaaatattgtgtgcccaaaaaacgcgctccagttttaaataggctatgaaaataaaaaaactttctgaattcggcgttttttttttgctgcaaattttttaagatttataattttcatgactttttcagcacgtgcgcaatgacgtttggatggacattttcccttttttggccatgctcaactcggcctcaaattggcattgctttcgccacgtttcaatgcgtttgtggacaaacattttcaatggcaaaagcggatgctgcgcaagttttaaattttttcaaattaaccggtcaaatgttttataagctctaaaaatttttgattgcattctgcaatta

SEQ ID NO: 58096 - DNA, 525 bp, Heterodera glycines
  Genomic contig location: Contig_ID=SeqID_5451; Location=1073..1597; Strand=-
  SCN-specific regions: Sequence locations=1-60,82-128,154-347,369 -399,425-482,504-525
atggtcgctaagcagaccggcacgtgcaaaaatctcatcatggtcgcaaagcagaccgataagattttgaaacaaataaatgtgagtctcaaatggggataaggacagaaatctttacaattgacttcaataatatttataaaataattttaagtacacatttaagtttcagtcaagcgtaaagacttcttaaattctatttaggagcttatgcgtgccaaagtgtacgaaacttattcctaaccaacctcagatttgggttagtataactattcacttagtatacactttgccataatttttcatatattacatctaaaaatttttccttgttctattcagttcatcagagatagataaattttaaagatttaaccggccaaacggcaattgcctgtgagaattttttaatttcacaaaaaattaactggatggaatggtttcagcccatcaatgttgagattttcaaaaaatcacaataattgattttcataaaaattaaattgctagtttttttaaaataaa

SEQ ID NO: 58097 - DNA, 977 bp, Heterodera glycines
  Genomic contig location: Contig_ID=SeqID_5451; Location=2427..3403; Strand=+
  SCN-specific regions: Sequence locations=1-554,576-977
atgccttctaagcaacgaaatttgcgaaaaaatgagcaagagcgttatcagcggcggacggagaaatctgtcagtcgggatacctcacccgtctcagtcgggagtgcagatgggaatggtgaggcatcagcatctctccggggcaccaccaccccaagtttaagtgctttgcaaataagcacgcctgcttcttccattggaagtaaaaaaaggggaagacccttgaaagcaggagcgaagccaattttggcaacgcaagaaactgtgtcctcaattgacacacctcgaactgctgtcacccaaagtgaccaaggttcgccgtgcaaaaaaagaggaaaggtctccgagtgtgaccaaccaacgtttgccaatgaagctattgctttgacgcctgtttcgactcaaagtcgtggagggcgtcctgccaaaaaaattagaggcccaggccgaggcagactcagtgattccatgagcaaaagctctgaaatggatatcaatcttgaaaatgcgccaattccggcaacctcgcacactgtgtctgaaaaaattgacttcagcactgtgcaaattaatttcgccacatcgcgaaattttgcctgtaaaatttggaaatgggcagcaatcggcctttacgaacgtgatggcgaaacaccgattgccccaagatctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattgtccatgatgtgcaatttggcactcattttgccgattctttgcctaccacatatggcag

SEQ ID NO: 58098 - DNA, 365 bp, Heterodera glycines
  Genomic contig location: Contig_ID=SeqID_27402; Location=499..863; Strand=+
  SCN-specific regions: Sequence locations=1-103,125-365
atgaatgaaacaatgccaaaccaaatccctgaaagtatttaatcccggtgtttttatgcccctatttccaatcttcaggcaagttttgctttttatcattaaatataattgtttatttttgtcaattaacccttgacagacttggacatcgaaatgaaattatggtagaaatgagccaaaaattcggaaacgcaaagcaacagttggaaaatgcacttagcgaagaaaaagccgaaaaacagctcaatgaagcagcacagaaaggatttgaagaggcgcaacggcgatttgaaattgcaaaacaagagaaagagacggcagaagcggcactaaagaaggcggaagagaaacggaagcaattggaa

SEQ ID NO: 58099 - DNA, 733 bp, Heterodera glycines
  Genomic contig location: Contig_ID=SeqID_27405; Location=336..1068; Strand=-
  SCN-specific regions: Sequence locations=1-733
atggagcaagtgtcggccatcgacggtgcggagctgctctactgcggtatgtttgtcacgaaatgttttttgggtggacaacgctatgttttagacaccgactccatctactacgtcaacaagatgggtggtccttgtgtagcagagggcgaggcgctggggcagatgaagcgcgaacacaccgaccgacggatcgtcgagttcgttgcgggtggccccaagaactacggcatccgccacactgcgcgggacggcaccgacgagcgcgccaacctcaaaatccgcagcttccgcctgtcctatactgcgcagcagctgctcacctttgaggcgatgaaagacctgacgctggccacttacaacattgacggcccaatgtgagtttttaacatatcattcttttacataatattaaaaaaaattgaattttagcgatgatgctttggacaatgcgacctttacgtgtacggaggcggcgaacatcgtgccatacgcgtcaacttcccgcaaattgatcgcaatgtgtacgccgatctctacacgcatgaggcccacaaagactacaggcccttctatgccaaggggcgcgttcggcctgggatgcagacgcgtccctttggctatctggaggatgatggacagccgaacgaaggacaacggacgcaccgacgaaagagaaattttgtggagcaagatcccacacagcccggacactctgggtggttctgatgtt

SEQ ID NO: 58100 - DNA, 202 bp, Heterodera glycines
  misc_feature (140)..(140): n is a, c, g, or t
  Genomic contig location: Contig_ID=SeqID_27405; Location=1..202; Strand=-
  SCN-specific regions: Sequence locations=1-202
cccagtgacaatgaccttccccgaaatataaactaggcacgtgactccattcgacaatttacaacgaagggctgggaaaattgttgggtcatagataccacccagggtgttttggagtcgctctacactgattcgctggngcaaggtttgaacaccgacaatgttgaccacgcgcagctggtggatgcacagtgtgatgctc

SEQ ID NO: 58101 - DNA, 1187 bp, Heterodera glycines
  Genomic contig location: Contig_ID=SeqID_27407; Location=9..1195; Strand=+
  SCN-specific regions: Sequence locations=1-606,790-1115,1138 -1147,1169-1187
ttggagccgaagcgtcaaactcattagcgggagctcaagggtcactaatcatttatgggttcagcccaatgtttggaatgcatccaatgcgacagacagacgctttggtattcgccggaggaaaacgaacggcacattgggagatgccaacgcggactgatcccgccaagtcaatgtgccaacagttcacacacccactgcatatttagctacttcaagcagggagggggtaagcggcaccataggcaattagcattggctaatttacactaattggaaaatttaatggaaaatcaaatcaccgttttgtgtgaaggtcatacagagggataattgagacagaacataaaaagagggcgtaagtgagggatgggatggaagaggaagtgcccacccgcaaaaatgatccaaaataatccaatccatcgttaatttctcggcggcatttttgataaacaaagggagccagcgggagagatgaagtgaacaatgaaaaaataagttggattgggaagacaataggaaggggagaggggaaacaaagaacacagagaatagggaggggacagagaaattagagagagtgattagggaaagtgccatggtgagagagagaggggggagacagagaaagtgggagggggacagagaaattagagagagtgattagggaaagtgccatggtgagagagagaggggggagacagagaaagtgggagggggacagagaaattagagagagtgattagggaaagtgccatggtgagagagagaggggggagacagagaaagtgggagggggacagagaaattagagttgccatttgcccacttctcccccaatttttgttagatttttttgtgcctattcagtgattacaatcactgaacgacgctgtggcactgccgatcaaatcagcggctgcactctgtacaaatcgatgatgcgggccaaaaggcatctgatcgcgggctcagcgattgacgtggaaccaacgaaactgtggagagtgggaaatgtgggacaaagtccgccaagtcatcgcagacgcgagacgaatccattggtggtggaagtgtgcacgggcggatgcaaagagaacggatgtgtgaacggagtgggaggaggaggagaagcgaagtggacgatggcatggattgtggtcatcggatgggtggcatggtgg

SEQ ID NO: 58102 - DNA, 221 bp, Heterodera glycines
  Genomic contig location: Contig_ID=SeqID_27408; Location=1..221; Strand=-
  SCN-specific regions: Sequence locations=1-221
cggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatcagagcaaaaaaagttcgaattactgggtttttgagttccttctggccataact

SEQ ID NO: 58103 - DNA, 707 bp, Heterodera glycines
  Genomic contig location: Contig_ID=SeqID_27409; Location=151..857; Strand=-
  SCN-specific regions: Sequence locations=1-63,126-184,206-278,324 -486,576-707
atgcgtcaatttggtcggcagttacaaatgcgaatgcgaggtgagtgtcagcgtttattttcgataaattttattcattttttaatattttatattttttagggaaaataaatttaaaattttatgcatttttaatcattttaagtttggttacaccggcgacatgtgcgcgtcacggatcagttattgtgatgatgaacaaccgtgtcaaaacggaggcatttgtcacgaccaattgggccactacgaatgccgatgcaaatttggtaatattttggaaaaaaataatttttaaaataatttaaaattgtttttaaatatttgttttaggattttctggcaaaaattgcgagtttcaacatgaagaaagcgcgaacaaatgcgaattggactgtcagaatggggccacctgccaaaatgcttcgtcagaacagtgcgaatgtccgccaaaatttggcggcattttgtgcgaaatgtaaacaaaggaaaataattaaattaatcactttaaaatatctatattaaaatattttgggtaatatgaagaaatattaaatttaatttaaaatattatacggattgccttcttattatctaaaaacacaattattgcagcgaaaagcccgacccctgcgaatttaaaccgtgccccgaggggacaatttgcacaccgacaaatgactataagtaattttttggataattaa

SEQ ID NO: 58104 - DNA, 1350 bp, Heterodera glycines
  Genomic contig location: Contig_ID=SeqID_5452; Location=43..1392; Strand=+
  SCN-specific regions: Sequence locations=1-229,268-1080,1102-1350
  Gene Ontology: Mol. function=protein binding; Cellular component =transcription factor complex; Biological process=regulation of transcription, DNA-dependent
caatgacagcggcgtcggacttacggacagatcgggaaaagggggtttgagaagagcgaaacctaattaagaagaaaacaattaaaccattgtaattttaaagactccaaaaatgagagcacttcgacggaagagacggccaatttgagcagcggcggcggagacgaattttcattcagtggcggcacatctttggcaagtgcgacggcatcgggggaaggtggccaattcaaaacagaaaatgaattggatagtaattaaataaaagcaacgacatttcagattcaaaatttgtgccctttcgcccattcattcgttccgtttccatccacggcgtccaacagtaccacgacttggagctgatcaaatacagcgatgtgagtttcaaatttaggaacgcattataatattggtattttgacactcttaaaaaaatactactcaatttgattgaaattgatggagcctaattagtacggaacgggccaactccgtttggccaactccgtttggccaactccgtctgagccaactttgagtcaatataactcttaaagttattgactgaatcaaacaatcttgatatcattcgaaagctcttcacaggctctattagcctactaaaaattacagaaaatttcgaactataaaaaaagatagaaataaaaaactttgaaaattctgtcttttttgcggttttaaactgacaacttttttgagagctgattaatcactgagaaatagcttataaatatcttctaaacatctagggctttcgaatgataccatgattgtgaagtttggccaacaaagaaaaaagttatagctttttgaacattgctgagacggagttggccagacggagttgacccctaccgtaattagtataattattttttccacctttttaagacgcccgcccgtctcgcccttctgggcaacaccagcaaatacccaatcactttggctgaaattgttcgtcgcgtcagtcccccggagtgtctgaacacttcctttttgagtggcattctcagacggtcaaaatgccaaagaaaaagtgttttaattcaattttaaaactttttagagcaaaaaacaaagacggcgggaagcgatttcgcacggaattgcaacagtttaattgcggcgtcgatttgcagacggggagaagaaagacgggcgcaatcacaacattcaccgcactttgtgaacgtatgaaaatgaatttggaaattaaaatggaaaataaaataattaaatcgtaaaataaattaaggagaatctgttcaattggccaaagactttgacaaattggcaaaggacgaatgccatggatttcctgaaaagtaa

SEQ ID NO: 58105 - DNA, 370 bp, Heterodera glycines
  Genomic contig location: Contig_ID=SeqID_5452; Location=554..923; Strand=-
  SCN-specific regions: Sequence locations=1-370
ttacggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaagacagaattttcaaagttttttatttctatctttttttatagttcgaaattttctgtaatttttagtaggctaatagagcctgtgaagagctttcgaatgatatcaagattgtttgattcagtcaataactttaagagttatattgactcaaagttggctcagacggagttggcc

SEQ ID NO: 58106 - DNA, 1089 bp, Heterodera glycines
  Genomic contig location: Contig_ID=SeqID_5453; Location=1025..2113; Strand=+
  SCN-specific regions: Sequence locations=1-130,152-235,259-360,396 -419,442-513,557-985,1007-1018,1040-1064,1086-1089
atgttaatgctaattgtaagccaaatcaccaatccgttgcacaacgcgtgcctcaacagctgcttttccaccatccctcgccttatttgcgtagggttaaactgccacgacttcatctcacagtaccactcaaaaaagtaccattttaaaaatcataaagtttaattgcggttacggtatgcatgactcattcctttcctgcccaattagacaaatgaatcgtcccatttatccgtttatattataaattatttttttggctttatccgccctttaaaataatttttttgttttcagtgttattcgccctgtgaatttgacgatgatttgccttctcccgacgaattatctgctcgagtggaattcattaatttaaaaaatgcccaaatcagacaacagttggtcagtggtgttaatagtttttttttaaattttaattttcagaaaaatagggccaatgaaattaaaaaagttgcagaacaaccaaagccggcacaaatacggttggtcggcattaaaaaattaaaatgaaattttataaaatttaataatttaagcgcttttttatgcccatcaatggctgaaattggaaattgcgattgaacaaatacacgaggaaaaccaatgaaaagcaggcactgttttgctgactaattgcaattttaaagtaattaaattcttaattaccgactatgttcttacacttttaccaaaacaacaagagaccgggggaatcgatcttttatgtatgttttctactcacttatttgttagttgaaatttaataatttagatgcaaaaattgaaaaaaattattttgtacgattaaaattgacatttttattggctttgccgatcggaatcaaaaatcacttggacaaaatcacgctcattcaactcattcattgattcaaaagtgtgtgaaatggcatatgtattgtaaatcaaagaaatgtgagaaacattttcgggtgaatttgtagcgtaattaattaattaatggggcgaaagtttacacaaaaatggaggggaaaagaaagagcagcgaaatgaatgaatggatgataaaagttgtgaaagaaaaactaa

SEQ ID NO: 58107 - DNA, 865 bp, Heterodera glycines
  Genomic contig location: Contig_ID=SeqID_5453; Location=2293..3157; Strand=-
  SCN-specific regions: Sequence locations=1-70,92-109,202-318,340 -775,806-865
atggcgatgagtgccgccgttttgggcggcttagtgggcgcggccggcggatacggcgacgcggcgctgtgcggcacggcgagggagcggacgacgcatttggcactgaaacaaccgcagcagcaacagcaggagatggcacaagcggccgctgcacaactaacggcggacgaacagcggcggcagcaacaacagcaacaggtcgaagcgcagagaaaaagcggggaacggcaaaagcagccaaggcgtagtcatggggggaagctggtggctaagggggctttttttaatcaatcaaatttataaattgaaattggcatttataaaaaattattaattcgacaagaattccaatgcgatggttcatttttaaacatttactaataatagaactgataaatgagtgatcgatcagttggcatttgcttgcctttcgagttttcgtccttttcagtcctcttcgcccacccgaccgttgggtttggggaggccaagcgtcgccggaggggtcggcggcaacggcacgcgccattttcaacgatcgcaacagcagcaaatgcatcagcagcagacgaacatggaccagtgttgtgccggggataacacttcgccaatggcacacgcgcagcagcaacaccaaatgaactccttcaacggattgctgagggcagttcagtccaacgataggtgggtgtagcaattagcggcaaagctatttttggccttttgcagtgccgcggtggacggactgctcggcctccgcggttccatggcaatgaaacaacagcagcagcagcacggccattccgggatggagctgaacgaacagctccaacttgtcagtgcacagctgatgaaccgatga

SEQ ID NO: 58108 - DNA, 59 bp, Heterodera glycines
  Genomic contig location: Contig_ID=SeqID_27414; Location=294..352; Strand=-
  SCN-specific regions: Sequence locations=1-59
aaagtcgggaccgggaccaagtttttcgaccgggaccgcgaaaaaacccgggaccggga

SEQ ID NO: 58109 - DNA, 283 bp, Heterodera glycines
  Genomic contig location: Contig_ID=SeqID_27415; Location=334..616; Strand=-
  SCN-specific regions: Sequence locations=1-283
tctcaacgactttgagcgcaaggagagggccaaggcggaacatgcgttggcgctgaacttgctcgagtcggccgtgtacgactacagtgccaagctggaagaggaggccttcaacagttttggcaccgatgaagagctggtattgatccgtgaacagacggcaaagctgaaggattggttggacgacatgccggacgatgttggggttgacgagctgaagcagaaacgacgcgaatttgtggcacccattcgcaagttgaagaaccgacagcgacagaaggag

SEQ ID NO: 58110 - DNA, 760 bp, Heterodera glycines
  Genomic contig location: Contig_ID=SeqID_27416; Location=93..852; Strand=-
  SCN-specific regions: Sequence locations=1-218,240-259,303-520,542 -647,692-760
  Gene Ontology: Mol. function=protein binding; Cellular component =nucleus; Biological process=nucleosome assembly
atggccgaggctcatgccaaaatgcatttgcggaactttgtgaacgatgacgacgtcagtgtggcgatgaaaattttattgcaatgttttatcagcacacaaaaggttggtttcaaaaacttatgttaggcattttttatttgtgcggtacctcgaattaaaaaaccgaaaagcagaaaatatgtgtgatgaggtccacaaaaatgtgtatgaacagtgtttaaattaatgtttttaggcatcggtcatgcgccaaatgaaaaaggtaatggcaaaatttaatatcgaaaagcaaaaacaaattaagaaattctggaaacaactgagttataaacgtgacaataatgacttgctgctctttttgcttaaacaattagtcaacgaacacattgtgtacgaacgtgttcgacacgggggcggtatttcggaaagtgctgacattgacacaatcgccatcccggaaagcgagttccttgaaaaggtaaccaaataaatcatctgttctgtttttttcataagcatttcaaataatttaggcccaacaattgaagatcgattcggcaaataaattctataaaagttgtcaatttactgcaaacaatttccaatttgatgcgcaacggaaaatgattgttaaatcacttatctaattgctatttttgtctatttatttttccagttaaagtttttacctcatttgttgttcattcgtgatttaaacggtaatagaatggatggtaccccagctattttttattga

SEQ ID NO: 58111 - DNA, 758 bp, Heterodera glycines
  Genomic contig location: Contig_ID=SeqID_27420; Location=277..1034; Strand=+
  SCN-specific regions: Sequence locations=1-255,277-347,369-758
  Gene Ontology: Mol. function=monooxygenase activity; Biological process=leukotriene metabolism
atgctcatcaccaaaccggacattgaggagacaatcggtcaaataatggccatggcttacctttacccgtcccatccgcggatgaccgccttttggattgggcccactcctaccattatgatttactctgccacgctgctcgagtcaatcaccggcaacacggaccatctgaacaaaggattttcatacgaatttttgaggccgtggctcggcaatgggctgttgaccaggtggggctgcactgtttccaataggaaattcccacctttttcagttgtgccgaacaatggaggcccaggcggaaattactcaccccgacatttcattacgacattctgaagcttttcttgcacattttcaaccatcagtcgagcattctcgtacagaaattgcacaaaattagtcaagagaacaagttggtagcgaatggcgaacaaacattttaaattatgccaacatctaggggattagttgcagacgtttcgccgttggtcagtctttgtgcgttggatatcatttgtgagacttcgatgggtcagtcggtcaatgcgcagtttgagtccgactctgaatacgttcgtgcggtgctcagaatcaacgacatcatccaacgtcggcagtgcaacccgttgatgtggctggacacacttttcaattggttcggtgacggaaaagagcactcatgggctttggaggtgctgcactcattcactcataaggtgcagtcaaatcgccaatttgccaaatcaaacgaatga

SEQ ID NO: 58112 - DNA, 363 bp, Heterodera glycines
  Genomic contig location: Contig_ID=SeqID_649; Location=364..726; Strand=-
  SCN-specific regions: Sequence locations=1-33,56-363
atgaacagacggtaagcacaaattcgtcatttatttacctaacaaaacttttttcagttggatttgcaacgacgtttggatggacattttcccctcttttgaccgtcctcaactcggcctcaaattggcacttctttcgccacgttttgatgcgttggtggacaaacatttcgatggcaaaagcgaattgactatttggagaacgatcgaaattcgcaaggacaaaggaccagaaccgaagctgtctgtacaaatggatgacaaatgtgtgccatttccattgccggaccgtccgttgcccagcaaaatttgctttaaatggcttcggattgagtaattaaaaaacagttttatggaaataaa

SEQ ID NO: 58113 - DNA, 1982 bp, Heterodera glycines
  Genomic contig location: Contig_ID=SeqID_650; Location=3364..5345; Strand=-
  SCN-specific regions: Sequence locations=1-1007,1029-1215,1243 -1345,1372-1433,1458-1696,1718-1982
atgaaccgacggtaaaagaattttaaaagtcacaaattcgtcgtttatttgactaaactgttttcccatttcagttggatttgcaacgacgtttggatggacattttcccatcctttgaccatgctcaactcggcctcaaattggcacttctttcgccacgtttcaatgcgttggtggacaaacatttcgatggcaaaagcgaattgacaatttggagaccaatcgaaattagcaaggacattggaacaaaaccgaagctatctgtgcggatggatgacaaatttgtgccatttccattgcccgaccgtccgttgcccagcaaaattcgctttaagaaccttcggattgagtaattaaaaatcaaaagctattgcaataaaagcattctttccatttttaggtacattgatcactccgtcatcgcttttcttcgttccaatcaccaaattttcgacaaaagaggcatcaatttacatttgtggcttccattatcaaacaccacgaatggccagccaatttgggatgtttttgttcgtgaaatttggcccattttttctgaaaacattcgccacttgggcgtttgcaatggcatcctttttgacaaattgcgtcgtctcacttcgcattcaattctcaccgatctcgaccaattgaattcaatctattccggtgatttgttgcctgaggcgtccaaatggttgcactctccgagaaaagatggacaacccaagcgatttcgttttggcagaaatttgaacgcacaagcggacttcgattgggtcaacagtttcaaggaggtgtggtgcggagggaggggggagcaggaacaaatactgctgaaaatccccgaatgagaaatttctcgagcttttttgaactatgagttgggttcaaggggtaaaccaaaaatacgtttaatggtcttaaatggcgttaattaaaaggtataatcattttttggcgtaaacccaacgatttcatagtgaaatacaattttttgtttaccgaaaaaatggacaaaataggacaatttagccttttaaaaaggtcaaattcagacaaatttacggtaatactaccgatggtaccacttcagaatgtttccatgtgattacccatttttagacgaaaaatgcaaaatttgaacttacgaaattttgttcgggttcggggttcgaaattagtcgaaatggatgtcatattggtgatcagcaaccccaaaaaccccagggaacattttttcacggcttttgaaaacaaaaattttttttttcaaaaaagttgtggtaccatcgggtagtattaccaaatttagtatcattcgaaagctcttggtgagttaagtctaaaaatcaaagaaaaatgtcaaaacgggagccacctaagcacagggacaactgagtcccattgaatatagacagttctgtaccaaaaaataatgaaagaaattaacaattaaaagtagggttgtacggaccggggcgggaattcccggtcctccgaggtctcggcccgttttacgccaaaaaatgatcataccttttaattatacgccatttaagaaccattaaacgtatttttggtttaccccttgaacccagctctagcttcgaaaaaaatattctataaaattcgaaaaaatgaggcccaaaatttcggaaattggaattccgaccccactcaaattgtttagcattttcttcgtgccaatgccatttcttccatcagttacgaaattcattttcctgttcgcgtgccgtcaatgcaaattgtgccatttgaattggtgaacgaatggacaaaggaaaagctgacattggccaaggaaaatgaatggggcatcggttggataatgaaacgaagcaaaattattggggagacagcggcggttcattggaaagacggaaattgggacaacaattgtaacaatgtgatcatttggcttgatagtgacactaattgcattgggtgagcaaataaa

SEQ ID NO: 58114 - DNA, 1772 bp, Heterodera glycines
  Genomic contig location: Contig_ID=SeqID_651; Location=343..2114; Strand=-
  SCN-specific regions: Sequence locations=1-6,43-72,94-333,356-397,419- 456,480-637,685-754,776-835,858-885,910-1435,1459-1466,1504-1510,1532- 1607,1631-1641,1664-1772
atgacaaaagaaatggctaaattttttgttgacaattttttactgaaagtgatcggcaacaaaaaagctgtagtgttgcttgactcatggcctcaatggaaaacggccattggtggagcagcaccaacaggcccatcatcatcaactgactttgccagggacaacatatgtctcgagacaatacctccagggtgtaccggattcgtacaaccatgtgatttgtatttgttcaggtggggtcccaaaacagatctgacttctaatttatttaaagaacttggaagtcaattgtcagaaaaatttcggatcgcattgtgcttgacgatctgcctgtaaatctttaccatcgtgatgaaattgttaaacttcaaagtttaatccatttccaactttgtgctccaaaatttcggtcatttcgtcgttattcttggcataaggggggctacattgaatcacaaaatgatgaattttccaacttttctcatcccgttaaatatttattcccaacaatttttcctgatcactgtcaaatcactttttgttcggaatttataatgattagatgtgcatggtgtgacaaattcctttgcttcactcatttctaccaaaattatcacatgtgccaaaattaatgtcgaataaaaatgaaaaaaatattatgttcaaatttattaatattaaaaagcttaaaaactaatttggatatgaaaaaaaaacaaaataattatttacagggttggggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatggtcacttgggtacctctcctttgttaggcctatttaatggtatcaaaattattttatttggttggataagaaaaaagttataacactttaaagttcgcggcgccaaaatggcccgcgccaaagtgaccccgacccccacccgccgcagccagcctgactgtctggctacgcttctgaaaaatttgaccaaaaatgtggatacaaacccaattagtacccagtgacgaaacatcagggagccttacgagttggcatagcacgagttatgtatgattttccattttaatcgtttagatagtttgacttttatcataactagggatggtaaaaatatggactaaaaatcgcgaaatatggacataaaatggtaaaaatctcaaaatatggacataaaatggcaaaaatatggacataaatttttctaaattgaggggtaaattttcaaaaaaacccgaccaaaaaaccgaaattttccattttttgcttatctttcacataaattaaccaatttttaagaaaatttaaatttaatcaattttttttgacaaaattttgctaaaaaatgtctttttcggagcattttctggtctttgaggttaaaacggccaatttagctgatgggggccgttctaataggggtttttttggaaaatgccaaaatatggaaaaatatggatatataaatccatcttaaaagcttcaaaccaagctaaaggcccccagcagctaaattagcctttttgagcccaaaacccgaaaaatttttcaaaaaatcattttttcgccaaaatttctcgagaatattgaataaa

SEQ ID NO: 58115 - DNA, 155 bp, Heterodera glycines
  Genomic contig location: Contig_ID=SeqID_651; Location=59..213; Strand=+
  SCN-specific regions: Sequence locations=1-155
ttcttcaaatttattggttgaaattgcatatgagatacatttccaaattttttgactcggtaaggcgctttgacaaagacggctttcgttttgcaattagtcagtcaacattcggaaattggtctcgaattttttcggcaattacgtgcaatcat

SEQ ID NO: 58116 - DNA, 362 bp, Heterodera glycines
  Genomic contig location: Contig_ID=SeqID_651; Location=1126..1487; Strand=+
  SCN-specific regions: Sequence locations=1-80,105-132,155-214,236 -305,353-362
gcctaacaaaggagaggtacccaagtgaccatgggacttccgaatgaaactttcagggtaggtagattaccccccctttgtattataaatttttttttatttttgctaaatgaagcttctggccgagatatgaagcttttcctttttgccttttcaatatcattttcaaagaatgtaaagccaatgtgagcgtcggtggcctggtggttgtgccttccatacttttttcttcttctaaagttcaattccccaaccctgtaaataattattttgtttttttttcatatccaaattagtttttaagctttttaatattaataaatttgaacataatatttttttcatttttattcgacattaat

SEQ ID NO: 58117 - DNA, 367 bp, Heterodera glycines
  Genomic contig location: Contig_ID=SeqID_651; Location=3484..3850; Strand=+
  SCN-specific regions: Sequence locations=1-8,62-131,154-212,235 -262,287-367
attctctcatataaaataaaaatgaaaaaaatattatgttcaaatttattaatattaaaaagcttaaaaactaatttggatatgaaaaaaaaacaaaataattatttacagggttggggaattgaactttagaagaagaaaaaagtatggaaagcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggggggggtaatctacctaccctgaaagtttcattcggaagtcccatggtcacttgggtacctctcctttgt

SEQ ID NO: 58118 - DNA, 342 bp, Heterodera glycines
  Genomic contig location: Contig_ID=SeqID_5456; Location=1593..1934; Strand=-
  SCN-specific regions: Sequence locations=1-342
gcgattattacggagagtgcggtgttttgccgcgacgaagagaaccatcgaactatggaaaaacgaacggacgatcgcacgtcgaaagcgttgtccattcgccattatgaggaggccgtccaacggaatcggggctacgcaaagcgaaaggacattttgttcggacattggtagaaagggttttttattgtcgtcctttctccctttctgatgatgttaccacatacatttatttttgcaatgttttcttacatacttcacaattttatccattcactttgccaatttttatttcatgatgaacatgcaatagtaggtaataagcaatttggaaaaaataaa

SEQ ID NO: 58119 - DNA, 596 bp, Heterodera glycines
  Genomic contig location: Contig_ID=SeqID_27423; Location=272..867; Strand=+
  SCN-specific regions: Sequence locations=1-86,108-349,371-596
atggaaaacccgcgccaaaagccatcaaaagtattggcagaaatccgtgcaaacaccaaggacgaaacctttgtttccatgggcactgacctcgcactggtggcagtaatgagaaggtacttctcttttgatacgtgtattcctctttcactcttatttcaaaatttttaggcagaaaaggaagatttacggcaacatggaccgtgtcaaccctttgagtgttgtcttacccgatgccctgcttattaaggatggcgaaagcacattgttgtatgacagccgagcgcatcgccaaggagaatcggatgtggtcttggtctttgcacacccgaagttaagttcattcatttcatgttcaatttttcgcttttgttttcagctgttggacgttttgaagcgggcgaggaaaatttcagttgatggaacattcaaagtgtcaccagccgcatggacgcagtgtttcgtgatcggcgcttttgtcaaccggcggctcgcattatgtgtgcatgctctgttgcctggaaagcaacgaaaatactacgaagaggcgctcaatgcggtcaaagcggtgatggcacccaacaccccagcacata

SEQ ID NO: 58120 - DNA, 1004 bp, Heterodera glycines
  Genomic contig location: Contig_ID=SeqID_27426; Location=502..1505; Strand=-
  SCN-specific regions: Sequence locations=1-1004
cataaagtacatcaacacgtcatcctttagacaagccgatgtactgtcccgcttaatcgccaattatccccggcccgaagaagacattttgatagcaaatatctgcacagagacagattgctacataaacgtcatcctccaaactgcaactgatcaattgccgattacggaagcagaaatttcagaatgaacgccaaaagacgaagtcctccgaaaaatttctgattacaccaaaaacggctggcctcaaaagtgcaccgaaccagatctctcaccttattttcctaagcgaaaggaaattttagagattgatggagttttgctctacggaaagcgagtgatcgttccgtcccaacttcgtgaacgcatcatcaaggctttacaatggcacaccccggaatcgtgcgcatgaaagccctcgcccgtcagcacgtgtactggcccggattggacttggaaatcgagcgtatggtcaggcaatgcgaagattgccagagcgcccaaaagagtccacccaaagcaccgctcgctccatggacgtcttgctcacgaccattccaacgcattcacattgatttcgccggtccctgctcagatggccactcctatttgattttgattgactcattttcaaaatggcctgaattataccgaatggaccgaatttcgacaccagcaacgctccatgtcctccgatcaattgtctaccgactcggatttccagaagaaatcgtgtcagacaatggaactcaattccatgccgcagaatttaaggaattttgcgacgaatttggcatcaagcataccttcaccccgccgtatcacccgcaatcgaatggccaagcggagagattcgtcgatacgttcaaagggccatgaagaaatgcgccaaagatggaaaattttgggcagaaaagatgcttctcgcctacaggacaaccctgaattcggcactcaacggactttcgcccgatcaattgttcttcggtcgaaggcttcgaact

SEQ ID NO: 58121 - DNA, 1662 bp, Heterodera glycines
  misc_feature (1000)..(1000): n is a, c, g, or t
  Genomic contig location: Contig_ID=SeqID_27427; Location=389..2050; Strand=+
  SCN-specific regions: Sequence locations=1-161,183-400,422-468,499 -532,554-565,588-1258,1280-1552,1574-1662
cattcatgagaagtgcggccgagtccgagcggttggtttcgcgccggacatgcaaattgtcagcattcaacaggaggacagtgtcattgtaaggggaagtgccaatgaataattgtcatttttattcagccaaaaagccaatttattcatttcgaatgtcattctttttattaaaatgaccaataaacgaagtgctgtttttacaggaatttgtgctgctgcaggagggcaaagttgtgggcacttttcggcacaattgcaccgcaaaaggcgccgttgtgctcggcgtccattggctgtccaactcccaagtcgcttttgtcaccgacttgggctgcgagttcttttgtgtgtacgcgtacaaacgcacgctgaaaatgacccaacggttagccatggccatccattggttcagcttttatgtgagcacaccgaacttttgtttttggatccataatttaaaaatgggccatcataagcacatcataattttgaacaactttttctgtttcggatgggtcacacttaatctcactccttcctatcgtttctccccagaaaactaaaaaattggtaaaactgaattttcaaattatttatataattttcttgaaaaacgttagaaaaaattatgtttttttaaaagaccgctaaaaaatgtcttataattttcttagaaaatgacgggcgaatgacttcatcccaactttaggtcttgaaattccaattataaagtacatattgccacatttttccaggctccctcaaatttgtttgtttgtgccagcggtgtacagaacaacctttttagtttcgtaacttttcaggtgggacaaaacggagaggctaaaattgaaagcatttcaatttagcaaaatgttccgcacactttgggcacggctgaggttgattttggctactcttccgcaaagccccgtctgtggagcgggacattgccattgcctcaatgtttgtgagcaaccccgagagaatgtctttntaaaaataaatcactgttttaaaccccagttatggcaaactgtgcattttggtgctcaactttgagtccgtccacgggttcgccactggactcagtgtgtacgaattggtgccgtcggggccacagaagctgctgaaactgaactgtttgctgggtttgcacttggtcggcctggttgggctgcacgttgttgacaatttggtgctggtccatcataaagtgagctgaaagtctttattctcccatgacacattcctactttttataaatcctaaaaagcatattgtttatttgtttggagtaatgtccgatttgttcattgtcagaatgtccaatccactctgatctttgatctaaaactgtgcaccgatcgtccaatttgttcaacaaaactttgtctcccatctgtgccaaatgcgttgtccagtgacagtgtcaatgccgacgatggcaatgaaaacaaaagtgctggtgatttgccacacaatcaacagcatgcaaatcgtgttttatcaatcggtgatgcttttctgtacaattcggcttggaaaatgtgcatgccggacgttgtggtggatttgcaatacgaattgttcacccgtgtacagcttcaactggagagtgccgaacatgcattgacgggcgaaggagggcacgacttg

SEQ ID NO: 58122 - DNA, 826 bp, Heterodera glycines
  Genomic contig location: Contig_ID=SeqID_27428; Location=214..1039; Strand=-
  SCN-specific regions: Sequence locations=1-507,529-707,729-826
aacgccggaccttggcgttcagctgctgatcagttggggctttgtacggaacagtccccgggagttggcactgttgttcatggaacggcgcgggatcagcaaacaaatgatcggcgagtacctcggcacattgcgctcacaattccataccgccgtgctaaagtacatttttacaaatttttttcagtaaccatagttagtttaaaaaaaactcttggcgaaatgaggaaaattgcgaactaatttagaatccaataaatttttgcacatttaaagttgtttcatcgaacaaatttcaatgtacgacatggaaattgacattgcacttcggcaattgctcaaacacattcgacttccattggaagcgcaaaaaattgaccacattattcaggcaaatgctttttttattgcaattttggagatatgaattttgagggttctctcaaaatcaaaacttttgatcaattttaaaatgtttaacctaaaaaacattttgctgtttcagcttgggattgttgttttcttgcttcaatttttgtttttttttgtcaaattcacaacaaaatctcgcattaattaaatacagtctcattttttttatctttgacattcttcatctttaggcctttgcacaacattacgttgcgtgcaaccggaacagactgtgcgcattggacacgccggactcgatgtacattttggcatttgctgtcatcatgctgaacacggatttgcacacgccgtcacttaaggactcgagacggatgaaattggacgaatttgtgcagaatttgtaccgacttgaggaggcacgacatatggacag

SEQ ID NO: 58123 - DNA, 1047 bp, Heterodera glycines
  Genomic contig location: Contig_ID=SeqID_27429; Location=940..1986; Strand=+
  SCN-specific regions: Sequence locations=1-167,189-380,406-547,571 -617,640-868,902-951,973-999,1021-1047
atgtcgaaaacagctcggcattgcaggtgccgcaaaagacgacgacgacggcatcattacggtgctcatttcgcgcgttattttcgcgcagacggcaaacggttggtgaggcatcgattagtccaacattttgaaaacggcactgagtcctcgcaaatttattagaatttttgtatttcacaaaaatacattaaatgattgcttactttactttttcaccaatttttatttatttatgggtgactcaccgtaatcaatttcacttcttcacccgtgtttactgtatgtaaaatctctcattattgtgtttttgttttgcaggtgtactgtagtgcagtgggccataatcatccgctgatttgtcataatggagcagcgcaacttagaaagaaaaaagattttacaccgcaaccgccgattaaggtgtgtgacagtgacggattctgttccgtgatttttagcagtttctatgtcccattatggtacttaaaaaaacaattttgctatcccgttaattctcagaaagatgatttgagaaagctctttttccaataatttaacttttttatttactggctttttggtctcgattaagaagcctggataaataacagcagttcaaataatttaaaatattttcaacagcttgaacgtagcgaatttgacgaggaaaatgaaatttcgccattcaaccgccagcaacagttagcgcctgaagcgttcgcttcggttgcgcgtccgtgccacaacaccttgcgcgtgcggcatgcgttggctgatgcgcgcgcattggaatgtgccggaatgtcgcacaaaaaggcggaagtttgggtcagcgttcacgcgttcaaacggatgatgagaaaagcggaaaagaatttgaaagtgaagaaagaggagacgaacgcaaaacaattcgccaaatgaatcaattaaaatggcaacaaaaagcatgtgattgattctccttttgtccaattaaaaatgccaatacccaacttaaatcatttaaataattatattcagcattgaaaaataattgaaaaa

SEQ ID NO: 58124 - DNA, 361 bp, Heterodera glycines
  Genomic contig location: Contig_ID=SeqID_27431; Location=103..463; Strand=-
  SCN-specific regions: Sequence locations=1-361
  Gene Ontology: Cellular component=mitochondrion; Biological process =cell cycle arrest
atgacccaaccccagtctatccccacgcccatacttttgtcacttctcctcaacaagtacatagatgttaaccttttagggtatcctcgtgaagtgacacaaggagaacgctttgagcaagaggttggcccataaatttctcccaaaatgccaattttctacaaaatgccaaattttttggatccaatcgcccgttttggtcatttatttcgaggccaacgatgaaacgctggtcaagcggctgatggggcgtggacgaagtgatgacaacgtggagacaatcaaaaacagactgcacacatttgtggagtcaacaaaacccgtggtggaccattacggaaagcagggcaagctagtgaag

SEQ ID NO: 58125 - DNA, 719 bp, Heterodera glycines
  Genomic contig location: Contig_ID=SeqID_5457; Location=213..931; Strand=+
  SCN-specific regions: Sequence locations=1-343,381-543,567-596,627 -636,659-679,703-719
atgataatcaccttgaaaatcagaatgttatcagatcagcgtcgagttgatggtaaaattgagttgggaaatagatcaggaatttggctgagcatttgatcaattagcgattgaaaatattattaacattgcatgtgacatgtttaatgataattttgattatcgtaattaggcaaagccaaatcatccattttttgcagatcatttaccaatcaaacaatgtccgctatgttctgctaaacttgatcagccatatgagcaagagttggagaagcatattgcagaggtaattttggcacttcaatgcatttattacttattaattgcctttaaagacacacaataattaattaatgaattaattacttagtttaataattgcttttaaagacattttcattaattaatttaataaaatgttgtaatttaaacccatcaattaatttgctttttgtttaaaggaacacaaaattcctgccaacattgtccaacgactgatcaaaacggaaattgatgaccaacacaatcaagcaataatagatcaagaagaacatcaacaacaacaaaagtcgccaagtgtcggccatccaaacaggtaattaatatgtatatattattattaattagcacaaagccaatatataattttaaaaaaaaacttgttaattggctaactcaatcattcattttccttcagctttttgtcactctccatttga

SEQ ID NO: 58126 - DNA, 2058 bp, Heterodera glycines
  Genomic contig location: Contig_ID=SeqID_5458; Location=2596..4653; Strand=+
  SCN-specific regions: Sequence locations=1-456,479-715,739-748,770 -1080,1103-1193,1227-1358,1380-1796,1862-1931,1957-2058
cccctccggtgacgacggcatgctgaacaacatcatcgcagccctggccaataatcccacgactccgccaagcagttcgacagcaccggcaacggcggtagatgatccaacagcatcatcatcatccaacaattttggtgcccaactgttgccaatctttccgcaccaatgccggcactgttccatcgcttttcgtaccgcggaacatctgcaggtggtcgtcgctgtccaaaaacactcttttgagtcccggactgaatttggaatgtttgcgcacttttatcttgtccaatcaatctcgaactcagtcccgaattaaatgctggatttacccgcccccaaataaaaagtttaaaaatttttcagaaaaataggcaaatttcaaaaaaattttttgaaattttcttaacaattgcatcgaaaacgagttcctgctttttctccccggcgctgaaattttgtaaatatcactgtaaaataaaactttggaatttttggctcaaatagcacaaaaaaggtcttcagattccactttccgaaatctttttttatgtatacgggccctgtggtcccgagattaacctcgtaccatctctaacggctcttaacattatcgcttcgattctccgtcccctggggtgtcaattatccgcctaaagccaaatttctgcaattgacactactagccgtgatgtagggtcgtaggcctccggagatttatcacagtgccaaaactgatcaattttttccaggcccacgcattggcccattcgccggccaaatttcgcctttggcaccgctgcgatgcgcctccatgcgccaccggcggcacagattccgacgcggctggcacaagtgccgacaacatcgcggaccaacaaacgacgacggcatcggcacttttccccacaaaacgggccctggagcggcatcagcggacaacggcacacgccggaggcgacgacggcaccgccggcggtggcggccatttttgcgacatttgcgcggacgggcaacgctttgcgtccgacaccgcattgatggcacacttcaacacggagcagcacttggtgaaggcacgcggtggcagtggcggcggcgcacaaaacggggtgggtatactataataattgggcgatacgtgccattcatatattgtaaaaagaacttgatgttacgagacagaggggttggaatgctttaataatgcaatggcatttttatttggcatagttcattataatattttagcaagattagcaccaagaaaactaaatttctatgcgatgcttactgtaattttgattatacggtaatctcacaaaacttgctccacaagaagatatatgtgtatttttggatgggactaaaatttggtgaagtttaattgtgcctttgtaatctcgttttccaattccatttccaattcgggataaaaccagggaactaaagatagccaaaaatcaaaaaacgggcaaaattttctatggcatttttttatctcgaatctcggtttgatggctttcttatcaagatcactacgggtgcactaatccccccgccgacaataaatttgagttttttctttttctaaatttcttaagtagaagttttttcttttttttaattttcaaaattcaactttttgagaaaagaattcatttttatgaatttctccgagggggtggggaaactagctgatctcagatcacttcaatcagctttcagtctcgactctcgagatttgtgctcgagcaaaaggtcccattaacgatttcccagtccaattaatgccgtaaattttttcaaaaaaaaaaatttttttttttgaaatttaagccttccaacgctcccggctcagtcccctcctgctcatccgcctcatccgcttctccatgctcatcatcgttcacttccaaagcggtgaagaggccatcctcctcctcgtcctcatccggcaaacatttgccatacacgtgcaatgtgtgtgcccaatcgtttggccaacccggcacattggacacccatttgaggtgggcggcagtggagattaattaa

SEQ ID NO: 58127 - DNA, 336 bp, Heterodera glycines
  Genomic contig location: Contig_ID=SeqID_5458; Location=3249..3584; Strand=-
  SCN-specific regions: Sequence locations=1-220,242-251,275-336
atggccgccaccgccggcggtgccgtcgtcgcctccggcgtgtgccgttgtccgctgatgccgctccagggcccgttttgtggggaaaagtgccgatgccgtcgtcgtttgttggtccgcgatgttgtcggcacttgtgccagccgcgtcggaatctgtgccgccggtggcgcatggaggcgcatcgcagcggtgccaaaggcgaaatttggccggcgaatgggccaatgcgtgggcctggaaaaaattgatcagttttggcactgtgataaatctccggaggcctacgaccctacatcacggctagtagtgtcaattgcagaaatttggctttag

SEQ ID NO: 58128 - DNA, 676 bp, Heterodera glycines
  Genomic contig location: Contig_ID=SeqID_27433; Location=941..1616; Strand=-
  SCN-specific regions: Sequence locations=1-6,44-167,298-344,387 -430,458-470,505-521,629-629,661-676
gatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtaaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatag

SEQ ID NO: 58129 - DNA, 133 bp, Heterodera glycines
  Genomic contig location: Contig_ID=SeqID_27434; Location=175..307; Strand=-
  SCN-specific regions: Sequence locations=1-133
tggagtccgcagacggacacacaaaggcattcatggacctgatcagattcattttgccaatggaagagcccgagggatcggaggaaagggaaggagcaaaagcagagacagaagaaggagcggaagaagcagg

SEQ ID NO: 58130 - DNA, 511 bp, Heterodera glycines
  Genomic contig location: Contig_ID=SeqID_27435; Location=267..777; Strand=-
  SCN-specific regions: Sequence locations=1-245,267-305,327-511
atggcattgctttccgaccgtttcgatgttttggtggacaaacatttcgatggaaaaagcgaattgacaatttggagaacaatcacaattcgcaaggacgaaggaccaaaagcgaaactgtctgttctgatcgatgacaaatgcgtggcatttccatttcccgaccgtccgctgcccaccaaaattcgctttaatagcctttggattaagtaagtaattttagacttttgtatatattaaagcaatttttatatttcttcagttacattgaccattctgtgctcacatttcttcgttccaacaagcaaataatttggccactttttgcgaaaagcattcggcatttgagctttttgtatggcgatgatttggacaaattgcgtcgccgcatttcaccgacaattctcactgatcttgatcaattgaattcaatcgattctgttggtctgttccccgatggaattgctgacgatggacccttgtttagacatttcgccgtgccaccacttct

SEQ ID NO: 58131 - DNA, 59 bp, Heterodera glycines
  Genomic contig location: Contig_ID=SeqID_27435; Location=1163..1221; Strand=-
  SCN-specific regions: Sequence locations=1-59
ggataattggagactgcggtattaatagagactgggccataattagagcatatacggta

SEQ ID NO: 58132 - DNA, 520 bp, Heterodera glycines
  Genomic contig location: Contig_ID=SeqID_27436; Location=752..1271; Strand=+
  SCN-specific regions: Sequence locations=1-195,217-431,506-520
atggagcaactttccgaaatttatgcaattcgcgcacttttgcgtcattattggaagaagggcaccaatgccgaggagacagtgcgcaaaatttgtgccgtcgaaggaccaaatgttgttgacattgaaacggcacacaattggttcagtcggtttgagtctggccacctaacacttgaaccaaagaaaacaatgtaaaattaaaatttatttttacgaatttgtacagaattttgggtaaatgtcaaattttttggcagcctatatctggattccatgttggacctggacctagatttcctggacaaaaaccctggaaacgccaggtccaggaaaaatccaggcttttcgaggcatggacctgattttttaaaattttttttgaaaaagcaaacaaatgttaaaaaaaaatcaattaattgctttggaacatataaaaatatttaattgaaaataacattttgtttttaaattttttaataattttttgaaaaacttaaaaatacatcggtcagatgaa

SEQ ID NO: 58133 - DNA, 1032 bp, Heterodera glycines
  Genomic contig location: Contig_ID=SeqID_27437; Location=443..1474; Strand=+
  SCN-specific regions: Sequence locations=1-55,77-364,386-693,743 -919,941-962,984-1032
atgtccacttccccgggcttgggtttacgggtggctcagcaggaatactatgtatgtgagaaatgattaagctgaggaaaatcgagaaaatgcgtcggaaaaccgagactgagaaatgagtaaagaaagacgagaatccatagagattttcaacacgagagtcgagcagagattcaattttcagttgataaaattcaacaaaatggtacgatttggcaaccatttactcatcataaacagttttgattgattctgtcatttatttaaagcagcaggtattgttagtctatttgtatgtaatttttgtctatttttggtgtttttttgtgaaaatggacacaaaaaaccttgcaaaattggacacggaagaaagaaaggacaaacaaaaagcctaaaacataaaatatgcaaatttttttgtgcaaaaggacgcaccataaaagggagaggggggggggacgaaacggaagagagagaacaaaatttggggggggggggggggttttattttgttaatagctttacaatttttaatttgcttttcccaactgattgacaattagcacaaaatggatgaaacttttcaattttatgcaaaaggccgttgattttatttactgtgaaaaggcaaaacgaaaaatacctgttaatttatttaatgagtttttgggtcttttaattaattgacaagagattaaatgaaaaaaaacaaattaattttttatttaaaaaacaaaatattccaaccattcttaaacaataatgtctgcttcatcgacattttttctgcttttttccttttggtgccaactctaaacggttaattcattaataactagtgttgctctcggggtttttttttgggtcttggtctcgaatctcgggaaaattttcgttcttagcagcagcactgtttctgcaaaaataaatgaatttgagaaagaattgttgtatattatcaatttagtttttattttgtacatttcagcgcttagatgctatgacggcactgaataagatggccgcggggta

SEQ ID NO: 58134 - DNA, 245 bp, Heterodera glycines
  Genomic contig location: Contig_ID=SeqID_27438; Location=140..384; Strand=-
  SCN-specific regions: Sequence locations=1-2,25-245
atgcatgcttttcagagcactttggacctgtacgttctctccatgttttggccatctaaatgcactgtgatgatgaagaaatcgttgcaatatgtgccattcttcaacatcggtgccactttggtccgtttattttggtctaattgccctaattaaataaaattggaccgtttctatttcagtcaaattgcatttttgtggatcggttcacccgagaaaatgccaagcaagcgctggacaaatca

SEQ ID NO: 58135 - DNA, 514 bp, Heterodera glycines
  Genomic contig location: Contig_ID=SeqID_27439; Location=937..1450; Strand=-
  SCN-specific regions: Sequence locations=1-378,414-514
  Gene Ontology: Biological process=aspartate metabolism
caaaggattggacggagttgcggaggaattgtccatggaaatgcatcggatcggagcacgcaattttggcagggacgaccgaattggcacagtgaatggcaaaagccttctgtgagttagccttttatatgcccttttgctgctttcaataaacgatcatcatcttcgttcagggcaccgttccttgaggagccgttggtctgctggctgaacactttgccgaccgcgttgaagaccggcttcggactgccgaccaatgacggcaccgccaacaaatttttgttgcgcaacgccctccgctctttgggcgtgccggaatgttttgtgcagcggcctaagcgtgcgatgcaatttggtcagttttttgtaatgtcagccattttttaaatttaatttaagttgaattttaaaatgcactttctatttcaggcacacggatggtcaaaatggagaacgcggagaatggcgacccaaagttaagagggcccaaatttgcgagaaactgatgctatga

SEQ ID NO: 58136 - DNA, 391 bp, Heterodera glycines
  Genomic contig location: Contig_ID=SeqID_5460; Location=439..829; Strand=-
  SCN-specific regions: Sequence locations=1-391
atgagtagatgtctacggatgcttggaagtggtgtttatgaaatgatcaagtaagtggtgtgagtgatcgtgtgataagggacgagtgagtgattaggaatgagtgtgtgatcaaagagagacacagagagatcggtgtgagtgagtgttatcagagagtaagtagatcagaaaatgatcagagtaagagttagaggtcagatagtgattgggaactaataaatgatcaaagagaaaaagtaagtgatcactagttagtgtgaaatgatcagagtgagaatgagtgatcagaatgatcagaagatgatcagattgcgaatgaatgatcaaaataacaagcggcccctatatcttaatgatttgtaggtgttgtgatggggcttgtgagtga

SEQ ID NO: 58137 - DNA, 932 bp, Heterodera glycines
  Genomic contig location: Contig_ID=SeqID_5462; Location=750..1681; Strand=-
  SCN-specific regions: Sequence locations=1-778,800-883
atgacgcttaccagaattttcagaagaattctgacatttaccagcatttacagaaccattctgacgcttaccagaatttttcagaactattctggtgtttaccagaattttcagaaccattctgacgtttaccagaattttcataactattctggtgtttaacagaatttacagaaccattctgacgcttaccagaatttttcagaactataatggtgtttaacagaattttcagaacaattcttacgtttaccagaatttacagaaccattctgacgcttaccagaatttttcagaactattctggtgtttaccagaattttcagaaccattctgacgtttaccagaattttcataactattctggtgtttaacagaattttcagaaccattctgacgcttaccagaatttttcagaactattctggtgtttaccagaattttcagaacaattctgatgtttaccagaatttacagaaccattctgacgtttaccagaattttcagaacaattctgatgtttaccagaatttacagaaccattctgacgtttaccagaattttcagaacaatgacgcttaccagaattttcagaaccattctgacgtttaccagaattttcataactattctggtgtttaacagaattatcagaattttaaaagcacatttgttttaataattaactcagttaaattttttccaagttgagacgcgtacaagattgatatgttgtgcaatggatttctggtaaaaaatcacagaatgttaaatcatttgtaaattagttttattttttgttggtaaagtaaatagttttatataatccttattttaatttgtcttattttttatctcaacacactttaatcgtttaattaggaattttttttacataaatttatttatttattataaaaatcaaaaataaa

SEQ ID NO: 58138 - DNA, 186 bp, Heterodera glycines
  Genomic contig location: Contig_ID=SeqID_5462; Location=1794..1979; Strand=-
  SCN-specific regions: Sequence locations=1-94,116-161,183-186
atgacgcttaccagaattttcagaacaattctgacatttaccagaatttacagaaccattctgacgcttaccagaatttttcagaactattctggtgtttacttgaattttcagaaccattctgacgtttaccagaatttttcagaactattctggtgtttaccagaaatttcagaaccattctga

SEQ ID NO: 58139 - DNA, 656 bp, Heterodera glycines
  Genomic contig location: Contig_ID=SeqID_27443; Location=176..831; Strand=+
  SCN-specific regions: Sequence locations=1-656
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttt

SEQ ID NO: 58140 - DNA, 207 bp, Heterodera glycines
  Genomic contig location: Contig_ID=SeqID_27443; Location=788..994; Strand=-
  SCN-specific regions: Sequence locations=1-207
aaacaaaaaaatcgatttttcaagtgtccgttggggtactcaacaattaatggggagcaaaaatccaacgcagaataaagtacaggctataggaagctattcggaaggattcggtctccccataaatctgggcgcatcggttcggggggactgccccgaaaacaaaaaaatcgattttttcaagtgtccgtttggggtactcaaaca

SEQ ID NO: 58141 - DNA, 651 bp, Heterodera glycines
  Genomic contig location: Contig_ID=SeqID_27444; Location=98..748; Strand=+
  SCN-specific regions: Sequence locations=1-8,75-597,637-651
atggcaaaagaaagtggaggaaggaattggatgcggaagcggaggagggggcgaagtgggaggaggaggagaagccgtgggatgtactcgacttaccaatcattggaaaattggaggtgggcaccagggactggacgttcccaggatttcggcttggggggggggtaccccactttttagcttgcttttcgcaccactttttttgcggcgcactttttaacaaaaatatgtggtgatcaagggggtccgcggtgccgataggtgctgctaggagggaaaatatttacccgtgcctagaaggcattttgctgccaacctctaaataaatgtgtcataaatttcagatttggattaatgaccaaacgtccagaaaactgctgcaaaagtgtctgatcagtgccgtcaacaatttgatcaaaacattggaaatcccttttaatgcgacgaaacaattcgccttccgcgtccgagtttatggcgatgaatattttgacaacaaatataccgcaagtctgaagatgtgcagcatcaaaacattcaaagcgcttaacccctagattaatgaagaaaacattttgaaatttcgttatcattttcatattaaatttgtaattttattttagtaataatattattggctttgaatcataa

SEQ ID NO: 58142 - DNA, 455 bp, Heterodera glycines
  Genomic contig location: Contig_ID=SeqID_27445; Location=339..793; Strand=+
  SCN-specific regions: Sequence locations=1-66,88-455
atgtcagacaatccctgcaaagtcgaaaaacaaatggcaaaagcaatgtaattttgagtctgtatttttatgtttaaattcatcatttttccgtttttcagcttcatctccggcgacggttggctggcggtgttccatttgctcccgccttctcaacttggccttggaatcgcactgatcagcccccgatttgaccactttgtggacgaacatttcaaaacgcgaaaatgggcattgggcaatatacgaattcgaagcaaaattggacagaatggcacaaaagaaatggaaattataaattccgatttgaaattgctgccaattgcgcaaaatccgccgccaaaaaaagtcattggattcaacagaatttcgataaggtaaaattgaggaaatgaaatgattgttgggtaatagtttttttgctagttaaaaaaaaaatctattttagaacataa

SEQ ID NO: 58143 - DNA, 327 bp, Heterodera glycines
  Genomic contig location: Contig_ID=SeqID_27446; Location=105..431; Strand=-
  SCN-specific regions: Sequence locations=1-58,143-283,305-327
atgcttgtggctgctgcaaaacattccaatgggctgaacaatgacgacaaagagaaagtaaataaatattaaaattttttaaattattttatttaaaattattttaaatcaaaaatattttgattttgattttatttttttagcctccgccccccattcattctaccgagtcgcatcagaatgtgctgctgatgccgacaaattcgagctgttctttgaatggtcgcctcctcgccgacatggacatggacggtggcacgttgctcagtgtggaggaggtgcccatttttgaatttgaaaatggcaaataaaatgccaaaaattaaa

SEQ ID NO: 58144 - DNA, 255 bp, Heterodera glycines
  Genomic contig location: Contig_ID=SeqID_27446; Location=584..838; Strand=+
  SCN-specific regions: Sequence locations=1-49,76-255
atgagtgagtcattcgcttctcttcactttacataaacacatcgaaacatttatttattgaatgaatgaaattgtgacgacaaaacagtgatcagaccggaaacaaaacgaatttgtaagaccatttttcgaatagcggaattttcagtccgtccaattccgggaagcaaacgaagtccaaatcatgatcatggactttgtgtcatgatttcgagattcgattgggcatctcgtttaatagggggatgctcgtga

SEQ ID NO: 58145 - DNA, 543 bp, Heterodera glycines
  Genomic contig location: Contig_ID=SeqID_27448; Location=131..673; Strand=-
  SCN-specific regions: Sequence locations=1-543
atgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaagagttgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaa

SEQ ID NO: 58146 - DNA, 653 bp, Heterodera glycines
  Genomic contig location: Contig_ID=SeqID_27451; Location=315..967; Strand=-
  SCN-specific regions: Sequence locations=1-145,174-410,432-621,643-653
atgaaaaagtccttaatttactgttacagtaacggtaaaaaccggtaattaccgtaactgatttttaccgaaatccccaaaactcgattagtaaatggcacttttgaacaggtccgaacaaacaaataaactcctcaaaactgtcaaaaatatgaaaatttaaaatttttaatgggataaatcataaaaataaattctcgaaactattaataattaaatttgcaggtaatcgatttgccactttggagctgaagattatccttgttcatgtgttccgacggttgcgcttctccactacaattccattcgagaagaatcgtccagctcttgaggctgtttctcggcttgaacttggctgccttttgcatgtccatgctgcgtcatagccaaaaaaatttaaaatggataatggaatttgtgaaaatggaatttcagacgacctatgatggggtgggggacagtttagtctggccggtttagtctgagccaagtttaatgaatagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaa

SEQ ID NO: 58147 - DNA, 1723 bp, Heterodera glycines
  Genomic contig location: Contig_ID=SeqID_5463; Location=2952..4674; Strand=-
  SCN-specific regions: Sequence locations=1-176,202-798,874-923,947 -1364,1386-1604,1626-1723
atgggtcactgtgccgcttcgttggaccacgccgatttggtgctcaccgagttggagaacatcgccaaatgggagcacaccaaaaaaggcatttctggcggcgtcggcggggccgccggcagcggaagctcttcctcgggcggtggcattttttcatacattcgagtgcttatttcatttattttaattataaataattttctgaatgctgatcattttttattttggcaatataatattgccttttccaattaggactattcctttggtcggactgtcgacgtcgaggtgctcaatttgcgcgcgactttggtgctcagctacggctacgtggtgttctactgccccaccgagggattggtcctccgccttcagcagacggtgctgcccttcctgcgccaatacacggcaaatgcaaaagtgagttgacaatttccaagggcctttctcttcttttgcctaatgttgccaccttttatgcaggaaaccatcgtcagagaggcgcacttggagacgttgaatctgatcgcactgtccgtccatccgagtcgaattcgcgactacaaattcgaacctcgctacgaatgccttacctatgttaaagtgggcacagtgggaaaggcaaaattattgtgtggaaagccattctaagacctatttgaacgaagagaagtcgccggatcagctgaacagttggattcgccttttgggtgcaaaagcggccgcttcgctaatgtaaaaaatctgctaaatttgttactattgattggttcattagaaagcgttttctgtaacaccaattaattagtgttaattgctaacacattaatttttaattgatcaattattgattaatttttaattgatcaattattgatgctaatttgtatttattaggttgacctttctcgcacaatctgaccctttcaagcctttcaaaacactttcagcctgttagagccaccgctcagtgacaatgaatttgttgaattggccaactctctcatcttgaacatcttttcgatctgtcgcgagcgaagtgggcttaaaacggtcggtgttttgtccttcgtcggacgaatgcgaatgtatggcactgaattttatttattttttgtttttgttttgatgtttcctttcctttgttctgttttcctttaacattgcgttggacacacctaacccttttttaacgttttattcgtcattattttgccttttgccatgggattattcccctcttcgcttcgtccgctttctcttcctttcttttacgctgtctgtctgtcctcttcagttggatgcgttgtgcgttttcggttttccgcatttcacgccgcttcgtcagggcgaatggacctttcagcctgcctttgttggccacctttactcctttgctgggcaacgccttccctcggtgggccactcaaaaaacggtcaaccgacagacggagaatgccagggatggcccaaggcaattgccatggccaatgcttttaaaaatggaccaacatcggcgaagtcggggggatcaggaggagagcatcagcagcaacgacaaagagcggcaaaccgtcgacaaatgggcaaaaggggcgccgacaacggcgatggcaatggaaaagccgacggcaaggcatgccaactgaacattttttgttgtattaagaaaggcctcccggggttttgccccgtttcggcgatttggttgaaatgtgattga

SEQ ID NO: 58148 - DNA, 314 bp, Heterodera glycines
  Genomic contig location: Contig_ID=SeqID_5463; Location=3467..3780; Strand=+
  SCN-specific regions: Sequence locations=1-262,286-314
atgacgaataaaacgttaaaaaagggttaggtgtgtccaacgcaatgttaaaggaaaacagaacaaaggaaaggaaacatcaaaacaaaaacaaaaaataaataaaattcagtgccatacattcgcattcgtccgacgaaggacaaaacaccgaccgttttaagcccacttcgctcgcgacagatcgaaaagatgttcaagatgagagagttggccaattcaacaaattcattgtcactgagcggtggctctaacaggctgaaagtgttttgaaaggcttgaaagggtcagattgtgcgagaaaggtcaaccta

SEQ ID NO: 58149 - DNA, 383 bp, Heterodera glycines; identical to SEQ ID NO: 51114
  Genomic contig location: Contig_ID=SeqID_27454; Location=605..987; Strand=+
  SCN-specific regions: Sequence locations=1-20,42-275,297-383

SEQ ID NO: 58150 - DNA, 388 bp, Heterodera glycines; identical to SEQ ID NO: 51536
  Genomic contig location: Contig_ID=SeqID_27457; Location=522..909; Strand=-
  SCN-specific regions: Sequence locations=1-20,42-275,297-388

SEQ ID NO: 58151 - DNA, 1313 bp, Heterodera glycines
  Genomic contig location: Contig_ID=SeqID_27458; Location=1..1313; Strand=-
  SCN-specific regions: Sequence locations=1-49,75-80,102-324,348 -523,545-652,677-742,778-1012,1050-1313
  Gene Ontology: Cellular component=integral to membrane; Biological process=erythrocyte differentiation
ttgactattgaaattcgcttatgggaattgagatttcatttgttatccgtcaactttcttctttccttcataaaatcctctgttgttttaatccaaaaagctccattaaaaatgacattaattacataaatttttctcccattttttttccaggaaaggcaaatactccgacaatttgtccgtcgatgagttatggcgtgccaaacatctgtacgactcggcattccatccgcaaacgggcgaaaaactgttgctgatcggacggatgagtgcacaagtgccagctaatacgatcatgtccgtcccatttttgcaaccatttttccaaaatttgttgaaaattttttagtaccggcggcatgctcagcttctacaagtcggttcaacgcccgtttttttttgtcatgatgcattttataattgttaatttttcacaggtctactcctgcggttgtagggtggcaattcattaaccaggtggaaaaaaaacttaacaaatttcgacttttgctgttgtggcgccccaggaaaaaaccaaagggtgtactttgaaattttttcaattcgactgtttgttcgagttcgggctaatgatttgttggaatatatgtcagattgtgatcagccagcaacctcggaaaccgcattcaaacaaattttccgaattattttaacaaaaaagcaaaagagtcctttctgattttttttcttggggccccaacagcaaaagtgcccggaatttctcattttcccccaaattttttggcacattttcaagacgtacaatgccactgtcaattactctaaccgttcgggcgatgcgttgagcggcgcacaacttttgcaggcgtatctgatggcaacgggtgggaaaattaaaaaaaatttttcgaaaaaaatttccagtttttgattgtcctgtctgttctatgattctcaaattgtaggtggagcgatgggcgttgcgttgggactgaatcatgcagcgacggtcggtgtttagcgatgcctacaaattttttgaaaaattttttcctctacagaaaatgccaccaatttggggtcgccttgtgccattcgcggccgttgcatttgcaaattgtgtcaacattccgatgatgcgacgaaagtgcggcacaaaaaaaatgcatgcatttttgaatttcatcttttttgcagggagtttgttgacggtgtccaagtggttgattcaaatggtgtgccgttgggccaaagtcgcaaattggcatggtgggcaattccgcaagtggtcgtcagtcggattggcatggccacgccggggatgggtgaga

SEQ ID NO: 58152 - DNA, 359 bp, Heterodera glycines
  Genomic contig location: Contig_ID=SeqID_27460; Location=490..848; Strand=-
  SCN-specific regions: Sequence locations=1-359
atggtacatcaaatatctgatccaaataccgtaaaattcgatgattttataatattagagcagattggtatgggagagaattttaaccattttcatggagtacctccttatcaacgaggttatggtcgccagcgaggtggcggtgtaggtgatgttttacgatatttatggagagccattctccctaaaataaaatctattggaacattgttgggtaaagaagcactggcaacaggttcccgtgttttagacaccagcaagaatggggaatctccaaagagcgctctaattagtcaagtcaagaaaggaattcataatttaacggaaaatggtgggattgaaggcaatatggaactcgt

SEQ ID NO: 58153 - DNA, 203 bp, Heterodera glycines
  Genomic contig location: Contig_ID=SeqID_5464; Location=498..700; Strand=+
  SCN-specific regions: Sequence locations=1-159,181-203
gaaaaaggcgaaataaaaatttctaaaatgaaaagagtggaagagcaattgcttgagtatcgacgaacgcgaaaagcggctcttgagcagcaaagggtggacggcgatggaaaatcggacatgccaatgtcactgaatggccaagaaggtttttgggatatttaaatttaaaaaattcaaccaaaagattaccttttgatgaa

SEQ ID NO: 58154 - DNA, 2901 bp, Heterodera glycines
  Genomic contig location: Contig_ID=SeqID_5465; Location=1164..4064; Strand=-
  SCN-specific regions: Sequence locations=1-220,278-441,465-492,523 -549,575-618,640-981,1014-1048,1072-1244,1267-1279,1301-1398,1421 -1480,1504-2131,2215-2227,2251-2462,2501-2532,2564-2901
  Gene Ontology: Mol. function=glutamate/aspartate porter activity; Cellular component=integral to plasma membrane; Biological process =synaptic transmission
atgccaaatcttggccattaccgaattgtcggtggtagccgggtcctagaaaacagcaatggaagccccggttttttgcgccaaaatttgttgctgattctcactgtcagtgccgtgggcatcggtgtactgctcggcgttggacttcgccaagtggagcccaactaccgaatgatcaaactgatcggatttcctggcgaagtacgcaatttgttttgggttttaatgtaattaaatttaatgaaaatttaaaataaatttaatgttttaaatttttcagcttctgatgcgcatgctcaaatgtgtggttgtcccattgattgttgcttcgctggtcaccggattggcccagctgaacattcgcgactcgggtcgaattgggggcattgccgtcctttattatctcgtcacaacgacaattgctgtcatggtaaagcaaacataaaattttaaattgattgaaatatttcccctatttaaatttcattgtgcttttaattagaaaataattttaaaaatattcgatacatggcaagggcgtagaaaccataaataaaaattttaatgaaaaattgaaagatttgtttatcttaagaaatttcattaaaattcacagaatttgacccaaaaaattgccaatttttgatgaaaatcttttgaaaaaaacggctaaaaattccaaaagttttcccggtgcacctttcatatgttttttacctttcaaaaaaaattgatgcccttgaacattttgttttgaaaaaaaaaataaattattcgttcctcataatatttaattccagactggcatttttctcgtcttgaccattcgtccgggtgatttgggtcacgacacgaatggtaatgggtatttgggaaatggcagcaacacaaagccaacggacaccatggacaccatgctcgacctgatcaggtcgataagtgatcaaaaataattaaaaaatctattggcgtaaattatccaatttttctaaaatatttattatttatttaaacgcgctaattatctattaattagtaaccaaccatcctttatttaaagaaacatgcttccggacaatttgcttggcaccgcgttgcgccaacagcaaaccgcctattactgtgtgattgatggtaggaagacgacgagtcgcgccctctgcgagaagcatacggtacatttgccggaggcacaaagggaccgtttcataaggacggagctacagaacattgacgggtacagtacacaaacaaattaattattaattatttgttaagaagcagcaacattctcggcattattgtctgctccatcattgttggcattgtgttgagtcaaatgggcgacaaggcgaggacaatggtaaaaaaaattctaattgtctctttgcgaatttattttaattttttgtgctaattggcacaattaaaaatcaattacaatcaaagctaaaatagttgacattatatttaactttccataattataattaatttttaattcccagatcgatttcttctccgttctggaccaggtcagcatgcgtatcattggctggctgatgtggtactcgccgattggcattgcttcactgatcgccgcaaaagttctcgaggttgagcgactgggcgacacgctttctcgccttggcttggtgggttaataattacaaaatttttaataccgtcatcttatgtacagttctgtgctaccgtaatggccggatttgctatccatttcttgatcactttgccgctgatttactttttaatgacgcgtaaaaatcctctgcgattttgccaaggcatgcttcaagtaattttccgaattaatgtaaacagtattcttttccgctataaatattcataattcttgcccctcaggcaatggccgtagcatttggcactgcgtcaagtgccgccactttgccgacaacaatccgttgcctggagcaacacttgagcattgaccggcgcgtgtgccgttttgtgttgccggtgggtgccacaattaatatggacggctcggcaatgtatgaagcggtcgcaacggttttcattgcgcaaatggtgggccgaacactgaacattggccaagtgatggtgatcaggtgatcggaaaatgaaaacgaaaaataaatttaaaacgaatttaaaaaattaattgtatatttttataaaaataattataaattattttataaaataattttacaaatagtagaggttaaatgaaaaaacaaattaaaatgaattgtttcagcttaacatcaactttggcatccatcggagccgcgagcattccctccggcgctttggtggcaatggtaaaactctttttttgaattaactaacaataagttaatttgttcactaggttatgattctgacagctgtcgatctcccaattgaattcatcacattgattttggccgttgattggttcctgtaagttaattgcctaattaaattaaatttaaatcataaattttatttatttctaaattcttaggggttgtttccgtacagatcatttttaaatctatattttataaatttattagggatcgtttccgtacatctatcaatgtgcttggggatgcgtatggtgccgccattgttcaccaccattgccgtgagcatttgtcaccggctgctgatcagaagctaatgaacggctttgttgttgccaacaacgagttgaaactgatgctaaaaaacgacggcattggtctgatcacttttcccggcaacggagtcgcaattggtaccaacaatcatttgctgctggtggagaaagaaaatgccgacaaaaatgacgagggaagcagccgaagcagtgccgcgagtgagggaagtgccgacggacgacggcccctggtcaatgccgactattcttaa

SEQ ID NO: 58155 - DNA, 558 bp, Heterodera glycines
  Genomic contig location: Contig_ID=SeqID_5465; Location=4..561; Strand=+
  SCN-specific regions: Sequence locations=1-17,39-308,339-558
ctttgtgctgtctgcgctgcttttgctgctgctcccttgggcgtccgacgtgagggtgaactgtccgcctattccgtgttcaaccccaactgtgaacggttgccgggccaattgactggcgaacactttgagcgggacatgctttttgccaggaggcagtaatcgatcgaacaccgacgggttctaaccccctcccccccccccctaagttaagccattttttgggtgggcctgtgatttttgtactgttgtatcaaatattatatatttagaaatgacaaagaagtgaagcaaagaataccaaaagcaaaatttaatttctttttaaatttatatttcgtttgtttttttagtcgattcataggagatgttctcgttttattgtaaaggtattttttgtacagaattttctgaaaatttccaaaaataaaaaccttaaataagtacaaaaaatagacatctaacatcgaagaagctccaacccaagtggaaagtgcttttttcctgtttatctcgattattaaaaatgctcaaaatttgcagttctttaaaaaagcg

SEQ ID NO: 58156 - DNA, 148 bp, Heterodera glycines
  Genomic contig location: Contig_ID=SeqID_27462; Location=531..678; Strand=-
  SCN-specific regions: Sequence locations=1-148
caattatgagtaatagggcccggatgggataggacgtgtggattttcccggaccaaaaattggattttaaatcacatcccggcctgattcccaatcccatccccgatttttaacaattacaggactctaatttcacacgcaatcattt

SEQ ID NO: 58157 - DNA, 1279 bp, Heterodera glycines
  Genomic contig location: Contig_ID=SeqID_27463; Location=183..1461; Strand=+
  SCN-specific regions: Sequence locations=1-96,118-437,459-1061,1083 -1190,1212-1279
atgaatacaattaacaaccgacagattgcgccaattccccaaactttgtcagaggcgcgtcagaaattgcgccagcgcccgcgcgtcaaattcaacgaggaggaggaggtgatcaacccgggtaagtggctgatcagtgattggattgacatttgatggctccgttgagtttagaagaagtcgacccgaacatcggccggttcaggtaacaaaagcattggacaaatggccaaacgatttacaattagtgaagggattaaataagttttgagttttattttcggaattacttattttgtcataaatacaccactgaatatgcaaaataaacctaaaaggcatggacaatcagtttttttggcccaaaatccgccgcttcaaataatgccttttgcgtctattcgaagttgaacttttccatccctctcttttgcaacttcattcatttgttcatgttttgaccatttgcctccttcccccagaaatatggttcggactgcggtcattccctcgtccaattcgaaccgccgtcagagggacgtggaggaccaattgttcgacttttacacgcccagcgagccgaaaaagaaaaaggtggaatttctgccctcttttttctgccgtgggtttgttgtgagatgaatcccctcttttcagctcctccaccatccgttgaccgccgcttcgcccgtcggtgcgcgttcctccctctccggcactcgcattggttcacttgcgctcggttcgctgactctcaacgcggcgcccgacttggaattgttggcgaaggagcctttttcgttttttaaacaatgcttcgtcagatattctcccgctttgccaccctccgcttctttgaacgccgttgcgccatcgaaatacggtccctcgcccgcagcgaactcttcggcacggcaattgctcggaggaggggcaaggggcggagattctggtatattcctgatacaatccaatggaaataagagcagctcgtcccctctcatcccccgatttttttttaatttactaaaaaatttcacaaaaaattaacatttttctagcgattttttaaaatgatgaattactgtttggggtggtgacgtaatgcacccactggactgattttgctatttgcaacttttcgcagttggcactgttccgtcggcagttgcgcctgacgaatgtccgctgaagaagaaatacgcgaaggaagcgtggccagcggaaatgagaaggcgttcgggcagcattctctgagcaaataagcaaatgaactcga

SEQ ID NO: 58158 - DNA, 558 bp, Heterodera glycines
  Genomic contig location: Contig_ID=SeqID_27464; Location=165..722; Strand=+
  SCN-specific regions: Sequence locations=1-558
atgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttggcttttgaa

SEQ ID NO: 58159 - DNA, 387 bp, Heterodera glycines
  Genomic contig location: Contig_ID=SeqID_27464; Location=96..482; Strand=-
  SCN-specific regions: Sequence locations=1-366
gcttaaaagcattgtactgcataattaaaagctaaaataattttcgtatatttttcacaatttatttcaaaaagccaaaaaaaatgattcaattttgaaacgaaatagtgcacaaaagggagggatggttagacgaaaagaggaatttttagaaaagagcgcccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaa

SEQ ID NO: 58160 - DNA, 887 bp, Heterodera glycines
  Genomic contig location: Contig_ID=SeqID_27466; Location=16..902; Strand=-
  SCN-specific regions: Sequence locations=1-66,107-223,288-393,435 -541,565-612,665-887
atggaacaccaacaatctcttctgccaaaatattttgcattttttggcatcaaagtgtgtttaaacaaattttaataatttttaaacaaattttaataatttttaactgcatcaaaattcataaaatttcatgccaatttataaatgttcttttgcatgaaaatattaaaagttggccccgattgttaacaattagttgcttatctctatatatttttagggcaaaatatttaaaattatatttatagacaaattttttataaattcttttaaatatatatatttatcgatcatttttggagtaaaattcatggactaaaattactccttttatacagtgcatcaaatttttgggccgcaacgcaaatgaaagcggatttatcactaattagctaaatttaatttttaaaataaggttttttaaaatttaatttcattaggacaacagttacggtgtgccgggtgaagaacgcttttttcttctgaccaaaaatttgttcccagaaaagtacaaagatgaaaagaatagtggtaaaaatgagcagcagcaacaatttgcattggatttcacttacaaatttgatgttaaaggatcgctggaccaccaaaaggtaaattaattagtttgtaaaatataattattatttttaaattaaatttttaagttgtcggccaaaaaacgaaatgccagcaaacatccgatgttccgttatttggacctttatgatgagaatgaacagcaaatgagtgccgatgaacgaaaaaagattgaagtgacgaaggagggatgctttttccgcaatggcattatgctggaggatgaaacgtacgaaaaattcatcggcattttggggagagatacagtggtaagaggagaatgtcattaa

SEQ ID NO: 58161 - DNA, 778 bp, Heterodera glycines
  Genomic contig location: Contig_ID=SeqID_27466; Location=959..1736; Strand=-
  SCN-specific regions: Sequence locations=1-8,30-259,281-417,439 -444,468-472,508-778
atgacattttatgattattataatgcatttccaatgccttcttcattcatccgtgttttgttgtttctcatcggcatttttctagtcacaattttggcaactccgtcaccccaaattgatgttggtgtgtcggttacgaaccgaactgaagccatccgccaaggattgatccacgctttatccaccatcactagcaccatcgattttggcaaagtttttcatgataatgtgccgtcaatcaagcaggacagaaacagtcgtagaagcattgaatacaaaatgccgatgccgacattgctggaattgggtcaaaaattcacattgggcgctgacggaaaacgccaatttgaattcactgcctacggcatgcaagcattcagcaaattggcagatttatggaacttaccaatgcaacaattaattgtacacaaaattaataatggctttaaaaaataataaaaaataatgataactttgaatttttcaattcctagggattaggatttggactctaaaaaaggacaagtttaaaaccacggacatttatgaatatttggcataatctcttttacaatgccaatcttaatttcagacatcgttgcgaatgggcaaacttcatcagatttcaaatcccaacggtcgcttgtctaacatggacattttcatcaaaacggttgatcaacaattcttcatcaaagacgtcaagacgggcatggagacgttgaagaataagcagagaaaagcactcaaaaaaacaaggccaaagggcggagattga

SEQ ID NO: 58162 - DNA, 1166 bp, Heterodera glycines
  Genomic contig location: Contig_ID=SeqID_27467; Location=726..1891; Strand=-
  SCN-specific regions: Sequence locations=1-508,530-772,817-1006,1033 -1114,1158-1166
aacaaaaaaatcgattttttcaagtgtccgtttggggtactcaaacaattatggggagcaaaaatccaacgcagaattaaagtacaggctatagggaaactattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaactttttaacacccccattcatctcccttttttgatagaaaaagcatcagagtgcctaaactaacatgtaaataaaatttggtgcgtttcaaaaaccctttctgaaaaaatatttaagaatttaattttgcaaaaaataaattaaaaacgaaagactcagattttcgaaaaattttttagagcaagctagctccggcgctcatttcagggtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaaatatttatgaattaattttgcaaaaaataaataaaaacgaaagact

SEQ ID NO: 58163 - DNA, 1029 bp, Heterodera glycines; identical to SEQ ID NO: 27469
  Genomic contig location: Contig_ID=SeqID_27469; Location=1..1029; Strand=+
  SCN-specific regions: Sequence locations=1-578,600-1002,1024-1029
  Gene Ontology: Cellular component=cytosol; Biological process =invasive growth

SEQ ID NO: 58164 - DNA, 531 bp, Heterodera glycines
  Genomic contig location: Contig_ID=SeqID_27471; Location=753..1283; Strand=+
  SCN-specific regions: Sequence locations=1-23,75-80,102-505,529-531
atgttccaagttgtgttcgagatgaagaagaagcagttggaggaggagaagaagaagcaggaggagcaagagaacacactggtgagaacactcactgaccaactaaaggaattgggtggagaatttgaattttactctttttttggcgattcgtttgggtccatgccattcgaaaaatttttttttttgaataaatgcaacaggcaggacccgaattcttgttaaaacagaacctgttcgggtccatctctcggaaatccgggaagttcccctggtcccctagggttttcccaaatttctggggtttttttggttacaaatttcctcccgtttttttttaaattttgaaaattgtcaatttgtgcctaattatttattcaaatttggcagaatgccgagcgggaggcgaagaacaacggtggtggtgccaatggacagcacagtaatgggaaggctggtggtgacatttatttgtcggcatcgaaaaccgaaaatggcaccggcggcggcggtggaagttgcggtggctga

SEQ ID NO: 58165 - DNA, 3067 bp, Heterodera glycines
  misc_feature (580)..(580): n is a, c, g, or t
  Genomic contig location: Contig_ID=SeqID_5467; Location=261..3327; Strand=-
  SCN-specific regions: Sequence locations=1-513,584-684,717-887,910 -980,1002-1237,1259-1283,1305-1855,1877-1957,1983-2078,2101-2734,2756- 3067
tccacaatgccgcccaccaccaccacatctatctcatcatcggtccctgcaattgtttttgcttttaagcagagtaggacaggaccgggaatttttggcaaaaccgggaccgggacctgagaagcagggaccgggacctcggtttttattcgggaccgggaaccgggacctcgaaggacagggaattcccggtcccatcctaccctacttttaagttctcggcctattctcgtgccttcgtttctgccttctgctggtgtctctttgttgtggctcatttaaattgctgttctattggacggacaagtttatatgaatttttcaaatgttcattcgccttaactgcttaactcataaaaatcacattatgaaaattgaattttgatcaaccaatcttttgtttttttagacaattcaacccaaaaatatttgcccgcaaaagtaaatgtcgtcgccttatacacttttctcggtgctatgtcgaagcacgaaaagtgcaagtgatcactgatcaaataattattcaaaaaaattaaaagtaaaataattattttaaataaatttaatatagtttatatanttagtttcagaaaatagaacaacactagatttttcaaatataaaccaaatgattaatactagagcctggacgggcccgggggcccggcaggcttttaccgggcgataaaaatagataaaaaaatatttaaattaatcgcatcactacgatttttgaaaaaaaagaaaaaaaaattaattttctaaacaactgtcctataatctgggatatacatataaaaccaataaattatgacttaaaaatataagtaattcaaaaattatataaaacgcttcaaaatttacaaaaaaattgtttaagatctaaattgaaaaaatccagtttattttttaagtcccccaaattataatgatccaggtcttcaaaatatgataattaatttgctttttaattcctacgaaattcatgtgaatttgaaaaatccatttttcagctgccccacccacagcggagtgatccaaagtccgccggtgtacagcgacgggctgaacatggcatttgcgccggtgttcgccttccatttcccagaccgtacacagatgaattttcggtgccaaatccagacgtgcaacaaattggacaatgagtgccaaggactaactgtgagtggcaccggaaatattttggcacaaaaatggggttttggatgtgtgtgatttgggttttccaggccagagacttggacacaaggccaaatttagaatggggaggaaaaatactatttttcgcatgacggcactgcaattttgacaaattagagtttagaaatggtactgtagatgccatggatgcgatactactccaaataatgacttttaaaattttttttccattacagcctccaaactgtcagcaaaacattgttggcctaggcgcatcaagcggcgaaggctacagtgctccacctactggccccgtggtaccgtataccataagtgagtggcgctgctttggcatcactttatcgcaagaatttgtggcatttcctagatcctccgccaactccgaactttgttatgccaacgctggcttcatcggttggcgtcggagcttatttgcaacaaccgatgttacagcatccgccgtttatcggcgccggggtgagtgaactacggtaggtagaggcctactgttgcacagtttgatttgcgcagcctttcggtcacaaccactgggccgagaccagagctttcgcaaatctgaacctccttagaattttttttgctcccttttgaacgaatttactggcgctggaattctcagggttacagtatcaaaacccaaaaatttttaatgataaagtgaggtgtttttgattccggctgtaggaaggcacagccggggaacatttttgaaaatttcgacgaaatcttctatcattattattttttatattgttccatagattgcgccctcatcgccgccaaatgcgctcccattggacagcgttttgcagggcaatccctcccaagtgctccagggactccaacggccgtggccaagaagcagcagcagcaaaaaaggcgcaaaacaccgggcagaaacaaggcgggacactgacaatgagcaacaaaatggtggagaacaacaagccggaacaggaacaaaagcagtagcaccaacagcacaaggacgccgggaacagatggagttggaacatcgcattctgatggccacgcaacagttgaagtgggcggaagcaattaagcatgctaattaaacacactctctctaattgacttgaacaataatgggctgatcacagaatcaaaattcttgatcagtaatgaactgattagatttaagtctagtgtttatgcgataagcaaaatggtaaaaaaaagcggcactttaaattaagcatactaatcattcaggcacaacgaggacggcagttggcccccatcgttggtgattttcggcacgggcaacaaaagtgccggtagcgcggctgctcgacgcttcttccgtccaattccagcagaagtatgtgataactgataacatacgaactccatcccagtaaggggttgtgcgagatttcgtgtcgttttcgtttcgccttttcggcacttttatgtttcattttcgtgttttggttttggatttaaaaattaaatttcattttctatattccaaaaaaaatttcctttcttttaaattttaaaatttaatgtttttagttttggttttgtttacgagaaagattatttattattttcgtttcattttcgattttcgattttgcacatctctgttcccagtcgtgggcagcagcttttcgagaatcgagactgagactcaaaaaaaaaactaagaaatttttcgagtagaaaattgaggctgggactcttatcgcacatgtttatcggtcagcttcttttctctatactctcggccattttcaggaacgcgaattacggcaacgccaacgccgtgcggaggagcacactcaggtaccatttggggacatgaacccattttggg

SEQ ID NO: 58166 - DNA, 873 bp, Heterodera glycines
  Genomic contig location: Contig_ID=SeqID_27475; Location=1..873; Strand=+
  SCN-specific regions: Sequence locations=1-42,65-727,750-873
  Gene Ontology: Mol. function=cation-transporting ATPase activity; Cellular component=integral to membrane; Biological process =aminophospholipid transport
tttcccgcagcgattggccaatttttgctgcgcggtgccaaactgaagaattgccgctgggtgttcggtgtcgtcgtctacacagggcacgactcgcgacttctgatgaactccaccagcgccccgctgaaaacgtcgcgcattgacgtgatgaccaaccagcgcattgtcatcctctttctcatgctggtgctgatcaccatcgtcaggtgaccgggcaatttggaatgagagtgccggatggaaccatccgattatgccaacaaatgcctacggaaaaattagaccaaacttagctaaaaagaagaatttttggtgaatttaacgacctttaggaaatgaaacgaaattgaatttttgtgtaaaatacactttaaattggctttggaactagttccgctttaaaaagctatcaaaaccttatatattattatgttacaacaatatggggtttttaaaaagggtctttatatatgtgctttgtgtgtgtttgtgcctccaatcagccttttgcagtgtcatcggtgccgaagtgtacaacaaatggtttttggacggccattggtacatcggcgccattggccattggtccttctggtggaacatgctcaccttcttcatcctctacaacaatctcatcccaatttcgttgcaagtgacgctggaaattgttcgcttcttccaggcctcgtacattaaccaggcattgactatttttgagtacattcaaaattttaaaacaaaaattgttcactaattaagtccaacctttttaggacatttttatgtatgacgaggcaagcgacgtatcggctacggcacgaacatcaaacctaaacgaggaattgggccaagtgcaattcctaatgactg

SEQ ID NO: 58167 - DNA, 724 bp, Heterodera glycines
  Genomic contig location: Contig_ID=SeqID_27481; Location=134..857; Strand=-
  SCN-specific regions: Sequence locations=1-14,50-86,165-407,430 -511,535-680,710-724
atgcttttgtgttcaaaaatttcgcactttcttctgcttttgcttggtgccctgctgttgttgtccttcatttcaatgggcaacggtaattaatttaaaaataatataattctaattttaattatatgaagaaataaaaatacaaatattatttaactttttttggcatgataatgggtttacttatttctaccccccccccccccccctcttaattagttggaaaattagtacgagtcagggtactaccagcagtactgagttggcctagtacgagttggggctttcataaaccattcatactccaatttatagttgctaaaaagtgccaaaataattaatttttagtttctaaaaacccccaaaatggttttgctaaaaatggccaaatagtttctaaaattcaaattaaggggggtgggtgtaaaatcgaaaattttcttcaaaaaacaaaaatattatgccaacccattaattagatacataattttcaaaatcaaaaattatcgtcaataaaataaattaattatttttggagatgattttttgagaaatttttcatttcttaggggtgtattttttgaaaaaaatttttaagtcgattcttaggggtgtatttttactttttattgcatttttttaacaaattttgggcaaaacgctaaaatagttgaaaatagtttttttaaaaaaattttatagttttttagttgctaaaaataaa

SEQ ID NO: 58168 - DNA, 1031 bp, Heterodera glycines
  Genomic contig location: Contig_ID=SeqID_5468; Location=656..1686; Strand=+
  SCN-specific regions: Sequence locations=1-87,109-379,409-485,507 -517,539-905,929-953,1012-1031
atgttggggtaattaaaatggactgtttactaagaaaccgaaaatccatttctgcgaattcatttgtttatttttttgtaataagaaatgtttttcattattttatcaacatactataattacctttttcattcatttaaattactaattctcatttaacggagctttcatttccttttacccgagaattaattaaagtgcttcagctttgtgggaccccaaaatgtaaaaaaatgagaaacacgcaatggaatatgcagtgccattaaaacaaaaaactgattaattcgcagaatcattagtgaaaaaatggaagttaattgaatggagtaaaattcaaaaactaaataacattctcctaaaagaggaattgataatgttaaataattctatttattatttaaattaccgagtcaatggtttcataaataaaacaacaattaagccgaaatttttaattattgtagtcgaaagctggcaaaaacgaaaaattttattataaacagtgaaagataccaaaatattgtatgggtacagtaacagtcaggtacagacagtacaatgtatacggttagcaaaggaatttcctgatgcacagttcctggtccacattgacgaagaacattcggaggaacaaatgcaatggcgcggcgcccgtgaacatgtcggtgtggaacagcgcaaaatgaccttggcgaaggatacggtcaaatgtacggtagaacatttggtgggtgtaattggccatcaaaaaataggggtcatgcacctgcaaaaaagcaaaactacaataattaaatggaagaaacaatttggcattagcaagaaaagaataacggaggaagaaaaaaaggagaaaatgaaaatttattcgcaaataaaaagagaaaatgcaaaaatgtgtgataatgaaattgctaaaattgtgaacacaatcatttgatgcaatatttggagaaaaatggaaagaaaaagaagaaaaacaacgaaatgagaagaaaaaaagagaaataattggaaaatattataaa

SEQ ID NO: 58169 - DNA, 870 bp, Heterodera glycines
  Genomic contig location: Contig_ID=SeqID_5469; Location=282..1151; Strand=+
  SCN-specific regions: Sequence locations=1-19,55-105,217-314,337 -654,717-820,843-870
atgaaattatttccgctacttttattaattatattatttttaattgtaaaaattggatcggaaaagaaaaaattgcaacaacaaaagtcatttggcgaaatatttggagaaaaatgggaagaaaaagaagaagaaaaacgaaatgaactcaaaaaaagagaaataattggaaaattcaacaaaataaaagagaaaataaagcaaaaaggaagaaaatactcaacaaaagaatggcataaaattgatggaaaaatagcgaaaaaattggggacaaatcgaaataaaatttataaatggattaaagaattatgcctatataaatacaaaacaaaaactgatgatgataaattagaaattatacaaaaatacattacaatgacaaatgaatacaaacaaataagaaaatattcgccaaatgaatggaacaaaaattatgccgaaatttgtaagaaaattggagttggctatggaacaatttgcagatggaagaaacaatttggcattagaaagacggagaaagaaaaaatggaaaaaatgaaaatttatccaaaaatgagtgatgaaacaattgcaaaaacaatgaaaataaatcgaaataattttttaaaatggaaaaaacaatttgaagaataaatgattcgaagaacaattcgcttttttaaaattattatttaaaattgtaattcttttgtttacctttattttaaatattttatgcaaatttaaatgatctgggcaattttttgttaattttgagatttttaaacaaattattacatacaaaaatttttttccaatttatggaaacaaaggtttacacagaaaacattttttacaataatatatttgcttgactgatcacagatgcca

SEQ ID NO: 58170 - DNA, 897 bp, Heterodera glycines
  Genomic contig location: Contig_ID=SeqID_5469; Location=1240..2136; Strand=-
  SCN-specific regions: Sequence locations=1-526,575-846,868-897
atgttcccagaatgccgcctggtcactgctgatccggcagctgaaatcaacgccaatttgacgcgccaaattggcggcacttttgtgcaggcggcggttggcggtgaaacggccacgggacagccagtgaatttttggggaaaaggtaattattaggcactaatggcggtcgagagtctttcagtatcgagccatttgaagattctcggtaactcgaataaagtctcgagctccgcaaaatagtaatcttttttcgtctaaatcctgcggttttctgtatttatttggcgttatcacttttcctaggtttttattttttagaacataaaaaacctaaaaaaaaatttgaaaaaagctattttcaactatttggagctttgcccaaaaatttattaacaaaaatgcaataaagtgacaaatactcccaaacaatcgaccccaaaaattccggaaaataaggacctaagaatcgacccaaaaatttctaaagacatgcataataaaggaaaaaatttttttcgtctccaaaatttattttttatttttttgaatttggtttttaaaaattatatatctcaatactaagttggcttaattttgttgctttttaggttaaatttttacaattttacacccctaaatttggaactttttggcacctcttttcccatttttagcacctattttggctgtttataacctaaaaaataaccattttgacaatttttagcaactttaaattacatttctactaattatcggcagataatccgccttgaaattggcaacgaaaaagatttgacaatgaagtcggggcgtcgtttgtgtacagaatttagtcaaccaaattcaattaatttgagtattcaaaatcccaagaatttttttttaaattag

SEQ ID NO: 58171 - DNA, 405 bp, Heterodera glycines
  Genomic contig location: Contig_ID=SeqID_5470; Location=473..877; Strand=+
  SCN-specific regions: Sequence locations=1-405
atgaaaacgcttcgccgtcaacaggcggcagcagttggtcagtcgcccattgttgtgcattcggtggggaccggtttgccaaggaaccaaccgattcatcaggtaaaaagttttttgcacattaccgaaaaacgccaaaatttcagcgccagcaagtctgcaccgtgccctcccatgaggtcatctacgacgtcccatgcaccggagaggaccagcaagaaggatcggaggacagcttttgagaaacactgaggatccgacaatctgagctttaaattcacacacacacacatatatcattttgcattttcatataatcatttttaattgcattttcatataaccatttttaaattgcattttcatttatcattttcaaattgaaatttccatatacgcattgaa

SEQ ID NO: 58172 - DNA, 422 bp, Heterodera glycines
  Genomic contig location: Contig_ID=SeqID_5470; Location=1453..1874; Strand=+
  SCN-specific regions: Sequence locations=1-399
atggtaaaaaagacaattcctcactttacaattaacaatctgtcaccttcagtaccggacgaagtcgactgcgaaatgcccgatgaacgtgttctacacctcgaatgttttgaaagcggcgattatggtgtaagtaactgtgatgaatcctatgtttaaatattttattctcaattttaatccattttagatgatggaattgtacgggccggaccgtgctaaagagatgctgatcgacctgcgcgactatgccgaggcgaatggaatgccatgtcaacatgtgaagatgctgctctacaaactggacaaggggctgatcaaatggaaggggacaaagccctgagaatgaatgaatgatgtgtgatgatcattgtgttggggagcgggaaaaattggtgatggtgtttattttaaaaattgaa

SEQ ID NO: 58173 - DNA, 705 bp, Heterodera glycines
  Genomic contig location: Contig_ID=SeqID_5470; Location=2100..2804; Strand=+
  SCN-specific regions: Sequence locations=1-705
atggcaatcaacatctccgacaaaaaatcgttgtgcaaccaaatcctcggccaaaccgatatcacagtgacctcgagtggcataaccatcagcggtccccgcctctcgacacctcgcttcatcccatttgatgaagccggccgttgtagatgctgtaagggcactgagtccgaaattgacactgtgatcacgaaagaaggcatcacgctttggtgcacccgcatagagaaggcccaattcatcccgtttgatgttgtgtacgatttgcctggtcattgctttttccgtttgaaaaataagtctcgtgtgttcaacataccctacggcgacataccctcttctgacacgcacaccactaaacggcgcaccaatgaccaacagcatgagctgaagcgcaaagcaaaggtagctcttgacttagtggaggccggactaatggccgatgccatgcaggacggcgcacgctggaagaaggcgaaaacagcaatcaatgtgctcggcaacctccttttggcggaatcgctggacaacacctccgctaatgtaaaaaatgatgtcgcggacatcaaaaaagaagaagaagcaactgtggcggaagaacacaaagaagatgatgatgaccaacaaaaagaggacctcggagacattgacaaaacgcttgacgatttcttcaacagtattaaagcatccacagcaaacatgtag

SEQ ID NO: 58174 - DNA, 1299 bp, Heterodera glycines
  Genomic contig location: Contig_ID=SeqID_27483; Location=284..1582; Strand=+
  SCN-specific regions: Sequence locations=1-31,74-459,481-503,525 -581,618-726,792-884,906-1048,1070-1178,1202-1299
  Gene Ontology: Mol. function=phosphopantothenoylcysteine decarboxylase activity; Cellular component=polysome; Biological process=mRNA catabolism, nonsense-mediated
cagatgtaaactcattggagtcggggccagtggaagatgatgaagaggaggaggaagaagaagaggtgggaagggtaacgagtggaggctgctcgagaattgaattttctcgagtctcaagaagctgggcaaagaattggacgagagtcgagggtcgattgagactgacacctcaaaaacccatagaaatttcttggctcgaaaaccccagcactttcgagtgagctacaatatgatcaaattggtgccactattcccgactcagtaaaattccttggttttaaatgtcatgatggtatcttttctgcaacatattagtggtggtgagaacgaaaaatttctcgagactcgagccccaaaaaccccgggatttttctcgagttgagaccgagactctcaaataagcaggaagatttctcgaattagcatttaaaaaattaattttaaggatcaaaagcgaaagccgagacggaaagcatcagatcaaggcaaattatttgtggatttatttatttattttttatcatcaaaattaatgctgtttaagcagatgaagaaaactcattggagtcggggccagtggaagatgatgaagaggaggaggaagaagaggtggtcaggggaaggggagctcgctgaaacttagaaaaaaatataaaatgaaaattcagaaaatccctcgccgaaagagaacaaagaaaaagaagaagaagaaacggcttcattatgatgatgattacggcaattatgatgacgaggattacgatgattatgacgacgatgaagacgatatttacgaggacagcgactacggtacctatgaggatgactacgacagttatgaggacgattatgatgatgagccggccgatatggagccggactatgattcagaggaggaggaatacgactatgtggatgaaggcggtggtggcaacaatggcattggcactggcgtgtcaaggccgaaacgatgccgggacacgaccagagagtgcaggcacggatttaacagacttttgggggaatgataatcgaccggaaccagtttatgaatttacaaaatgctaggtgtatgataacctcccagtcggggctggtaaatcggagatttccccgaaaatggcttaaaaaattcgcgggaaattagcccaaaaatgccgggggccctcccaaccataatttgttgtttttaatgggaaagttgcaggacaaagcaaatgcgtctctactgttccgacgaggactatgaagaggacatgcaccaaagatgtccagtgacatgccgattctgtaaag

SEQ ID NO: 58175 - DNA, 797 bp, Heterodera glycines
  Genomic contig location: Contig_ID=SeqID_27485; Location=320..1116; Strand=+
  SCN-specific regions: Sequence locations=1-172,194-408,431-587,609 -676,700-714,736-797
atggcaacgacccgccccttcccagacacggcacacgggcctcactcccgcgacattgtccccgaaacggcatcaacccttccgacacggcatttcctaagaagcggcaacgaccgaccctcccgacgtaaaattgtcccgacagaccctccccctcacccttccatcccgaacaaacgaacaagtggaatttccaataatttttttggaggtttgtgaaaatgggaatgggacttgcatacaatattaaattttatttctttgcaatttaatgatttgttttttgttctagtgaaggtgtcatttccccgtttcgtatgggccacacactcggacgaggtgtttcgcgttcctgagggatatcaaccggaagaggaaataatgtttgataattattttttgctaaattatctgtaattttgtaatttgtttatctgtctgtttttgtttaaaatgttctcattcgtattgtggtccagccactgtcatatgttatatttatttagtgcttgtatgacgtattgcgattagacaattaacaaaaaagttatacatgaaatttgcgaaaaaactcgaaattttgaagtttttgttaataaaaattttttcaggcttgaaaatcttttcgctttttgtaaaggctaatagagcatgtgaagagcttcgaatgataccaacaatgtttgatttggatgacaaagaaaaaagttgtagtggaaaagcatgctggggccaaatcgtgacggccgaactgaacgcgtagatttattattgtcattagtcgtaatttcaaatga

SEQ ID NO: 58176 - DNA, 149 bp, Heterodera glycines
  Genomic contig location: Contig_ID=SeqID_27485; Location=1303..1451; Strand=+
  SCN-specific regions: Sequence locations=1-149
atgaaattgagcggacaattcctttgccttcgtcccatctcttctctcattcgcaattcgtccgggctgagattcactcttttgaagaagcttttgtccacaacaaacgcttcaaagagttcgaaggattactcagaacgaatcacaaa

SEQ ID NO: 58177 - DNA, 289 bp, Heterodera glycines
  Genomic contig location: Contig_ID=SeqID_27486; Location=429..717; Strand=-
  SCN-specific regions: Sequence locations=1-219,241-289
atgggcaacatcgacgtgggcctttatgcctcaaaggatgcctttgcgaaggacattcaattgattcgcaacaatgccatcgagtacaacccggacaccgacatggactccaagcaaatacggcacgccgcaaatgccctcgtggacatgacggaggcactgttcagcatggaaatggacgacgatttcccgaccaaattggaggaggcgcgaaaattggtggaggaggcgaagcgatggacagaaaaaatggaatcggcggagaaagacgatggcacgaggaatggag

SEQ ID NO: 58178 - DNA, 130 bp, Heterodera glycines
  Genomic contig location: Contig_ID=SeqID_27489; Location=899..1028; Strand=+
  SCN-specific regions: Sequence locations=1-130
atgcgtttttggttaagccgtaaaaacaaaggagatgatgcagtaaacgatactgatttggaattggaattctctaataaacttgatgatttggaaaatgataataaagcagaggggatcatcggagacg

SEQ ID NO: 58179 - DNA, 93 bp, Heterodera glycines
  Genomic contig location: Contig_ID=SeqID_27489; Location=1..93; Strand=-
  SCN-specific regions: Sequence locations=1-93
tccaagtggggaattgaacccaggcgaaaaattatgaaaggtagaaagtttaacgactacaccacatgtgcatgtgtgtaatcccatgactaa

SEQ ID NO: 58180 - DNA, 129 bp, Heterodera glycines
  Genomic contig location: Contig_ID=SeqID_27490; Location=340..468; Strand=-
  SCN-specific regions: Sequence locations=1-28,51-129
aaattgtacaaaacttactagttttttgaaaaaaaaaattaaaaaaatttccgacttttcatcaaaaatttcggaagtcggaattccgaccccaaaaatgtcggaaatcggaagtctttccgtgccata

SEQ ID NO: 58181 - DNA, 806 bp, Heterodera glycines
  Genomic contig location: Contig_ID=SeqID_5471; Location=443..1248; Strand=-
  SCN-specific regions: Sequence locations=1-43,72-281,304-426,487-806
atgtcgggtcaaatcagagcaaaaataccgttacttaaccgagtgttaataaaagaaatacagaaaattaagtcaaaattagaagaagggaatttcgagtatgataaaaataattttgatgactgttctcgaatttttaataaaactaaagaaatcattcaaagaattgaaccaaattttgaaaaattaaaaattttgcaccaaaaatggcaaaatttaatgaggcgaatgaataaaacagaatggaacagtgaatggaaactacaaaaaatattccgggaaaagcataattatttaaaaacaattaaggaaattgacgaaatccttgacacaattaaggatataaatttggaggtaaaaagaaggctgaaagcgctcaaaccaaattcctcttcagaatccgaccaagagaatgaatcaattgatgaagagcaagaaaacgatgatgaagaagccggagaagaagaagatgaagatgaaaaagaatatgatagtgatcaagaggacgaatcacaagaaatgcattcaagtgatcaaacacatcgtaatcgcataccatttgttcatcaacgatcaagaataaagcttccggcacaaactctaactcacttttcgggaaaattttcccaatggccaagtttttgggacgattataaatcatcagtgcataacgattctaacatggaaaacatacaaaaacttaagtaccttcgtggacttttacatgatgaaccctaccggattgtgtccccatatcccctcacaagcaaaaattacccaataataataaaattgctgaaatcacg

SEQ ID NO: 58182 - DNA, 1410 bp, Heterodera glycines
  Genomic contig location: Contig_ID=SeqID_5472; Location=411..1820; Strand=-
  SCN-specific regions: Sequence locations=1-45,67-195,217-424,462 -593,714-790,820-1062,1087-1376,1403-1410
atgcaagtcacacttaaaggacataaggttaaagctatttatgataaaaatatttgtaatattgttacaatatcattggaaggatgttattcctgtactagtggtgctaattggactttatcatgtaaaacaaattttggtaccgcattagccaatgttaaatgtccaagtcaaaaggtccaagtgaattgtgataaagaaggaaaagaacaacaaatccaacttacatataataagcaaaatattatagaaaattgtgaagttatctgccccgatggtaagactgaaattattttgaaagctaatttggaatatatatcccaacaagataataaaattattcctgctaacaatactaatgaaaaacctattagcggaacttcattggaccaagtaactgatatattaaattttgtctattcccttattaaaacaaattttttcaatatatttattattatcatattcatactcattataattttcctaattccatgtctactatctattctatataaatttatgtgtcgctgccttcctctttcgcgcgggagtgtcgcgacgacgcgaaatcctaagataaaacccaaaacaaaaaatgtaaaaaataaaaaacattagaaataaaaatgggaaaaataatttaaaattatttctacatttaatttagaaaaaacacattaaaaactattaaaatatattaatataaaaatgggaaaaaacctttagaacaataaattaaaaaatgtgatcggaataatagtgcttttccttggattgaaaggaacggaaattaattaaatattaaatgattaatatgtaattggcaaattctgttaaaatacgttcgtaaacaaattattaatgattaatttgatatattaaagaaattgaaattgtaaagggaaaaaatggaaaaacaacaattaatgggaaaaatggcaaaatccaaagggataaacataaaaacaaattttaattaaaattagaaattggagcgtactatgatgcaaaaaagccgtataaaagcggctgggcttttcagtgattttcagttcgacattggttccctccgaagtttccgtcttcccccgtgccacaccatcccgaagtgccctgcgccttcccccgtgccacaccatcccgaagtgccctgcgccttcccccgtgccgcaccatcccgaagtgccctacgccttcccccgtgtcgccccatctcgaaaggtcctgtgcctctctccgcccgtccttttccgaagtgccctctcgcatccccattatgccattcccatataccgttcaattttgcccattttttattttttatgtttttgtattgatcattttttgtattgtgtcgccaagtttgagggctcggtttaattacccaagtttgagggtacaaataaa

SEQ ID NO: 58183 - DNA, 477 bp, Heterodera glycines
  Genomic contig location: Contig_ID=SeqID_5473; Location=607..1083; Strand=-
  SCN-specific regions: Sequence locations=1-477
atgagaaaagtaatcggaaaaagatttattgagtttgattcttttcaaactctgacttgtgaaattgaagccctggtaaattcacgaccaattacctttatatatgatgaaattaactcttatcagattcttagaccaatcgacttcatacttccacataaaaatttatgtattcctcctattttggaaaatgaggaaaccaaagacccaacttattacccaaaaaagacttcatacgaccaaacaattgaattatggaagaaaaccacaaaattattggatgattattggaaaatttggactgatgaatatataccaagtctaagagaacgttataaaatcgaaaacaaaaatccacgaaattgtatgaaatcttttccagaattgaatgaaattgtaataatacatgatcaaactcccagagcaatgtggaaaactggcattgtcaaaaatgtcataactggatcagatggtatc

SEQ ID NO: 58184 - DNA, 589 bp, Heterodera glycines
  Genomic contig location: Contig_ID=SeqID_27492; Location=57..645; Strand=+
  SCN-specific regions: Sequence locations=1-208,230-297,319-335,357 -527,550-589
gtcgatgtcagcggcttccgccccgaggagatcaacgtggaggtgattggtaatgaaatcatcgtcaatggggaacatcgcgagcagaacgacagtgagttttgccattgttcgagtaattttatcggggttttggattttggtgagacaaatgtcagggcttgagtgttaatggattcatttaaaatgcttttcggaaccatatttagccaatttaggcttacatttagcgaatcagagaaatatcgagaaacttctttcaatttggaaaatttatatccgcatttctgccatttatggccatatttttgcaaactcttgattttttacgtcccaaaatacctttgaatggatttttcgaaacgcaaaaatattttttttcgggtcgggcatattccgaatttatgattgatttaaatgcaataaatgtctagtcataatgctgtttttcgatgattcattgccccctccaactcaggcgaatcggtccaccgtcagttctcgcgccgtgtgctcatcccggagggcatccaaaaggagagcatcaagtgcgagctggacggcggtcgcttgtgcatctgcggaatga

SEQ ID NO: 58185 - DNA, 1219 bp, Heterodera glycines
  Genomic contig location: Contig_ID=SeqID_27494; Location=119..1337; Strand=-
  SCN-specific regions: Sequence locations=1-332,354-465,487-1186,1216 -1219
atgattgccggacttggctgtgccgctgcttcgggtgtcaccaattcgtcgtcgtcctcgtccccttattacggtggtgtcggaggtgatgagcagcccactgctgatagtggcggtgttgttcggatggacctcggctggacgacaacgcggcacaataaccgcaacgccaacaatggccaacacaaaaaacaaaacggagaagcgacgaagacaacagagcaggaggagcgggagcagtacagcaacaacgagttcatcctgttggtcaacctgatcgcctctcggtattacaatacaaaaaatagttaatagttaaactgtgattatgaaaaattttagcaatttttaaattctgaaaattcgaaatttggagttcgtgattaacttcaaatttccagggtgttttacgacttttgccgtgacaattactggtgcggtgcggttcggaacaaaattcagacaaagttggccaccattcatgtgcgttgtttttccagattccgattttttgggtgattttgaggggcccaaaaatgtaaatttatgccaaaaaggtatcaatttagtaaaaaaattactcattttcattgaaattttgtttgtttttcggtcaatttagtcaatggtcttcgtacaaattgtaaaagttgcagttgccctatttcatcgagacgctggagctgtccaagttggacctgggcaccatcacggccccaaattgtgcgggtgcacccgcccgacggtcaacgaatggggcatttggtgcgactttgacatcaaatacgacggcatgattcgactcgtgttggaaacgcgagttaacttgatgaagctgaagagtgtcagcgagtcgtcctccaccgccacaacgccgtcttcgtcatgtccaatcatttccggtgccggcggtgccatcgacccgacggcgacattaactataaaaaacggtgccgtcgatgaacagcagcagcagcgacaacggcacagttgcggtggatgctgtgccacttctgctggtggtggtaccgccccacaaacgatgccaacttcgacgacgacgccgttgttgccccggtccagctgttcgacctatcgcattgcgccaaaccggtgaattgatggggggaacggagaggagggggtttgcatcagcacacttagtttcaccaggggttgttccttagggaattaaaaacaaattctttttaaaaataaa

SEQ ID NO: 58186 - DNA, 512 bp, Heterodera glycines
  Genomic contig location: Contig_ID=SeqID_27495; Location=56..567; Strand=+
  SCN-specific regions: Sequence locations=1-9,33-305,327-458,486-512
atggaatcatttttaaaagttttaaaggaaagcgaagaaacgctgagggatttattggctcaaatcgaattggaccatttggtgccaaattcggcggagaaattagtcgaattgaaagacggaaagctaattgaaagcccatcattggaaaacattcaaaagcaaacagagcaatttgtgaacaatggccaacattcgcaagaagcaattgatatggcaaaagatgcgctgtcatcaatgaacacaattaaaaatgggcaacttttttttcatctttccattgaaaatttgaaaataattacagtggagaaaaagcagaagaaaatgccaaaaattttggctttattatcgcgaattaaaatctcaggaaaaaagaaaaagacatgaacaaagttggcacacaataagcatttttaatttgctaatattattaattaacattcgtaaatgcagttaaattgaaattttaaagtttaaaaaatttgcaatttctacctattttcaaagaatta

SEQ ID NO: 58187 - DNA, 1569 bp, Heterodera glycines
  Genomic contig location: Contig_ID=SeqID_27497; Location=91..1659; Strand=+
  SCN-specific regions: Sequence locations=1-526,559-1569
atgagctccgaattgaacgaacttcaaagcccccctcgtgtttacttggaaggcttggtggatgctgttgacgagagggttcgagaggcatttctgaacaacatgatggcgttcaacaacctgttcgcctttgcatctacacatggcgaaaaggccccacctgagcaaatggggggccgcctggacacgtgcaaatacaacggttaagaatcaacttatacatttttaataaaaaaatttaggggaattttcgttcctgttcagcgacctaattgccccgggggtccgtcgcccgtcgtttgctcaggtttatacattgacgccggaagacgctttgaatgtccgtgaaggggcattacacaccgcagttgcgccgcacatcagacgcacaatcatccagagacttgaggcgctgatgcgggcaaacccatttggtcagacattccagacggtgggtacgaagattgaggcagctcgagcagcaacgggagaacttccgcattttcgagtacacctacaatgaatcaatttttgattaaattaaaaaaatttattaaagattgccctgttgacggatcggcacttaaagggggttccgcttcaaggacgcactgatattactgttattgaacgagcggatgcaccgactgccaaacaagtggctgtaatttgggtagaagaggatgggctaccaccacagatcagcggtaataacaaacgatccaaaaatagtctcatcataaaataattaagctttctgggtgtccgacaaagccgggaagatgcgcgagctgaagagtggcatgccgcaaatcgacccgtgctgcttcccactactccacccacttggcacacttggatggcggtggtttatgaagaagcgtgggtccgaggttataacgagaaagcctatcaaaatcaaaaataattaaaattctcaagaacgcccatcatgaaatgcagcaacaagaggaaccggatttggaccaaatttccgacgacgaattgggcgacgaagttccaatcgatgacattgtgggtacgcagaagaatgatgaggaaattgacgaaatgccggagctcgaactggaattggacaacgatgttgccgaggaacaggaggaacctgatatgaatgctgtgggttcgtctactgcacagccaaatcccggacgcaatgaaaatgaggacgtcatctttgaccatgaagtggagactcgtggaggccggaccaacatctctgaacgacagttctaccgctaccgcatggcacttcgggggtccggcaagaacaccttccattggttgtggttcgcgcgacgactcgccgagtacttcaccatctctgtgctcaaccggatcgagcgaaacgaccttgaacatctgaaggcaatccaggtcaagaagaactaccggcagcttctagcccgtgaatatatcgccgccatggagaagggggtccgacagcaaggaccaaatgccaagctcggccgtgttttcctcatgccacagaccttcgccgggtctcggcagtattaccaagggaagtacgccgacttgatgacaatg

SEQ ID NO: 58188 - DNA, 387 bp, Heterodera glycines
  misc_feature (13)..(13): n is a, c, g, or t
  Genomic contig location: Contig_ID=SeqID_27501; Location=211..597; Strand=+
  SCN-specific regions: Sequence locations=1-387
atcttccaccctnttgttgtccttttgccaagtggacgaattgcgaggcccaaccgctgcagcaattgtcgctgttgagcccaacgagcagcagctgaacacgccggcacaggccatggtcaacacggcacggctcacctttgaggaggccatcttccccgaagtgccgttgaccgccctccaattgttggcatttgtcatcaaggcaagacacaattgtggcacttttgttcactgctcaacaaatttctctaaatttacataaatgtccattttcttcgattaaaaaaaaagagtttgccaagcaatttcctagcatttaaatttttttcaatgataaaaaacaatgtttgctctctttaaggaaatttttcataaaaatccaaa

SEQ ID NO: 58189 - DNA, 197 bp, Heterodera glycines
  Genomic contig location: Contig_ID=SeqID_27501; Location=704..900; Strand=-
  SCN-specific regions: Sequence locations=1-197
ccagtcgcagtgcttcagcaatttgtttggcatggaatggcgccaacggagggcacagcaacggatcaatgcgtacggttcgcaatgtttgcccaatgagtgcacacaaagggtcgaaggaggaggagaaaaggcgacgaattcctctgccaacatcgacggactccttaatttggaaaggattaagcaaaaattga

SEQ ID NO: 58190 - DNA, 257 bp, Heterodera glycines
  Genomic contig location: Contig_ID=SeqID_5474; Location=1..257; Strand=+
  SCN-specific regions: Sequence locations=1-158,204-257
  Gene Ontology: Mol. function=receptor signaling protein activity; Biological process=signal transduction
ttcccttcttcctcagcgtccaatggtctgaatccgctattacaggaacgctttgtgttccatgtgcggcacccggagctgtcactgctgcgctttcatgtggaagacggcgatttcgtcggtccgaagacggatccgttcattggacaggccgtgtttccgctcgactccgtccgctgcggcttccgctccgttccgcttcggaatcagttcagcgaaccgttggaactttcggcacttctcgtccatgtggaaat

SEQ ID NO: 58191 - DNA, 534 bp, Heterodera glycines
  Genomic contig location: Contig_ID=SeqID_5475; Location=807..1340; Strand=+
  SCN-specific regions: Sequence locations=1-355,377-534
atgtcggcgatcgaaaatgacgagacaaagagcagaatttggcagcaactgaagaccaaactccactcgacgatggtcgccttcggaagcgggtcggtgcagttgcccaagctgatggacacgttcaggtgcgtctccgatggactcaaaaaagggcactttcactttttaaatccggcatcaaaaacatggagataggaaaaacaaaaagttatgcaattttcatcgcattcaaagatacatgcaaaattgttgaatgctttggattttttaactttaatttcttccgtttttttgttacgtttcaatttttaggcatgattggggctccgaattgacttcgtacgcggtccaactcggcttcggctgcaacgacgcggcggtgtacaaaatgttgctgacgatgcccgacgaaattgaaagcggcttcatatcggccactggcaccttcgcgttcaaagtgattccgaaggcggagaccagcgaaaacttgacgaagatcgaccagagcaaccaataccaagagtttgttgg

SEQ ID NO: 58192 - DNA, 304 bp, Heterodera glycines
  Genomic contig location: Contig_ID=SeqID_5476; Location=170..473; Strand=+
  SCN-specific regions: Sequence locations=1-1,23-304
gcacaaacaaattgaaaacattctgcgcagttcacgcggtcgactgcctcccaacggacatcctcccatcgtgcggaaaatcagcatccgttcgcaggtccaacaggtcgtacaaaaggagcagcaggtccaagtcgtacaagaggttgtttgataagaaattgcttattgtattcgagatttgaatttgtaattttaggacgagcaaagtcacgatcttcagaagccgaaacaatcatcgaatgctaaggacgagtcggaggacatcatcggacaactgatcgaacaatttaagagattgaaa

SEQ ID NO: 58193 - DNA, 1361 bp, Heterodera glycines
  Genomic contig location: Contig_ID=SeqID_5477; Location=441..1801; Strand=+
  SCN-specific regions: Sequence locations=1-106,128-162,184-1361
  Gene Ontology: Mol. function=glycogenin glucosyltransferase activity; Cellular component=soluble fraction; Biological process=glycogen biosynthesis
gcgtctttgtctttgtcccctcggagcaaacatatcgcaatttgcttgattttgcactcgtttatgggtccttcgacggcggtgaccagggacttctgaacgcatatttcaggtttgattgttttttgccatgtcgcacaaacatccactaattttcaggtcatttacattttttctctttcagcacatggcgtgaatcagatgctacccaccgtctcccgttcacttacaatgtcacgaccgttgccatttatggctatgccgccgctttgaagcggtaatttgtttgctgaacagcagcgacaatgcaattgtttgttgcttttagtttcgcgccgaacatcaaaataatccattttcttggcaagcaaaagccttgggctctgctctacggggacggcgctgcggggatggcattcgtttcggactatcacaaggtgaaggggatgccttatattgaacgcattcttttcaaaaagggtgcacttcacttacaccccgccggttccccaccttcccgaaatttgaaaaaaggttatacaaaaaggtttagattttttcttgaaaaatttgtttgaatattttttcaaatttttcggccgggtaacgacgtgtaagactccgtttcaaaaatacgacatatttggtgtttgttcgcatgcttttcaatgttttaacccatttcagcaatggtaccaactctacgcaaacattgtccagcaacttctgcctccgtcctcttcggtaatttcttcttccaccccttcttctcttccgtcctcttccttctctattattcaacatccgttgacttcgttcgaaaaccgtcccattgtcgtaagctgtgcagtgttttatgtgttcttttttaactattattagggaattttttgctgcttaaaattgcagttttagtgcagcatgtgtgtccctttttgcgtcccgttcaattttatttacggtattattcgtaagcggatcgccactagtaaacgcgtacagatttatgggacaggtcaaaatcatgggacgggttaaaattctatgggacgcataaatgggcattttgactgtaatactaacaatttcatgtcttattgctgtgttaacagtttccattttttcttttattttctaaatccgttaaaccgatttcagtcgcacggtgctaccgcaatcccggggcgtgcgcctgctggcggtggttacgaggcttgggaagcggggtcaccggattatttgggtaataacaactcttttattttacaaattatttctgttccatatattcgaatttttaaggtgctgactcctttgccaacattcagaaggctattgaaaaagcactcaaaggcgaatga

SEQ ID NO: 58194 - DNA, 381 bp, Heterodera glycines
  Genomic contig location: Contig_ID=SeqID_27503; Location=247..627; Strand=+
  SCN-specific regions: Sequence locations=1-14,129-381
atgaaagatgaaagttattaaaaagaaaaataatttttttatttcatttgtacttaaaaataaatatttaaatattagtaaatataattttcatttttcctatttgttaattttttaaattataaaaacattttgaaaacaaattcagctgttcaacgcattgttgacctgcatgttggtgttgatatgctcaaaattttggacaattatgctgagggtttttcgggtgtgctgaaagatttaagtgccaaaaatggtcaagcaacaacattcaatgccatgttcacgacggcatatttgaacattttgtccagtttaagcaacaaatgctatgtgtccattgaggaaggaccttttggacgaatcggctcaattataatc

SEQ ID NO: 58195 - DNA, 168 bp, Heterodera glycines
  Genomic contig location: Contig_ID=SeqID_27504; Location=226..393; Strand=+
  SCN-specific regions: Sequence locations=1-168
atgtcagaactgaaagacgcaccgacgcattggtcgggaatggacgaaaatcgggaggaggaaatgatgcgcgagataatgacgaacggacccatccaaattagtgtaaatgcatatgatgatatttacaactatggtgaaagcagcaatcgaatcaatgtttacgtg

SEQ ID NO: 58196 - DNA, 305 bp, Heterodera glycines
  Genomic contig location: Contig_ID=SeqID_27505; Location=70..374; Strand=+
  SCN-specific regions: Sequence locations=1-305
gtgttggatttgtgtgcactgatgttgaggcagctctggaggcgcgtctttcatctgccaaggacaatctgatcagatttggcgacgaaatctacataaagctgagcggcgaccatggccagagttgtacgaagattaccgtctcattcagccaggctgctcggtcaaattctccatcaaacaatttcgtctgtgccgttttccctaccaaggatagccgcgaaaacttggagcgctatggaatcacactttgggaacaaattgacggaataggcacattggcgggcaaacgagtcaagtggtaa

SEQ ID NO: 58197 - DNA, 904 bp, Heterodera glycines
  Genomic contig location: Contig_ID=SeqID_27505; Location=638..1541; Strand=+
  SCN-specific regions: Sequence locations=1-524,546-577,599-781,811-904
atgatggggatcacgaaaccaccgcttctcctgtccattggatttgaccggattatccccgcgccatttcacgttttccaggggattggaaatgccttaattcgggaactcgaacagcaggaaggatgtgtcgaaattgctcaacacttttttcggagattcggcgcgcggagggagcaatttcgtaaacgagacatgactgggaattcaattagaaaaatccttgtccatgcttctgaaatggaacatctcttttcgacggattggccaattacgatttgcagaacccttgtgcacctcgggaaaattcaaaaattttcaaaagtcccttttttctcttttcacaaacttaaattcgaaattcaggcagagccattgtcaccgaatgacctggatgagctagaggagcgtgtcaacgattttaaatcttttttgtctgcccaggagcgaatgcgcgggtttctctcaaagaagccgaaagcacatcttttgttgagccattttgttcccttcgctcgcgagcacaagtttcttggccttttagatgaacagggttgtggtgaaaaatgttttctatcccattaatctgaattttaaggtgatgaggcgctccattccgtttggcgccgacttgagcaactgtggaagtgtatgccggacgcagaccaaattttgcagcaattggagcaccattttgtcaacaattggctcctcgacacgggcaaaattgatgaaatgaagcaggtctgtatgtttggagggggtgattgcgttaaacttgttttattttaaaatttatatataataattcagagacaaagtgatcagagggaagagcatgatgagctcgatcaatctgaagaagaaattgacgaaatttcgcttatcatctcattgattgatg

SEQ ID NO: 58198 - DNA, 1563 bp, Heterodera glycines
  Genomic contig location: Contig_ID=SeqID_27506; Location=68..1630; Strand=+
  SCN-specific regions: Sequence locations=1-677,699-1563
atgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattaaatacgcactcaagtacccttttaaagggccaggacattgttatgtcgagtgcaaagaagagtccggcaataaaatcaaaattgacgagccggctcaatatgccaagatgaactttcgtggtgcaacggaagcatatgccattgttcattcaatgccatttgcccgtctttcgcatcatgttgtcaaattggcaattcatttgccaaaccaacagcccattgtatatagggctttccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggcctcctatcggccgaattgttcctgtacccccatcggacccggaaaggttcgcgctctattcacttatgcgtcactttcctggagacccagaccatcttaagatggttaatgggttactttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaaaagtttttctttggcgatgatgatttgaatttgcctccagggcaaccaaatcctcgtccacagccaaatacccctccgccacttaacagcgaccaacagaag

SEQ ID NO: 58199 - DNA, 111 bp, Heterodera glycines
  Genomic contig location: Contig_ID=SeqID_27508; Location=525..635; Strand=-
  SCN-specific regions: Sequence locations=1-111
ttcacccaatatctttcgtccacgtcgttcaaccaaaagtattattttacggtggacaccaattatgtgcggcgaaagttggccctcattctgttcccgttctttcatcgg

SEQ ID NO: 58200 - DNA, 649 bp, Heterodera glycines
  Genomic contig location: Contig_ID=SeqID_27511; Location=158..806; Strand=-
  SCN-specific regions: Sequence locations=1-243,265-294,351-486,508 -510,532-649
atggctgagctgaactcggtctgtgaattggaatggcgaattttcgatttttctcaaacggttgaaggacgagtgcgccacccgaaaagtttcgcgtggaaaattttggccatggcggtaaattaaatttaaaaaatcaaaaaaccactgcaattctaaggaagttttgtcggaatatgacacggtcggttgggtggatacatcagttttatttagcagtgacaatttggagccaattttaacacaaattcaaaatggcaaaattggcccagtccaattactaaccagtgagtgtaaaaatggacaaaattttaattgttttgttttttgaaaaattgttgttaaccttaagctacttggcacggcaaaaacattgcgacacatccgagtacttattttaatagaatatttgatttaaaacttataactaattactaatcacaatttttgccaagggatgtacgattatttgccaatggtcgccaattttgggcccacaaaagaaacaaatgatttgtcagggaaagaagacccgccacagttcgagtcaaaatttgtcatccttcataaaacggaaagtacgcggcaaatgatgaaatggttggtatttattctcattggagccgttacaaatatctactggcactaa

SEQ ID NO: 58201 - DNA, 925 bp, Heterodera glycines
  Genomic contig location: Contig_ID=SeqID_5478; Location=196..1120; Strand=+
  SCN-specific regions: Sequence locations=1-34,66-350,393-424,446-925
gccaaaaaaggaagagctgtcccctccgcccgtttcttctccgtcctcctcctcctcttcttcggtcgcacgggcgcgaaaacgaatgccaaaagcatcgccgttggacggaactttggacaattcgccactttcactggtccaacaactgacggaagccgcacaaagtgcacgggaactgatcaaagcaagcatttgatgggagattcaattgaaaggggcgggggagtgacgtcactttcttaataatacaaaattaaataagtaatgggagagggattaatcggtcgatcaaaatttgaaatttacagtccgaagacaacgccaaagaatcggcgccaccggcggatcaaagcaatgggattaaaatggaaaatgacaacagcagagaagaaaacggcggggacgaagtcggggacggggaggaggaggacaacttcggggagacactgggccaaattttcatgctgaggtcattgggaaacaaaaatggaatgacaaagacaacaaacagtatatccgacattttacagtaagcaaatcgctgagaatggcgtcggatgcgcacccgcaaaaaacaatggcaaaagtcaccaaaatgccattgggacggaacaacaaatgacggaaaagtcggcacaattagctttttgtaataactaataatttaattgcagcgatttgccaattcgatttctgctgaacgaatggatgctgaagggagggccgagcatgatgacgaatggcgaagggacagccgaagcgaacgcagcgaacaacgcaattggcattggcaccgacggcaatgcttttcggcaccatccgtcgccgccggcgccgaaacgcatgcgttggacggaagagaatggcaccgcaacagccgcttctcaacaaaacggcggcggcgaccaatttgacattttcg

SEQ ID NO: 58202 - DNA, 561 bp, Heterodera glycines
  Genomic contig location: Contig_ID=SeqID_5479; Location=158..718; Strand=-
  SCN-specific regions: Sequence locations=1-329,351-398,420-424,446-561
atgtgtcccgttcggctggagttattctgctccgagggtcccctgctgatggagccgttccgtgtcgattgtttccaccgggacgagttggacccacttttggcagaacacttttgggagcacggcaaaccgttgccataccttcgcgagattcaaacactacgccaattcaaaacggattattatgcggtgctggtggcgggcagaacggtgggggaaaagaggggagaaaaataataatcaaaaatggaaaggaatgccaaaggtagtgaagaaaatggaaaagaatgccaaaatgggaggggatggggtgccgaaaaattggacagttttaatgaaaaggcaaatttgaataacgaatggtcatttcggcatggaattcccgtaccaatggacccattaattaattattttaatttgttttttgtcctttttatgaaaagcatttgacttttgcagcaaagtcaaatgcattacatgctcgacttgagctcttccaacaacgtgaacattgagggtgaattgaaggtcaatcagacggtgcccgcgaacactttgaga

SEQ ID NO: 58203 - DNA, 423 bp, Heterodera glycines
  Genomic contig location: Contig_ID=SeqID_5480; Location=862..1284; Strand=+
  SCN-specific regions: Sequence locations=1-57,79-175,204-423
atgggagtggtggaggagacgagagccggacgaaacattggacactgtgaaaatggtaaaggtaattaattaattaatgacaaattggtcaaattgtgcgaatgaaagcatagaattattcatttcaacttatcccaactaattttacaaattatcatgaccatttcgggaagctcccccccccccgctcccccggcggggggacgacccttccctaagtccgtccatctgttcgttcgtttctatgccaccaataattggcaatttattaattaaatgctttgtcgaccaaattactggccaaagctaatgagtgtttaactgtttatctttttgcagaatgaatgaagaaaaatgaaaggtgcgcgggtggacggacttcgcctttcattttctgcgaattccccggcaacggacggacga

SEQ ID NO: 58204 - DNA, 503 bp, Heterodera glycines
  Genomic contig location: Contig_ID=SeqID_5480; Location=1..503; Strand=+
  SCN-specific regions: Sequence locations=1-266,288-503
aatcatttaaaatgtagcaaatgcagcatatttattcccgactatttccaaacccaccgaacatgtcaaacagattcatgagcatgcatttgaacggtttggtcagtcgtcccttatgatcgatgatttggtctgaccgttctggctcaattatttttagtgctcggcagaaacggactctgatcaaatggtttccggccggcaccgacacccaatccgtggtgcatttctgtgatcagccgacggtcacaatatttatcattttaatgatgctgccttccactcactccgttttcctttcgccgcgccaccgcgtggacgcgcgcgttcgactccaattcggaggacatgagaatgccgaggacggagttgtggaagcggctcagagagtgatcgactgaccagcccgggggagggacggacaattgggcacggcacccgacaaaacaacaactcactggcttcgttgacgcaaatggacagacgcattttgcggggccttt

SEQ ID NO: 58205 - DNA, 241 bp, Heterodera glycines
  Genomic contig location: Contig_ID=SeqID_5482; Location=76..316; Strand=-
  SCN-specific regions: Sequence locations=1-241
atgtctgaatttggcatttcgatcgaacagattttacgcttttgggccaatacgatgaatgtttttattgatgacaacaatttaacggctgttgaccgaatggaatcgcaaaacgtaattgatccgttgtttggagcatggctggaccaattacgcgttaaagaaattatgggtcttttttgggagcgaaattacggatcgtgttgtggaaataaagacgttttgagttctgaaattacgg

SEQ ID NO: 58206 - DNA, 1907 bp, Heterodera glycines
  Genomic contig location: Contig_ID=SeqID_5483; Location=727..2633; Strand=+
  SCN-specific regions: Sequence locations=1-129,151-315,338-402,424 -726,748-1192,1214-1442,1466-1907
  Gene Ontology: Mol. function=G-protein coupled receptor activity; Cellular component=integral to plasma membrane; Biological process=G- protein coupled receptor protein signaling pathway
atggacaattgcgcaccgttccaatatgccgtggagaacatcagtcgatacgtttatgacaagcttggcgaacgctgcgcaatggtggtgaagggcaaaaaaaaatttttcaatgggtttaaaaaacaatttttaatttgatttgataaaaattaatcatttgcccccccccccccccctcttaagccttccattgttttgccaacggtggtcatttatggactgatccttctgcttggcattctcggcaatctttgcacttgtttggtgattctgcgcaacaaatgcatgcaggtcgaacaattggcgatttatggagggaaaagggggaaaggggtcgaacggaaaagcgaccgattgattcgaccgatcatttgatcgaatgaccaaaatgcttgtttgtttgcccaaaaatgccaattcgattcagaacccaaccaattattacctcttctcgctggccatctccgacctgcttctgcttgtgcttggccttcccatggaattacacggcgttttcggtgccgtttacccatataaatttggcgaattcatctgcaaaggtcgcgcatttctaatcgaagtctgtggtcgagaaaatgataaaaaataattcgacctcccctctttcccctaaagttcacaagttatgcctccattttgaccatcacttgcttttcagtggagcgatggctcgcaatttggtattaaatttgagaatgttctttttgttgtgttaaatatgtaattggttttatttaagaattagtcattaaaatgccaatttttcttggccgtgtatcatttgtctatttgtcattgtgccaattgtccatttacaatttctcagttttccgttgcgcatcaaaattttctcaactttggaccgtgccgtcaaagtgatcgtcgccgtttggctttgtgcttttctggccgcttcgcccgtcctctcaattgtcgtggtcaacaaattgcctgttcccgactgggccactgatcagccttggctgcccctcgtcagtcatttttgattacttttggcaaattagtcttgtcaggtctcctccgacggccaacttttgatcggcaccgaaacatgcgcgatggattttatgagaccattcgtaaaaatgggggaggcaaatcaaaagaaccctggggcattttttgatcgaattaaggcacagcgcaacttcatcttcattgccttcaccattttcttcctcctgcccgcccttctgatcactcttgtctattttcacatcgtttaccgattgtgcgcctcgggcgaccgttcgctgacggccgagtcggccaagcaaaagacgcgttcccggaagagtttgctcaaaatccttggtgaattttgttggcatttggcagtgccaacaatgggttctcattttcatcccccttcagttcccgtggtggttatgtttttcctctgctggttgccttttcacgtccagcgtttgctcagcgtttatctgaatgagtcgtcgatggaatccgtcgaggacgagcagtacaattccgccattcacactctgttcagcatcgtcttttacatttccggtcggtgcattttcagtgccatttggtgccacttttccttgctcaatttgccattttctgttaaggttattgctactactccaactccgcttgcaatccgatcctttacaacattttgtctgccaaatatcgaattgccttttgcaaaacggtcagttaattttgcttcttttcttctcatggctttcacttataaattttccgcttagattctcggcgagcgtttcgcccacaaaatattgtcgggtcgaaaccgcgccagagactccgccatcgctggcggcaatggactgaatagcaatttgaactccaaagtgtccaccggtggctcg

SEQ ID NO: 58207 - DNA, 681 bp, Heterodera glycines
  Genomic contig location: Contig_ID=SeqID_27513; Location=542..1222; Strand=-
  SCN-specific regions: Sequence locations=1-134,208-304,412-539,564 -585,607-681
atgccggattggttacgctcatttgggctcgaaaacattttgggatcaatgaatggcacaaaaggcacaaaaacggcgggtgccgacgacggcgttgccggcgaagacaccggcaacgcactggcacaactcttcggcagaagtggtggtggtagcggcagcagtgccaacggcggcgaagctggcggcaccggtggtggcaaaggcttcgcgctgtcttccgtgttcggctctgggctggacgatatgccaagaaggcgttgaaaatgcaatttttgagtgtgttcactgggtttttgatttcattttttaaaagtttactaaaaaaaattttaaaaaatcgttttaaaaaattaaatttttttttcattaatttattaaatattcaaagtaaatatgttaaaaatattagcacaacaaaactttgcagggatactaaaaggaaaagaatcaaccaattttaaacttttttatcccatatccttcaaatattttaacgcttattggttctaaaaaaatttcaaaattatgagttttccattatttaaaaaaaaaattattttgcacaatcaattcataaatattttttcagaaaatgctctgaaacgcaccaaattttatttatatgttaattaataaggcactcggatgcttatattctcaaaaagggtgatgaataaa

SEQ ID NO: 58208 - DNA, 983 bp, Heterodera glycines
  Genomic contig location: Contig_ID=SeqID_27514; Location=1..983; Strand=-
  SCN-specific regions: Sequence locations=1-126,149-366,388-875,898-983
  Gene Ontology: Mol. function=protein kinase activity; Cellular component=bud neck; Biological process=glia cell migration
gggaccagtaaaagtcagtattaccctattctttttggattatcggttaatcttatgataatataataaattactactacacttaaggttggcaaaaaaattggttgtggtaattttggcgagctccgacttggcaaaaatctttacaacaacgaacatgtggccataaaattggagcctatgaaaagcaaggcgccacagcttcatctggaatatcgtttctacaaattgcttggccaaacaggttccctcaaggggagctaatagtaaaacgatttttgaccttttttgcggtaagccgagtgataatgttttgggtatttttagaaggaaattcacaaatactgaattgaatttggaatgattatatggttctattcaagtttacacgttcaatcattaccggcttgtttcttaggcttaagcttgaagtagggagttttatgtaactaaatatactataaaagactgaattttattgtttcttaatgccattatttgttctttttggtcatgattggaggcgtaaactggaatagagccaacgacattacaaatgaaaccgaaaaattgtagaggggctaccgcaagtgcattattttggtccctgcggcaagtacaatgcgcttgtgatggaattgcttggccattcgttggaggatcttttcgatctttgtgacagaaaatttacgctgaaaaccgtttgtatgaccgcaatgcaattggtgcccatgttttacacaacctttctatacatttatgttttaagttgagaagaatagaatacgtccactcaaaacacttgatttatcgtgatgtgaagcctgagaattttcttatcggaaggagttccactcggaaacagcacattttgcacataatcgacttcggtctcgcgaaggaatacattgactgtgacacgggtatgccatgggtgttatggcaatcctctagattattggtcccgaaaattttttcttaaa

SEQ ID NO: 58209 - DNA, 311 bp, Heterodera glycines
  Genomic contig location: Contig_ID=SeqID_27515; Location=218..528; Strand=+
  SCN-specific regions: Sequence locations=1-311
tggcaatggccaacaatttttgtttcgtaagatttcgctgttcattcaaaggttggccacggtgtccgctcaatgccgtgccgatgtgtcccatttgttctgttccctgacccgactggtccaatccttgaaaacggaatgcccgggagctgacgagggaatggcacaatgtgccgagtgccgtaggaaaacggacattctctaccgggagaacaaatgggtgctgacatgtaagcaaaaggagtactgaagaaaaaatatttgagtactttagggatcgactcgttggggaagatgccctcgggcataag

SEQ ID NO: 58210 - DNA, 901 bp, Heterodera glycines
  Genomic contig location: Contig_ID=SeqID_27516; Location=199..1099; Strand=-
  SCN-specific regions: Sequence locations=1-317,357-660,683-901
atggcttggacgagttcggcgagtgcaaaacgtcctttccgttcagctgcgatgggtacgccaaacgctttccaaaggacgagaaaatattttgtcgcacgacgcgacacaaaacggcgaatggtgcggcactttttggcaattaaattttgtttaaaatgtttttcattgcttccccccccccttttttaggcactttcactgtggtgaaggaatgcatcgcggacagtgcgcaccacgtcactttcccgcgcaaaccgtaccaattggcggaggagtgcgacgtggtcgaccttaatggggtcgaagtggcctattgcctttgtggggaccaaaatttgtgcaacggcgaggcaattgtgggccaattcagcgcatttgaggaggtgaaaagtcaaaatcagagaatgttattctttatccattgcttatttgaacatttgcatattttaagtttttcttttaattagtaaaggaaaccccaaattaattatccgaaattacactgtctatttcaagtgaaatgtttaatttataattcaaaagttcaattgaggaagagttcggcatgccaatatcaacaagcaaaatttgaggatttaatcgatgatttatgtgcgcaattatcacattttccaaaaaataattaaatgtcgactcaaaataaggacagatcttaaaaaatatggacttttgcgagtattgcttttgtttccgtgcccatttccctccaattccctataaaatttaaattcctcagaaataccccgaattgttcgactccgatccgacgaccacggcgtccgatcagttgtctctgtctcagtcctcacaccagcgatcagcggaggaaaagcaaagggagcgaagcggagaagaagcagcagaatctgcggaagaa

SEQ ID NO: 58211 - DNA, 808 bp, Heterodera glycines
  misc_feature (45)..(45): n is a, c, g, or t
  Genomic contig location: Contig_ID=SeqID_27517; Location=20..827; Strand=+
  SCN-specific regions: Sequence locations=1-172,194-613,635-808
  Gene Ontology: Mol. function=RNA polymerase II transcription factor activity; Cellular component=cytoplasm; Biological process=TGFbeta receptor signaling pathway
ggcagattctgaccacccttcgctgaagagagagttgaaaagttntgctgaaaaaactacgaaaacaaaaatgtctggacgaattaaaaaaagcaatcattgctgagggcaaatacgtcaaatgtgtggtgtacaaaatgtaattttttgaatttacgtatttataaaaaattgaatgggggcacagacactgacaaaattcaaaaactacgcaaattcacaaaatttcctgtttgcttaaattaacccttttgacacgttaagtgcactagatgaaggaattcctcttaattgtttgcatttaagccaccaaatgttagggttttttttataaaattcattgcttttcatgccaaactttggctcatgcttttttgctaaaatttcttgtttttttaagtccagagaagcagcaaacaccctatggtggacagatgaagtcatttccgcatttcatttgctgtaaaatttgcagatttcctggtaattattgtttgtacaaatttttgttaaatcaattttttaaccccttccaatttttcaaatttttctaaaagcagttgggctggattgatgagagggtgtatctactaaatcattcacttttccatctcaaaaaatgccaaaatttccaaatactggagaggtgttggcaaaaaaaaaaatgataaataatctttctggcaattttgctaaaatgtctaaaagtcgcttttcttcataaaattactactagatttgctaactcatcaccaacttcgtccggttgctcaatgtttgcatcccttcaacaaagcccagaaaatgg

SEQ ID NO: 58212 - DNA, 93 bp, Heterodera glycines
  misc_feature (27)..(27): n is a, c, g, or t
  Genomic contig location: Contig_ID=SeqID_27520; Location=76..168; Strand=+
  SCN-specific regions: Sequence locations=1-93
atggggagcaaaaatccaacgcagaanttaagtacaggctatagggaagctattccggaaggattcggtctccacataaatctgggcgcatcg

SEQ ID NO: 58213 - DNA, 289 bp, Heterodera glycines
  misc_feature (78)..(78): n is a, c, g, or t
  Genomic contig location: Contig_ID=SeqID_27520; Location=911..1199; Strand=+
  SCN-specific regions: Sequence locations=1-289
ccaacgcagaattaaagtacaggctatagggaagctattcccgaaggattcggtctccccataaatctgggcgcatcnggtcggggggactgccccgaaaaaaaaaaatcgattttttcaagtgtccgtttggggtactcaaacaattattggggagcaaaaatcccaacgcaggaattaaagtacagggctatagtgaaagctattcccggaagggattcggtctccccataaatctgggcgcatccggttcggggggactgcccccgaaaacaaaaaaacgattttt

SEQ ID NO: 58214 - DNA, 1420 bp, Heterodera glycines
  Genomic contig location: Contig_ID=SeqID_27521; Location=460..1879; Strand=+
  SCN-specific regions: Sequence locations=1-58,101-110,135-139,188 -691,718-1011,1045-1420
  Gene Ontology: Mol. function=plus-end-directed kinesin ATPase activity; Cellular component=plus-end kinesin complex; Biological process=vesicle-mediated transport
atgttaaggaaaaaattgacaaatcataaaatattcatcccacatagtaattatttggtttttattactattatttatttccaatccatttaaattctttgtttattgagttaattaaaaaaggatagtgagaagtgtctttaaaacccaattttaatttaatttaattccatttttccatcacacagtgcattttgcaaacagaaggttcatcggttccaaaagcattcacattcgatggcgtttatttcatcgattctactgcggaacagctttacaacgacattgtgtatccgctggtcgaagttggtgacaattggataatgtttaaaaattagttgatcatcttaaaatgataaattattttatccattgaaggtgtgaaaatggtttttttatttaaatttttccaaggtttttgctaattaaatgatccaataaaataagcataaattatagagcgtgatcgaaggctacaacggcacagtgttcgcctatggccaaacggggtccggcaaaaccttttccatgcagggcgaccaacaattggacgccgcacagcgcggcgtaattccgcgggcatttgagcacattttcgaggccattgccaccactgaacacaccaaattccttgtccatgtttcctatttggaagtcagtcacgaaacttcaaataattaataaccaaaataaatgaaaattttgaaaaaattttaagatttacaacgaggaaattcgcgatttgttgggcgacaaatgtcagaaattggatgtcaaagaacacccggaacaagtggatttgggggggggggtttgaatttattaatttttattccgactttaattcccatttagggcgtttacgtggccggcctttccctgcacgtgtgccatgacgtgagcgactgcgaacggctgatgacgaccgggttcaacaacagacacgtgggtgccacattgatgaacaaggactcgagcaggtgcgaagagtcggcgggacattttttagggaaaataaaaataattaataatatgtaaataaatgctttttgtaatttttagcaataaatcattttttattcgttaaggtctcactcaattttctcaatgtatgttgaagcattggatgagaatggaaacatccgaatgggaaaacttaatctcgtggatttggcgggcagcgaaagacaggcgaaaacgggcgccaccggcgaacggttcaaaggtgggaaaccaaaacaaataatgtgactaattaaaaggatcattagcataggataatttagaagcgaccaaaatcaatctgtcgttgtccgcattgggaaatgtgatttccgctgttggtggacggcaaatccacgcacattccctacagagactcgaagctgacccgtcttctgcaggtacagcaattagcaga

SEQ ID NO: 58215 - DNA, 2068 bp, Heterodera glycines
  Genomic contig location: Contig_ID=SeqID_653; Location=1163..3230; Strand=-
  SCN-specific regions: Sequence locations=1-384,409-468,491-561,583 -1060,1086-1293,1315-1399,1421-1776,1799-1962,1987-2068
atgatcacttggtctgtagcagatgggtttgaaccaatgagcgaatttgttgattggattttgggatttaaacgatttgaaacggttgcttttgctcattatggtggaaggttcgactcgcattttgtgttaaaagagctgactgaaagaggggtcgaaaccgagttgatgatggcagacctgaagatttatcaaatgaaagcgcgtggtgtgtattttcgggatttctggctgctcagccaaaacaagttggcagatcttccaaagactttgggtttgaaaaccttagcaaagttgtacttccctcataagtacaacaaaaatgtgaactttggaaaaaaattgacacacctaccaccccttgaagattattgtccggacaatatgaaggaggaggaatgtgctaaattggtaaaatggcacaatgaaaattatagaatggaatttgagctaggttagagaaaatctgttttccttttaaaattgaattttaggagagcagctcaaggtttattgcgaaaatgacgtcgaaattttgatggaggcaattttgaaattccggcaattgtttttggagattactgatgggatggatgtgttgaaggacagtgtaacaattgcgggggttgtgatgagaatttttcgaacaaaatttttgagagaaaatcatctcccaattattccggaaggcggttatgagagagccgagaatcagagcaaaattgccgtgaagtattttgaatggttggctcaaagcaaaagagtgagacttagacacgcatgcaatgggggtgaagtggaaatcgggggattaaaagtggattgtatcatcggagctgagaaaaaaatcattgaatttcaggtaggcagaatttccttccctattttattttttgctaaagggatgtgcgtttcatggatgtccaaaatgttttttgccctggaccataggacccaatgggcgttgtatggaagtaaatttccgacgaactgagacacgaatggagtttttgagggaaaaatgtaaaaacttctcggtggaggaagtttgggtgtgccaatttcaaattttattgattattgaacaaatttaggaatgcgatgtgaaagagaacttgaaaaaaaatagggagatgaagaggttctttgacgctgtgccggataagggtccaataaatccgagggatgcttacgcggggggacggacaatgcctttttgtttgtacgcaaaagcaaccgaagaagttgagatttcgatgttcgatatcataagcttgtatccgtttgtgaattatggtaaaaaatctgcttgcatttttgaaattttccttcgcttaagacaccccttatccggttggggtccctaaaattgtggtgagcagggaattcgatgtgaattggacggtgcccgacgatgtgccctatgatggcctgctaaaggtgaaggtcatccccccaaaggaactgctttatcctctcctccctatgcatattgataatatgcttctcttccccaattgttatacatgtgcgaaaaaaacgaagaaagagtttgtgttggctaaggatgtcaaaaaatgtaaccatcggccagagcggagagctttgattggtacattcacctcgatagaactgcggaaatccttggcgttgggatatagagtaataggcttctatcgggcctatcactttgagcaatttgacagtcagctgttcaaaggatatgtgcgcatgttcttgaaaataaaggtggaggcgtcgggctggccctcggaggtgagaaatgaggaggaaaagagagcattcattgaaatgtacaaggccaagtacaacatttggttggaatatgataaaatggtgtttaaccctgggctacgtatgatcgccaaattggtgagaaaaacaaataaaattcaaaaaacaaataaatattaagggattgaacagtttatgggggaaattttcaatgaggaacacactttctgtgactgagattgttaataatttggaaagatggacggagctcatcaaagatgacacgattgagtttaaagaccgattgagataa

SEQ ID NO: 58216 - DNA, 1703 bp, Heterodera glycines
  Genomic contig location: Contig_ID=SeqID_654; Location=432..2134; Strand=-
  SCN-specific regions: Sequence locations=1-151,173-322,344-403,425 -762,784-1573,1597-1703
atgcaacgcagccgacgtgacccaactccaccaacatctcccaaaagaatgagggccccaactccgcgaccaatcgttggactaccaattcctgttgtggagggtgagtttgtgctttgacaatgagagaaacggtttcatggttggccattttatcccccaaaaatttaggcaatcggccggcggaagatgtaagctcagacgatgacgacggtgacggcaatgccgcccaccaaaacattgtgcaaagacaggaactggacattggcgcacgagctgtccaacgtccaattgcccgggtgccgccggcatttcgtcaaggccctgttcgccgcccctttccaccacttctactgccacgtcaggtcagaaaccaaaggcttttgagctttctttgcccagattcacagctttgggtcttagggtccacaaatgccacatcgtgtattcccagtcccgcaccaccatgtccaacaccctcttctccacgtccgaccacttcctatgccccgtcaggtcgaaatcgaaatcgctttttttgctttgccacaaattgtcaaatttgggctttagggtccaccaatgccatacaacgccctccgtgccccacaacaccccatccggtttccaattgtgaatgttccgccacttccgctgccccctcaggttggatactgttttttgaccctattttgtgccaacatttctcaaacttttgagttcttagggacaaccaatgctgcgtaatgttgttcctgttcaccaccaccatcatccaatcaacggcctaccacttccactgccccatcaggtcaaaactcatgaccttttttcgccttttcttgaccaacatttcctatctttgatttgttaggggccactgttgttgcgtcatgttgttcctgttccacatcaccatgtccaacctccaccgaatggtctaccgcttccattgcctcatcaggtcaaaaaatgaccttttttcgccttctcttgaccaacatttcttatctttgatttgttaggggccaccgttgttgcgtcatgttgtacctgttccgcatcaccatgttcatcatccaatgaacggcctaccacttccactgccccatcaggtcaaaactttgaattcttttgacccaaatttctcatctttgatttgttaggggccaccgttggtgcgtcatgttgtacatgttccgcatcaccatcatccaatcaatggcctaccacttccactgccccatcaggtaaaaactcatgacctttttcgccttcttttgacccaaatttcaccgctttgagttcttaggggcaaccaatgttgcgtcatgttgtgcctgttcaacatcaccatcatccaatcaacggcctaccacttccgctgccccatcaggtcctaaacccgcagttttttctaagacaggagaaatttaggctcatcttgtgccgccccaaccatggcatttcccacctgtcatcgttcgcgtcccgcccgtcgcacaaaggaacgaagctcttcaagttcggaactttcaaacccaaaatcatcatcgtgaatttatttaggcgcctccaattgtcaatccgttggggcaaaatccacagcaaatgatccgttggccaagacaacaatggattgggagaccaattgaccccgctcacccccacattaatgagaaaacagatgcatttttaataaa

SEQ ID NO: 58217 - DNA, 643 bp, Heterodera glycines
  Genomic contig location: Contig_ID=SeqID_654; Location=3294..3936; Strand=+
  SCN-specific regions: Sequence locations=1-105,166-170,196-310,332-643
atggacgtaactcttcccgtcagcaactcggcaggtgaatggatcggagaggaacggagggatggtgttgtgctctatgcgccgtggacggacgagtggcatgtgcaacagcagcagcaacagcagcagcatcaacaacaacaacaccaacaacaacaacagcaaaacgaggtgcagcagcagcaacaacagcttgtccggcgaacaggcacggggtggacgcggtttccagcatggaacgaaccgctcgttgccaacgattggcgagagaaggaggaaaatctgatccaaaggaagagactacagcgtgaaaacccggagtattgggcgcaaatattggaggaggaaaagcgagccggtgaggagcgccgcttaagggatttgcggttagagcgcacatgggatggctacaaggaaggccacttcgagcgtcggcacaatgacggctcgttttttgaggccagaaaatttcttggttcaaatcgacagaatgactttttttcattttcagtttgttgctggggtcgggaagacagtggttggaagttctggaggagggctttggtgaatgatgttggcatgggattgaaagtgttaagattaactatgattggggatggtatttgacattaatcgctgataa

SEQ ID NO: 58218 - DNA, 741 bp, Heterodera glycines
  Genomic contig location: Contig_ID=SeqID_654; Location=5330..6070; Strand=+
  SCN-specific regions: Sequence locations=1-15,37-64,89-156,178 -334,372-468,562-563,714-719
atgggcgctacccctggggaggtgttggaggaagagaccgaaggtctggaggaggaggatgtgtgtaaaaaagggaaaccggaatcggcagatgcgggaccagaggtcgaacaattgaagaaaatgctacgtgacagtggccaaatgccgatggataatgccccactacccctaccccgctgggtgcggggtagtggggcatttaaaaaaaagtacaaaaaattgtacgacgcaatgactaataatatgggatgatgttgaatgtttatgtattgcttgttgttgcctaataaataataaaaaaatcaaaatcgaaaaaccaattagaatttaaagaaattgacagtattttgtattttccattgtttttctgtatggtgtgactcactgcccccccccacacccgccacaccaccgaaaccacacccattaccccacatttggatgatagacatttggaatagtgtgaaaataaaatgtaaataaaatttggtaaaaattgttatgatttataaattgaaaaataattattagggttaataaatgaataaaaaaatttttggtaaaaataaaatttaaaaaataaaaatgaaattgattaaacgaataaggttaaaattttgaaaattaaattggaaattaaatattaatttaattatagaaataaataaatatggaaaatggaaattaaaaattggaaacaattaagaatagcggattaattagaattttaaatataaa

SEQ ID NO: 58219 - DNA, 1386 bp, Heterodera glycines
  Genomic contig location: Contig_ID=SeqID_5484; Location=1821..3206; Strand=-
  SCN-specific regions: Sequence locations=1-91,113-412,437-484,508 -569,593-629,652-1306,1329-1386
gctgccaagcagtcttgggaggactatcggaagcgaaatgacagcatcattgttgacctgctccatggacaggtgtgtttaaaactaacgattatttatttatttttcaccattcttccccctccccccgaattccagcacaaatcgacgctcacatgcaatggtgagaattttatttggtaaaaaaaatatttcgtctaacatttttctccccccccccccattttccatggtaaagtgtgcagcaaaatcagcatcaagttcgagccgttctgcttcctgtccgtgccggtgccgaccaaggagcacaaggcccaatcgacgatcgtttttatgcgggccgagaaatgggcaaaggtacggtgcattgccatggcatacaaaatttgtcattttttggacaaaattcgttaataaagcgcattataaaatgaaatttttttccggcggcgcttattggcaccggccggggatcccctgttccacaaaaagttttttggaaaaaccgccgcaaaaaaaagtggtgtgaaaagcaaaaaaaaaggtcggtcgtcgcccggggggagatacccccccccccccccccccccccaagccgaaatcctgggaccgtctctggtgggggcggcaaaatctgttaaacaaacatagggttgatcgcgtgacgagaaaacagtcgggattgggtggtcgaaaatgcgatttaggttgagacggtcgaaaattttcgggaagaaatacatgacgtatttttttttttaaatggcattcattctcttttccctgcacagtttcacgtcacacacaccagcaaaacgacggctggccagctgaagcaaatgctgcgtgaagagttgcagttgccttccaacacacaggtgggcaagcagtgcatggtcagatttcttcatcggttagaaccctagcaaaaaaaaactcgtttttttgaaaaaatgttcaccggtccgagttcgacccccccccaaaaaaaaatgaataatttttccattcaattttgacagatgatcatttattcgacctacagtaaccgaatattgaaggacgacagcacattgtcctccacctacatgtacaattacagtatgaaactgtatgcctacgctgtgaagccgggccccgtcattttggtcagtctctctcttccatgaatcatatccatccatttttattaaattgcattcattagatttttattgatttcattgtcaggccatatttttttggcccaaaaagtgccaacagttctgacaattttttgggcatccaaatttgttgtatgtaaattggtttcataaaattgcccatttaaaattttgagatgcatcgatgccaactcgtacaaagaaagggcaacttgcacaataa

SEQ ID NO: 58220 - DNA, 594 bp, Heterodera glycines
  Genomic contig location: Contig_ID=SeqID_5485; Location=337..930; Strand=-
  SCN-specific regions: Sequence locations=1-36,115-132,155-237,344-594
atgaattcggaggaaaattttgaaaattgtcaaagccaagaacaccaacaaacagcaacaacaacaacgccaccaccatcctctcctgtgtacaacaacaataacaacgacgacggtggcattgatgacaatggtggcaccaccaccgccgccggcactgtcggtggcaacagcagcgagttgttggccgacaccagtgacattggcgacgacaatggcaccaccatggccaccgttggcagcagcagcggcagcagcaacgagatggtcagcaaccatggcggcggcggcgacgacgagttcagccgggacagtggcggcggcgccggtggaggcggcgacgattttgtcggcgccccgctcgatgaggaagggaacatgtacgggccatggccgaaggaggcgtacgaaggggaggaaaacagattgtcgtttgacggcggcaaacgggtgaaaacgtacgatcgcgagaatgtctatatgcggatggaggacaacaacaacgccgccgcgggcatggcgtcgtcgtcgtccaccagcagaaacagcgcgccacggccctactccactcgctactcgcaagcaatgctgtga

SEQ ID NO: 58221 - DNA, 483 bp, Heterodera glycines
  Genomic contig location: Contig_ID=SeqID_5486; Location=3118..3600; Strand=-
  SCN-specific regions: Sequence locations=1-54,76-92,114-483
atttcatcctcaaatgttttttacttattgttcaccttctcatttacattttacacaaaaaattcaccatattcattgcctgtcacattgattcaacaaaaagcaaagtaaaatttaccacttcttttgcatcacatttaaactgttgaagcgggtgtcaacaaaaccggccaattcagaatgggctacattctttttattccatcaaattcatgcaccgaattggtggctaaataaattgtctctttatcccatcctaactttttctctcgtcagatttgctggccacacacactgttgttcaagttcgagcttggcattaaggcggatgatgaccggcgccagtgctgtaaagtgcagagacggagttggccaagaccgccaatttcatcatgcgcctggaggcgcgcgtggatgacatttggcaacgcttttgcgccacatccatttgctcacaatcagcggcaacaagtacgacaacat

SEQ ID NO: 58222 - DNA, 60 bp, Heterodera glycines
  Genomic contig location: Contig_ID=SeqID_27522; Location=712..771; Strand=+
  SCN-specific regions: Sequence locations=1-60
ggaaaatattgatcatagtccccaaactcaaaaatgcttaaaaacggtcagaatcgatgt

SEQ ID NO: 58223 - DNA, 138 bp, Heterodera glycines
  Genomic contig location: Contig_ID=SeqID_27523; Location=1..138; Strand=+
  SCN-specific regions: Sequence locations=1-138
gtaaccctggcaccagcgggtctcacaagcgcttttaagtgaatttcgtagattcgatgatgtcataatttgttgattgatatgcaatagaaattattttattcgaaaataattattcatcttttttattaaatgaat

SEQ ID NO: 58224 - DNA, 1649 bp, Heterodera glycines
  Genomic contig location: Contig_ID=SeqID_27524; Location=157..1805; Strand=+
  SCN-specific regions: Sequence locations=1-62,84-178,209-321,344 -548,571-823,845-949,971-992,1015-1610,1633-1649
  Gene Ontology: Mol. function=receptor guanylate cyclase activity; Cellular component=integral to plasma membrane; Biological process =transport
tcttatcaatgaccgctggcaagtgaaaaatttcgtattttgggcttcgctggctcaaaaatgttcaaaaaattgaaacaaaaggtgaagcattgctccgaatgacttctcttaattgaataaatgcctttaagactttttgtggttgtcgcctgaacaattgcggaaaatgggcgacaacactaataataataataatgaccaacaaattgacggttccaaacaaccggacatttacacattggcattgattttcactgaagtataaattaaatgcattaaattttgggttcaatttcacctgcagaaggcggcaccatcggatcatttcatctttttaaaactaaaaaaacatttagatcgttttccatagaaaaattagtgtttacaaacatactttggacacttttgttttgctgtaccatataagatggaattgtgaagcctttatagagtattaattttaattattaatcactaattaatgggtatttgtatggagaaaaagaaaaaattattgtctaaagcaagcactaaattaatttcataataaatcatttgttaccttaattaactttgtgtcccaatttcggatggtgaatatgtgcccgtgttgggaggagagtgaccaatacggcgccaatgagcacggggaaaacgtgcggcgagcagcggatgaacacgcagcagcagcagcagcggtgttcaacaggcgcagggaaacagcgcagcagcacgcggcacgacagccgagggaacggaacgcggaggaaattgcttatttggtgaagcggggcggcactgtgccattgagaccgaccatacgccccgcgctggacgaactgaagcccgaattggtagggcgcggtggataaatgtaaatgtaaagttggaattggaattgcactaggaaattttttgggactgcttcatctcccattttttcgcttattttcattgtctctattttgaaatttttaattcgagattccaattgcttaaagaaatattattcaaatcagcttcatctgatccgcgattgttgggtggaggcgccgaatgaacggccaaccattgagaaagtgcggcaaaagttgcggcaaatgaatgccggcagaagcatcaatctgatggaccatgtgttcggcatgttggagcagtacgccaacaaattggaggaggatgtgcatgaacggacgcgcgagttggaggaagaaaagcgcaaatcggaaatactcctctaccgtatgatgccacggtaattaagtcaaaagtgattaaaaaaattcctttttttctcacgggccctctccctccctattacaaccccctgttttattgcccttactgtaaagccgatcaaaaaccaaaacgtaattaagccaagttgcggaccggcttaagcttggccagtcggttgagcccgagcatttcgagtgcgttacggtgttcttctcggacattgtcaaattcgcggaactgtccaaccaaatgcgaccgctgcaggtggtcaacctgatgaacgaactgtacaccatttttgacgcgatcatcgacgaacacgacatgtacaaagtggaatcaattggcgaggaatttttttaaaattaaaaacagacaaatgaaatgtttgaattttggggctaggc

SEQ ID NO: 58225 - DNA, 264 bp, Heterodera glycines
  Genomic contig location: Contig_ID=SeqID_27526; Location=537..800; Strand=-
  SCN-specific regions: Sequence locations=1-233,255-264
tccttcgtttggtgctcattcttttggccgtccccaccgttctgctcattatcattgtgatggtcggtttcatcagccacaaaaagaaacgtcgtaacgaattccatttggacaacggcgccgccaccatttgagaaaagagtgacgatacgataaaccattgaaaatttggtatttgtttttgaaaatttggtattttgtttttcttgcaatcgatcagcatattcccgtgtcttttctttatggataaattgtcgatctgaa

SEQ ID NO: 58226 - DNA, 718 bp, Heterodera glycines
  Genomic contig location: Contig_ID=SeqID_27530; Location=786..1503; Strand=-
  SCN-specific regions: Sequence locations=1-205,228-402,425-604,626 -630,652-655,677-683,705-718
atgggccaaaaatcgcgaaatatggacataaaattgcataaatatggacataaatttttccaaattaagggtataatttcccaaaatttcttcatatttgcttaaaaatttgaaaaaaaattgtataacaaatatttaagacacaatttaaacatatttagagagaaatgcctgttttgaacaatctttgtcctttttcgtccaattttcagcaaatatttttaggcttgcacctaaattcgatccctgttaaataattgctttaagaattttttaaaattagccattttcactaattaatttatttgaaattctgttattgcttcatccactttttcaggtgactttgtccgcttcttggcttcgctgcttctccccggtgatcgatcggatgctcagtgtggagatgagggagaagcagcagcgatcggtcactttgaacgaattgggcattgacatggaccaatttttggattttcttctgcacatttcgccaaatgctttgagccaaccaattcttcctaaccgtaaaaatttgaaaatttaaaaaaaactggaaaaaagagaacgtgctgagacgatcctaaaaaagtatcaatggggcgttcctaaaaaagtatcaatgtgggcgttcctaaaaaagtatcaatggggcgttcctaaaaaagtatcaatgtgggcgatcctaaaaaagtatcaatgataataattaattaaa

SEQ ID NO: 58227 - DNA, 229 bp, Heterodera glycines
  Genomic contig location: Contig_ID=SeqID_27530; Location=266..494; Strand=+
  SCN-specific regions: Sequence locations=1-67,95-229
gcgattttttgctgctttccgttgaagaattttccccaaaattcggggtgcatataagaacaagcagaaatgtaattttaaagggaaacattttggtggtttttgaatttggtggggaattgcaagcttttctcgggtatttaaacgaaattttttcatcaatttttcattaaattcttgaatttcatccatttctggctttttgtgttcccaggccgttcctctgcgg

SEQ ID NO: 58228 - DNA, 620 bp, Heterodera glycines
  Genomic contig location: Contig_ID=SeqID_5487; Location=901..1520; Strand=+
  SCN-specific regions: Sequence locations=1-13,35-282,304-620
atggcaaaaacggacgacggcaccaaacattcggagacgaagaagattttgacggccaatttttacacaaagtggagcgagaacgaggcaaaagacagaaagttccactggaaacttctgattacggtaagagaaaaaagacatacggtacgggacgaaagttcgcgagttttaaaaatggaaagtgtaaaatttggaaattaattttagttgtaacggtggaaagcaaacctttggacttacgcaaaatcgaccgaattctcgacaatttcgaagcgtaccaaaagaaaaggaaacaaattaccaatgatttgttacggcaaattgcagtgctcgaaaatgccaaccccaacaacgaagccaaagtttggttcagccgtctcagaattcaaacgttggccaatgcaaatgccatcgacacggcgatgattggcatcgaaatttcgttgataccattcaaaaatttgtggcaaaatgggaaaagtttgctgctcgagtcaaacgaatatttgaggttttgttttgccgtggttttttttatctcttccgaaaattttgacatattatcaaaagattaactcacaagcaaaaaaaaagggggaaagaatcatcggaattta

SEQ ID NO: 58229 - DNA, 593 bp, Heterodera glycines
  Genomic contig location: Contig_ID=SeqID_5487; Location=1875..2467; Strand=+
  SCN-specific regions: Sequence locations=1-191,228-264,287-593
atggtcaaagcattggtccaaatgaaggaagacataagcattgttatgaagcaatggattggggcgatgaagcgacaaatgttggcaaacggtggtgctaaatacgacatatcagtggacaatttgcttaacattgtcgaggtattaaaatgaacgattcgcattaagctcggcacatttgtcatccgagcaaaaaaaaatattatttttttaattttcattaaaatgccgtctaaaatggacgcggggtggtggtgattttcctaaaattattattttttaatcaaattacacacattgaagcgcaaattactgttcattataagcgtaatcaccataatttagagtttggtcgacattattgaagccaaacataagaatgtttctcgccatcgtcacatttccaatttgactttttccgttgcgtttttccgccaagtgattggccattgttcgccaccgctgactttggaaaatattccgatacgttcgaaacgtttgcaaataatttgcgaggcaattcgaaacttttgcaactcggcaatttacgaattgagccaatttttgtgtctctacggaagacgaaagtaaaa

SEQ ID NO: 58230 - DNA, 124 bp, Heterodera glycines
  Genomic contig location: Contig_ID=SeqID_5488; Location=282..405; Strand=-
  SCN-specific regions: Sequence locations=1-54,78-124
atgcggaagggattgtggaagaacagtcatcgacaattgatgaaggaatggcaccggaaagaggagggagaggaagcggagggcgaggatgaacagaaagcgggtcgacctgcacgagttggct

SEQ ID NO: 58231 - DNA, 182 bp, Heterodera glycines
  Genomic contig location: Contig_ID=SeqID_5488; Location=2244..2425; Strand=+
  SCN-specific regions: Sequence locations=1-34,57-182
atgctaaatcaacaaaatgtaagaagaagaaatgttttttaatattcacaaaagttgcttcttttcagaaggaagtcaaagtggcgatggttttgttcagcttaattcatttattcgcagctgcttttgactctcctcaatgcaatttgggcctcaaattattcagcatcgaaggcggaaag

SEQ ID NO: 58232 - DNA, 498 bp, Heterodera glycines
  Genomic contig location: Contig_ID=SeqID_5489; Location=79..576; Strand=+
  SCN-specific regions: Sequence locations=1-131,153-369,393-498
ctcccatttcatcgcttttcgcgggcgccgcacttttctgtcggggattgtcctatcggaacagagcattcttctccaatgctgcgcttcgttggccacctccgtggaattaggcaaattagcacaataaattaattacataaaaataatgattaatcgaagcaaacccattaaaattcgagcgataattaattatgataaatatttcaggcgatgaaaaggaaacgaagtgccattggagtgaggaaattgagactgtcgtcgaccggccgaatatgcgctttgagagagtgctgggcaaaacagaatattacagaagtgagtaaaattaaatttgcaaactacttattaataaaatgcaattacaatggaattaaattaatttttaaagatttgggcgcagtacgaaacggacggagttcgattaaactgcgcgtcgaagtgtgccgttacacttctgaaaggacattttgcgagagaaatgtgtgccaaaattag

SEQ ID NO: 58233 - DNA, 851 bp, Heterodera glycines
  Genomic contig location: Contig_ID=SeqID_5490; Location=61..911; Strand=+
  SCN-specific regions: Sequence locations=1-26,66-78,131-252,281 -288,329-413,435-555,577-851
atggggaaaagcgatgccaaaacatcggaaaaagaagacaaaagagagggaggagaaggcgaacaaagcgcgaaaaagtaattaaataattaaattaacagttatatttaaaaaataaaaaaataattaaggatgaaacaaacggaaccaattcaaccgacactcaaccatgaagcaacgattggcccacaacatttggccattcggcgaattcgctacccccaaatgatggagcagagaacgggcaaattcaattaattaattttataaaaattaaatagcttttcctattttgcctttttcaatttatcattccctttctcagctctttttcgtccctccgccgcttcgccgatgggtcggccgaagggaccgaagcgacacctttggcccgttttggccacaaattcgacaaaggtattttttgtatatttttggcattcctttaaatgagacaggaatttttaaggaactgattccagcaaatattgaccaaaaatggaacaatgccaaagaaaattggcgaggcgcctaccaaattcggagcggaaatgtggggaaaaattggcaaaatttgcgccaaacgaattactcatttatggacacaaaactaattcgacaacaaaaggtgaaaaatgcattaaaactaaagcaattaaaggttcaattttatcagcaaaatcccatcgcaattcgggcgctttccccgcgcagtcaaaacattcctccgacaactcgtcacgaattgcgcatcaaaaaattaagccgaaaagcaaattcgaatggaatacagacaaattcggcagttatgaaacagcagttgaaagctgaagaaagtcgagaaaaagtga

SEQ ID NO: 58234 - DNA, 212 bp, Heterodera glycines
  Genomic contig location: Contig_ID=SeqID_27536; Location=560..771; Strand=+
  SCN-specific regions: Sequence locations=1-46,69-212
atggctaatttagacaatttcgaaaataatacggtaattcattggtaaaatgttattttaaatttacagtaaattttcagttttatttgaccttcaaagatgcccatcccagcttgtcactgattggatgtgcaacaatttttggaatcaccgcttcatttggaatcctgtttcatttttcagtgatttttgtcacaatcaaaacaaagtga

SEQ ID NO: 58235 - DNA, 747 bp, Heterodera glycines
  misc_feature (686)..(686): n is a, c, g, or t
  Genomic contig location: Contig_ID=SeqID_27537; Location=186..932; Strand=+
  SCN-specific regions: Sequence locations=1-3,25-107,130-218,241 -367,418-462,516-605,633-747
  Gene Ontology: Mol. function=extracellular matrix structural constituent; Cellular component=extracellular; Biological process =cell proliferation
atgagtgatgatgatgatgacatgcgagcacaaaaagggacactaattattgatccaaaaagcccgtctcctatagcgacacccccagttccggcggttaaaccgctaacaacaacaacaacaacaacaccgactcctccagccgtaaaaccggtaacaacaacaacaccggccccccagtcgtctgcaaagccatcagcacaacagcaaaagccaacacctgtcctgccaaaaccatctgcccctcagacgtcagaaccaaaaatagcgacgacaacgacacctggccctccaaaaacagcaataacaaaacctacaacgctaccgccaccgtcatctcctccaacagttcctctacagcgaaagccaacaacaacaacaacccctcaaacatcaacaccaacaacaacagcaacaccgactcccacacaaccaataacaaccgtccatacaccgaaaaatacaaaaacaacaacaacaacaccgatccctcaaacaacaacaaaaaccacaacccaggtctctccaacgccaaaaataccatcgcctaagccgcctgctgttaaacttcctcctcccacttctacaacacatccgcctcagccagagccaacaacaacaacaactgctcctaccaaaactttcacttcctctcctacgacgggggctgttattggattaccttncaaagaaaaacaaattccgaccgtcgacgaacctgtctcggctgcgttaactctagaaaga

SEQ ID NO: 58236 - DNA, 877 bp, Heterodera glycines
  Genomic contig location: Contig_ID=SeqID_27538; Location=229..1105; Strand=-
  SCN-specific regions: Sequence locations=1-60,113-303,364-542,578 -647,669-735,757-814,836-877
atggcaaagggaaaaagaaagtggcacgcaagcgacgagcaattagcaggcaattagtattaaaataaaaagaaaattttctgtggaaataatttttaaatttgtttttcagtttcgtgccatcgcctcaatcgcttcatctttcacctcctcgcccatcagcagcagtaacagttgaagaacaagcaattatcatcccgtccaacaacatccagccatcagcaaaagctgcccattacaccattttcaacctgtacttcccgaaaaacccgaaattcaacgtgttcaggtattaatccaatcaaaaatataaaataattcaaattttgtttaatttatttaaattatcaaacaatttttttacaaaggtctgacaaggaattgggcgcttcttcagcagctgaagaaattgacacaatttcggacttattggaaatgtcaaaagcgaatcgaccggcagaaaaatcaggtgaacatttttaaaaaaatgaatttttccggtgcatttttttgcatttttatttgctgttttaaacattacgaaaattaaataatgagaaaaattttaattttaaatgtgttaagaaaaggcatctgccggtggtggaaaagatttagtggtaaatttatttcaataaatttttttatgtattttcttctcaaatttttaaggtcgacgaaattgctgacttgctaattgatgcgataaaagacttgtgaaggagaaaaagatttgatttgatgataataagcaaaaagcagtagaaaaaagcataaaccaaatattattactaattttctattttggttcgttgaaatttaaaatggtattctacattaaaaatgaaaaaatcttaaattggtttaaattaataaa

SEQ ID NO: 58237 - DNA, 413 bp, Heterodera glycines
  Genomic contig location: Contig_ID=SeqID_27539; Location=348..760; Strand=+
  SCN-specific regions: Sequence locations=1-413
atggcgtggaaagctggcatgcccgactgcagaagacttttgcctctccccatagcaaaaatgaacagacggtaaagaaagattttaaaaattttcattttccctattttccatgtttcagttggatttgtggcgacgtttggatggacattctgccatcttttgaccatgcccaactcggactcaaaatggcattgctttccgaccgtttcgacatcttagtggacaaacattttgatgggaaaacgacgaaattgacaattcggagaacaatcgaattgaaaaggaggaagggccaaaagcgaaaatatatgccaatggttatcgtgtgcaatttccgttccacgaccgtccgctgcccaacaaaatccgctttaatcacattcggattaagtaattcgaacattttgtaa

SEQ ID NO: 58238 - DNA, 1054 bp, Heterodera glycines
  Genomic contig location: Contig_ID=SeqID_27540; Location=894..1947; Strand=+
  SCN-specific regions: Sequence locations=1-511,533-635,675-680,703 -1015,1038-1054
atgtgccgggtccaagaatgggaacgactcaacgcgataagtgagcaaagcgtggacactgagttggcttcacgctttaaacggagcgcaaaaattgaccaataccaagtgagttggaggttgttccaatttggataggatatcaatttcttaattgtcacaatgattcgtcaagttgtgcattcaatgcggtttgtcagcatttgctgaacagtttggtctgacgccagaggaatttgcagaaaatatgactgaatatgttaaacatgaagtgcggcaagtagacaaattgccgaacgatgctgcgctggagttcgtcaaagagtatttaacacaatcgctttaccatgaaatcatttatttcacagggagtttcttcaatttccatcgcccgaaaaagtcatccaaggcgccatttatttgttagctcagcaattcagtagagaactagcggtgcgaaaaaaattacgacaaatttaccgacaaaatttactcatttctgttcatccgactctgaagggaaaggacgaaattgacgaaaatcattctctctatgggcgccattatattaaggacaagccggtgaaagagctaaaggatgacgagtacttgagcttcgttagggtttgtacaacaaaaaaattacaatattatttatttttattttttaattaggaaattcagaaacaaaaaatatagccccaaatatctttgagagaaaatcggaattttgaaattggttgggtaatcccgaccgtatgcttccataaaatgacattaatttgtcttttgataggctcaaaaggacggccttatcgaaatcgatttacacattacttcgaatgaggaatcggagaacaaatgtttgcgtgcgtgcatggaaaacgatggctgtgcgacttttaagcgtaacgaaaattcggaaattgtggaagaatggaacaaacttcggaaccttgttcttacgatttgcgtcaacaaaatgttaattcctgtgctcagaagggagtcgcatgaaaatttgattgaggaggccaaagaatttgtaattatg

SEQ ID NO: 58239 - DNA, 636 bp, Heterodera glycines
  Genomic contig location: Contig_ID=SeqID_5492; Location=283..918; Strand=+
  SCN-specific regions: Sequence locations=1-93,118-263,285-363,403 -560,590-592,635-636
atgggattgattatgagtcgctctcgttcccgttatcgttctcgtccgtctgctccgctcgccaaaccggcaatcgagatggtaagaaatatctttttattttattttttttatttactcctaaggtggaattttcgaacaaaagagatgttgttcgtcatcgtcgcaattttccggtaaaagatttgtgtgattttatctgattaaaattttaaccagccactggctattccccctcttcccaaaaaggaccataaaaccagcactgaagctggaaatagtgctggttttatcgaggacagttggatggctgaagttgtcaccaactgtgagcagcgtgctgctgatggtcaggtaaaccccaatttaaattaaatataaattttctttaataaaatttaagttcaaggctaatgcgaccatcgaaaaagaggtcgtcgatgacttgccggtgacgccgaatgacaatggaaaatacctcgacaaagaggtcgtcgatgacttgccggttaaaccgaaggataatggtaaatcccattatggtaagtgcctcccatttcatttatataataaagaatataaaatttttcagttttgaccaccatccctgaggaggaggaaaaggaaaaagaatga

SEQ ID NO: 58240 - DNA, 635 bp, Heterodera glycines
  Genomic contig location: Contig_ID=SeqID_5492; Location=1176..1810; Strand=-
  SCN-specific regions: Sequence locations=1-245,268-308,330-483,522-610
atgcctccaaataaccgtcgcttcaagggtattccgaagaaaagacaccaaataggaggagtcgcgcactggtccgcaggtaaggaatagagtcaaggtcaaaccttttagtctcacctttattcttttcattaatcacaattatcttagcccatcaccgatcagactctcggaccttttttatcaaacaccaccagaaacagcaccaaaagcgtcaaattatgctgttgcagcagcaacaacaaatccataaaaaagagatggaaattatgcaacagaagcaaatcgaatcgcttcaaaaagtgaagcatttggggaaactctacattgaagccctacatcaacacctacgcgtatgtgcagaacatcagcagaagcagcaacagtttcacgagcattcgttcaccacgacggaggagcttggcgaagccttctctcaaatggctgtaaacgcagacggaggactgatgtggtattttgtcgtattttaataattttttttcaataattattaattttttcgacattaaccatcaaatgggagctgaagaaatgtcgacttctgccgcttcgctcctgggaattccttacggggacactaattttggtgattaattttttattgacaaaataaa

SEQ ID NO: 58241 - DNA, 319 bp, Heterodera glycines
  Genomic contig location: Contig_ID=SeqID_5493; Location=18..336; Strand=-
  SCN-specific regions: Sequence locations=1-319
atgtcagagcaatttgtgcaacaccaaagacccgaggacggagtgaaagaagctaagaaaccacgagttgatgaccgtttcctttggaaaattacgaggggtcaatttatgttggcgattcgactctgctcaggttaaaaaaaattttagcttaatttattaatgtttttcagatgactgggacaaattatttcacaacaaggagaaggtacgccggctggatattggaagagtgggggttggtttcaagatgtgcgaaaaatggtgcaagattaactggatcacaaatgaacgatgccaaaaaacgaaggaaggatga

SEQ ID NO: 58242 - DNA, 599 bp, Heterodera glycines
  Genomic contig location: Contig_ID=SeqID_5493; Location=478..1076; Strand=+
  SCN-specific regions: Sequence locations=1-506,528-599
atggtcctcgtcatcgaattttgtgcccaaattctcggctgttccccgaaatcactccgcgacaagctgaatcatccggaggaccgggtgaaggcactgaaggagctgattggaaagaaggtccggacgacatacaaggatcggaatggaatgcagaaaacattttttatcgacggaatatcggaccaaggagcggctttgaccccgacgtatggcagactcagacaaccatacaacatcaacatagctgctcatttctacgctcgccaccgaatcaagctgcatctcccatacgtgccgtgtgttgttgagaaattttccggaagtggcgaagacagatactacccaatggaactaattgaaattgtggatgacgactacaaagagcgatggcttggcaaattgtttacggaaattgaggacgactcaattcatgtcaaacgatttggccgaattgaggaagccgaagaaattgacgacaacaatgatggtcgagatgaatgcagtcagtcagcatacatttattggtaagagacataaaattttactgtccttaattatgcacttttctacctaaaaatgacaagttcgtgcacata

SEQ ID NO: 58243 - DNA, 437 bp, Heterodera glycines
  Genomic contig location: Contig_ID=SeqID_5493; Location=1423..1859; Strand=-
  SCN-specific regions: Sequence locations=1-437
atgggctttaaacttcggcgaaatggacaggaagaatttgtgctgaagctgaggggcatcacactgaactacgacgtgatgcagaaccaatccctctgctatgacacattcaaagaagaagtgttgcggtacgccgaaacaggagagtatgagccaataaatgtgatttaccctaactttttgagacccgacattaggggtggcggacacgtcacttcaggccccctccaaaaatgttatcgacgatatgtaggtaaagggatagtgggccccaactataatgtgcttaatttcggtcacactttgtaattatttgttaaccattcattgtatctctctcacacacacacacacgtatccacacatgtacccctttattttctctattttatacctcaaattgtgttattttgtcatttttttgcgtttttaataaa

SEQ ID NO: 58244 - DNA, 397 bp, Heterodera glycines
  Genomic contig location: Contig_ID=SeqID_5494; Location=67..463; Strand=+
  SCN-specific regions: Sequence locations=1-28,50-257,279-293,316 -343,366-397
atgacccaagccaggaaagtaagcgaaaatttttaaatttttaatgacaacacaaaatttttagtcaattgccattgggaatttgtttgggcttctgcttgattttgcaaccagctcgccaactccttgggtgatgaaacggccaatatgctgcggaatattctaccgtcaacacatgccgctttctgctatttgataaaaaactaaaaaaaaatgatgcagacattaccatagattaaaaatttctcgctaaattgattttttgttttaaatattatgacaaacatttcttgtaatataatttttttttaatttccaaatatcaacattacttattttcaatttttctatgtttatttctttttcattgataaacaatctttttcggaaaaattca

SEQ ID NO: 58245 - DNA, 595 bp, Heterodera glycines
  Genomic contig location: Contig_ID=SeqID_5494; Location=537..1131; Strand=-
  SCN-specific regions: Sequence locations=1-56,78-254,281-336,358 -551,573-595
atggatataaagccaactactggacagtttcaacgatcagtatgttttgagtttgtggaaaagcacagaaaagaaagcgcgactttcagtggaggcacatttgtttggtgttcaaactactcgggctgagactttcaactttatggtagaccatttatcctttttagctagggttggtcgggaccgggaatcttgggcaaaaccaggaccgggacttttcggattgaaaaaccgggtctttttggctgggaaaaccggaaaaaacccgggaatttcccggtaccggtcaaaactgttcaaaaccgggacttcggtactcagttgtactcaattgcaataatgatttatattaaggtttttaaatgtgttagatagagttgtattttttcgttgtatcatttcaaatcacgcgggttatctttgaatttttcgaattgtattaataaattatgatgaataatgcttataaatgtttgtttacttttaaagtataatttagaaaaaacttatttcataaacttgcagaagccgactttcgaaactgatcattttgaataaataattgttaaaaacaaaaatatttaccgaaaataaa

SEQ ID NO: 58246 - DNA, 1132 bp, Heterodera glycines
  Genomic contig location: Contig_ID=SeqID_5494; Location=1177..2308; Strand=+
  SCN-specific regions: Sequence locations=1-14,37-41,63-78,107-174,227- 273,379-481,588-747,798-813,841-1132
atgcttatattagttctcttttttataattttgatgttagaaataagatgcaattattaaatatttgcaattttcatctatttatttatttattacaatattttatcatctcgttgactcgctgtcatcgtttttagcataatcgagctcctttttagcccatagtgtcacatgaatttttgatattttatttcatttcattattttaattaaagtaaaataaattgtaatgggaaccgaaaaaacaaaaaccaactttaaattggaacattcattaaatttcaaaaattattaaaatattttgaggttttgtttaaattattctgatattatttatcattttttcaaattttagaataatatttctaatttattttactgaataatcgtttttttcagctgtgttctcttccaacaggttgattataataatgtgggtttcgacctcgataactgattttaccatactataaatagtcagtaatttactaataatttaattaacacaacattttattatatttattgcttaataaattaattactttaatttttaatcatttttcatatttacattatttattaaacatttcgaaattttagttacaatattcttttctaaaacataacaatcgaatatgcgaactcgttgcaagcgctgctggttctccctacaactttagagcccttcatttggtcctatttgaggtcaaacaactctccccagaatttcgatgaatccatcacatatttatttaaatttttaaatttattattttattatgtttattatttaagctattaatcacttcttgttagttttttaagattttaaaatttatcattgttattaaattgtttctaagaaaaatttcaaaatttttgttttttacaaatctttttaattggcagtttaaattgtggaaatttcataattgagttctataatgttacaatcacagatgatgtgttgcttatcaattttttcagctttcgcattcataggtttcatattcatacagaaaatgctcaatgtcaatttttatgttatattaattcgattattttataagaacaggtcagaggtcaagaatatttccttatatttttatttcgaatttttttatgtgaa

SEQ ID NO: 58247 - DNA, 234 bp, Heterodera glycines
  Genomic contig location: Contig_ID=SeqID_27542; Location=297..530; Strand=-
  SCN-specific regions: Sequence locations=1-55,78-234
atgcgcattgataagcaatttttgataatacgaataagacaagaacaatgtcataaaaatataaaggaacaaagaaacaatgaaaaacagaaattaaacggagaatggagtatcggtatcagtgaaacaaaaaaagaaagatcgacaaaacatcagagaacacaacaacattttgatcggtcaaatatcaatcacaagtccgcggactttctgtctcaaatcagtccgtccgtg

SEQ ID NO: 58248 - DNA, 748 bp, Heterodera glycines
  Genomic contig location: Contig_ID=SeqID_27542; Location=705..1452; Strand=+
  SCN-specific regions: Sequence locations=1-245,267-748
atgaacgaactttccacgctcgcttggtacccggctgccgaatttttggaatttgaacgaatcaacaaagcgtattcgttcaacgtcccagccttttctgtggacacttcgacaacggatgggccgaagtacacacaaattatgaacgcactgtcggaacaattgcaacagcacgtggccaaggcgaatttgctgatttctctcaacgagaaaatcccacaattcgatgttgaagttgaggtcggttttaaaaccgaaaattgaaatgtaggattttatgagatgacggacagataacgaaactaaaatcaaacattaaaaataatataaaactgttttaaacgcgttttccctttatttcgagcattttttgagtttcaaaaagcatttgcgcaaatgtcaacaaaaaccttttgttaaggaaatgatgcgcattgcaattggccgtacgcaattgctgctgaacaaacggatgaagcaatttcgggaacatttgagccgtcatttggtacgaaaagagagagcgacggcatttacggcacgacaaattgaattgtcatttttacagaaaccaattcctggccaaaaagtgaccaaattgaacgatttgcacgctctttgggtgcttatcgacatgcaattggatgacatccgatccattttcaactccatcgagcagttccgtcttcgctgttgggctgtcgctgaaccaaaggccgccgcgactgccgcttcttctggcaattaa

SEQ ID NO: 58249 - DNA, 103 bp, Heterodera glycines
  Genomic contig location: Contig_ID=SeqID_27544; Location=1356..1458; Strand=-
  SCN-specific regions: Sequence locations=1-2
atgatgagggggaggagggagggaaaaggaagggcacggcacagcggaggaaacggaggaggacgagcagaacaagcaaatgttgaaggaggaggaggaggaa

SEQ ID NO: 58250 - DNA, 881 bp, Heterodera glycines
  Genomic contig location: Contig_ID=SeqID_27546; Location=637..1517; Strand=+
  SCN-specific regions: Sequence locations=1-118,293-577,755-881
atggctatggctctggtggctatggctctggtggctatggctctggtggctatggctctggtggctatggctctggtggctatggctctggtggctatggctctggtggctatggctctggtggctatggctctggtggctatggctctggtggctatggctctggtggctatggctctggtggctatggctctggtggttatggctctggtggctatggctctggtggctatggctctggtggctatggatatggtggctatggccacggcggtggaataggcggtggtagaatgggcatgggcagcggcagcgggatgggcatgggcagcggcagcggaatgggcagcggcagcggcagcggaatgggcagcggcagcggaatgggcatgggcagcggcagcggaatgggcagcggaatgggcatgggcagcggcagcggaatgggcagcggcagcggcatgggcagcggcagcggaatgggcagcggaatgggcatgggcagcggcagcggaatgggcagcggcagcggaatgggcatgggcagcggcagcggaatgggcagcgtcagcggaatgggcatgggcagcggcagcggaatgggcagcggcagcggaatgggcatgggcagcggcagcggaatgggcatgggcagcggcagcggaatgggtatggggggcggcagcggcagcggaatgggcatgggcagcggcagcggcagcggcagcggaatgggcatgggcagcggcagcggaatgggcatgggcagcggcagcggaatgggcatgggtggacgctgatccgcgaagtgatgaaaaaaagattatttaaaatgacccaacattttttcatcgtatttaatggatcaaaaaaacccaaaa

SEQ ID NO: 58251 - DNA, 369 bp, Heterodera glycines
  Genomic contig location: Contig_ID=SeqID_5495; Location=294..662; Strand=+
  SCN-specific regions: Sequence locations=1-369
atgtctaataagcaacaaaaggttggttttgagtttaaatgttgccatcggtgccttcttaacacaaattctttcagaacgcaaactttggacagagatggcaacttgaatcgaatacgtccggaagtgattcgaagacctttctttgggggcagccacctgattttggatttactgccaagactcggaatgatttggtcgggcctcttccgccctcacaaggcgtcagtccgtcgaaaaaaaagccgagttcaaagagtcgtgtagacgcattccgtcccccgtgggaggacagttcggaggaagaaaaggagggcaccgcgacagagggaaagggcacggaggaaaagcgctgggacatggaagaga

SEQ ID NO: 58252 - DNA, 354 bp, Heterodera glycines
  Genomic contig location: Contig_ID=SeqID_5496; Location=360..713; Strand=+
  SCN-specific regions: Sequence locations=1-354
gaccaccccgatttggcggcggcctttcgaattgcttccgagacgtactcccacgggtacaacactgccaacgcgtcaaaggcgttggaccgattcgtcaagcgcaaattgctttgcgtcgagcaaatgcaatgtttggcgaaggaggcgcctacggcttggaattcgacggtgcaaatttgcagaaaattcatcacagtgccgtcaatcggcgtacaaaacaccaaattcgaagggcacggggcgacgctcaaagaagcggtggacaattgcgacttggccattctgtacgaactgttcgactttgacgtgatcaaggaggccaacgtggagataaacaacatgcaacgaaag

SEQ ID NO: 58253 - DNA, 537 bp, Heterodera glycines
  Genomic contig location: Contig_ID=SeqID_5497; Location=1948..2484; Strand=-
  SCN-specific regions: Sequence locations=1-69,91-151,181-537
  Gene Ontology: Mol. function=protein binding; Cellular component =nucleoplasm; Biological process=skeletal development
ttttgttcagttgcatttgatttttggggagtatcagaagggtcatcggtcatcccattgagcaggcaattcagcaacagttcagcggagacacgagggacgggtcggtttatttggggggaaaaggggggggggggaggcggataatggcaaaaagaggaaaagaaggaaggggaggcagtggacaatggcaaattcaaacgatttgccttgcttcagttatttggcggtggtggaatgtgtgcacaatcggcacgccttcttcgccaaagtgctccaaaactcgaccaaaagcttcctcggcattggcaggcgcgactcggacttgatccgactgattgtcactcgtgccgagtgcgatatggtcgagatcaaagtgagtgaaaaggacaaacgatggatttaatcgatcctctgctaattggcctggtttaggagcagttcatgcaaatgttcaacactccgctggagaaggccatcgaaagcaactgttccgggccgtacaaagacggacttttgactctggtcaaagggaat

SEQ ID NO: 58254 - DNA, 1644 bp, Heterodera glycines
  Genomic contig location: Contig_ID=SeqID_5499; Location=1..1644; Strand=-
  SCN-specific regions: Sequence locations=1-1578,1600-1644
atggacaaaactctcgccgatattttggaaaaactcacccaggcaataaagcaacaaaaggcgccctccacaacacaaacagcacagaacatcacattacctgacattcagacattttctccgaacagtgctgaagaattcgaggagtggctggaacgtttccaatttgctttggattgtgctgcctcaaatttggacgatgaacagaaggtcaaattgttgatgaccaaattgtctccgacggcgttcagcgagtacaagcgcttttgtctaccggacgaaatcacgaaattcaattttgcggacacaaaatcccgactgctaaaattattctcgcatccgccatcattggcaatcgaccgatacgaatgtcttaaggcatgcagagacgatggcgaagaatttggcgcgtttgtgaaccgtttaaaggcgctgcttcgaaaatttcgctactcagaattaaatgaggagcaatttaagtgcctggttcttctgacttcactcaaatcctcgagtgatgccaaattacgacaacacattcttgcccgtctaactgtcgaagatgcgaaggtcaacaaaacggccaagttgtttgattcggttgttgatgatttgaatacagtgcttaaaactgaagcggaggcaaaatttttggaacagccgaagcttaaaataaatgcagtgcagcacactaaatcatcaccgacaaaacaacaaaatcaaacaaatttcagtcgatcacacaaaatttcaagcacatcaaaacgcaaaaatcctccgaacaattgcttccgttgcggagagcttcactgggcccaaaattgcccaaagaagaataatgtgtgcagaaaatgccagaggagcgggcacatcgagcgacagtgtgacaaaattcaggcatatcacaaaaataagaggagccaaaatccaaaagtgaatattgtgatgttgcccgacactttcatcaattccgttcaatcggcgggtctaatgaatgcaccaattttaatgaacgacaaatcaatcgatttcgttttggacagcggcacagaaataattgtcgtcaccaatcagacgtacaatgatattggacgaccaccaattcaggcgtgtcaggaagaagggagattttttgacggcacgcgctgcaaattccttggccgcggtgttgccaacttccaattcaacggaatccgaacggagctaccatattatgtggccaaaagtggaacaattaatcttttgggcctgactgctttggaccgttttggatttctggaagaaatgaagcggctgatcggcaccaaaaatattaatcagatttggtccactgattcaacaaaaattcgggacacaattgcaaattttgagaacaaatataagcaaattttctctgagggccttggactctgcaccaaaatgaagggccaattgatgctcaaatccggcgcaaatcctatttttaaacgcgcccgtcctgttccttacgcaactctgccgacaataaatgccgaaatggatcgattggagaaattaaaagttatcaccccggttgatcataccgattggtcagcacccattttggtggtcaaaaaggcaaatgagaacagcaagattatgcgcagatttttccaccgggcttaa

SEQ ID NO: 58255 - DNA, 1282 bp, Heterodera glycines
  misc_feature (1217)..(1217): n is a, c, g, or t
  misc_feature (1226)..(1227): n is a, c, g, or t
  misc_feature (1241)..(1241): n is a, c, g, or t
  misc_feature (1268)..(1268): n is a, c, g, or t
  Genomic contig location: Contig_ID=SeqID_27554; Location=186..1467; Strand=+
  SCN-specific regions: Sequence locations=1-62,86-317,339-1092,1120 -1282
atgtggaaaacatttttgattacctacctatgtgaccaatttgattatggttttctatgttcacatacatatatgtgtatgtattcccataaaattggtaagtcttctaggaccccaagggcgtggccaataccttcacttccggatcgggccagtatcgtctgtccagttgcgtctgagccaagtttagaccaccataacttttttctttgttgaccaaatccaacagttggtatcattcgaaagctcttaacaagctctatcggctatacaaaaatcaaaaagacattacgacatataaataagttataacattaaaatatgcaaaaattaaatcttgttgccaatgatctaggcgattgccccctacgtgctctaatttagacaattttgaaaaaatttcataaaaatgcgaaaaaacagacatcgatcgcgatgttcttttttggatttgtgtaaaaaaatgcaggtatatgaaaaacacagttgccaggttactctttttttcactatatagtattctaaaagagaacatagagctgtattaattagataaactcttttccgaagggaaaattttgaaatttacaaaaaaatcaaatttccgattaacttttgacgtccaatcaatgaccatcctgtttttggccataactttttgttactttgtcaaaataaacattcttggtatcaaactaaagcttagaagaaagcaaaagttggcacaagaaagcagtcacaatgagaaaacaccaaagtgcgcgaaaagccattttttgtatgcgacaaagtaaaatcaccttcaaaattgagatttaagttaaaaaaataggggaaaatataacaacaaaaaaacggcttaataaccatagagttcttagagtttacaacttgcgaaaaattgaagggaaacacaaatttttcatttttgtttctggattttttttaattgggcaaaatgccaaaataaaataaaactaaaatttttgaatttttagaacgcaaaaaggaaaaccgtaaagcagagaattaggaaaggtggccaaacatgaacaatcgcttctagggattgcatttcatcaatattgaacaaaattggacatattttttaaaattttaaacggcataaattagacattttttaaccacatgattttctgcctgcctacttaagttaatgtcaattaacattttaattaatgatcaaatgtatttgntggcgttgnntgtgggcgctcttnttaaaaacagtaattaccataaaactntgaaaaatcgctaa

SEQ ID NO: 58256 - DNA, 140 bp, Heterodera glycines
  Genomic contig location: Contig_ID=SeqID_27555; Location=111..250; Strand=-
  SCN-specific regions: Sequence locations=1-19
atgaccagacaaaagcagagaaagaaagggccaacaaacgcacggattaataacggaacgaatcagcggaaggccaaaggaaaagccgacataaccgaacgaagaacggacaaacggacgaaaatcggacgaagaacgaa

SEQ ID NO: 58257 - DNA, 653 bp, Heterodera glycines
  Genomic contig location: Contig_ID=SeqID_27556; Location=247..899; Strand=+
  SCN-specific regions: Sequence locations=1-478,500-516,550-653
atgccgaaggttgtgctggttgtcgacgaagggtatttccacgccgtacatcacaaccagctgaggcctctcactgaagtcagttaaagccttcacagcaaattcaaacaaaatcattttagacagtgaccgctttcaacaaaatttttctggcaaaatgtaaggtaaagcgtgttaatttttatggacctgcagattgtgaacatttagcttgaaatcggcacggatggccaaggccgtggttggagtgcggaggtgcagcactttgtcagcgagtcattgcggaaggtggccatgcgaagtgattgccgggtggagttgctgctgcaaaagggtggaagttggcaatacgcggagggagggaagattccgacatgtacagcgaaattgctaatcgacggtgccgattttgcagcacaaatggcactgatgggaattggccattcgaaagcaatggaatgaaaacgcaaaacgaacgacgaaaagcattggggaaaaacaatttataataatccaacttaattaaattacattttattttgtgataaatgtgtataatcgcattctaatcacattcgaatgtgtgcaactcgaggcccagtgacggaacggatggctttttggatggtccgtctctcagctggttgaaaata

SEQ ID NO: 58258 - DNA, 656 bp, Heterodera glycines
  Genomic contig location: Contig_ID=SeqID_27559; Location=343..998; Strand=-
  SCN-specific regions: Sequence locations=1-432,454-656
gtttccggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttctgggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttt

SEQ ID NO: 58259 - DNA, 966 bp, Heterodera glycines
  Genomic contig location: Contig_ID=SeqID_27560; Location=125..1090; Strand=+
  SCN-specific regions: Sequence locations=1-966
atggaattcattgtgaaagcgatgcccatcgtaacgctgaattcgatggatgaagcggaattaagcaagaaaaaactttcccttccatcgcggccaagacagccagacattctgttgggaatggatgtcagacatgacctgaaaataagagacgagacagaaaagttgccaagtggattcacattgtcaacgtctcgagtcgggcggatgataagtggttatggccaagtccagggcccaatggacatgagtgtgcaagtgacgtacactggagcactcataagtgccttacaatgtgccaatagcagaagagatgctgacgaagaaattgaagaacagataaagacatttttcgggctgaacataatcggattgagcgacaatcctgaagaagaggacaagggagaagtgatgagaacgttcagaaaaggcttgacattcaaagaaggaagatatgaatgtggcctaccatggaacgaaagagtaaaggatttgccgacaaattttcaacaagcgagggcaagactttgtggcacagtgaagaaattgcgagaattgaatttggtggaagaataccaaaaaattttcaatgagtgggagaggaacgggataatcgaaagagtgccggatccaacacaaacaactggaccggtacattatctcccacatcggcccgtgataaaaatggacaaggccacgacaaaaataagaattgtgatggatgcatccgcgaagccagcaaaccgcaaaggagccccatcgttgaacgaatgcttgcacacagggccgttgttgctaaacgaattgaccgggatccttctaagatggagaagaatgaaggatctaatcctggcggacatcgaaaaagccttcctccaattatcagtgagagaggaggacagagacgcgaccagatttctgtggctggaggatccacaaaagacagaaatttcaagcccaacatat

SEQ ID NO: 58260 - DNA, 3949 bp, Heterodera glycines
  Genomic contig location: Contig_ID=SeqID_5500; Location=408..4356; Strand=+
  SCN-specific regions: Sequence locations=1-298,343-353,376-457,486 -804,826-991,1013-1382,1404-1630,1662-1822,1844-1871,1893-2224,2246 -2315,2337-2458,2483-2578,2600-2758,2780-2942,2964-3670,3693-3949
  Gene Ontology: Mol. function=translation elongation factor activity; Cellular component=mitochondrial ribosome; Biological process =gametogenesis
atgatcaccggcgcagcacaaatggagggcaccattttggtggtggccatcactgatggaccaatgccacaggtaaaagagggaaaaggggacggacagaacggaacgagtggcaaattggcaaggaatggataacatggggagagagaggtgttgtgacgggagcagtaggttcggttcccccccccccgcccgtatcagtccgcccccaagaaatttttgtttttttctttattaacttggtaatttaaaaaaaaattgttgaaatttttttcttggaatttccgtataagaaaacattaaatttttataagttaattaattttaaaaaaataaaattttctcggatgtgtgggggaaattgcggtggtttttatgtcaatacacgtccggctcgtttccataattgtaagaggatggatcctcccgtttcgtttcggctttcaggggcataacaaattccacacccacccaccctacccacattcaaaattattttgacacagaatttttaatgttttggcggcatattaaaatgcaaaaacatttctcttctattttgtagacccgtgaacatttgctgttggcacgtcagtgtggcattccgcaggagaacatttgcgtgtttctgaacaaagtggacgaagtcagcgacgccgagacgcgcgaattggtcgaaatggaggtttgacgtatttgttacaaaacttgtacattcaatcactcccatttgtcaggtgcgcgaactgctcaacgagttcggctacccgggtgacacggctccgatcattgcaggttcggcactgtgcgccttggagggcacaaagccggagcttggggaggagtcggtgaagcaactgttggacacaatagacaacttttcgatcccaaagcgaacaaaagaggacgagccatggatgccggcggagaaagtatacacaatcaaaggtgaaaatcggggggaaagtggggaggagagagcaattttccattttaaaataaaaaggattgaaatgcccgtccatctttcgcattttaggccgtggtacggtgatcaccggcaaattggagcagggcactctgaaaaagaacgacaaagtgaccattgttggactgggcaaaaaattggacaccacaatcgccggtaaacccaatggtttactctcgtattttaaattcataattttgtttataggcttggaaacattccgcaaaacagttgatcaggcggagcccggagaccaattgggtgagtgatttaacgaacaattgacacatttaagtaattaatttaaaaaaaactgaaataccggagtaggtcgtttccaaaaaattttattgaaatttcaaagatttggaaaaaattttaaatctccaatatttttgcccgttccttccacccgtttttgttcaggagttctcctcaagggccttggtccgaaggacgtgcgcaggggaagtgtgctgctcaaacagggccaagacgcacattttacggacaaagttcgagcgcaggtgagcgaaatacaatggccgtttttctagaccacggtttcttaaacatttttttagtttaactgctaacaataagttctttatcggcaccgccgggcttctcccccccccccctcaattccccaaaattttttttgtgaaaaaccgcgccgaaaaagtctgaatagcaaaaaaaaaacagcagaagaaaaaattagaccttcgtatgaaaatcggccccgaggtttttatgtttttttaaattacgaaattttcaaaagctgattttcctgtcatcaaaaaatttcatgtcattctgttaatgattaagaaaatcagcatttttaaatattttaactcattgggttttcattgtttgctaacaataaacaaaacacacgctttcacagatttacttgctgaaaccggaggagggcggctccaaaatgccgttggcccacatgttcaaggagcacatgttttcattgacatgggactcggcggccaccgttatgttgcagggccgtgacttcgtcatgccgggcgaggtgggaattgtctggcaaattggtcaccgcatttaaaagaggggctatttaaaaaaattttcttcaattgcttattatagtaatattattttcattgtttcccttccccctttagactgttgagctcgagtttctgttcaagtactgtttggcggagtgttcaaatgcacccatttcctcttccaccccctttttaaagcactccccaatttgttcgtccccaacagcgtttcactctccgccatgacaaaaccacaagttggttttgtatatttgttatgaaatgggcagttgcctcgaaaaaacgaaaattcaattccaattgccgattaattaatataattaattgattgaattctttgtgtgtgtattgtgtagcacttttccgttttcagtcgcctgcggcgtctttttggaggctcttcccgagtcggagggcgaaattcgcgacaaaaagtggaggaaaatgcaaatgcgaggagtgatggaaagtaaggccttttgaaaatcaaaaattgtttatttgtgttcggtcctttccttttcatcgtatttctgttttctcatttttcaggggttggtttcaatccgttcggcaaccgatcgtttgagcgagcgtgcaaagtgagttttattcgctgcccaatttcattcattttaaccaggcacataagcagagggatatggcagttctcctcccccacaaattttttcggaaatgtttaattttaattttcagcaattttaccctacattttccctggcgttgcctaacatcactgccggatcccaattttcttatatttgtgtcatacattaacaaggggtgcgtcggcgcacccccccccccccacgtgcgtcgtaagggggcggctgtaaaggaggggaggaggtcgtaacgaagggggaaaaagttaaaatttgaacaatttccgtagtgaaacccatagaaaattcaacaaaattttcccggcggcgcctatcggcaccgccggaccgccccaccccttcccacgaagttttttggaaaaaacgcgccgcaaaaaggtttgaatagcaacaacaacaaaaaaaggtcgccggggaaaaatagggaccgacgtaagaaaaagttggtcctggcgcacccccctgcgccaaacgtccgacgtatgggggtctgactggcgcaccccttgttactgtatgatttgtgttaaaattttgtttcgaaatggctacaaatttcccctttctcacaaagccagaaacttttgaaattaatccctccccctttcgctttcagcctgactataccaattcgccgaaggacaacccggccgaggcattgttcaaagccgaggcaaaagcctagaaagaactttagcgaggggatgactttagatgaaggatttgttttttcattaattaaatcactcatttccgtttcatttatttggcgttctgtttttattccatgataaattcctctttaccaatcattgcttttgctgattccctctatagtaagattctcccccccccccctaactcacttctgagcaaatttaagactttttagagagtgttacgggcgacagttgggtctatcgacgcataatcttaagtgctataaaggaaaaacacgggttttcctaaatgtttagaactgttcgaaaaactaaccaaaaatcgcactttttttgtatgacctatttttgaacggtttttcataccttaaaaaattcaaatcaaaaatcgaaacaatttcgcatgctatacaaagtgttggctttcagatgataccacatctttttaaatttcttttttccctttttcgggattatcgtgccttaaatgccttttttggcatttttccattttggtgttatttttggcgtttttacgaaaaatccattaaaaatgca

SEQ ID NO: 58261 - DNA, 1184 bp, Heterodera glycines
  Genomic contig location: Contig_ID=SeqID_5500; Location=5131..6314; Strand=+
  SCN-specific regions: Sequence locations=1-160,182-203,225-233,256 -573,595-914,937-956,978-1184
atgaaattgcttatttttgatgattacgaggcgatgagcgctttcggcgcccaattggtcgctcgaaggataaacaacgctttggaacaacgaaaagtcactgccggcgcagcgaatgtgccaaatgggcgctctctgtactcagttggccttcccaccggtgggaaaaaatttggctttctgagaggccattagcgctactgcaatgcataataatcagaaatttctgactatgaaaagcctaaaattgtcattttttggacaaccgccgagaaatccaaaaagatgcattttttctggctgttcttttgtgtaattggtctttttaatcacttcctgattactttttcaatctgatcatttgctctcaatagaaatcatctctgattatttgtcggtcttgtgccattgttgaccgatttttgccatttcgttttcgactaaaccgtcacacgaattgctactctttctgatcagtttttccgatcatttttcaggtggcacccctctgggcttgtactgtaagctgacagagatgcacaaggctggccaagtgtcgtttgccaatgttgtcaccttcaacatggacgagtaggaaaaaacgggcgcattattagtgccactttgcgtgatctaattcaaaccgaaccagcagcagcagttaaatctgctgatcggttttcgaggcgccatttgattttttgatcagagtccaaatccggcactattccaacagttgaaatatattaaccgattttaaatgaattctttagtcatgaattgatagaaaatgtcttttttgcttatcctaagatatgttggcattccgcgcaaccatccgcacagttaccacacattcatgttctccaatttcttccggtgagtacatattttgaaaggatagaaacattttgaagggaaaaatggatgaaaaatccttctaaaaagtgccaaagttgaagaattaccttatttgcctctgatcaattattcactgatcgcccccaattttccctttaggcacattgacatcgatccgtccaatgtttggtttttgtccctccgccactaattttgtgcccccccctcccctcaaaaggtgcatattccgaatggaaacgccgccgatctgaccgcggaatgcgcaaactacgagtaagaaaggcgacacgatttgctgttca

SEQ ID NO: 58262 - DNA, 1017 bp, Heterodera glycines
  Genomic contig location: Contig_ID=SeqID_27562; Location=333..1349; Strand=+
  SCN-specific regions: Sequence locations=1-57,166-382,404-576,632 -941,963-974,996-1017
atgtgctggtcaacgaatatttgcctggacaaggcattatggcgagttattgttgccaaaaatataaatgtattaatataatttttcaattatttttaaaattaaattagtaaaaaaaaattttccattatttttaatattaattaattttattattattattttcagcctcacacggatggaccagcattttacccactgatctccacaatttcacttggctctcacacagttttggacttttacgaccaagtcagtcatgtctagggctccaatttttagccaaaagcctatttttttcctgagctccccgtggcctgaaacgcacgaaaaacatttttttgggctgttgttaagctacttttcgagttattagtgcctattttctagccttttatttttagcgcctaaaaagcctaaaaaattttgaaagagcctatttttgcctattttggcgttttgccgaaaatttgttaacaaaaatgcaataaaaacaaaaaaacacccctaagaatagacctgaaaattttataaatacacccttaagtaattaaaattttatcaaaaattccatctccaaaataatttatttattttcttgacaagaatttttgattttaaaaattatttagctcaatactgttttccctaattttttgctaaattttttaattttacacccaaaaaatttgagactttttagggcctattattcgaaaccttttacagattggaaagacacttttatctttttagaatagctttagtccctttaagactgttttcgagcgttattaaacagtcggacgattcagtccctgttgaaaatggacacttcagtatgcgattgtttacagcaaaatggcaagcgcgcgcctaatttgcatttttctcaccgttttgggccatttttttacaaatgttttgaattttttgatgcaaaatattttaatacaatcatacaataatcttcatttttaaaaattttcttgaaaacatttagctgaaataatttca

SEQ ID NO: 58263 - DNA, 113 bp, Heterodera glycines
  Genomic contig location: Contig_ID=SeqID_27564; Location=727..839; Strand=+
  SCN-specific regions: Sequence locations=1-113
atggcagccaaagcaccgctgttctgctacctgttcgcctggttttgtgccattattgttgcagcaccgtacggtgccgccgtgtccgttgaagatgccaccattttggaccc

SEQ ID NO: 58264 - DNA, 1690 bp, Heterodera glycines; identical to SEQ ID NO: 27565
  Genomic contig location: Contig_ID=SeqID_27565; Location=1..1690; Strand=+
  SCN-specific regions: Sequence locations=1-1690
  Gene Ontology: Mol. function=protein phosphatase type 1 activity; Cellular component=cytoplasm; Biological process=adult locomotory behavior

SEQ ID NO: 58265 - DNA, 577 bp, Heterodera glycines
  Genomic contig location: Contig_ID=SeqID_27569; Location=1..577; Strand=+
  SCN-specific regions: Sequence locations=1-577
atgccatcggtcgtcagttgatcactgactttcatccaggtccctctgccggtccattcaaatttcgtccattttgtctctcatttcctttagctgtcaaaaacgtcgcttctgccagtcaaaatttgctccgttccttccaaagtgtgtttaattttccccgataattttgtctgtcaaaaaaaggcctaagtcatcacttttacgaatacaccgccgctttatacgctttgggcttttcgggcataaattcggatgagttcgaagtgagggaacagtcgaaaactctgcagacggtgaccgaagtgctgaagaaagtccattcggaacagatcgattgggttggtaacagtgaagggaaagcaaaaacaaagcccaaaagatggattacttcacggcgatggcactgacaatcaatcaaaacagcaaaacggagaaggaacggctgaaagcattgattagcggcttttccgagagagagaggcaattgagcaaagcaatccatcgaggcaagcaaatgccggacacgcggagtaacttttacgagacggagttggaggcgatgcgggaccaacaa

SEQ ID NO: 58266 - DNA, 1215 bp, Heterodera glycines
  Genomic contig location: Contig_ID=SeqID_27572; Location=304..1518; Strand=-
  SCN-specific regions: Sequence locations=1-323,345-973,996-1048,1070 -1131,1153-1215
atgatggatgtgccaaactctttcaacacttcaccaggatttttcgagaacttggcccagtcgttacttgacctcaaaattcaggacaatcgcaattacaaaaatgaggaaccaagatctggggcaatgaatgcgctcacacacatcaaacccaaaacaacagcaatggattgtcaggtcgaaaatgaattagcaaaaggatcctctagtgaatccccagcctgtgggccggaaacaaagacaaacattcccaaaacgtcaaattgggaacggccaagcgtacgatcgaaagtcgcttctttaatgttcattacattaatgcttgttggaatgattttaccctttactactgctaatatgccccatctgccaatgcatccccttgtctgtcaaacccaaaacggaggaaaaatttggcaattgccggcagttactggctgttcaaagctgtcaattgatcattcaaaagcacctgttgttcgaactttcgatgtcttttcgccaaatttatttgagcactcggcagatgcttgggcttgccgaaaagtgagaaaatccgtgcgtaagtacacttcaatcactaatgttccgatccaagagactcttgaaccacttatgttgcaaatgactccgagtgaatgtaagcaaatggccgaaaatggaaagtgcagcttaggcttgctaattaatgactcgggactctcgcatactgacaagaaattggatttttcaccccgaatgtggctaattggctcatttagctggtcgactgtctcaactgaaaattgttatctttttaagactaaaattatgtcacaacacggtagcacagttatgcaaagtcccctcgggttagtgaacaattgcgaattcaaggcaggccaatgtgagatggaagacaagacattgctcatgtgggacaccaacactacccgtgcctgtgaattttcgaaaatcggcacatggaaaggactacaacttgacaatatttggatttcggatgaggtcagttttcgtttgacatttttgaacaacacaaagaaagtcaactcatgtggtctgaatctgataaaatcggaggaaggatttgctgtacaagacttgccttccgacgatagcaacgaatcctcaaagagaagcagaaagacgagatcacttgaaagttgggtcaccgaatcggaaatgaactccaaattgggctatttggatgaacaa

SEQ ID NO: 58267 - DNA, 655 bp, Heterodera glycines
  Genomic contig location: Contig_ID=SeqID_27572; Location=290..944; Strand=+
  SCN-specific regions: Sequence locations=1-77,99-160,182-234,257-655
agcatttctcttacttgttcatccaaatagcccaatttggagttcatttccgattcggtgacccaactttcaagtgatctcgtctttctgcttctctttgaggattcgttgctatcgtcggaaggcaagtcttgtacagcaaatccttcctccgattttatcagattcagaccacatgagttgactttctttgtgttgttcaaaaatgtcaaacgaaaactgacctcatccgaaatccaaatattgtcaagttgtagtcctttccatgtgccgattttcgaaaattcacaggcacgggtagtgttggtgtcccacatgagcaatgtcttgtcttccatctcacattggcctgccttgaattcgcaattgttcactaacccgaggggactttgcataactgtgctaccgtgttgtgacataattttagtcttaaaaagataacaattttcagttgagacagtcgaccagctaaatgagccaattagccacattcggggtgaaaaatccaatttcttgtcagtatgcgagagtcccgagtcattaattagcaagcctaagctgcactttccattttcggccatttgcttacattcactcggagtcatttgcaacataagtggttcaagagtctcttggatcggaacattagtgattg

SEQ ID NO: 58268 - DNA, 678 bp, Heterodera glycines
  Genomic contig location: Contig_ID=SeqID_27575; Location=338..1015; Strand=+
  SCN-specific regions: Sequence locations=1-39,71-124,146-289,312 -340,362-526,555-678
atgccaatggtggtgaattttggccgggtgggtaaaaactttttatttttattttactattttaaattttcaaagtatttcagactggggacgcgcaaaggactggacaagtcgggggccgccgatcgatgccaccctctgttgtgccggcgaatttgggcggcgtgccgccataccaggtacaaacacaacaaatccatttgcttccctttcttataccatttttttttaaaaaggagccgcaaacgcagcgcgaggtgatttacgatgtgccggcggatggtgtgccggaagacgacgatgacgacgacagtttttgaacgatgagccgatacaacaatgagctttaattcctcataaatttttataaaatttgggaattttcatttcacatttaacaaattttggctaataaatgtaattcaaaaatgattaattggcaatttataggagaccactaaataggagaaatttcaaatgttttactgttgggtattcagatcgttaggcgagattaatgctctttacgcaaaattttaaattttaagcatttgatataatctttttgaatgattaatgtgtgatatagtggagaaaatctgtcggtacatcaaatgagcaatttgtttaaaaatgggtcacatccattatcgggaattcgggatgctttggtgcata

SEQ ID NO: 58269 - DNA, 1097 bp, Heterodera glycines
  Genomic contig location: Contig_ID=SeqID_27577; Location=106..1202; Strand=-
  SCN-specific regions: Sequence locations=1-243,265-670,693-775,797 -835,857-1097
ttccaactggtgtgttaacaattgaagaagtgaacagcgtgtatcagcattattcccatccaaagttaagtgatgccactgggcttatcaaattgaaatttcccacccatcaacgctacaaaaacgaaggcacaattgagatggaaattgaaaaagtgtccgaatttgcggtggaggaggtgggaagtggccgatttagcgatgccatggacattgggagatttccatggaaaataatggcacaaatcgaaacgaaaaacgaaagcaatgagaaatggttgggcttttacctttccaacgatggccttgaaaatggtaaaaagtctttttcgtaaatctgtccgaatttaaattcaccaaaactaaatatgtataataaatagggctgggatttttatgttttaacatattttttttgcggcttagttatggcgagagaagcccaaaaatagcattttctccgaacaatttttgatttagagcgacttataaaaacataaaaacacatattttggcgttttcgcacataaaaacatatcgcacatatttcggggtttggcacatattttgcacatattttggcatttttgaaaaaaatatctaagaaaaaaaaacacaaaaaattcaaaaatgcacccctaaaaatcaactttcttgccatttttataggctctttcaaaattttctttatttatttcgtgtaccgaaaatcgaattcttcattaattcgttactggatatcgaagtttcttgctggcacttactcaactgatggaaaaattatctttaaaaacaatttatcaaaaaaggactaattttacccccaaacacctccaaatgttttttatttgcaattgtgcgggcaaaaatgataaagaatgagttttttggaatttttatgcaaaaataccattggtttttccaatttttagcacatatttttgcattttttaacacaaagtaaaaacctaagaatcccatccctgcttatgatgattggtagtacgacaaaataagagaaattataaagaaaaagagaaaggacgaaatagggtaatcatgtactttattggtccctaaaaaaaagaaagaataaa

SEQ ID NO: 58270 - DNA, 228 bp, Heterodera glycines
  Genomic contig location: Contig_ID=SeqID_27580; Location=167..394; Strand=-
  SCN-specific regions: Sequence locations=1-228
aatttctcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 58271 - DNA, 393 bp, Heterodera glycines
  Genomic contig location: Contig_ID=SeqID_27581; Location=152..544; Strand=-
  SCN-specific regions: Sequence locations=1-69,91-167,189-393
tttgtattggccaattcgctaaacttttgactcgaattgatggaatggaagcccaaataaatggactgaaggaaaaggatgaagaaggatcgttgtcgtcatcagtgccagcagcagtggaggatgatgatattggcgaacattcagattcaacggtgggtggtgcatttttggttcaatgacaactcgcgtcgtacaaaggcaattaattcgtcgtttaagcggcagcaaaccgagggccacaaccagaattttgaatttggacaacgtcagttcgtggattatactggttacgcatcaccaacatctgcagccagctctgtcaaaagttctccaaagaagacggcggaggaggagggtcagcagcagtcgtcgtcttcttccaagcgtcat

SEQ ID NO: 58272 - DNA, 738 bp, Heterodera glycines
  Genomic contig location: Contig_ID=SeqID_5504; Location=568..1305; Strand=+
  SCN-specific regions: Sequence locations=1-21,43-107,293-310,394 -419,442-566,611-666,689-701,725-738
atgaagtttcttctattttacgagttttctttttatcacaaagtaatcaatgacttaagtgacttcagatcagtttcctagactcaattggtcgcgcctcgacattcaaattaaaataaaaaattttactattaaagtaatatattgttaaaaagctattaaagcataaatcattgaatttttcttaatgttttaagttattttcatttatataaaattattttaatcaaaacaataaaaaataataaaatagaaattttttttaataaattaaatttcaaaataaattattcttgtttaaaattacattaaataacaataattagctataaaaatgaacataaagaataagaaatataaaatcaaaaaagaaactgaattaaataaaaaataggcaactttttcggcaatctcattcgataatataataaaataatttaactcaatcctagtttaaaactaaactaaattaatgttgaccaaaattattattttaaagaatcaaatcttccctgatatcagctaattgcactacattaagaacaaataaatgagaacgcttaaacaaaattaaaataaaactattaattgctataattaaattatttttcaaattgaggaatttatggataataaaggagtttttatatacgcagaatggcttgtgtgcatgatcatggacacacacctggaaaacttataaatttaaagaaaaaatttatttctgaaaaaatagga

SEQ ID NO: 58273 - DNA, 559 bp, Heterodera glycines
  Genomic contig location: Contig_ID=SeqID_27583; Location=280..838; Strand=-
  SCN-specific regions: Sequence locations=1-114,146-276,302-451,479 -485,507-559
atgccaactccgttccgcctgctgcttcggcatttggctctgtgcgtgtccgaatgggaagaggtgtgttgaggaagggattaaccgagcatctttcgcatttttcctccgaccaaaatttttaaaaaatagaaaattttaatttcgaaaggcacaaaaagagggtttttgatttttcatgactttgggtgtcgatggtgattattttcaaattcttttttattttttacattttccattcatatatcactcgtttttggataataaatttttccaggtgttgtacatggcatttttggctatccaaggcatgttcattgacctcaacagcggccgaagacggccgataacgaaagagaagcaaaggcggcggcttcggcacggcttttgtccctcctccgcctcgttatcggacgaagcggcaacggaaaatcagcagaaggaagttgggcacggaacagaagcagcagaagaagaacatgttgaggaggaggaggagacggaacaccaactgttcatgataagcagcagttcgtccagcgaggaagaggacttttga

SEQ ID NO: 58274 - DNA, 351 bp, Heterodera glycines; identical to SEQ ID NO: 53910
  Genomic contig location: Contig_ID=SeqID_27586; Location=571..921; Strand=+
  SCN-specific regions: Sequence locations=1-20,51-351

SEQ ID NO: 58275 - DNA, 772 bp, Heterodera glycines
  Genomic contig location: Contig_ID=SeqID_27589; Location=435..1206; Strand=-
  SCN-specific regions: Sequence locations=1-323,345-459,481-612,639 -721,764-772
atggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaaggtaaaaataaagtagaggtatatcgaagctattcccgaaggattcggactccttataaatctgggcgcatcggttcagggggactgccccgaaaacccaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 58276 - DNA, 803 bp, Heterodera glycines
  Genomic contig location: Contig_ID=SeqID_5506; Location=624..1426; Strand=+
  SCN-specific regions: Sequence locations=1-132,180-555,582-803
atgaacttcaagaagcgctttcttctgcagcattttttgacgattttatgccatttgttttggcatttgaatttggcgcaacattttgcgcagaaaacggcggtaccaccaaattgtgcaaagagaaagtgcaatttttatatttaaaattcgtaatttataaataatttcattttttagtgcctttcccaaacattggtcgccccaaaaacaaaggcaccgtttgttggcccaaccaaattccatcggacaacgccacgcgcagtgccaaaaaccacttttggcattgtgccaaaaactgaagaaacctttggctttgtgccatttgcacgaaatgtggaccattttggcacaaattgtacgaacattttcttcccggcggaagtggacaaattcttgctgaatatcaccgcgaggccatacgaaattgcatgcaatgactatgaaaaacgtgccaaaattgacgagccaataccgtccgattattggtcaggcggacgccttgtgaatgcttgcatggcggtgccaagtgaaaaatgcgaaaagtaatttttggaatttattttttgaaaaatttcaaagttgaaggctcgtcgaactttacgggtgctatgaaagcattggcaataagccaagtgtcaatgccatcggcgaattgtgccaaaaacatctgaacaatgccacaaatgccgctgggttttgctgttcaaatttgtgcacatcggcaccaaacggaggcgacgaatgagctcattgttgaatcgttcatcaacttttcgttcactaatggagccgtttgctaa

SEQ ID NO: 58277 - DNA, 2720 bp, Heterodera glycines; identical to SEQ ID NO: 5507
  Genomic contig location: Contig_ID=SeqID_5507; Location=1..2720; Strand=+
  SCN-specific regions: Sequence locations=1-104,150-296,328-809,836 -1140,1172-1978,2000-2150,2185-2189,2211-2675,2705-2720
  Gene Ontology: Biological process=body morphogenesis (sensu Nematoda)

SEQ ID NO: 58278 - DNA, 1688 bp, Heterodera glycines
  Genomic contig location: Contig_ID=SeqID_5508; Location=1468..3155; Strand=+
  SCN-specific regions: Sequence locations=1-156,186-206,228-269,322 -600,622-753,775-1247,1421-1688
atggaccgtatctaccagggatcacacggaattacgacgatttccgatcgccattcttggggttggaattccgatttccgatatttttgataaaaattcagaaatttttggaatttttttttaattagcaatttttatacaatttctgtatataaaatgcactgaaattttgaaaaaattttcccggcggcgcctttcggccttgaaataaccttttatttggttaagaacgtattcgaactgacgtatgaatcaggcaaggaaaattgaaaaataaataaattataccttttaaattttttaaaaattaatttattttaacttgctttcgttttaaatgcttttctaatcagaaccattacaaaatggaaaattaattgttcaaaaatctgttaaggcaacgccaaactcataaattcgaacaaatgcgtaaataccgataatttgtatgccgagaaaaggaaccccggcaccagcggtttgaagtgttatgacggggtcaaacaccaattttatgactgctcctgtcacggtgataagaaatgcctcgctgaagaaaaatgggcacacgacgcatttctttgtccaataataaaggtaattaattaattagttattcattaatgccaaaagacaccgccagatacatttcatataatattttggcaatttaatttttccgtactaaaaaattaccattttttgtataaaattagtgaaataaggataaatatggcaaatgataaaaacactctattttattaattaatttgtaaatccaaggtcaatggaattcaaatccaaggaagccgacaacaagtgtttacggacccaaaagattttcgatacgattggactcggattgagattgattgttatgtaagttgggtctgctatatcaaaaaaccctgtttgattgactaactttacagaaggccgaagcgagtaccgtaagcttttggggctacagtaagccgtacacaaaggaaatcattcgggtggacgaaatccactgtttgacttataaagctgctggagtaacaccaccgtcacagaaacggttcaagagtttgcaagttgaagaacagctgtcgatgaaattgaatccaagtacattattggacaatgcttcatcacttatccatgtgttcgtgccatttgttggccatccatgagagaaaaggggtgatcagtgatcagtgggtgatctgtctctgcagctgatcagttggccaattccaatcagcaaatttttattttatttttatttttttgaatgaatttggaaatgaacaaataattaatttaaaaacgatattgtcttaaatttaatttaaatgcgatatttttatttatatgcttgtgattttttataagattttttgttaaatgttataattgtaaaattaatttattttaacttgctttcgttttaaatgcttttctaatcagaaccattacaaaatgggaaattaattgttccaatatgttaaggcaacgtcaaactcatcaattcgaacaaatgcgtaaataccgataatttgtttgccgagaaaaggaaccccggcaccagcggtttgaagtgttatgacggggtcaaacaccaattttatgactgctcctgtcacggtgataagaaatgcctcgctgaagaaaaatgggcacacgacgcctttctttgtccaata

SEQ ID NO: 58279 - DNA, 1388 bp, Heterodera glycines; identical to SEQ ID NO: 27593
  misc_feature (1296)..(1296): n is a, c, g, or t
  misc_feature (1302)..(1302): n is a, c, g, or t
  Genomic contig location: Contig_ID=SeqID_27593; Location=1..1388; Strand=+
  SCN-specific regions: Sequence locations=25-107,150-338,370-533,555 -1079,1101-1388

SEQ ID NO: 58280 - DNA, 928 bp, Heterodera glycines
  Genomic contig location: Contig_ID=SeqID_27594; Location=77..1004; Strand=-
  SCN-specific regions: Sequence locations=1-928
atgatggaagaagcattgagcgaaatggagacgatgctcaacgagtacagggaggaaaacagcgcactcaaaggacaattggtggaacgacgggaaggggtacggtaatgggatggcacagggaaagatggccgaaggtacgataattgaaggattgcaccgttacagtttttgcatagccgtgacatgatgagcgcctctgccagtacagtgatcagcaacggcgtgtgttcagctcccgcggtattggaagagcgtctgcagatgagcgagtccatgtgcgagcagttacgacgagagcggaaggagttggagcgcgaaattgaagagatgcaggaccaataccgagtggaagagatcgaggagttccgcgagttgcagcgcgagttggagcaaagcgcgaagaacgggcgcattctgcagttcaaactgcgcaaggcggagcggcaaagggaccaattgcaggtggacaaaacggaggggtgggggaatgaggctcaaaggctgatcagacatgagaaaaactgatcaaaaggaaagacaatagttgatcagctcaaggtaagccggatcagtattcgttgtatcgaaacaaatgatcattggtcagtccatgagaaagtgccttggttgatcagcaacactccaattaaactaacacttctgatccgcccatatcatcccaattggaactgatacaacattttatttttctttttaagactgaaaagaatttgttggcacgaaaagtgcaagaaattcaacgagggattggagaaggagctgaacaaattgaggaaatgagcggagaaagcgacatggaagaacaaatggggcgaaaagtgagcgaattggagcaggaattgcgagtggccaaggaagtgtcactgaaaatgcacaacgaattggaagtggcggaggaaaagcg

SEQ ID NO: 58281 - DNA, 88 bp, Heterodera glycines
  Genomic contig location: Contig_ID=SeqID_27599; Location=187..274; Strand=-
  SCN-specific regions: Sequence locations=1-88
atggacccggaaaaggcacgacaacacattcctgagccggcaattttcacttatgcatccaaagatgccattctctacgccttaggaa

SEQ ID NO: 58282 - DNA, 1395 bp, Heterodera glycines
  Genomic contig location: Contig_ID=SeqID_5510; Location=1445..2839; Strand=-
  SCN-specific regions: Sequence locations=1-71,95-120,149-227,265 -354,532-869,891-1025,1047-1208,1231-1395
  Gene Ontology: Mol. function=cytoskeletal protein binding; Cellular component=cell-cell adherens junction; Biological process=N-linked glycosylation
atgattgccgaagtggaacggctgttgactcgaaaaaggtccgcaccggtgcatgcaagttttgggaacattgacgacgacgatgaggaggagggcgagattcttgacgtctcgtttgttgaggaggaagaagacaatatgggcgaagcgcccttaaacccactttcatatttgaccaagcaatcagcggctcaacaagaaacgttgcggcatgaaaaatgggcacaagaagagagaaagcgaagggaagaggagcagagaaagcagcgagaaaatgaacgtagacggcgagaagaagaggagatgcgtcgtaagacagaaaaagatagaaggaagactgcagagaaagcagccaaggaaaagaaggcaaaggaagagaaagaggcaagtgaaaagaaggcaagggaggaaaaactggcacgggaaaagaaggaagagcagagaatagcaaaggaaaagaaaggcgagaaagagaccaaggataaaaaggctgaggaggagagagtagcaaaggaaagaaaggcagaggaagagagagtggcaaaagcggaagcggagagagtggcaatggtaacaaaggcagaagaggaaagagcggcaaaggcggaagcggagagagcggaaaacgagaccaagaaaaagcaagcggaggaaaagcagttggaagagcttaaacgacagcaacagctgcacgaaacggatgattaccactttgtgaatgctgtacacaaataccgtgtccggcactcagagctcccctgggaggcgcccgagtttaacccatccgcgcacatccaacagaatattggggagttccgtgagctgtttgagcaagaggtgtacgatgaaaactatgcggtgaaaacgcgagaggaaaaggaggagctgatcgagctggtcaaagggttccgcttttacttcaccgagcaaattggcagatttgagctcaaagttttcaacgggaaaatttcgcacattacgctgactgatcaactggcctacgtgttgggctatgaacaagagcagcagatcagaaatgaagagcttgcaaaatatgcggttgatttgggtggtggtgtgagccacctgtgcatttacctgaacagtggcgtcattgagagcatgattgtcggcaacacctttgccaatctgctccaagtgattgccgttgagggaaagtcgggtagtgtggtagagaaggacttccaggcgccgttgtttcacaaaatcatagcaagggaggtggatgtgcttgacgttgagattcgcactctgaccgggaggttaggctcttcagcagggcaattatttctaatcacttatttaagggaggtgccatttgagtttggccaagttgttttgactcttcagtttaaaaaggtgttaacgttctga

SEQ ID NO: 58283 - DNA, 579 bp, Heterodera glycines
  Genomic contig location: Contig_ID=SeqID_5510; Location=3108..3686; Strand=-
  SCN-specific regions: Sequence locations=1-160,183-320,342-579
atgaagaaagcaaaagccatggaagctgaaggtttggctttttctgcaaatttctttaaattagccaaattttagtggatgaatcgcccaaaaaacaaccgaccaatgtgtttgagtacccgaccatattttggaaattggcccgcccaaaggttttggctaatatttaatttgaaaaaataggaaaatttcttaagtacggagtgttcacgttcatgtgcaaagagtgtcgtgatgacaatttccggcaggggaacagccgattcaaacttatcaatcagaatggcgagcagcaacgccttgagttcacccaatcgttttgccaagactgtgcaaagctgaactttgactgcaccgatctgatcatgaagcacctaaagaaggatgaaccggcaacgacgacgacgacgacgatggcaaagagtttccgctggatcaaagatgggggaaagtgaaccgagatggcacaccacgatataaggacgatctcattttgaagaatttatacttgttgatcaaatgacaaactctttctttgtaattttgccgagcaatacgccaggctttgttggaaataaa

SEQ ID NO: 58284 - DNA, 1190 bp, Heterodera glycines
  Genomic contig location: Contig_ID=SeqID_5510; Location=7047..8236; Strand=+
  SCN-specific regions: Sequence locations=1-859,890-967,989-1091,1113 -1131,1158-1190
atggacaagaaaataaacaaaatatacaccgacccggccaatccgggcgggtatgcgggggcgagtgccctgtacgcggcggtgaaggagaagcacccgaagttgaagcgtgccgagtttgaggactttttgcagaggaacaccacctacacgctgttcaagccaaagagggagaagttccaacgcctacgcacagtgcctacgggtttcatgaccggtaagttgtactggggcttattgtgcacaattcagggttcagatgttcaggcggacttggcagatttccaggcactttcgcgcaagaacagcggctaccggtacctgctgttggctgtggatgtgttgtcgaggcgaatgttcggcgcgcccgtaaagagtaagcgaccggcggacatgaaaagggcgtttgaggagctatttgagcaaatgccaagggtgccggacacactgtacaccgatcgcgggctggagtttgtggcaaaaccgctaaaggagttttacgcggagaagggcattcaaaagtttgagaccagttcaaagaaaaaggccgacgtggcggagcgtgccatacgcaccctaaagacccgtctgtacaaatacttttccgccaacaacacatcggtgtgggtggatgtggtgccaaagtttttgagtgccatcaacaactcagtgtgccgcgcgaccgtacttagacccaacgaaatcagcgacgccaatgcgagggaggtgtggaagagggtgtacggcgaagggctcgcacaattggacaagacaccaaaaatcagagccggggaaacggtcaggattcccgagcctaagcacattttcgagaagggtactgtatttcacacattttttcggtcaatttattttaattttaggttatatacccaattactctgatcacgtttacacagtagatgtggcccgctcaaccaacccccagcactatttgctcaaagactattatggcacaaagttcaagagaaaattttatttaccagaattaacaaaagtacaagttgatgaaaacacaatgtatcggattgaaaagaaatacaaagaacgagtgagagatggaaaaagtgaaatattggtgaaatttattggctttccggaaaaatattgggtgacaaatgaagaaataaatgaataaaaatattacaaaatgaagaaaatcaattgaaaca

SEQ ID NO: 58285 - DNA, 1513 bp, Heterodera glycines
  Genomic contig location: Contig_ID=SeqID_5510; Location=5237..6749; Strand=+
  SCN-specific regions: Sequence locations=1-65,87-638,661-863,885-1513
atggaccacccaagaataaatgaaagtgagctcgcttttcccatcccttcggggattattgtcagcggtccgtcctcatcgggcaagacccagctggtccttcgcctgttacggcatgccaacgtgatgtttgacccgccgcccaaggcaataggtatgtgcaaagggcgtttctgtgcagtgggctgttgctatttagtatgggcatacggtgagtactcgacgcagattcccgatctggagcggcagggagttgccccccacgcaggtgccccgtctgacgagatgctgaaaaagctgccaaagccttgtctgattgtttacgatgacttgatgggtgacattgaggccaagaagttggccgatctgtacaccaaaaagtcccaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcagggattcctgatggatgcctaccgacaggcatgtgccctaccgtacggctacctattggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtcttaacgttttgaacgggagtttctgtctgagcaggaaacaaaagcagagacttgcgccatttgcaaaagacatcagacagttggcacgtgtgcgaagcgagagcggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaggggctggttgcagcgaaggagacaaagaatgacgacgacgacgacattgctgagcggacaaacttgggctttgtcaaacgacaggtgaccgctgcagtacagaagcggaaggaaaacgtcagcgaacggaacgcaatgtacaaccagtacctgcgccggtacctgaagatgcgcaaggaacataaagagcggcccgtccgggtacagctcagcaacggcgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagccgatcacccaggaccaataagaaagcagcaaacagcaaaaattga

SEQ ID NO: 58286 - DNA, 627 bp, Heterodera glycines
  Genomic contig location: Contig_ID=SeqID_27602; Location=128..754; Strand=-
  SCN-specific regions: Sequence locations=1-96,118-269,357-418,448-627
  Gene Ontology: Biological process=N-linked glycosylation
atgaacaaaaaaggcagattaatcgagtccaaagaaaagagcgggaaaatttataaaagccattcatttttcaagatggaattgctgtcaaaagaggaggaagaatctctgaagagattgaagagaaagctcgaacatcaacttctgagggtccagcaaagtgtgaccgaaagcgaaaaatggaaatccggaacgtcggatgatgatccagtgagaccacaggagtgggaagaaaatgaggaagaaacgacgaaaaagggcgaagaaatgaagaaaaaagaggaggaggagaagaaaggaagagagggaaaagaaaaagagacggaaaagaagaaggaagagatgaagcagaaggacgagacggaaaccaaacgaagcctcagcgtcggaacaacgaaagacgatgaaatctcgattgtggattctgaagaaagagaaagagatgccttcgaaaaaccgccgaagccgacaaacgagcgaatggcattttgggagtcgactttgaacaatgaggcaaaaaaggatttgcgggaggacaaagagaaagccttaaaaaatacaggccaaggtattgttgtaagctccagaaaacgaacggtaaacgaagccgccaactttgtcaaatga

SEQ ID NO: 58287 - DNA, 538 bp, Heterodera glycines
  Genomic contig location: Contig_ID=SeqID_27603; Location=494..1031; Strand=-
  SCN-specific regions: Sequence locations=1-58,87-109,132-191,214 -442,464-517
atgtggcacaaaaccgcacttgcccaacaacgcgttgtgtacaatggggagatgggtgaccggcagcagcaacaacagcagcagagacgaaacggagagagggacgaaacgacgacgcatcggaaggagagaaaagcgacggaagagtgaggggacaattgaggggaggggggggggcatttggaatgcattggggggcaattccttttttatttccattaatattcattttattttgcaggttttcgccgctcattaatttctcgcaatttgaagcaaatccaaagaaaaagagtgccgaggagacgaaaagcagaacagacgaggaagaggaggggacggcacaaagggcggggtgggggaatgacgaatgataaatgatcgcatttgatgtgttcaataattacgccctttcatttgtcagcgtaatagctaccgatgcttttaaaagtcaaaaataatttaacctttacatacatcaaaaatgtaaatttaaccgtaatcggaaaatgcgtcaatggtaatatttttaaataaa

SEQ ID NO: 58288 - DNA, 678 bp, Heterodera glycines
  Genomic contig location: Contig_ID=SeqID_27608; Location=250..927; Strand=-
  SCN-specific regions: Sequence locations=1-117,139-486,520-678
atgacgacagaattgccacggacaacaaccattccaatgctctgcgattcgccggtcttaaaacaagatattttaaagtgttttccaacagtcctaaaatggacaaagagaatgtatggctcctttttataatagtgaaaaacactgccatttctacaccaaaaagttgagtttttcaaaaagcataggaaattaggcgttatttacaaagagtagtattttgaacatttttcactttttttggcctaaaattttttttaatactactctttgtaaataacgccggaaaatcttaaatgacagaaattataacaaaagaagtgagtttgaggtttaataataaccttgaggtgctcaatacaatcttcaacgacgatgttcataaatggatcaaacccacgcagaataccggacacatttctaaacataagaacgcaattagaattttctattttggattttttgtccaataaatccggcccctagtaataaattattactaataatatattattaaaacagaaattcctgggctcggttctctgatcagaaaggcttttatccaaatgcgtgccaaaaaattggttattgactgatccatcatcctaatataataatttaaggttctagtcggttttatgcgtcccatgtcatattatgcttccctgaaaaaataaa

SEQ ID NO: 58289 - DNA, 80 bp, Heterodera glycines
  Genomic contig location: Contig_ID=SeqID_27608; Location=872..951; Strand=+
  SCN-specific regions: Sequence locations=1-80
accggcgaatcgcagagcattggaatggttgttgtccgtggcaattctgtcgtcattatggaaccgatggagcgaattgg

SEQ ID NO: 58290 - DNA, 365 bp, Heterodera glycines
  Genomic contig location: Contig_ID=SeqID_5512; Location=5..369; Strand=-
  SCN-specific regions: Sequence locations=1-23,45-365
atgtcgcacaatccgaaagaagcaaagaaagaaatggaaaaagcgatgtaaataattaatctttcaattttccatgctaatcattttgatttttaagcttcatctccgccgattgttggcttgaggtgtttcgtttgcttccgccctttcagcttggactgggaattgcgatgattagccgccgttttgactacttcgtcgatgaacacttcaaaacgcgcaaatggacattgggaaaatttaaaattggaccgaatggcacaaaggaaatgaaaattgtcaattccgatgaaaaagaattgccaattccgcaaattccgctgccaaaaaaagtcatcggattcggattcattgagatcacgtaa

SEQ ID NO: 58291 - DNA, 639 bp, Heterodera glycines
  Genomic contig location: Contig_ID=SeqID_5512; Location=2098..2736; Strand=-
  SCN-specific regions: Sequence locations=1-159,181-206,230-413,435 -541,573-639
atggaacacatactcagcgcatcgaggcgagttggaggcccgcgaaagactggtttcgcgagagacgaatccctgggttccagtttgcagaaactctggtggagtatcaatggcgacgtgagctcaagaagaatgaattggacccattttcactgctccttcaagctgttcaccattattacaacaaaaatttgtgaaaaaaacagtaaaaatttttttttttaattttgatttcaccaagaaattgacagttttgcgccaaaaaacgtttatgcctattaaatacacgccatttcaaaaccattaaacatgtttttagtttaccccttgaacgaaagtcaagccaaaaaattaccaaatattagcctctgcatagggttttccatgttttcatcattatctctatgatgcttatttttcaagtaaattacgaagaaaaggtccggctgtgattctaatctggtaatttttaaaaaaaattaccaaaacattaaaaaacatagcttggcttaaagaattcttttttcctttttaaaaactcattaaaaatttataaaataaaaaaataataacagtttttaattgaagcatttcttggagcccagtactataggatgcttctttacacctgaaattaaa

SEQ ID NO: 58292 - DNA, 1199 bp, Heterodera glycines
  Genomic contig location: Contig_ID=SeqID_5513; Location=1937..3135; Strand=+
  SCN-specific regions: Sequence locations=1-448,471-505,528-1199
atgtctgggccaatacaaaaagggatcatcaatgcactcaaagctctggacaatgccaaaagcgccacctcactccttctacaccccgacccggacctgtcaaactgggaaaatgccgtcaacttggaggctcaatttgatcgcgtcgtcaaggaaatccgtacaatggaaatgcagatggacagtctacgagactcatccaacgcttggattgaacttctcgcccacctgaccggagacgacaaagacaacggcgaaaaagaatacatcaaattcgataaaaatgagaaaatcgccgagcgatacgacgcagcatcaaccaaacttcgggatttgcgagatctcgaagcaacactcagtgccgcagccaaactgcacagaggcagagccgacagagaagcaaaggcggatcaattggccaatccgcagcaacaaccgcccatgccaccagcaatggcagcaccaatgacaatgccaacattcacagcaccgctctaccaattccaaccaattcaactggagaaatttttcggccaaaagcgaaaatggcccgaattctacgaatccttcaaatcggcaatcggcagtcaatcaatcagtaaagcgcagaagctgaacttactccgcaatctgctgggtggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgaaggtcctcaagtgttcctcatgctggaaaagaagctgacgccagcattcctgcgaagcatcctcaacaagaaaggagaggatccggcaaattggacgacaaccaaatttcgggacgtgctaaacgaagccgtccgaaaagaagttcaaatccaagaagtgatgggagaatatggccatcactacgtccaaccaaaagcagaagtcgtctcagcagcacctgtacaagcaccgagaacaccaaaccaaaggtcacgaaggcctaaccaaccaatggcactgcgtgatatgacatttatcgcctcatcactggacgagggccacagacatcaagg

SEQ ID NO: 58293 - DNA, 2002 bp, Heterodera glycines
  Genomic contig location: Contig_ID=SeqID_27612; Location=6..2007; Strand=-
  SCN-specific regions: Sequence locations=1-1055,1172-1222,1244-2002
tacatccatccacggactggtgaagcaattgacttggccagtgcggcaaaccaaggccttgtggacgtgacgctggccgagacgttgcccaacggtgttgtacatccgggcaccggcgagaaagttagcgtccgacgtgccgtcgaagcgggcattgttgactcgcgaacgggcgaagtgcggcatccgttcaccggcgagcgcctctcgtgggtggacctgacgcgcaaggtgtacagtgcgatcacgcagaacggcgtgtacgacccgcgcaagggttacgccgtctcagtggccaggtgagctggcgaggcgagcggacgggaaaataactgatcaattagttcctattatgccctttgatcattgaatcaaatcaaacattttaatcgatcagctctgtttttttccatttatccattgttgtatttacagtgcatttgctgacggactgatcgacacgcgtgcagttgcctacttgaacccaatcacgcaggaacagctgtcgctggaggaggcgcatcaacgtggcatcatcgacgcacaaacgttcaactcactgacaacgcctgcgctcctcgaccaccgtacccatcggcggctgaacctggtgcaagcggtcgatgcccgtctgattgacccacgtgcaaaaacggtgcaactgtcgccggacagggttgtgccagtgaaacaggctgttgacgaaggcgcactgcctcgcgatgttggggagcagttgcagcgcgtggacaaactgacttttgtggaggcggtcagccgtgggctgatcgacgcggcgcagggcacgttcacggacgcagaaagcgggcggcagatgagcattgcggacgcggtcagccatggactgatcgacaccggttcaatcagtgggcctgatacagacggagccgaagcggcgactaacctggcgcggatcatccaatcggaagaatttgacgagcgatcgggacgagtacaggtcgcaaatttttccttgaactaactgatcagctgagtgcaaaattaattccaccgaatcgtttttccatgaattcaaaaattttaaatttaccaaaaaaaatttagaaattttatgtttatactaaattaattctcgaaaatttataaattttaattgaaaattcaaatttcatatttttaagaattatttggaacctaaaattttcaaagtttttcatgaattttttttttgaaaatttgaaaaaattgaatgaatttttaatatttctttctgatcagaccatgatgatcagcagaacatgtacccttttcataattctaaatttttatatctgactgattacttttccctttaggacccgcagacgcgcctttacctgccgtttggcgccgctgtcaatcagcgactggtcgacccggactcgctgctgcacgacttggactcgtccaaaacaatgacattgcgcgaggcgctgagcatggacctgatcgactcgcacggccgctacgtgccgaagcatgcaaagggtgccgttggtgcgcagacagtgccgctgaaggaggctgttcaacggggactgatcgcgctgatcggctcgccaatgcaggcagcgcttgcggtcagcgaggcgttgaagcggcgcgacgttgagggctacaaattccggctggagccgttggatgactcgaccctgcagcggatgagcagcgcaggctacgacacgcttagcggcacgagcggtgctactggccgcccgcgtggctatgaggagaccgtggtgcgcacccggcgtgcacccgagcccagcctgtccgtccgtgtccgctcttcggatggcagtgattcgctgttgcgcggctcacgcgcacgctcagacgtggacccgctagcgcttgtcgacttccaaaccgacttcctgaaactgctccaagcccaagggttcgacgtggacgagaaatgcgtggagaatccgtccacaatgcggctgatgtccatccgagaggctgtcgagtctggctt

SEQ ID NO: 58294 - DNA, 358 bp, Heterodera glycines
  Genomic contig location: Contig_ID=SeqID_27613; Location=1116..1473; Strand=+
  SCN-specific regions: Sequence locations=1-358
atgggtttttccgattgcgtactgccttctcacttcagtcataccatagaaaacttcaacgtgcatttgattgttcacatccaactgtcttctgcttcatcaacacaattcgatgtgagcaaaaaccaattgatgcagacatcgcccaatgcgtctccggtgaatccctcctcaaaaggcgcccaaatatcgtgccgccgatgcgagaattcttcgacttttgcagggctacaatgccatcaacaataacccggctaaccaaaatgaccacaattatcatgccaatgtcaatgttaatcccgataacatcaatcatcttctagttggtgtttctcgaaattatgaaatgtgcccgtaa

SEQ ID NO: 58295 - DNA, 458 bp, Heterodera glycines
  Genomic contig location: Contig_ID=SeqID_27615; Location=167..624; Strand=-
  SCN-specific regions: Sequence locations=1-236,258-285,308-458
atgccggtacttcaaaatggcaatgaacgggaagaagccaaatttgcatacgaattggacaaaacatttttggacgataaaaacgcagaaaaagtggccaaaatgttgaacggacaaacactgaaagtgggaggaagaatgggagaagaaaacagcggacagagcagcaggtgaaaggaggaaacgaaattgaaagaaaaattggcaatttgtaaattgaaaaggacaaaaaaacaaattaattaagcaattaattaaggcacatgccacgcgacatggcccattttgatgaccatttggggagtggtggcattgccgttgaagagcaaatgaataattattacccttctgattatagtttcgcccatttgtgggaatatttaaattcaaataatttgtcacaacaaatgccacggggaaggcgaaagaagcgggtaattaaaaaagcaattaattaa

SEQ ID NO: 58296 - DNA, 369 bp, Heterodera glycines
  Genomic contig location: Contig_ID=SeqID_27615; Location=860..1228; Strand=-
  SCN-specific regions: Sequence locations=1-114,176-187,209-283,333-369
atggaggaggacggactgaagttggagctgaacaaattgggaatgaaaagagtgcggcaaacggagccgacacttcgcatggaaatggtcgaaatggtgggccaattaagagacaattaattcattaaattattaattgctttaaataataattaattgctttaactaattaattgttacaaaattatttgtcctttactagatattgaatgaatgttctttttgccttgatgaattctcagaaaaggaaaaaaatgcactgaaaatggcgggttgtgaggtcaaaataaaaataaaaatatttttattttttataattttgtttatttttagcattttgctcatcggaattgtttcaaaaaatggtaa

SEQ ID NO: 58297 - DNA, 208 bp, Heterodera glycines
  Genomic contig location: Contig_ID=SeqID_27616; Location=686..893; Strand=+
  SCN-specific regions: Sequence locations=1-181,203-208
atgaatcgaaaaaaaattgaaattcttcaaaaatgtcgtaaacgcaagtttctgaacaacaacgacggtgaaaacgcgacaacttctgaacaatgtgagcataacgacaacaacaatgaccgcgatgaagactttggagaagaacatgccatcatcaaattcgaactcggaaaaactcaaaagggaggcaattgtctttggtccgaag

SEQ ID NO: 58298 - DNA, 552 bp, Heterodera glycines
  misc_feature (491)..(491): n is a, c, g, or t
  Genomic contig location: Contig_ID=SeqID_27618; Location=703..1254; Strand=+
  SCN-specific regions: Sequence locations=1-149,484-552
  Gene Ontology: Mol. function=general RNA polymerase II transcription factor activity; Cellular component=SWI/SNF complex; Biological process=N-linked glycosylation
atgcgtgctttctcttctccatcctggcccatttcatgcccaatttttctgctgctcattgtcctacaaaattcgctgttaattaatgctttcttcggatggggtggttgtgaggacgaaacgcaaatcggagttgcacaaattattggacaaaaacaacaacaaaaagaaaaccaagaaaaacagcaacaagaacaagaagaaaaacaaaaccaagaaaaacagcaacaagaaaaacagcaaaaagaacaacaagaaaaacaaaaccaagaaaaacaaaaccaagaaaaacagcaaaaagaacaacaagaaaaacaaaaccaagaaaaacaaaaccaagaaaaacaaaaccaagaaaaacaaaaccaagaaaaacagcaaaaagaacaacaagaaaaacaaaaccaagaaaaacagcaacaagaacaagaagaaaaacaaaaccaagaaaaacagcaacaagaacagcaacaacaacaacaagagcatanagacacacaatatttcggcaacagtgatagccaacacagaaacacgacaaacacttcagca

SEQ ID NO: 58299 - DNA, 466 bp, Heterodera glycines
  Genomic contig location: Contig_ID=SeqID_27621; Location=258..723; Strand=-
  SCN-specific regions: Sequence locations=1-466
gatttgaactacaatatgaggaccctaactgatttgtacatgatcattttcatcctctcgattgcgttgccaattttcacccgtggaaatggcccagtcaatgcccttggaaatggcatcatcgatgtccgtggtaatgatgggatggatgcccattgaaatggcacatgacaatgttacaataattaaactatcagccaacaccgaccaaaatgccccagccaatgcccttggaaatggcccagccaatgcccttggaaatggcatcatcgatgtccgtggtaatgatgggatgcccattgaaatggcacatgacaatgttacaataattaaactatcagccaacaccgaccaaaatgccccagccaatgcccttggaaatggcccagccaatgcccttggaaatggcatcatcgatgcccgtggtaatggttggatgcccgttgaaatgacaatgttacaataa

SEQ ID NO: 58300 - DNA, 1839 bp, Heterodera glycines
  Genomic contig location: Contig_ID=SeqID_655; Location=3245..5083; Strand=-
  SCN-specific regions: Sequence locations=1-704,726-744,766-1185,1207 -1454,1476-1599,1621-1635,1674-1748,1770-1839
atgagtacattcgacgaaaaacacgagagaagcgagccaaccgtgctcctggacgcactccaaactggcggcactgacagcactgttgatttgatggacgcagcagcccaaggcattgtgtcgagggagaaacgtgcagagacaagccaaattccgttgagagaaaagatggatgacaaggacacataccaaaacaagctggacaattatttttccaccctcaagggggaggatttggaactgcttgatgaacttggccgaaacaaattgaacgatgagattgcaaacatgtttgacgaagatcgcacaatccttgacgccaccaaagaactgggccttgaggcgtggatacaggcatacaaaaaggtgagatttgcgtgcaagtttacttttgacactcacaaaaaccggttcacgctgagacttgacccacgttatgtacagcgcgtcagaatgtcgtcacagctcgcctacattcttgggtttagcagcaccgagctggtggcgcccgaaaacgaggcacgcttcatgcccgacatgagtggcggcgtttcttcattccacgtttacacacctgacctcattgagccaatgatgattggtgatgtcaccgcaccagtgctacgcatagtaacgatacggggccaacccgacgaaattgtcgaggaacaatttttagcaatccaataccatagaatactggtaaaggaaatatctgaacttttgattgaaatacgtacaaatagtggaaacttgatgccattccagtacggcacatgtactttaactttgcactttcgaaaattagcctacttttaatcataacaatgatgaatacatttgaaattgacaacagtttggccaacaactcagtcacacgccacgcctatgttggatgttttgcggcagataaaatcccaactaatcacattgcagtatatccacattgtatggtactgaatgttgacccaagcacatcacgaggttcacattgggtgtcactttactgtctttcccccatgcacattgaatactatgactcattgggcatttggcctccgctaagtgtgcacatcaaaatttttttggcccaatacaaacaaattcgctacaacccaataccaattcagtccttcaactcaaatgcgtgtggtcgacacgcaattttctttctatacacacgctgccaggggtttccctttgaaaaaattataaactttttacatttctccagaatgtcacccgacagaattgcaaacacctttgtcagaaaggtaattttcaacaaacaacaataatattataaataatagtcattgcctgattaaaaggtgcagtaaaaaaaaaatgcatgtcgattttgatcctctccaggtggattggtctacactatcaccatcatcagctgaattagttcagtttggtggcttcaacatttttcgtggcgttccctatcagcgaggcgcgggtgttggcgccgttttcagaagcctcatgcgatacttgttgccaattggtaaacaaattggcacggcacttggacgccaaggacttgagagtggaaaccgagtgttgacaaatgtactggacggtaaagaccttaaagaatcacttgtcaacgagagtaagtcaggtctgaagaacttgctggaaaaggcggcaaacaacattgaagcccaaaaagggcaaggctttgacttcaaacggtacaaaagtgagcaaatgccaaaaattgcaagagctagacataaacctataaataaaatgcattcctcaattagtccaccaatgcttggtaaaaagaaacgtgtccgtgttgactcgttgggaccttattga

SEQ ID NO: 58301 - DNA, 2057 bp, Heterodera glycines
  Genomic contig location: Contig_ID=SeqID_655; Location=5487..7543; Strand=-
  SCN-specific regions: Sequence locations=1-323,361-518,549-1532,1555 -1942,1965-2057
atgcaccacacaaagcgctatgtgctcgtccccgaggaaatttatcagagcttgaccgccacctccggcgcttcccaggacggcagcccaatggggttggtccgcgcgcgaatggaccagctaaaaaatgacgacacaataaatgaggaggaaaagtccatcaggtatgagcaggagtttaagcgactgaacaaactgaaacgtgacgaggaagaacggccagttgatgtgcgtctacaaaatttgcgcgagatcgccgatgcggcggcacctgctctgccaacaacaactgcatcattggccggcccagtggtacaaatgacacaacaacaacaacaacaacagcaaaaacaacaacaagccaaacgcaagccaaccagcgcattccgccgcacaatggttgggcggcatcttcagcaacaacaacgacagcgtcgtcggttgatcgtaaacaaacgtggtggtggaggtgatgacgatgacgagtcggcgggcgatgagcagcccaaaacgcgagttgatgatgatgatgatgatgatgatgacgaattttgggaggacgcgagtccacgtgtgttacgttcagcccaacagacagcctctgcgtccacaacaaaatcgcacgcaaactacacgctgaccaaacaaggcgtgatggcgttaatccgtcgcaacgcagacgcattgggtgtgtccggggaggggaaaatcaaaagggcggacggacgaccgttaaaaacgagcaacgtggagcgtattgttgcccacctgttaaaccgggacagccggagtgagtacaaggatccacccgttgggctccgcgagttcacggaacgggcacaacagaacgctcagctgagcaaatacctcttcaccaagcatcagtttgggaagggcaaaaaacataaaaagagtacggcattgaagttcaagccaaagctatggtcggcagcctgaagaagaagcagcgtttgttggagtttttgtacaaggacacaaactcacccgtctcgttcacaagcgttgagccgcttttgtgccaagcgcgaaaacaccagcaaaacatcagccgaaaagatgttcaaaattttttgtccacccagcgcacctacacccttcatcgacaagcgaagcgacgctaccgccatttgccaacgctcgcacccggcctgcacaccgagtggcaggccgacttggccatctttgatagactcggcaaacaaaacgccgggttccgttacctgctcgtctgcatcgacacgctgagcagacagctgtttgtagagccggtaaagtcaaagacgagcgccagcatgatcaaggcatttgacgcggtactcaaacgtgcaaaatatgtaccgtggaaactgttgactgaccagggcagggaatttacagcccgggccgtacaagagtactttcgggcaaaagctattgaacacttttgcatgttcacatccccacaattccatgccgggatggcggaacgagcaaatcggagcatcaaggagcggctgtaccgctacttcaccgaacgcgacacctataaatgggtggatgtagtgcaggactttgtgcgcgccattaaccactcttacaactcaagccttggtgcgagacctgttgacgtaaattttaagaacgcagagagctttagacaaatgctatatgataaggccaaaaaaatggtcaaaggagtacaaaaattcaaggtgggggaccgtgtgcgtattgaaaagtacaaacacgtgttccaaaaaggttacttgccccgtttcaccaacgaactgttcacagtggcggaggttcacgccgaccggtcacccatcgtctaccgtctacgagatgaccacaacgagacactaaagggctggttttacgcgaacgatttgtgcaagacgctgaagaacaaggagcgcatgtatgacattgaaagggtgttgcggaggaaaaagggaaaagacggtgtggaatatggttttgtgaaatggcgtgggtacagcacacgcttcaacagctggattccactgaactcaatcacgtcgaaaaacatataa

SEQ ID NO: 58302 - DNA, 811 bp, Heterodera glycines
  Genomic contig location: Contig_ID=SeqID_656; Location=389..1199; Strand=+
  SCN-specific regions: Sequence locations=1-35,59-63,85-216,299 -300,322-327,351-811
atggatattattcgtgcaactgattggatctgctgcaacgccaacgccaacgccaactccaccttggccacaaacaccacagaaatggatcagcaggacgacaacaataagccctcaactccaccaccagagacagctgcaatggcaacagcagtggtggtggacccgaaaggagatgaggaggaggaggaggaaatcaactggcttcgtctcatcgatgaggtagagcaacaggagcagcagcaggagccgaacaaggaggaggaggaggagcagcacaacggggaggagaaggcggcacaaagtacaggtggtggtggtgacggctattttttttaaatttttataaagacacagagaaatgtgcttgtggagtggtgagcggcagccgacagcaagtgtccctggtggaccacctgtgcaagcggttcaactgctccgcgcacgagctgaacgtgttgttcaaaagtttggagcaacggcgtgcgattgttgggcacttgcgcacagcacggttgcgcacctcccatcttcgcccctctgtccgcaactttcctgtgcgctgcaatgagctgtccgtcctggacgcacactcggcgcccgcctatcggggctaccttggaattactgtgagtcattgtttttttttttggtttatttttccattattaggttcgtatgcactactacataaagcacggcatccgtctgcgccatcccaattttccatgtgttgttgaatttggaggcggtgatcacaagaccttttttccgcttgaagttttgagtgttgttctcgcataggtgaaaa

SEQ ID NO: 58303 - DNA, 445 bp, Heterodera glycines
  Genomic contig location: Contig_ID=SeqID_656; Location=2076..2520; Strand=-
  SCN-specific regions: Sequence locations=1-292,335-445
atgaaggagctgacgttggccacctacaacatagacggacccatgtaggtgcgctatttgtggtattaattttttttgtagtgatgatctgatcgacaatgacgacctgtacgtgtacgggagtggtggtggtggtgaacatcgggccatccgcgtcacatttccgcaaattggtcgcagtgtgcacgcggatctgtacacgcacgaggcgcacaaggactaccggcccttctacgccaagggacgtgtgcggcctgggatgcagacgcgcccctttggctaccaagaagagcagcagcaacaacaacaacaacaagcaccacaacaacaacaaacacaggcacaaccaatgatgatgatggaggaattggagatgatgacgatgatgatacccaaacagaaccccgacccaacccagcctggccactctgggtggtttcgatga

SEQ ID NO: 58304 - DNA, 1150 bp, Heterodera glycines
  Genomic contig location: Contig_ID=SeqID_657; Location=143..1292; Strand=-
  SCN-specific regions: Sequence locations=1-52,80-82,118-413,438 -821,843-997,1040-1150
atggcgccaaacccgggcctgcgcctcatcgccaagacactggccaactccctttggtatgatggtggtggtgatgtcagcgcacacacacacacacacacacacacacacacacactgcacaacacaggggaaagttggcccagcgtgtgggcgggaccgaggtgcggtacacgcgcacgcccgccgagttccaccgtctgctggaggatccgtcgctggacaagctggactttgtgcacgtgtcggaccgcatggaccgctgtgtggtgcgcaagaggccagagtttgccaaggcgccgcccaccaactgtctgcccgtggccatctacgtcacgtcgtacgcgcgactgcacctttacgggtacatggaacaggtgctggcgctggacggttcggagctgctctactgtggtttgtttgtttgtttctttgttttcgttacaaacaaaaaaaattttgcagacaccgactcaatctactacgtgaaccggatgggcggcggccaatgtgtgcgggagggcgaggcgctgggccagatgaagcgcgagcgcaccgaccgacgcattgtggagtttgtcgccggaggcccaaagaactacggcatccggcacaccgcccgtgacgggagtgatgagcgagccaatctgaaggtgcgcagtttccgcctctcctactccgccgagcagctgctcaactttgacgccatgaaggagctgacgttggccacctacaacattgacggacccatgtaggtgcactatttgtggtattaatttttttgtagtgatgatctgatcgacaatgacgacctgtacgtgtacgggagtgttggtggtggtgaacatcgggccatccgcgtcacatttccgcaaattggtcgcagtgtgcacgcggatctgtacacgcacgaggcgcacaaggactaccggcccttctacgccaagggacgtgtgcggcctgggatgcagacgcgcccctttggctaccaagaagagcagcagcaacaacaacaacaacaagcaccacaacaacaacaaacacaggcacaaccaatgatgatgatggaggaattggagatgatgacgatgatgatacccagacagaaccccgacccaacccagcctggccactctgggtggtttcgatga

SEQ ID NO: 58305 - DNA, 191 bp, Heterodera glycines
  Genomic contig location: Contig_ID=SeqID_657; Location=2272..2462; Strand=+
  SCN-specific regions: Sequence locations=1-191
atgggggctcccaagtgcgcgaccgtgatagtaacagcccatccactcgatggccatcgggcgaaggggcggctcccgacgccaaaggccgtccacccgatacccgctgtcctcaatgtgcgcctctccaacggaccagctcgcacactgcacctgcgccacccggatgctctagctcaaagaaagcgaat

SEQ ID NO: 58306 - DNA, 704 bp, Heterodera glycines
  Genomic contig location: Contig_ID=SeqID_5514; Location=587..1290; Strand=-
  SCN-specific regions: Sequence locations=1-317,350-375,434-558,589-704
atgaaagaagaagcaaatgatcaaaagaaaagagaaacaattcaaaaatttgaagcaatcaaagaaaagttgaagcaaaaaggaaaatatgaatggaaaaacagtgtcaaaattgaatgtaaaattgcaaaattattaggcgtaaatcgcgacaaaatatacaaatggaaaaaagaattaaatttaaataaaacgaagaaaaagagtttttatgaggcgaaaaagcaagaattcattgaacgaattgatgaattaaaaagtttatatggccaacgtaaacagaaagaatttgcgaaggaattgggcatttctaaagacacatttttcaaatggaaaaaagaattaatggcaaattaccataagagtcacagtaagaaattttgtaatttattcatttaaattattattatttttttagtgaaaaataaatattctaatgaggacaaacaaaaaaagatgaagcaatattttgaaatcaaggggaaatatccaaaaacaaaagacaaaataattgctaagaaattatcaattgcctatgaaaccctgaaaatgtggaaaaagaaattttcttcattaaatgatttttaagaagtacaattataataggcattttaatgttttcgattgttgttaaaatggtttttttctaaaatttaaaagcgctttgaaaaatttggtcagattattcaatgtattttaataaa

SEQ ID NO: 58307 - DNA, 1432 bp, Heterodera glycines; identical to SEQ ID NO: 5514
  misc_feature (47)..(47): n is a, c, g, or t
  Genomic contig location: Contig_ID=SeqID_5514; Location=1..1432; Strand=+
  SCN-specific regions: Sequence locations=1-82,106-112,134-389,416 -498,527-557,599-702,733-857,916-941,974-1432
  Gene Ontology: Mol. function=extracellular matrix structural constituent; Cellular component=collagen type IV; Biological process= extracellular matrix organization and biogenesis

SEQ ID NO: 58308 - DNA, 458 bp, Heterodera glycines
  Genomic contig location: Contig_ID=SeqID_27622; Location=12..469; Strand=+
  SCN-specific regions: Sequence locations=1-120,142-458
  Gene Ontology: Mol. function=structural constituent of cuticle; Cellular component=extracellular; Biological process=cuticle biosynthesis (sensu Nematoda)
gagaggctggtgcccccggacagcccggtcagcctggagcccccggtcagcccggcgcccccggacagcccggcccgaagggaccccctggcgcccctggacagcccggaaacgccggaggcaatggccagcctggtcaacccggacagcctggcaaccccggagagcgcggaatctgccccaaatactgtgccatcgacggaggagtgttcttcgaggacggcacacgaagacgttgaaaaggcacgaacagtccaaatgcaacaggagaagaagcggaagaagaacagtcactcccccgccccgcccctctccccactttccggtgtccttattgttcttattttttgtagtttccccaattcatccaaatttcgtccccaaaaaactgccatttgttccctccttcgatgagaagcgatcagtgatcactatccgaaattgcaaaagatcagcaa

SEQ ID NO: 58309 - DNA, 709 bp, Heterodera glycines
  Genomic contig location: Contig_ID=SeqID_27623; Location=22..730; Strand=+
  SCN-specific regions: Sequence locations=1-92,115-222,272-357,379 -398,421-642,664-709
atgcttgaccgtccccgctttagaaccgtaggagctgcgggaaactaccgcgcaatccctgaggggcccggggtaaagcaattagtccaatgaatattaattaattttaattaagggacaaaagtcaaagtctaattaaaaacaaaaagagaattatgtcaaatcgtcaaaataggcattttgtgatacgtaaaagtcaaattataaatcataaggaaacagattaaattattctaattcaaattttatctatttaaaattacatttattagtgtaaatcggtggtgtgtgccgaagggtacaaatgcactgttggggcgtcggttgaaaaaattggtgatcgaccgtttgcccaatcagtctgtaagtaaaaaatctaacggaaaggtaaaatgaccaaattaattttataaaaaatttggctccaatatttagccttgccgcaatgcgttgtcaacggcggttcattaaaagatgtgagaacgaaaatccgaggcggaccaggggtaattaatgcaataattaaaaaatggatttactacacttatgggtccaatcaatgatcttttcttcattggtttaattttaacattaattggtatcaattggaagcttaaggtctcggaaagtaagacaatatgcattttttaatatatatattttcgtcttaatgagcttatttgttagaatatgattatttaaaagggca

SEQ ID NO: 58310 - DNA, 542 bp, Heterodera glycines
  Genomic contig location: Contig_ID=SeqID_27628; Location=1..542; Strand=+
  SCN-specific regions: Sequence locations=1-38,60-299,326-451,473-542
ggaaaagtgatgctcactaccgtaatgaacaacggtaatttggggtggggggacgaaaataatagaaatcttgttcttaatcaaaaggattcgtcaccgtcgaagagggccccgccggtggctcacgaatccgcttcaaactcgtggacattggccgtatcagtttcagccgggatttgcccgtccacgacgtaaatccgattaaaattagcgtaaattgggatgccaaacggaggcaaccgaacaaatgccaaaggatcaaacgaaaataaaataaatgggaataaaggaactcggaaaagcatttttatttaaaaatctttttggtttggcatgaaaaacccattaaacttaagtatcctcaccaatttaagttggtccgcgaatggactcagttggaccacaaccatttcgaggcccgtctcgacatggaaacggcgagaaaatctttccttttttcccaatcagctgattaattggatttttagctaacccatggaatgcaagaacacacagtgattgtctacacaaaagtgatgtga

SEQ ID NO: 58311 - DNA, 415 bp, Heterodera glycines
  Genomic contig location: Contig_ID=SeqID_27630; Location=364..778; Strand=+
  SCN-specific regions: Sequence locations=1-46,68-319,342-364,398-415
atgtcgaaattatattacccgccaccaaattggaagccgaaaccgagcaaaaagtcaggtgagtggggaaaagccgaacaaatcgaattgaacggtcgaaatgaccgacgggagagaaaattaagtcaaaaaaaaagaaaaagcattttgcattttcagccggacattcaactgttatggcgaccacacgagcggcaacttgtgagttaattaattggtcatttaaaagtaattaaagaaaaattggaaaatgaaaaaatcaacgattaaaacgacccattctgttctggtttgtacacatccgctgacaaaatgttgatcaaaaacaacagcaaacaaactctcgacaaaaaatgacatgacctttttaattttaaaatattttaatattttattacacaaaaaaacatttcaa

SEQ ID NO: 58312 - DNA, 66 bp, Heterodera glycines; identical to SEQ ID NO: 53774
  Genomic contig location: Contig_ID=SeqID_27631; Location=202..267; Strand=-
  SCN-specific regions: Sequence locations=1-66

SEQ ID NO: 58313 - DNA, 302 bp, Heterodera glycines
  Genomic contig location: Contig_ID=SeqID_5516; Location=521..822; Strand=-
  SCN-specific regions: Sequence locations=1-302
atgcattggcaaaatccgaaatccccgcagtcgccgcagtgccaagacccgctgaattctgccatattgcgctgggaattgccacgtcaaaaggacaccacttggagcgtgctgttcgaacgagcgcaggcattggccgaccaattcccggtccgtctcgggaatttcttccctttttgattttcatttccgtctcaggtcaaactcgagaaagagaccgacggactcccccaaattgtggacttttcgctcactcagaattcgctggagcaagtgttcatgagcttgaccaatgtggacgt

SEQ ID NO: 58314 - DNA, 3507 bp, Heterodera glycines
  Genomic contig location: Contig_ID=SeqID_5517; Location=104..3610; Strand=-
  SCN-specific regions: Sequence locations=1-37,62-69,91-158,180 -241,263-468,494-725,747-2201,2223-2232,2254-2429,2455-2682,2704 -2866,2888-3507
  Gene Ontology: Mol. function=ATP-binding cassette (ABC) transporter activity; Cellular component=integral to membrane; Biological process=programmed cell death
ctacaaggaatacggatctcctcaataaattagtccctgtccttattgtgatgtgcattttgatcactttgatgccctcctttctgctcaaactgatggtagaagagcgctcgtcccgtttcaagcaccaagtaaactatggaaataatgtcaaatcaaaaacaatattttgacacaacatcagtaaaaagataagaaatcgctcaagacttcgaagtttttccattggttcatataatccaataaaaattttaaaaaattaccaaaatgcaaaaacccaataaatctcataataactaattgattgtttgcttctcttttccagttgctgctgacccgtctccatcccatcatttattgggcttcatttctcctgttgcacttgaacatttacgctctgttttgcttttgcatttcgttgccaatttttgtttacggaatattggaagggggcagacttcggtaagttctttgtttgtttaaaattaacaaaaaccgtgatttcaaataagacttcaacccgattccggtcttataaaggtcaatttttgagtttttttccatgccttgaacagctttgttcatcctaattatctaattaattttacgtctttctttcagtcttccgctcctttttgccctcttcttttggatttaccatccatggctttgctgtgcgtcgtttctgttcaaaacggtgcagtccgtcacaagggcacttttggtcctcatcgttctgagtcttgttggtatcggaattgtgttgctattcgaatctttatttcctgttatggattgggtgccaacaactctgaacgttgttttctttttgctgctgccaccgtatgacttcagtaagtgcttaccgtatgaaattagttttacagtgttttgcccctctttaccccccccccccccgccctggtcatacaacagaaaggcggggggaagggagtcatagaagcagagtacggtatttgttgtcgtccaaaattttgttccaatttctcataaataattagcatctttccccagtgaacggactgtacagattggtttatcgaaaagaaagcctccacgcggcatcggactacatccttagcatgtttgccttgggcacttttcactggctgctccttttttgtctccaatcgcatttcgttgtccgacaattgaaccaattgaagtgtcgcattttcaatcacagactttaccaaagggtaggcattcacttcttttccggcatatccgagaatttcttttattttgtggctttttgaatgtttagcgaagatgcttttttctgatttttagcaaaatattgacaaatcgcataaaatccgtaatttgaaaatttttaacaaaaaccgagtgaaaatgtctaagggttattgagtcaaacgaaattttgataatttgcgatcggtggtacttcaaactgttctgtttcagcttcgatcccgggatttttccgctgaagaagacaaagatgtcccccgaagagcgggaatttgtgaaacaagaaggcgtcgagaacttcgtattgtacattaatgagttgagcaaatattacgggaacgtgcccgccatcgatggcataacattcggagtgcagcgcgatgattgttttggcttgctgggtgagttttctcaaagcataaaattgcaggactggtttcggcagaaatccccatccctggctctcatcactgtcaaagcacgcaaaaatcgatcttctagtttgaaatggtttatgtttgggcgctatcgtgccgacagacgccttcggattggccctattaattgttgatcacgttcatttcaggcgttaatggcgcgggaaaaacgacgaccttcgacattctgtccggcattaaattcgccacctcaggcaccgcagcaatttccggcgtttgcgtctccaagcatccgcccatcggttattgtccccaattcgatgctctcccaatggaactcactggacgtgaagtgctccatttgattgctcaattaaacggcttttccgaagtgtcgcaaaagacggagaccattttgaaatgcattcaaatggacaaacaagcggacaaacggattaaacacaacaggcaaaaaacagaatttgtgttaaaatggatgaaatgccaaaatatacgcaaaatttggactgataatctaacaatacgaaatagtttgccgaaatttttaattgaatatcaattccccaataaagaggtaactaatccaacttcaaatttagcggtggacagcgtcgtcgtatttcgcttggcgttgcgttgctcacttgtgccaattttgtgctcttggacgaaccgaccgcaggcattgacccgggcacgcggcgcgatgtttggcatctcatccgtgcaattcgccagcagggcactgccgttctgctcgcctcccattcgatggaggagtgcgaggcgctgtgcagtcgaattgcagttttgaaccgcggcagattggccggcattggcaccgcccaacacttgaagagcaggtagaacaatcgaacagcgggggaaggggcagaaaatgtggaaaaaggcaacaaaaaacattattgtttaaatcctggaaggatgcaggtaaagtgtgcctgtctttagtgatggagtggttgcttgggttcgggtcccatttttctacgtgttttcgcccattattatttttaaattttttgactttgaacgcttttttatttatttgttaaataaagtttatgatagataaatgagaaagaactgaattaattaagcggaaaatttttcagtttttattttggaccaatttttagaaaaatttaggagttttcttttgagtttcattataagtcaaagcagaaagaatatacaaaaactaattattttaaaaaaaccattttgaattggcaaaaaaaaactaaaaagttgaacgaattctgtagaacttttgagaaattatggaaaattcatgtgctaatttttgcaaatttacttgtctttctgttcataattttagtgcaattactttttcttagatttggcaacagttttctgctttccatcaccgttgccaacccgtccaaagccatcggtgccaaattggacaaaatggtccgtgatgcgatggctgtaagttgaatatgacggataagtacatagacaaaatccgaaatccccgcagtcgccgcagtgccaagacccgctgaattctgccatattgcgctgggaattgccacgtcaaaaggacaccacttggagcgtgctgttcgaacgagcgcaggcattggccgaccaattcccggtccgtctcggaaatttcttccctttttgattttcatttccgtctcaggtcaaactcaagaaagcgaccgacggactcccccaaattgtggacttttcgctcactcagaattcgctggagcaagtgttcatgagcttgaccaatgtggacgtgtaactttttcgccttggattcaagcgattttctgtatccctgcggctc

SEQ ID NO: 58315 - DNA, 806 bp, Heterodera glycines
  Genomic contig location: Contig_ID=SeqID_5518; Location=775..1580; Strand=-
  SCN-specific regions: Sequence locations=1-293,326-602,624-666,697-806
atgcataaccactatattaaacgaatattgtaattagggcaagggaagaatttcgtaaatccatgcacccaaatgtttcaaatccatcagaccagacaggctaatgtggtcattaattctttaattgtcgggtcaaaggcagcagagcctttttgactgttttacatttattttatttggtttattcattttttgctcaattttctgagtgctaaacatttgaaacctgaaggacggaccccccccccccccccctcgtatcagctcctcctcctcgggtccaaccctcggacattaaaaagatttatatattttttaaataattccggtggaatacgatacgggggaggggggagtggaaacaactcctcactgcccatgtatgtactcgataatacttttttgtttttcttaatttggcaagttattcctcaaaatctaattattttttcttttaggttgtcaatgctggaagggttgtggaggatggccagcagaaacgctttggtggtgcaattgcaacggttttggccataattcggaagcattcgccccaagcatacattgaaaacgcacaaaatccgcccgaatttacaataattttgccagtccaagacaaaaaactgtaagaaatatttgttttttttgtcaaattaaaaaatctgcttatatattttttacaaaaaaaaataattaggctctttccaaaatcggtctctgctcattttattgacatttaatttttttagctttgccggtcttttcaaagaacttgaacaaattgtgggcgatcagcggccaataaa

SEQ ID NO: 58316 - DNA, 685 bp, Heterodera glycines
  Genomic contig location: Contig_ID=SeqID_27633; Location=237..921; Strand=-
  SCN-specific regions: Sequence locations=1-571,636-685
atggggtgtctgtcgaacaccaaaacggccgggcccattgattcatacttgggcaagccggtcaagaacagcattttcactttctacggtgccggcggacgcggcgcgtgcggtctagacgccggagtggtaagtcaagaaaagtgatgagtgatggtaaattaaatcttaaaaatcatagtttcgaaaaagagcccctatttacaatacaattttgatggcatctcatattttagccaaaaatgtcagctgccggctccggccaattgttcaagtcggacgggcagtggaaagacgcatgccgagccgacaaacagtacatgttggacgacccgatttgcaagaacatttgtatcaaagttgattacaatgggaaaacgtaggacaaacacttgccaaccgtctctgatcgtctcaattaattatcctaattactaaagtttgaccgttccaatcaataacaaatgcccggagtgcccgcccaaccacgtggacttgtccattgatgcgtttaactttttggagccacgcgggggtctcgtgggcatagcgagaagttcgaaaaaaactgttttttaataattactttgttaattaattatatattttttaaaattattttttgataattaattgcatttttagatgccacgctcacttacatgaaatgcccgtcgagcgttaa

SEQ ID NO: 58317 - DNA, 264 bp, Heterodera glycines
  Genomic contig location: Contig_ID=SeqID_27634; Location=97..360; Strand=+
  SCN-specific regions: Sequence locations=1-264
attagcatcagacaccgagtcagagctgccttgagaccaccggaggaggatgattcattcttctgatgtcaccgagcccaatgagcggattgacacctggagaaccgtccttaacttgcggttcggcgactaaccaatgttccagccgattgtgaaaagaatcatactgaagcgaagacaacagaagtgatgttgcggaaagcgactcaaatttcttaaaatctaatttgtatttatttttgtcgataatgtttctctcgttca

SEQ ID NO: 58318 - DNA, 879 bp, Heterodera glycines
  Genomic contig location: Contig_ID=SeqID_27638; Location=68..946; Strand=-
  SCN-specific regions: Sequence locations=1-45,67-83,115-135,174 -223,291-370,392-795,821-879
  Gene Ontology: Mol. function=protein binding; Cellular component =secretory vesicle; Biological process=actin filament-based process
atgacaccaccgcctcctcctacagagagtgccgaacatatcaacgggttgcagccaccgcctcctccaagagagaatgtcgggcccgtgccgccaccgcctccccctgcagagagtgccgagtctgtcagcgaattgccgccgccaccacctcctccttcccttcagccttcgcttccattatcacttcctccaggcgccaatgtcgccacttttctgcactctccgccaccgccgccccctcccccaccaccgcctcctcgaccttttcatccgccttcacttcctccacaaggcaaccgcaactttcttcggtcaccaccgtgtcttcttccaccctctccgtcgggtactgtcgcctttttacacacgccaccgcctcctcctccgcaccctcggcctgcaattcctccactgatgatgccaataacaacagcgacgacaccgactccaatgcggcactttgcttctccacatccgccttcgctgtacccacttcgggttacatcgccggcaatgttcgcccgttccatcggttctccactgcctccacggatgactttgccggactcgatgatgcattttggtccacctcatacttctccactgcctccacggatggcgccgccagttacaatgatgcattttggtacgtctcgtccttctccgatgccttttcgtatggcagcgaggcaaatgttcccatctgccgctgctccaccgcaacggatgacggcgcccacttcgtttcttcccacaatggcttctccccctccgttgatttgtgctccatcctcttctgctgctgctcctccacgactgccacaaagccaaccaatggcagcgacaactgatgccaccacgccacaatcatcgaag

SEQ ID NO: 58319 - DNA, 438 bp, Heterodera glycines
  Genomic contig location: Contig_ID=SeqID_27639; Location=703..1140; Strand=-
  SCN-specific regions: Sequence locations=1-1,24-160,190-321,355-438
aaaatctataaaaaatttaaaaatgagaattcatgcgagattttctggaaataagcttaattgggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaatatttaaaaatctataaaaaatttaaaaatgagaattcatgcgagattttctggaaataagcttaattgggcctagttaagctgtaaaaaaaatttggggcgatttgaaagaga

SEQ ID NO: 58320 - DNA, 626 bp, Heterodera glycines
  Genomic contig location: Contig_ID=SeqID_27640; Location=27..652; Strand=-
  SCN-specific regions: Sequence locations=1-327,350-626
atggaatcgttttgctgcgtttgtaaagctatttatggaggaacccacagctgttccgtctgcaaattgccgtgccacacattctatggcgattctggtggagttgaaaacgaaggcttcggcggaaaggtcgtgtgccacaactgcgtaaacgaggaaggaaacgcaacgatagcagaaggctcagaaaacgatgaacaagaaccgcaaaacaataaagagaatgaaggcacaccgacaaaagacaagaagcgccacagaaacaacgatgtgatgaaaaaactggaggcagttgagtgggcgcaaaaaaactcaataaatgcagcagcaaagaagttcaaagtgtacaggaaaacgatcagagattggatcgcgcatgaagataagctgagaaaacaaatgtaggtatttaataattttttttgtttgtgatcaaaaattttagcatgtcaccaaatggggggaaacgaatgcgactcgacggagcaggtcgcccagttcaccgtccggacatcgacactgaactggccgaatggatcagcgaaaaacaaaaaaataaacagcctgtgtcaaggagcatcattcgacagaaggcggctgcgctgttcatggacactgacattaag

SEQ ID NO: 58321 - DNA, 1053 bp, Heterodera glycines
  Genomic contig location: Contig_ID=SeqID_27641; Location=291..1343; Strand=-
  SCN-specific regions: Sequence locations=1-143,165-205,254-254,276 -439,570-665,710-795,821-852,876-1053
atgacaacggcgcctcaagcggcggcagcgactgcgctgtcggcacttcaaaacccacttagtttggcacgactccccccggcccacggcagcgggttgaaaacggcgccggcggggtcggcacaatctttggcggacagatatcgaataaccaaaaaggtgaaagggcggccaacagcagcagcgatcgaaggaaaattacatcaattattttttaatttcctaattatttaatttatttttttgattaattccctttggtttggccttttctccgtttgattctcacattttcctaaattcaaccaattcgttgtctttttcctagagtgcagcgggaccgggaattttgggcaaaaccgggaccgggacctgagaagccgggacctcggtttttttcgggaccgggaaccgggaccacccgggaatttttaagttcaaaaaatttttaaaaatttaaaaaaaattcaaattttaatttatttcacgtgaaaatattaaataattaaattttgatttttattttataaaatccaaaagttaaaacaaaattaaattaataaaaatttcaaacaaattttgttcaattatttcaaacaattaattaatcacttttggactaagtgatcgaatattattataaattcagatttacttttcagatcaatttttttctaaaagaatatattaatattttttaaaattttttccttgtaaccaattttcatcattaatttttcacccagacccccattcttaccagtgcttgtttttcccggtttccggttgcccattgggaccgggacctgagcttttcaaattccggaaccgggaccgggacctcaaaggaccgggaattcccggcccggtcccgctgcactctaatttgcacccctaattttcaaattttttgtgcatatttgatgcatattttgcgatttttatgcatatttgatgcatatacgacattatttgcatatttatgcgcatattttggccacttttcgtgcatattttttgcagccctgttgattggtctatgtaattaataaa

SEQ ID NO: 58322 - DNA, 1134 bp, Heterodera glycines; identical to SEQ ID NO: 27643
  misc_feature (1084)..(1084): n is a, c, g, or t
  misc_feature (1090)..(1090): n is a, c, g, or t
  Genomic contig location: Contig_ID=SeqID_27643; Location=1..1134; Strand=+
  SCN-specific regions: Sequence locations=1-73,95-432,454-619,649-1134

SEQ ID NO: 58323 - DNA, 613 bp, Heterodera glycines
  Genomic contig location: Contig_ID=SeqID_27647; Location=296..908; Strand=+
  SCN-specific regions: Sequence locations=1-89,111-613
atggacaacgaagcggccgggacggacggagaagcggtggaggacgaggaagtgatgacggacgcggacttcgaacgcgccatggaacagctgagggaggagggcggcgaggacgtcaacgaattgctcagtgcgttttgccaaaagccaaaacattgccaaattaaacaatggtcgcctttttagtggcaatgagtgaaaatcgcatcatcagttgggaggtgaaacaaaagtcagattgaggggccattgcgaattggccattttttaggaagccgaacacattttgggcaactcgacaaatgaaccggtaaaatcgtcgcttcctcagcagacgcggcccacggagccggacaacgacacggacgtggactggtgcgtacaacggctgatgaacaacgacccgaaactagtggagataaacctgaacaacatgaaagtgcgtgccatggggtggaaagggaccgagtgtttttcgatcactatcgattgattgattatcaaatcatttatcgatcgctgctctattaaactattgattggatcacattaattgatctgctggtcaatctgccgctgattattgcttttcagaggacacccattcccaaaa

SEQ ID NO: 58324 - DNA, 80 bp, Heterodera glycines
  Genomic contig location: Contig_ID=SeqID_27648; Location=261..340; Strand=-
  SCN-specific regions: Sequence locations=56-80
gtcctgcccataatatctgtggcatggaataaattttggaactgcgctgcctaactgcggtgcttaaagtgcgctaaaaa

SEQ ID NO: 58325 - DNA, 80 bp, Heterodera glycines; identical to SEQ ID NO: 51817
  Genomic contig location: Contig_ID=SeqID_27648; Location=873..952; Strand=-
  SCN-specific regions: Sequence locations=69-80

SEQ ID NO: 58326 - DNA, 149 bp, Heterodera glycines
  Genomic contig location: Contig_ID=SeqID_27649; Location=1..149; Strand=-
  SCN-specific regions: Sequence locations=1-65,95-149
atttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgt

SEQ ID NO: 58327 - DNA, 691 bp, Heterodera glycines
  Genomic contig location: Contig_ID=SeqID_27649; Location=560..1250; Strand=-
  SCN-specific regions: Sequence locations=1-192,216-691
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagctctttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccgataaatctgggcgcatcggttcggggggactgccccgaaaacgaaaaaatcgattttttcaagtgtccgtttggggtactcaaacgattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaac

SEQ ID NO: 58328 - DNA, 345 bp, Heterodera glycines
  Genomic contig location: Contig_ID=SeqID_27651; Location=590..934; Strand=+
  SCN-specific regions: Sequence locations=1-45,100-345
atgttccgatatgacgagaagttccccgcttcggtaactcaaagccccgccgatgaaaagggtttgaaatttaaatttcattttaaaataaaaattttagcttcccaaaaagagggaaacagtcccgtggagattccagatgtgtttttgacatatattattaaaaaattcttttggcagacattgcgttggccattggacaatgtaagcagaaaggaatggactgttcggcgaagaattaccgacaaatgcttggccaagcattggtcaaaattcgatttccaatcattaatatggattttttggctgatattggtatgcaattttacttgcgctttacagtag

SEQ ID NO: 58329 - DNA, 673 bp, Heterodera glycines
  Genomic contig location: Contig_ID=SeqID_5522; Location=4022..4694; Strand=-
  SCN-specific regions: Sequence locations=1-363,391-673
atggagcaagaaattaagcagaaaaaactggcggtggtccatgccggacgaagcattgactcggcactgatcagcatcgaactgtcgttgctgccgttcgccgccgatctgtccgcccaattggaacagttttatggcgccataaatgtaaatgaaatgaaacaaattgccacacaaatcgccgaacaaatgatttgtgcactgatcgagccaattgatgtgcgggaggactttttgaaaacatacatcaaacagctccaacgagcattgccgcagaacattttgttggcatcggcaggcgcttcgttcattcgtcccatggaattcctcaccaaattagaggctagcagcattagcattagcattttaaattttaaatttttaaatttagatggctgactttacaagcggagcagaaagttccgtacaaagttcggcacaaagattgatcaatctcaattttaagctgtacaacggactgtacaaagtgtcgagcaatttgctcaacgcaattcccacaagtttcgagaaagtgccgggaattggcatttttttgcaaaaaacgaaggcatttgtgcgcattataattgagcttatgagaggatttgtggagaaggcaagagaaatcggactaaacagggccaaaatcgagaaatgcgaagacggccaatga

SEQ ID NO: 58330 - DNA, 470 bp, Heterodera glycines
  Genomic contig location: Contig_ID=SeqID_5523; Location=913..1382; Strand=+
  SCN-specific regions: Sequence locations=1-192,216-447,469-470
atgagaaaggcccttctttgcctattgttggatatacagtgagtgttacacaaaatgatacgttgacccccgtatttcagttttttgaatgttctaattaacgaaattgtttcagcggaggccattttgtagagcaattaaccaaaggccattttgtagagcattttgtgctctttcagattggcttaataattttttcaagaaaaattttctaaccccttaggaatttttttcgtaaattttcccgatttcaagccattttaaagttttcagattaccatgaagcagtgatctgatgaacatggtttaattaacttttttgatgagcttaaagatttttcttacataaattatatcagattttttgggcgacattttccgatattatgatttttttttgaaagtgaacgtatcattttgtgtcacctattttataaaaaattgctggatattgaagacccttttatcaa

SEQ ID NO: 58331 - DNA, 821 bp, Heterodera glycines
  Genomic contig location: Contig_ID=SeqID_5523; Location=1406..2226; Strand=-
  SCN-specific regions: Sequence locations=1-578,689-821
atgtcctttcttttcggccattgtcctttttctctttcccttttttgcttcttccttttcctctgcttttcgctgctcgttttggctgatgaatttgccgaaaatggccaaaacggcgctttaaaaagccaaagtcagcccaaggaaagacggctgcgaaatcggccacgcgactttctgtcggaatgtgtgacggggtaccgggaacggatcgaattccattgccaattcccgaacatggacaagccttgtctgcgcgaaaatgctgaaggtgtgacgactttggcactcaaattcgctttttcgattgcgatggatcccatgttttgtcccaaaatgatttggtcccattcactgatcacctgatcacagattccgtccatcagttggacgtgttggctgccgagtgctgtgcctccccccgcctatgctccgtcgatgacattgagtcgttttgctgtcgtacgatggactgcttgggcctgtgctacggcgactccttcttggcacaaattcaaagccgcttccgttatgcggacattttgctgaaacggcactcatcaaaaggggcggcggaaaagaggggacgaagaacgacggaggaggaggaggaggaagaaaaaagagatgaagatgatgatgatgatgaataagaaaatgatcggatgaacgttgaagagaatgatgagccaaagaagtgaccgtcacaaaggaatactgtcttatacagtgtgacacaaaatcatacatcatccttgaatttcagttttttagaatgttctaattaacgaaattgttttgaaattgtgcaaagcaataaa

SEQ ID NO: 58332 - DNA, 62 bp, Heterodera glycines
  Genomic contig location: Contig_ID=SeqID_27652; Location=1..62; Strand=-
  SCN-specific regions: Sequence locations=1-62
aattgttttgaagaaaggtgctcaaaaaacgcatttctgcattaaaaattttcgattctgag

SEQ ID NO: 58333 - DNA, 701 bp, Heterodera glycines
  misc_feature (550)..(550): n is a, c, g, or t
  misc_feature (606)..(606): n is a, c, g, or t
  Genomic contig location: Contig_ID=SeqID_27654; Location=244..944; Strand=+
  SCN-specific regions: Sequence locations=1-10,33-65,87-398,420-701
atggagcccggtgcgaagaagagcagaaaaaggaagaatgccgaaaacaccgacggcgaggctatggaagtagatgaggaagaggatgccgtggatgaggacgccgagaacaactggatgctgggatacgaagaagccggggagaagccggagtcggtgacaacatacgcatacgcccacgccggtaattttgaaattattcaaaaaaacttggaataaataaattttaaaggttcccgctacgaccatgtgctggtttatggtgaaatgctgcgcatgggtgtccgccctgaactcatccgccaaggcaaccatctcctagagatgaaggcgcgcaaaacgggagtctacacacccaccgtgtttcgggacaggtaaaaattcaaactgaataattttttattttgtcctttcagctacaagctgatcccgatcaaattggcaaattttgtcaagacgtttggtctggaaattgagggcgtggaaaacaagaaatattttccacacaaattcaataagggtaaggggttaatttaggaaaataatttanaaaaaaaaactcataaatttcaggcggaaaactacggcacagtcttggaaacctgncaccgatggaggactattaccccagtggactcttcccggcagagcgcgcaaagtttgagcagtggtacgacgagacccgggaaaactggttttga

SEQ ID NO: 58334 - DNA, 328 bp, Heterodera glycines
  Genomic contig location: Contig_ID=SeqID_27655; Location=144..471; Strand=+
  SCN-specific regions: Sequence locations=1-187,209-328
atgactttcagtttgttttcatgcatttaagtcgttttcgagacattaacccaaatttctaaaatttaactttcgattctttgttcgaaatcgggtcctgttttaggaattggtcgaaatggatgccatattcgtgatcagcggcccaagtaacccccgacggtgggcacaaacaacttcattcttttgttgattatgtacacaatttcccctccatttttaaggcaaacgggcacaggacttggccgaagaaggaggacttgccgaaatgatggacatttttcgcactaccacggcagccgaacgaacggaggcggcggaacgttga

SEQ ID NO: 58335 - DNA, 673 bp, Heterodera glycines
  misc_feature (21)..(21): n is a, c, g, or t
  Genomic contig location: Contig_ID=SeqID_27656; Location=92..764; Strand=+
  SCN-specific regions: Sequence locations=1-137,159-673
atgcaaaaattttattgtganaattatgcaaagaaattccggcacataaagaaaagtcgaagaggcgaagaatttgccctttgtatcgtctgcaacgatgatattaatctcctttccattggaaaagctgccatttctcagcatcaaaatactggaaaacaccagaaagcggcaaaagcagcaaaccgatttctcaattcaatcccaaaggacgaattgcagaagctcaacactgaacaaaagtggatgaagctatttgaagccgatttaccgcacttgtacaagttggtcagcattgtactttccgtgccggtctcaaatgcatttgtcgagagagtgttttcgctttgcggctcacaatggactgatgttcgaaattcgttgaaagtcgaaaccgtgaaggctctggtccagacgcaaataaattttgatctcacttgcccagaaatgtatcagatgctcatttccaatcacaaactgttggatcagatcggtggatgggacaaattttgcgggacgggatcccgcgggattaatcccgcaaatcccgcatttaaaatttgcgggatcccgtgcgggattgcgggattttggaaaattcgaaaaaatttcaattaaatcaaaaaatttccaaaaatcaaaaaatgctgaaaataggggctggcgggatgca

SEQ ID NO: 58336 - DNA, 636 bp, Heterodera glycines
  Genomic contig location: Contig_ID=SeqID_27661; Location=57..692; Strand=-
  SCN-specific regions: Sequence locations=1-190,219-221,247-562,588-636
ctaagtgtttgtttaatcgaagcggaatcactaaacgtgcacatttgccatccgatcattccttcgctttctccggcacaaattcaactcaatttgcaatcgaccgttttgaattttgcggtaattgcactaacacccgttgtgtagcgggggaccctttctcgggcccgaatatttaaaaaacccatagattaaaataattataataatattttattgttcaatgtattttttattcatttttatcactagtacaatttgttaaatgagtctgttgaaagtttttcaatttttctacgtaaaacgggtcgtttttgcaattaaattatttgggcttttcgtttattgctcggcttcttctaaaaagttcaaacaaaaatcatttccagattgccttccgaattgaaaatgttaacattgattttgaaaattttgtgatcattgacgacattgaagttgctggcggtgaccaatgtggtgatttggcagcaaaattggagaataaattgcttgaccaatttcttccggtaagaattaattttccattatatttaattcatcataaaatttaattgtttttgcttttaggctccaatgctcagcagtttgttgagccgcccaattcattcggctcaa

SEQ ID NO: 58337 - DNA, 330 bp, Heterodera glycines
  Genomic contig location: Contig_ID=SeqID_5524; Location=597..926; Strand=-
  SCN-specific regions: Sequence locations=1-77,233-330
atgaaaaatggacaaatgtgtaggctgggcactgtcgcatttgtagattattatcaatttttgtgtgcatcgcttgcaaggaatggaagagaaatgaaaacagagaaagagtgagtgaaaaaaaagaatgacaaaataatgaataaaatatagaaaaatagaagaaataggcagagaaaatagagaaagtaagaaagctaaggaaattaaggaaaagaaaaaaaggaaaagatcagacacagagcgcaaagacagagaagatgtatgtggtgttcaatgtgagaagaggtgagcatatgccgagctgctctagatgggtgagaaaataaa

SEQ ID NO: 58338 - DNA, 439 bp, Heterodera glycines
  Genomic contig location: Contig_ID=SeqID_27662; Location=497..935; Strand=-
  SCN-specific regions: Sequence locations=1-98,232-244,266-439
atgagcaaaactgaaatgctattgaaggaagaaaatggaaaaattagcgaattggagatgaaaatgaaggacgaaaaggagacattcgaagcaaagttggaaaagatgaaaaaagagggagaaaaggaggcacaaaaaggagaggaaattttgaggagggcggaaaaggaaaaaagagaaatgaatttggaaatggaagcgatcaaaaaggaaagggacggaagaaaggaagaggtaattgcggaagaaagcaaaacaaacccaataatttgggggattttaggtggaaaagctaagggagcaaatcattgcatttgaggaagagaagggacatttgaaactcgaattgaaaagcgtaaaaagggagttgaagggactgaagcaaatcgaagcacaaatgaaaggtggcgaagaaaagggcaaaagcccaaggaaatga

SEQ ID NO: 58339 - DNA, 702 bp, Heterodera glycines
  Genomic contig location: Contig_ID=SeqID_27664; Location=391..1092; Strand=-
  SCN-specific regions: Sequence locations=1-702
atttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 58340 - DNA, 251 bp, Heterodera glycines
  Genomic contig location: Contig_ID=SeqID_27665; Location=16..266; Strand=-
  SCN-specific regions: Sequence locations=1-73,95-110,159-202,224-251
atgtcaatttcgaccaattcaataaattataaagatgatttcacaccagcagaaaatggaggtaaattatgagaaaaggcaaaatgggagaaaatttgaattttggggtgaaaataaataaatatttaattcaaaatttaatttatgtatattttttagaagtcaatggcggagcaattagtttggacaatgatggacaatttgatggaaaaaacagtgaacaatcggtcactgatcagcaacagtttaag

SEQ ID NO: 58341 - DNA, 156 bp, Heterodera glycines
  Genomic contig location: Contig_ID=SeqID_27668; Location=211..366; Strand=+
  SCN-specific regions: Sequence locations=1-30,56-156
gcagttccggcgcccgtcagtctgtccggctacggcgtcgagttggccatcaaaagcaccgagtacaaagccatcgacgactccaatgatcagaaaactggcggcgacgagccagcacagaatttgcacgggttcaacttcagtcttttacggtaa

SEQ ID NO: 58342 - DNA, 722 bp, Heterodera glycines
  Genomic contig location: Contig_ID=SeqID_27671; Location=406..1127; Strand=+
  SCN-specific regions: Sequence locations=1-183,214-307,330-334,370 -389,415-480,504-614,636-722
gacggaaaatggcttgaaaatgaacatcgaaatgcaacaattacattcaaaaacatttctgttttagaactgttttttggcatcaccaatggcaatgatgtgataaagttgaacggtgtgcaaatgtttgaagaatattccaattcggcgccatattgcgacatgaaaaaaatcgaggtgacataattaatgaactaattaattaatttattacatggaatgcatttttttgcttgaatgaaaactggctgaaacgcacaagatcttgtttttataagcttctcttctatgacgcattttcatatgcattttttaaaaatttaatttttggaaattttcttggaaaaataaataaattaactaatttttaccaaaatttacgcaaaaagaaaattatttattttattattttttggtttgcatcgataagagttgccggggaaacttatgaaaatttttatgtttttctatgtgagagattttcagccataaatttggagaaaattagaaaattttcatcataaaacatctaacataaatttacatgttttatggggttttgaaattttacaaatttgttcaaacaaaaaaagttagccactttagaatcatagtttaaaaaaatttattttatacttgtatgatggctttattaatttttctaggtaatgggagatgttattttattagatgaacccgagctgaatgtgccaccaccaaaa

SEQ ID NO: 58343 - DNA, 4941 bp, Heterodera glycines
  Genomic contig location: Contig_ID=SeqID_5526; Location=898..5838; Strand=+
  SCN-specific regions: Sequence locations=1-442,464-577,599-1516,1539 -1828,1850-2257,2279-3016,3038-3115,3137-3195,3229-3271,3293 -3442,3464-3528,3550-3755,3777-3931,3953-4340,4362-4376,4399 -4706,4731-4800,4830-4941
atggcctttgatcaaatggactgcgacgatgaaaaacttttggacttcgaggaggagacaccggtgaacgaaagtgtgaaatcgttaacaaaagaggaggaggagaaagtactgaaagagctgggcattgtgtctgaaaagcccaaaatttgccgatcattttcatcgccaaataatttttgtgccgatcgggtctcagtgctgaaaacggcgctgattgaaaggtcaatcgtcggttcggaaagaggtaatgtgaaagttttgatccataataaaggaccggaaccattaattttggaaaaaggtatgaaggtggcatatgcagaaaagttggacgaaatttttaatccaaatgtcgaattgtttccattagaatttgatagaatgttcgtgtctcaaaaattcataaggtcaactgcaaaattcgaacggaatttgagaaataaagaacttatttcaattctgaacaacaaaattggtgctctctcagacagtgaaaaggataaaatgcaacaattttggctgggattttctgatgtttttgcactaaatgaatttgaactcactcaaaccgatttatttccccatgaaataaaaactgaaaacgcaaccccaattaaaactgctcctcgtccaattccattcggtgtccgaacaaaagtcacagaaatgataaatgattatttgaaacgggaaataattcgaccatcaaactctccgtgggcatctccaattgttttagtagccaaaaaagatggctcaatccgattttgcctggactaccgaaaacttaatagtgtgacaatcaaagattcatacccaataccgaacattgaccaaattttgatgtatttgggaaacaaacactattttactgtgttggatctaatgtcgggttattggcaagttcgagttaaagaagaagacattgaaaaaacggcgtttacagtacctggtggtctttatgaatttttggtccttccttttggtctaggtaacgccccagccacatttcaaagactcatgaacaaaattttgtccgaatatattaacgaatttgttttcgtttatctcgacgacattttaattgcctctgaaacatttgaagatcatatgctccatctcagaaaggttttcgaaaaactgaatgaaaacggaatgaaagtcaaggcagaaaaatgtggttttgctttagaccaaaccccatatttaggacatattcttacacgagaaggactcgcaaaagatccggaaaaatacaaacccatcaaagaatttccgatgccaaaaacaatcaaagaattacaaagatttttgggaatggtcaattggcaccgaaaatttattatgaattttgcaaaaattgcggcacctttaacaaaaatgttgaaaaaacaggatgctaaggtgttaatttggtcggacggagcaaaaaagagttttgaatcattaaaatcgctaattgttcaggaagttgtacttaaatacccggattttaatttggcacaaaatgatccaaaatttaaatttcatattttttcggatgcgtcgaaagatgggttaggtgcagtgctttgtcaacgggatcaatctgggaaaatgagaacaatttgttacgcatcaagacgctgtaaacaaaccgagtcaaattatgggccaacagttttagaatgtttaggcataaaatttgtcgtaatttaagcattttatcgcatggcttccaacaatcgtatataccgaccataaggcccttccccaaatgttcaaaagcaaaaattcggtcggaaattcaaaagtagacagatggatcatggaattaggtgctccattccaattagaggtaatttataagcctggaaaagagaatcacgttgctgacgcactttcacgagcctttaactcaaaaactcttactttggaagaaaagggaagcgaaaattgcgcatacatttctgccgtcttaacacccgaaattccgaaattgccaattagtgtttctaaggaagaatgggtcgaggaaatcaaaaattctgaattggcttttatttggaactttttggtcaaaaaagaattgccacacgagttaaaaactcatcagaaacttttggaatcgcttggaaagtttacagttgatgaaaaaatcctttactatttgaattccgacagtgaatcagagctttttgtccccaataaatttgcgattcgttgataaacgaacaccattcagggccatgcgcagggcaccagagtggaaaaaagatttataaaaggctaaaatttctcaaatacttttggccaaacatgttttcggactgccaacattttgctaggtcatgtcgaatttgcgcacataaccgaattccccgaaaaaaccatccgggtctgaaaccaattaatactcaaaaaccaaacgaacttttgtgcatggatattttgaaacttggaccaacccgaaacggaaacaaatactgtttggtcatgatcgatcatttcacgagattttcagaagtgatcccaattccaaacaaaaaagcggaaacagtttcacaggaatttgttgagaaatgggttctgaaatttggagcaccagaggcaatccattctgatttgggaggcgaatttgtgaactcaattttgaaggaaataactgaaaaacttttggtttcaagatcaaccacttctggttatgatccaaacgcaaatggtctcgcagaaagattaaaccgtacaattattgaaatggtcagaaaaacgagtacaagtccatgggagtgggaccttcgcattccatatgtcacattttcacataacatcaccccaaacgaaagtaccggattttccccatcaactttatttttcgggcgagctctaaattttccaaccaatgtaacggccccaaaacgaccaaatcctctttacaccatagatttggatgaatatttgcaatttttcagagaaaattatgaacttttggttaaagaggcttcaaaaaacattgcaaaagcccaatttatccaaaagaaacaatttgactcgaaaccgaacgttcaaccaggaaaatataaattgggagatagagtaatggttttctttcgaccgtcagcacaaattaagcactcaaaattatcttggaattattttggcccatacaaaattaaggccttaagtccaaccgcagcatgggttgtgcctgtgaataaagaagaaagtgaacaaatcaaagtcccaatcgaacacttagtccatacaccaatcgaacttcccaatgaaacttttctcccaaaacaaagacgcggaaaaattttcaaaaatatgccaccttctgaaaatggaaaagaaaccagccagaagaaaattaattctgttttgacaaaatgcatcttttcagaaaatgtcgccccggcgaaattggcactcagcgcacactgctcaggcattgagcaacattcaaattgttcttgcattttgctggaagaagtgtttccgaacttgccggccatggaccctcttcgacgcgtccaattgtcatcacttggagaattaatcccaatttcaatcgccaaacagaaagggattttgctgggccatattcgcagttgggccaattcggatgaagaatcagcttcactccttcgccacattccaaatttcagtcccgacattcaaaatttcattcctccaattttaatgtgggtggaccgttgtgccgtcgcatttcaaaccctcaaaaatacgggaatgaaagttgtacagcaagagatttgctcaaaaaatccgctccaccggttcggggagttgatcagcgaagcattcgaagaagtgaaggcaaaaaatataatcggcttttcatcaatggaatccgaaaaattcctttgttacggcgactcatcggttcgagagtttgctagtaaattggaaacaaaaaccatcatttttaaaaacacactggaaatggccgaagcattcaaaaatacttattttacgactaaagtccaagaaattctgatcctgatcggaaatgacgatttggaccaaggccttgtgttaaatgatgtcgaagaggccattcgcaaaataattgttcatgcaaataaattctcaatcaaaactattttcattccacctccttttcactattcaaaaagaattttgcatggaaaattgttaaatttgttggccaaaatgttgccaaacgatggaaaaattgtgttggcaatgaaaagaggcaaccggagtttggcagaggtaacccggttcgggaacctcgaaaatcgccgaacagtgaatgaaaatggcaagttgaaaccgcctggcattcattttacaatcagttttttaactgatgtgtttggaatgaccacgccggtgaaaatgtcgtcagaatcagggagttcaggaattcgaaccccagccacttccaattcgcgtgctccgagtttgctcaatgtgcaaattccatcgccaatcattcctcacccccgtcaagagcaaaatgcttacaggcgtttcaatcgtggtcgaggaagcggccaaaatttccaaaatcggggggcttaccgcaattaccgttggcaaaatcatggggattatccccctccccctaaacgtggaaggttctgaacggatcgtcattaccttaattgtgccggataaattttatttttgattgtatttccctgcctcagacctacttataaatgacctcattattgtttcattttgttgtttatttatttgttttttttttctctcatttaataaattttcatcgcttaaaatattcgtccaaaaagagtagtccctcctatccaccctttccccctttatttcatttcagctctcgccttttcgcttcatcaaatccgctgtttgagcgtcgacgtcaaaactcgcaagcgctcgtctttcgctgatccgggggaggtgtgcggcgatcagacc

SEQ ID NO: 58344 - DNA, 65 bp, Heterodera glycines; identical to SEQ ID NO: 54797
  Genomic contig location: Contig_ID=SeqID_27673; Location=339..403; Strand=+
  SCN-specific regions: Sequence locations=1-65

SEQ ID NO: 58345 - DNA, 1125 bp, Heterodera glycines
  Genomic contig location: Contig_ID=SeqID_27674; Location=2..1126; Strand=+
  SCN-specific regions: Sequence locations=1-192,215-820,842-973,999 -1081
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtctgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatt

SEQ ID NO: 58346 - DNA, 667 bp, Heterodera glycines
  Genomic contig location: Contig_ID=SeqID_27675; Location=300..966; Strand=+
  SCN-specific regions: Sequence locations=1-222,256-468,490-536,562-667
  Gene Ontology: Cellular component=signalosome complex; Biological process=cell cycle
aaaaaaggaaaaacgatggtaatggactcggaccgtgacaaaatattggtgtccgaattgatgactttcaaaggcggactggacaaggtgatcagtgactgtttcaactcaaatgagaagtttctgcacgcgctcaaagattccttcgactttttcatcaatacgagggcaaacaaaattgcggaacttattggtcagcgtaaaaagaaagactgaaaaaccgaattttaaaatggaaatttagcaaaatttatggactcgaaattgcgcaccggaaacaaagaatgttcggaggaggaattggacgaggtgatggaccgcgtcattgtccttttccgttttgtgcaaggcaaagacattttcgaggccttttacaaaaaggacttggccaaacggttgctgctgggccgaagtgcgtctgtggacgcggagaaggcgatgctttccaaactcaggacaggtgggtacttttaaaatagttttttatttcagaaaatttgctttttcagagtgcggtgccggccttacacagaaattggagggaatgttcaaagacatggatttgtcccgagacttttgcaagacgttcaaacaagtcgcaattaaatggattttggggatttgtcttttgtttttcagtatctcgaggcaaaccacgctagagatg

SEQ ID NO: 58347 - DNA, 610 bp, Heterodera glycines
  Genomic contig location: Contig_ID=SeqID_27676; Location=268..877; Strand=-
  SCN-specific regions: Sequence locations=1-179,201-384,440-610
  Gene Ontology: Mol. function=structural constituent of cytoskeleton; Cellular component=spectrin; Biological process=body morphogenesis (sensu Nematoda)
cacgaaggcatccaacgggtgaccgagctgaaggaccaattgctggaggcggagcatgaacaatccgccgcaattgaacaacgccaccgggcggtcatccaacgctggcagcaattattagcaaattcgctggaacgacgtcgcaaattgacggaggcccaggcgcacttcaaacaaattgaggacctggtcagtgtacattttaattcaagaatggcatattttgaatcttgtaaatgccgagaatagcataattacctcctcttgtaaattacagtatctgacgttcgccaagaaagcgtccgccttcaactcgtggtttgagaatgcggaagaggatctgacggacccggtccgatgcaattcattggaggaaattcggggtaattttaaaaaatgttatatatttttatttattttaaaaatatatatattttaagcccttcgcgaggcgcacaccgaattccaaaagtcgttggttggcgccgaggacgacttccgccagttgcaggagttggaccgtcagatcaagtcgtacaatgttgggcccaacccatacacgtggttcaccatcgaggcactgtcagagacttggcaaaatttgcaaaag

SEQ ID NO: 58348 - DNA, 275 bp, Heterodera glycines
  Genomic contig location: Contig_ID=SeqID_27677; Location=308..582; Strand=-
  SCN-specific regions: Sequence locations=1-77,99-275
  Gene Ontology: Mol. function=DNA binding; Cellular component=nucleus; Biological process=RAS protein signal transduction
atgcatccgattcgtctcaccgtggcgctgaactttgccattctccaattcgaagtgcagaaatcaccagccgatgcctgtcaaactgcccaacgggtgatgaacagaaaatttgtatttcaagtttaaccgctcgaattttttttacaggcttatgacgacgcgacttccgatgcgcagacaacgggcgagagtatttgcgcggagtccgtcacgatcatgggactgttgcaggacaacatctcgtactggagtggcaacacctctaagacgga

SEQ ID NO: 58349 - DNA, 409 bp, Heterodera glycines
  Genomic contig location: Contig_ID=SeqID_27679; Location=225..633; Strand=+
  SCN-specific regions: Sequence locations=1-409
atgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaattattttagcttttaattatgctgtacaatgcttttaagccccgccgtgcggcggctccccttttgtgcactattttagtttttaaaattggttccggactttttggctttttgaaataa

SEQ ID NO: 58350 - DNA, 388 bp, Heterodera glycines
  Genomic contig location: Contig_ID=SeqID_27679; Location=166..553; Strand=-
  SCN-specific regions: Sequence locations=1-367
gcttaaaagcattgtacagcataattaaaagctaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaa

SEQ ID NO: 58351 - DNA, 202 bp, Heterodera glycines
  Genomic contig location: Contig_ID=SeqID_5527; Location=10..211; Strand=+
  SCN-specific regions: Sequence locations=1-202
tttcgtcaatttgctggtcgaccgttccgtcaatttcgacgccgacgcgatgcagctcaaatacgcgctcatttgtcgcttggttgaggccgcgccgtccgcgctgaacgacggacagatggaaatgctgcgcgactattgcacgaaagggcctttttggggggcgccggtggtggaagtcgcgacggaagaggcggcataa

SEQ ID NO: 58352 - DNA, 690 bp, Heterodera glycines
  Genomic contig location: Contig_ID=SeqID_5528; Location=315..1004; Strand=-
  SCN-specific regions: Sequence locations=1-509,540-634,656-690
  Gene Ontology: Mol. function=pre-mRNA splicing factor activity; Cellular component=spliceosome complex; Biological process=mRNA splicing
atgtcatacacaacaaatttcccgcacagtcggaaacgtacagtttatgttggaggtttcggagaagaggtcaatgaaaaggttctcacacttgcgttcataccattcggagacatcggttagatgctttttacaaatttaataaatcaaatttaaatttggtttagtcggcataagcattccgttggacaatgaaacgggcaaacacagaagttttgggtaagttgattcattttaagttgaatgttagtctttgctttttgagatttgtcgaatttgaacttccggaggatgcagcggcggcaattgacaatatgaacgactcggagatttatgggaaaacaatcagagtgaattttgcacgccctccaaaagtgaatgagcgaagtcaacgaccaatttgggcggatgacgagtggttgaagcagtacggccaggggagtggacagggcgaaccaggagaaaatggaggagaaaaacttaatgaaacggaaaggatggcgggagaagagggcgatgaggaggaagagggaagagacagcagccaacagaaactgccaaaagtttatttgggcatcaaaattggaataaggttggcattttgactctattgcagcagtttacaccaatcataaaataattgataaatttaatgcatcataactttcttctagaagcatccgaattaaa

SEQ ID NO: 58353 - DNA, 2159 bp, Heterodera glycines
  Genomic contig location: Contig_ID=SeqID_5529; Location=128..2286; Strand=+
  SCN-specific regions: Sequence locations=1-1656,1678-2110,2132-2159
  Gene Ontology: Mol. function=chaperone activity; Cellular component =extracellular space; Biological process=nucleocytoplasmic transport
acgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgagtcatccgacgacgacgaacgagtgactgatcgggattcatccgaagacgaaaacagtgaaggatgcgaatcatccgacgacgacgaacgagtgactgatcgggattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgcgattcatccgaagacgaaaacagtgaaggatgcgaatcatccgacgacgacgaacgagtgactgatcgggattcatccgaagacgaaaaaggcttcgcgcaagtcgacatcgagaagggtgggaatgcctttaaaatttaattgtgccattttcgtaattgacttaccaccccctctcccgcatcgttcagcgaactcaccggaggacttgtggagcagggtcatcgcagcgtcgcagtcattcaagaaagtcgcgttccgtgagcaagtcgccgatgaagaaggatgctcgtccgcccggaagccgtcgtccgaccagccgtgctacgatcaaccgtcgttccgaggcggaggcgaccaacaccggtgggacagcagcggatggagctcatgccgcggagaagcaaaagaagaccagcaatggatagatgacgacaaatcggatgaaaagcgattatccaacagaaattaaccatattttttgtccgtcataaatgtgttaagagcgcccctctttctccccgtgtttgtgttgtataatattcatttcctataatcccgtgagatgcctgacacacacacatccgttgtatgaatgtccccttaatattgtcagtgaaggcatcctggtgttgtattgtcgatttaatcgctatgtgtgtctctcaattatgtttttgctctaccatgataaacgaacgatagtctcttgcgaaaaaacaatggaaaatgaattggcataagatttgtcattatatcctttgtaattattcccaagaaatgaattgccgataggcaccgccgggaaaaattttgagaatttgaatgcaatttgttaacagatggttgttaaaaatgacaaaattttcatcaaatttaaaaatttaagcgcacgcatttttagctttcataaggtttatcgtttctgaatccctcctaattatatggtcgaagcaaatttcaaaaatgcgcgaaaacacggcatatttatgcgggagatgcgatgtcaagctttacactagggctgggaatttaagccaaatgacttttttttgctgactctaaatggcctttaaatgacttaaaaagtgttctaaacttgtttgaagcttctgacatgcattttttgtgatttttttaaacttttttacactttttgggatttttatgactatttgagtttttgcgactttttcgtgattttttttactttttgagtctaaatttgaattttaatgaagaaaatgccgaaaaatacaaagaaaattccgaaaa

SEQ ID NO: 58354 - DNA, 1095 bp, Heterodera glycines
  Genomic contig location: Contig_ID=SeqID_5529; Location=27..1121; Strand=-
  SCN-specific regions: Sequence locations=1-1095
  Gene Ontology: Mol. function=chaperone activity; Cellular component =nucleolus; Biological process=nucleocytoplasmic transport
atgtcgacttgcgcgaagcctttttcgtcttcggatgaatcccgatcagtcactcgttcgtcgtcgtcggatgattcgcatccttcactgttttcgtcttcggatgaatcgcgatcagtcactcgttcgtcgtcgtcggatgattcgcatccttcactgttttcgtcttcggatgaatcgcgatcagtcactcgttcgtcgtcgtcggatgattcgcatccttcactgttttcgtcttcggatgaatcgcgatcagtcactcgttcgtcgtcgtcggatgattcgcatccttcactgttttcgtcttcggatgaatcgcgatcagtcactcgttcgtcgtcgtcggatgattcgcatccttcactgttttcgtcttcggatgaatcgcgatcagtcactcgttcgtcgtcgtcggatgattcgcatccttcactgttttcgtcttcggatgaatcgcgatcagtcactcgttcgtcgtcgtcggatgattcgcatccttcactgttttcgtcttcggatgaatcgcgatcagtcactcgttcgtcgtcgtcggatgattcgcatccttcactgttttcgtcttcggatgaatcgcgatcagtcactcgttcgtcgtcgtcggatgattcgcatccttcactgttttcgtcttcggatgaatcgcgatcagtcactcgttcgtcgtcgtcggatgattcgcatccttcactgttttcgtcttcggatgaatcccgatcagtcactcgttcgtcgtcgtcggatgattcgcatccttcactgttttcgtcttcggatgaatcccgatcagtcactcgttcgtcgtcgtcggatgactcgcatccttcactgttttcgtcttcggatgaatcgcgatcagtcactcgttcgtcgtcgtcggatgattcgcatccttcactgttttcgtcttcggatgaatcgcgatcagtcactcgttcgtcgtcgtcggatgattcgcatccttcactgttttcgtctatgattcggatgaatcgcgatcagtcactcgttcgtcgtcgtcggatgattcgcatccttcactgttttcgtcttcgggatgatcgcgatcagtcactc

SEQ ID NO: 58355 - DNA, 463 bp, Heterodera glycines
  Genomic contig location: Contig_ID=SeqID_5530; Location=223..685; Strand=+
  SCN-specific regions: Sequence locations=1-463
  Gene Ontology: Mol. function=chaperone activity; Cellular component =extracellular space; Biological process=protein folding
tgaaggatgcgaatcatccgacgacgacgaacgagtgactgatcgcgattcatccgaagacgaaaacagtgaaggatgcgaatcatccgacaacgatgaacgagtgactgatcgcgattcatccgaagacgaaaacagtgaaggatgcgaatcatccgacgacgacgaacgagtgactgatcgggattcatccgaagacgaaaacagtgaaggatgcgaatcatccgacgacgacgaacgagtgactgatcgggattcatccgaagacgaaaacagtgaaggatgcgaatcatccgacgacgacgaacgagtgactgatcgggattcatccgaagacgaaaacagtgaaggatgcgaatcatccgacgacgacgaacgagtgactgatcgggattcatccgaagacgaaaaaggcttcgcgcaagtcgacatcgagaagggtgggaatgcctttaaaatttaa

SEQ ID NO: 58356 - DNA, 1677 bp, Heterodera glycines
  misc_feature (52)..(52): n is a, c, g, or t
  Genomic contig location: Contig_ID=SeqID_5530; Location=1..1677; Strand=-
  SCN-specific regions: Sequence locations=1-200,233-287,319-1677
  Gene Ontology: Mol. function=chaperone activity; Cellular component =extracellular space; Biological process=nucleocytoplasmic transport
ttttgcatatttgtgatatttcgcgatttatgtgcactcctgggcatatttntggcatttcatgcatattttatgtgcctttttgggcattttttcaataaatcctctattaaaacggccccctctattgaagcggccatttgggctctaatgaccgaaaatttttcaaaaaaatcacatttttgagtatattttctggtaaaaaagtaactttttaaaaaattggaattttatgccaaaaatagtcagaaaatagaaaattctcctttttttgctcaattttcttcaaaataaataaatataaaaatttgaaaatttgccctcaatttggaaaaatttatgtgcatatttttcactttttatgtgcatattttgcaatttttggtgcatattttatgcgcatattttgcgattttatgtgcatataattaccatccctatttatcatggtagagcaaaaacataattgagagacacatatagcgattaaatcgacaatacaacaccaggatgccttcactgacaatattaaggggacattcatacaacggatgtgtgtgtgtcaggcatctcacgggattataggaaatgaatattatacaacacaaacacggggagaaagaggggcgctcttaacacatttatgacggacaaaaaatatggttaatttctgttggataatcgcttttcatccgatttgtcgtcatctatccattgctggtcttcttttgcttctccgcggcatgagctccatccgctgctgtcccaccggtgttggtcgcctccgcctcggaacgacggttgatcgtagcacggctggtcggacgacggcttccgggcggacgagcatccttcttcatcggcgacttgctcacggaacgcgactttcttgaatgagcgacgctgcgatgaccctgctccacaagtcctccggtgagttcgctgaacgatgcgggagagggggtggtaagtcaattacgaaaatggcacaattaaattttaaaggcattcccacccttctcgatgtcgacttgcgcgaagcctttttcgtcttcggatgaatcccgatcagtcactcgttcgtcgtcgtcggatgattcgcatccttcactgttttcgtcttcggatgaatcccgatcagtcactcgttcgtcgtcgtcggatgattcgcatccttcactgttttcgtcttcggatgaatcccgatcagtcactcgttcgtcgtcgtcggatgattcgcatccttcactgttttcgtcttcggatgaatcccgatcagtcactcgttcgtcgtcgtcggatgattcgcatccttcactgttttcgtcttcggatgaatcgcgatcagtcactcgttcatcgttgtcggatgattcgcatccttcactgttttcgtcttcggatgaatcgcgatcagtcactcgttcgtcgtcgtcggatgattcgcatccttcactgttttcgtctcggatgaatcgcgatcagtcactcgttcgtcgtcgtcggatgattcgcatccttcactgttttcgtcttcggatgaatcccgatcagtcactcgttcgtcgtcgtcggatgattcgcatccttcactgttttcgtcttcggatgaatcgcgatcagtcactcgttcgtcgtcgtcggatgattcgcatccttcactgttttcgtcttcgg

SEQ ID NO: 58357 - DNA, 663 bp, Heterodera glycines
  Genomic contig location: Contig_ID=SeqID_27683; Location=1..663; Strand=-
  SCN-specific regions: Sequence locations=1-663
atggccttcggggagtcaatttgctgggcaatggcaaaacggaaaaaggcacggattgggcgtggaacagagaggccgatggctgtacaaggtgagaagaggaggtgaacagaaagttaatcggcatgactggtcagggcgagtggacccaggggtacaaaggacggtacggacgaagggaagcgattaattcggtggcacattatttgggcacttggtccagcggactccacgacgggtaatgttccgtttatcgctttttatctaactgtgctgaatctgtacagatacggcactgaagtttacgcggatggaggtattacgcggggacatttttgggcaatatttcgactctgttgttaagggatgtacaagggccaatggttacgcggcatgcgccacggatacggcatcagtgagaagagggtcgaattaatttgcaaaaaaatgtcaaatcatttaggaacaagtgccccgtggaattcagcaacaaagcagcgcacctctggcaattcgcatgctcacgcgtcactgagctcactccgttcgacgtatggaagcatggcgatggacgacgaaacggcagctgcgatggacatgccaaaccacacgggaagaagtcactccagagaccgtcggggagaagaagccgggtccgagtga

SEQ ID NO: 58358 - DNA, 683 bp, Heterodera glycines
  Genomic contig location: Contig_ID=SeqID_27683; Location=743..1425; Strand=-
  SCN-specific regions: Sequence locations=1-152,174-321,513-652,682-683
atgtgccattgccttgcttatatagcggtcattgattctgtggtggagccaaaggcacttcaaattggcacaaacgggtacaatttggtgaatgttgaggtaaaagtggaaaaaaattctaccgtattttcgaaatagagcccctagcagtgaattttaattattttttttaacaacccttgaaagggggggggggggctttatttcagtagagggggtcttctaccttaggaaaaattaccgaatttcggaaaattgagcccctagaattctgaggaaaattttgtatttttaatgcaaaatttttttttaaattgagggttttatattttttttttacttaaatatatttttgacataattaagtttaaatatttaaaaatttatttaaacataaattttcatcatttaaattagataaaattgaaaaattaaatttcacaatttaaaaatttatcgaaaaatttataatcattttaaattccaaaaataaagaaaaattattattttttcataggtccaacgtccgtacctaaagaaacgggtgcatgttggcgtctgttttagcccactgttttacatggaacattggcaattggttgttttggcaaaggagagggaaaggttggcaaccattgaactgggcgagtgatgggaaatgaatgaatgaatttgaaaataaa

SEQ ID NO: 58359 - DNA, 102 bp, Heterodera glycines
  Genomic contig location: Contig_ID=SeqID_27684; Location=184..285; Strand=-
  SCN-specific regions: Sequence locations=1-10,32-102
atggctcccggacatttggacagtggacatctggacagtggacatttcgacagtggacatttggacaatgaagtcatttggacagaaccggacaattggaca

SEQ ID NO: 58360 - DNA, 56 bp, Heterodera glycines
  Genomic contig location: Contig_ID=SeqID_27688; Location=44..99; Strand=+
  SCN-specific regions: Sequence locations=1-8
gtcccggttcccggtcccgggttttgaaaagctcaggtcccggtcccggtagggca

SEQ ID NO: 58361 - DNA, 711 bp, Heterodera glycines
  misc_feature (198)..(198): n is a, c, g, or t
  Genomic contig location: Contig_ID=SeqID_27689; Location=309..1019; Strand=-
  SCN-specific regions: Sequence locations=1-106,135-405,436-446,468-711
atggcatgcaatatatgctttgatgacattaaaattgatcagctctgtttttgtgaagatccatcatgtaaaactgataaacctgataacgatagaacagaaggtgaaattttcttaaaaaaaaattataattacgtaaacgagtatttataaatctcgaatttctttacaccgaaaatttggccattttcaaatttntaaagaaacccatgcccatttgcattgaatgccttcggcgttacacaaaggcggcacattcaacaatgccattcgctggcggccttgggctcagctgtgtggcactcaattgccaaaacccaataagatggggtatgcaggaatttttcgaggcctagacccgttttaagaaattaaaaaaaagtttttttcagaaaaaatagacagaaaattaaaaaaaaattatattctttttatcgtgtagtttaataaaacttggataggaaatcaatttttagtttttgaaatttatggttttattagcattattaatttatttaattgcgtttcttgtaataaattttagataccttaaagaaacggcttactaaggacaaaacgtcaattaaatcaattaacggcctaatgaatctttcggagcgatgtattgcaaagtttggcgggggacacattgaacggtcaaatttattatttctaaaaatattcgtcaaaatagaattttccaaattgtaa

SEQ ID NO: 58362 - DNA, 588 bp, Heterodera glycines
  Genomic contig location: Contig_ID=SeqID_27691; Location=23..610; Strand=-
  SCN-specific regions: Sequence locations=1-291,344-563,585-588
  Gene Ontology: Mol. function=structural constituent of cytoskeleton; Cellular component=insoluble fraction
atgattggctcaactgctcggtgtgttgcgcttttgctgctcggcgccacaatggcacaagcattcctcacgacatttaagtaaatattacttattatcgttttaaattggctaattgaaagccttgcatgtttagcgttgcaccgaacgcctttcgaaaccgacgcggatgcggaggaggaggaggcggcggatgcggcggagggtgcggtgctcctccaccaagcggtggcggtgccatcaaactgacgctcggatgcgaagggcctccgcctcaagcgcctgccccatgcggatgcggcggaggatgcggcggcggttgcggtggcggatacggcggaggatgtggtgcccctccgccaagcggtggcggtgcgatcaaactgactctcggatgtgaagggcctccgcctcaagcgcctgctccatgcggatgcggtagtggatgcggttgcggatgcggcggagggtgcggtgctcctccaccaagcggtggcggtgccatcaaactgacgctcggatgcgaagggcctccgcctcaagcgcctgccccatgcggatgcggcggaggatgcggcggcggttgcg

SEQ ID NO: 58363 - DNA, 2528 bp, Heterodera glycines
  Genomic contig location: Contig_ID=SeqID_5532; Location=7..2534; Strand=-
  SCN-specific regions: Sequence locations=1-41,63-84,110-119,141 -659,681-1303,1326-1460,1482-1546,1581-2528
atgatcgtgctggacagtggtcgtcaagcaacaatgtacgagggtttagacctttttctggatcaaatgcgacgagacaacaacaaagaggaagaggaggacgaggccgctctcgcaattggggaggaggccgccaggaaccaaagaaactggtcaagcaaccctcgatgccattattgtgaccgtgctggacattttgcgtacaattgccatcaacgccgcgccaattttagaggaaattccaaccaatcgttccgtcaaggaagatggtcaaatcagcaaccacgccaatctcagggacaatggcaaaatcggcagaatcctgttaacgtgatggatgctacaagttcttccaacgcttcaccaggaattttcgagaacttggcccagtcgttacttgacctcaaaattcaggacaatcgcaattacaaaaacgaagagccgagatcgggagcaatgaatgcgctcacacacatcaaacccgaaacaacagcaatggattgtcaggtcgaaaatgaattagcaaaaggatcctctagtgaatccccagcctgtgggccggaaacaaagataaacattcccaaaacgtcaaattgggaacggccaagcgtacgatcgaaactcgcttctttaatgttcattacattaatgcttgttggaatgactctgccctttactactggtaatatgccccatctgccaatgcatccccttgtctgtcaaacccaaaacggaggaaaaatttggcaattgccggcagttactggctgttcaaagctgtcaattgatcattcaaaagcacctgttgttcgaactttcgatgtcttttcgccaaatttatttgagcactcggctgatgcttgggcttgccgaaaagtaagaaaatccgtacgtaagtacaattcaatcaccaatgttccgatccaagagactcttgagccgcttttgttgcaaataactccgagtgaatgcaaagaaatggccgaaaatggaaagtgtagcttaggcctactcattaatgactcgggactcttgcacactgataagaaattggatttgtcaccccgaatgtggttaattggctcatttagctggtcgactgtctcaactgaaaattgttatctttttaagactaaaattatgtcacaacacggtagcacagttatgcaaagtcccctcgggtcagtgaacaattgccaattcaaggcaggccaatgtgagatggaagacaagacattgctcatgtgggataccaacactacccgtgcctgtgatttttcgaaaattgtcacatggaaaggactacaacttgacaatatttggatttctgaggaggtcagttttcgtttaactttcttgacagcacaaagaaagtcaactcatgtggtctgaatttgataaaatcggaggaaggatttgctgtacaagacttgcaatccgacgatagcaacgaatcctcaaagagaagcagaaagacgagatcacttgaaagttgggtcaccgaatcggaaatgaactccaaattgggctatttggatgaacaagtaagagaaatgctgactctttccttttctcagacaattaaatcgatttgtgattatatgttggagacgagaagatgggcagcgacggcacttctctcagacccaacaacttttgccagaaaattattccaatccggtaaactggtggcaaaagtggctgggcctgaattgattaaagtgtggccatgcatcgaattgcaagcgcacgattacgaatttgccaaaattgggaactcagtggactccgaattcgaatgctttgacaaaattccaattaaattccgagtgaaggacaacaaaagaatggcatttattgacccaagaacaatgattttgagctctgatgcgagactggcaccatgctcagaataccgcaaacagctcatttttgtgcgtggttctctttatgaagttgatcaaattgatgctcaggtcaagcaggtgaatgccaatcgcattgacggttttagcctaaatctatcattggcaccgacttatgctcgccattcttttcttcatcttgcccttgtgaatgtgtctgactttattggccagttttacgacgccaatttcgcaagagaaagtgaactcacattccaacttaaaagtgaggacacggttataacaaagactctgtctgaacaatgggagcaggtgagtgagtccattcgcaacaaaatggttgggaattgggaacaaattggaaaaattgtcatgtccatgatgataattattgtttttgcagactttttgatccgatttggattaatgattagagacgaatacgttggcagaggaacaacacgacgcatgacttttggtggaaataaaacgcagaaaattgtgaaatctccagcacacctcaacatgatggatctgaatgcatctgtagaatttggtaacgaaattgagctcagtcccgttaagctcattgaacccgcccaaacccagacacacaaaattgcaggaaaacgaaagagaccg

SEQ ID NO: 58364 - DNA, 724 bp, Heterodera glycines
  Genomic contig location: Contig_ID=SeqID_5533; Location=428..1151; Strand=+
  SCN-specific regions: Sequence locations=1-162,320-326,357-398,420 -422,467-724
atgggcttgcaaaagttgttgaagcaacttttcaaggttgtctattcggtaagagaaggccgcgaattgctgttcagacgagcttgccgaagtcgtgtcgtcgtttagattttcgcatttttggaattttttggacgagagaaaaggatttatcgattggtcaattttaaaatttattttttttttgagttcgaaatttaattctaattaataaacaaaaaaaatttaaaaatctttcttttgtaccttaattatattttttaagatatgttatcataatttttaatatttttctaaatatttaaattgatttaaaaatcaattcatcagttagcttttttgttgtttttaattagataaaattattcaattactttttcatgcattagtcttgtttgtaaaaatatggatttagttttgtcaaaaaattatttttatataatttattaacgataaaaaatttttacatttgtcttttagtatttttatttgtttgcaacttacaataaagtacttattccgctgttataataacgtattttaaatagagaaatttttgctactgttcaaaataccaaagttaaaaataatcgactcatattgaaaaaattgcataataagcgttataaatctcggcacgcaaagaaatgcttcatttaaattgtcccatttttgaagaagccctatcaattcttgccttatttagtccctttcggcgcattaa

SEQ ID NO: 58365 - DNA, 660 bp, Heterodera glycines
  Genomic contig location: Contig_ID=SeqID_27693; Location=77..736; Strand=-
  SCN-specific regions: Sequence locations=1-660
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttt

SEQ ID NO: 58366 - DNA, 380 bp, Heterodera glycines
  Genomic contig location: Contig_ID=SeqID_27694; Location=854..1233; Strand=-
  SCN-specific regions: Sequence locations=1-171,204-380
atgggtagcagaaaagtgggaatgacaatggtcggagaaaataacgaaagatggcaaatggacgacgaacagagaaaggtgacaaaatgcacaaaaatgggccaaattaagggaaatttggacaaaaatgggccaaataatgaacagaaaaattggaaaatgaaaaaatggaaaaataaaaagataattatttaaattaatttgaacaatttgttcagccaaaggcattgtcaaatgttgacgagaaaagaatggtttcactgatcgaaagcacaaaaagcgcaaacattggcagaaaagaacgcgcacggacaatgccaacgaaaagcgtttcattttgggacgacaaaatttaaaaagataaaaaaacaaacaataaa

SEQ ID NO: 58367 - DNA, 776 bp, Heterodera glycines
  Genomic contig location: Contig_ID=SeqID_27695; Location=176..951; Strand=-
  SCN-specific regions: Sequence locations=1-566,673-675,697-739,761-776
atggctgtgccgcccgcgggacttggcccgggcaccgctggtgccgccgttatggaatggttgcgcaaaaaaacaatggttagtgccacgctggtctcggtgatgctgggcgcaatgctcggcaccgttgtacggcaaaattagaaatagatgattgatcaacaattaggctttttgatcagatgggctagtccgtaaaacggaatcctaactctgttgatcatccaagaccattggttggcgttaaaatcattttgataggatgaataccaaaattcccgatgcagactttttgacattatatagtgcaaataagggagagaatgtcagtaataatgtagttaaagaatttagtctatcaaaatttgattcaggatcaggagtttgctcttcaagtcttttcctaggaataattattttccggggttcatcggtctcctgtggtttggatggcgctaggacttttcgacagcggacctttcgacagaaggacttttcgacagaaggacttttcgacagcggacttttcgacagtgaaggacttttcgacagtacactaacaaatcaaatttttcattaaaaacaaataatttctaataattaatcttgtttttttattttattatttgtgaaataagaatttttaattaaaaaatatatttttataaattactggtttataaaatatcttaatttagcggggtttaagaaggcattttagtttattgcactgcatttttggagttctcatgaatggttttcttatcaataataaa

SEQ ID NO: 58368 - DNA, 596 bp, Heterodera glycines
  Genomic contig location: Contig_ID=SeqID_27696; Location=244..839; Strand=-
  SCN-specific regions: Sequence locations=1-177,201-231,254-596
  Gene Ontology: Mol. function=tRNA dihydrouridine synthase activity; Biological process=tRNA modification
acgcgcgtaccccccccccccccccctgggacttaccctgcttcccaccttccatttctctaaaattgcctttaccctccatttgcaaactgtaggccactgattgtccaattttgtgccaatgatccgcaaactttgctgagtgcgtgccgtttggtggagggaaagtgcgacggtgttgacctgaacttgggctgccctcagctgatcgccaaaaaagggcgttatggcgcatttttgcaggtgaatttggccggagaaaaaggcacaaaaaagtagcggacccaaagaataaagaatgttatggacatgctaaaatttaacgagataaaaattggaccatttacggtaagatctgaaaaaaattaaatcaaattatccagtagtatcgtaaagtcaaagaatcctttttgattaaagattttttaattccgcctttttggttttcttttaaggagtctcctgaactgatcgagtcgatgatctccgctgttcatcgccattgtcaccttccaatttcggctaaaattcgcgtgctgcacaatttgtcttcaaccattgaatacgcacgacggattgaagcggcgggggccagg

SEQ ID NO: 58369 - DNA, 801 bp, Heterodera glycines
  Genomic contig location: Contig_ID=SeqID_27697; Location=685..1485; Strand=+
  SCN-specific regions: Sequence locations=1-71,93-301,323-615,638-801
atggacggctccaccagtaccaccaagaggacccaaacggaaattgatacaaacagaccaagcgccagaattaaagcaaaaatcacaaaaactcagaggaatgagacaggcgagattcagggagcaagaaggattgatgcttccgtttccaacgaggggagtcaagcggaagtcgacggtcctgccaacagtagaaacggaaatcccaaccaaaagccagcgtctcaggccacaaaaatggaaaaatcaatagaaaatgtgttagaacgcctctacaatgacccaaaatcccctgctgcgttcgccggtgttgacagactgtggctggaagccaaaaaagaattaggaaataaaattcgtaaaaatgatgtaaaacattacttggagggacatcgcacctacactttgatgcgcccaaggcgcgtaaattttctgcgcgctcgaacgactgcagccggttttatgaccgattgtcaggtggatttggctgactttcaatcactttctcgacacaacagcggcaatcgttatttaatggtggtaatcgatgtcctttctaaacggattttcgtaacacctcttcgtaccaagaaatccgatgacatggtagaaggctttaaacgagtgttttcaactatgccaatgaaaccacacagaattttctccgacaagggtacagaattcagaaatcagcagctgaaaaaactttttgatgaagaggaagttgagaaatatgagagcacacattctgagaagaaagcagcattagccgagcgcgcaatacgacaaataagaaatcgg

SEQ ID NO: 58370 - DNA, 407 bp, Heterodera glycines
  Genomic contig location: Contig_ID=SeqID_27700; Location=503..909; Strand=-
  SCN-specific regions: Sequence locations=1-30,52-64,104-187,209 -252,274-407
atgtgcgaattttttgcatacattgcgttaaacaaaatgtaaattaaagaaagacttgaatcacttatttaaatataattaaatataatttttacattttttagtttatccgttgttgaagagcatcgaattgaggaattggtgaatgagacaaacaaatccgtgcttgatgtgaacgaacaaagctgaaaccattttgggaagggatcatttggacagaaaaacgcttggcagaagtcgactaactcataattttagaaaagataaacaaaagagttgcaaaaacttaattatcaattagggaagtgctcgcaatgaaaaatgataaattcgggattcgtagcgaaaaaaataattgaatttccgtttctcgcttatttttgatttcggttgcctcaactaataaa

SEQ ID NO: 58371 - DNA, 3093 bp, Heterodera glycines
  misc_feature (2520)..(2521): n is a, c, g, or t
  Genomic contig location: Contig_ID=SeqID_5534; Location=658..3750; Strand=+
  SCN-specific regions: Sequence locations=1-667,694-745,767-1068,1093 -1114,1137-1353,1377-1678,1705-2776,2800-2927,2952-3093
atgcgggcggattgtgtaaatgcggtgttgaaatgtcggatctgcgcacacacccgaaatccaagggcaaatgcgccagaattaagaccagtgattacggcggaaccttttgagctaatatgcatggacattttatcaattggaatgtcagaacggggaaatcgatatgttttagtaatggtggaccattttacaaaatatttgatcactgcagcaattcccgataagagcgttgaatcagtcgcaaaggcttttgtcgaacaattggtgcttgtatttggcaagccaaaacgtattcattccgacaagggcgctgaatttgtgaataaaacaatggaagaaatcagccaaattcttggagttgaaaagagtacaacggcagggtacgacccaaatgccaacggacaagcagaaagggccaatcaaactattttaaatatgcttaaaaggtcaactgattcaaattggtcctgggatgaccggctgccttttgtcacatttgcttttaacatcactccctctgaaaccaccggattttcgccttacaatttactttttggccggccagtaaattttccgtcgtctgataatgttaattttactgtaaatccttcatacacaatcgatgaagaaagttatctgcagctctttcgtgaaaatttgttaaaaattttggaaaatgcaaaaaataattcggacaaatcaagagaacgaatggagaaatggtttaattcgcagccaaaagtgactttgcagaagtaccaaaaaggcgaacgcgttatggttatttttccgggagctaacaaacgctcaacacataagaaattaaagtggaatatctttggaccctaccaaatcctcgaaatttccaaatcctcggcaaaagtaacgcctgctgataagaaaaatgctgatccaatttgcgtcccattagaacgtctgatcagagcaccggatggacttcctaatatttcaacaactccgcgcggcaaaaatgcttataaaaatgtgttaaatgtgatgactattttgatctttgaagaaaaaagcatggaatttgaacaggaaaattttttgggaaaaacaaaaacttcatcagggacgatgaatttttcagaggaggaggaaaaaatggacattgccgaagcggagattaagtggacgatgacatgtgaaggcggcggacatgtgttgtgcaaaaaattgttggccggcgatctcgaccccgtgctcagcaaaacacaaggaatcggtgctatggttgtgcagactccattacaaggactcatcacactattcattttgcggtccaatgtttcaatgtctgcgtcgaaagatttgctgaaggtcgcaaaccaattggaaaaactgggtggaattgctaaattgcaggccattttgacttcggaccctgatttcgaactattaaaatatgtcgaagaacgtggtgatgctgtgcgttcgggaagatgcccgggaatcgaagaagtcgaaatcatttggaaaaattgggtcagcagttgcgcatctgcacacgaagcattgaaacgcacgggatttggccaaatatgcttagaagcaccaatttcgctttctgagctgccggaagccgacagaattggatgggaaaaagtctttaatgctggcacatgggcattggagaaagtccgcgcaaccgttgtttttggcaaaacaacattggtccatcagccgagagtgatcattggagactcaagtgctgcgcaactttgtggcgaagcaaataaccaaattgttgctcacttcatcggcaccgtacaagggacattgggcgacgtgatccgcgcattggacaaatcagtactgacatcaaaagtcacgtcggcactgatcatccttggaagagatgcactgatcaaagggcagaccgtagcacaaattatggaagaatgtgaacgcatcaaatcaatttgcggacaatttgaacacgttcgatttgtgtggatcccgcctccgtatgtgcgtgaaaagcacgcacagtacaacgaattgattcctggattggagcgcattgccgcagaatggttcattgcgctgaccgagaatggcaggagtttgattgagatgtggagattcggagacactttcgacatgacacgggtgcgtgctgacggaaagattctgcctgaaggactgaaatgcctcagggcatggatattcactcaaatttctgtttttcccgatgacaatttccttggcattcgtcgttcttctcgctcactcccttctgtacccgctcaattttccgaattgtcaattcatcgtcctcatcaattttctcggggtcatcgggtccatccatattctctccagccaagctcaagccgcaacactcaaagccgcagtgatgggaaagcgtacagtagccgtagccgtcgccattaagccataaatgcctttgaccccacctttctgttctcaatttctcaattttcatatttattgttctaagacgaggggaccgtcttcttcagaggatgnnggatgtggtacttaattgaccttttgacttcttttatgttttgaattataattatttattggcgttttgttatctttttatggaccttaaaatattagtgagtcttttttactgttcgtttcttgtttggtttttttgtcttgtcttctcttgaattgctttgaatttcttttgatgctgacttcttctcaattgattgttgtggtctcgtctttttaattattattgttgcggtttaaaatttatcgccgtaaattattttgttttgtttatttattaaagtgtttgcgaattcgttttgaaacaggtgctgacaagccgacagataattgtgtttgatccatttctgaaaagagacaacccatccccatcaaccattttatgaccctatttaagtgcgttcgtttgtttaatttaatttttaaatgctaaaaaaaactagtgaaataatatataaatcaaatcacagcttttgaacatgaaatatgttcattccctgcaaataaccatgaacacagaattctaacaaattcaaatttttgcttaaaaaaacataatcacaaaaaaaaata

SEQ ID NO: 58372 - DNA, 1206 bp, Heterodera glycines
  Genomic contig location: Contig_ID=SeqID_5535; Location=431..1636; Strand=+
  SCN-specific regions: Sequence locations=1-60,82-109,132-164,186 -657,683-983,1005-1037,1190-1206
atgctattcgacgctttgaatataagcataggtatggatggattgcttgatggtgcttaaaccctttcaattgaattaattagtttccattttgggcgtattttacacatttaatttgactctatttcattttacacgacccaaaaaaaaacagaattggggttaaaaatttaaagttttttgttgcaaaaccaaaggggtgaccttttgatttacaaataaatcggttttaaacgacctaaaattatgaaaaaatgtaaatcatcaagggcgggaacttccgacacatactaagtttttttgccgttccttactctacataaatgctaaaaaaaattcggttttttagggctctattacagatcggcaccgccggaccgtaaaaatccttaatttacaagcaaaaatttgctcaaaatcgcaaaatttgtcatttttcggacaaaatctgttaacaaatcgcattgaaaattacaaaatttttcccggcggcgcctatcggcaccgccggacccccttgcgccccaaaagttttttggaaggcgccgcaaaaaaatcaacttcgtttttcatgttcagaattccaaaaaatgcttatttctaacaaaaaaaaatgctcaaattgatcatggacaatcaaaaatataacatttgaacattttaaacgtgttttgatacattttgtaaaaatgaggctttttgacccaaaatgaggtttttttgcatgccaaatgaggcttttgaaaattttaatctggcagccctgactatgtatgtgtattaatagaaaatattcatgaaaattttgaatttctttcatatataattatttttaacaaatttcaaaaaatctttttcctaataagattaattttctcaaaatttgtttataaaaatagctttttaaacatttcaggacttgatatcaaaggtgtgggaaatgggaaacatatttgtatttacactcttcttgaaggggatagtcctttggatctttttacgaaagatgggaaaagactatgtggtgaggattactcagaaatagaagaggaaaaagagttgatggaacagaagaatgacgaaatgggagggacaagcaaaaagaacgagaagggagaagaggaagcggagtcaaagaaagggaagaatgccaaaattggagagacaaatggtaaggaaaagaagaagacagacacgacggcatag

SEQ ID NO: 58373 - DNA, 378 bp, Heterodera glycines
  Genomic contig location: Contig_ID=SeqID_5535; Location=1761..2138; Strand=+
  SCN-specific regions: Sequence locations=1-5,188-204,369-378
  Gene Ontology: Mol. function=protein binding; Cellular component =axoneme; Biological process=N-linked glycosylation
atgaagagaaggaataggagaggagaaagagaaggagaagcagaggagagaagaagagaaagaaaggaaaaggaggaaggggaagacaagaaggaggagagaaagagaaaagagcaggaagaggagaggagagaagaagagaaggaatggagaggaaaagaggagggggaagacaagaaggaggagagaaagataaatgagcaggaagaggagaggagaaagagaaaggagtaggaagagagagagaagagaaagaagggaaaagaaaaagagaagagggaagacaataaggaagagagagaaagagaaggagaaggagggaagacaagaaggaagagagagaaaggagcaggaagagagagaagagagataatgcca

SEQ ID NO: 58374 - DNA, 602 bp, Heterodera glycines
  Genomic contig location: Contig_ID=SeqID_27704; Location=111..712; Strand=-
  SCN-specific regions: Sequence locations=1-151,173-301,323-365,387-602
gtatcttgaacgaattgcttatgacgtggtcgtaagttacccttttcttccgccaaatgacgtgtggggagaggccaaaaatcccgccacaggttatacctcctctctatcataaataaatattgttgaatgttcaggaaaatgtatcgacacaatgggccaagcggtgccagggacaatgggcgccacgccatgccacggatatggcggaaaccaattaatcaaactgaacacggagggacaaatgacgcagggggagtggtgtaagctaacaatgcgggggagagattggtttaaactcattaaatgttaattaaggcattagacctactgacggatggggagggcggctgcggacgggccattgcacgaagggaacggtggacggaccgttcaaatacgatagagtgagtgttgttgtgtttcggatgggaaattcctttatgctataatgtttacaggagacgaaacaaatccgcaacaaacaatcggggaaatgtctcgtcgtcgagaaggacccgtcctcctcggtgctcactttttcggaatgcgatgcgtccaacgaattgcaaaaatggcaatgggctgaaaaatttgcataa

SEQ ID NO: 58375 - DNA, 1791 bp, Heterodera glycines
  misc_feature (906)..(906): n is a, c, g, or t
  misc_feature (923)..(923): n is a, c, g, or t
  misc_feature (932)..(932): n is a, c, g, or t
  misc_feature (976)..(977): n is a, c, g, or t
  Genomic contig location: Contig_ID=SeqID_27705; Location=57..1847; Strand=+
  SCN-specific regions: Sequence locations=1-3,34-386,434-749,771 -978,1001-1017,1039-1050,1072-1438,1528-1684,1706-1722,1744-1791
atgttgggaatattttttctctttgctttatttgccttttctgatggagtattaaaagcacaaaaatgcgaagattgctcaaatttgaatcggttttggaccaatctctgtaaaaatgccgtgccaatgtttaaaaatgccgtgaatggggtacaaaaatttgtgtgccgactgagtcaactcgacgaattattggacatcattttacaagtggatttcgagaaatcggtgagaaacagggcttctttttttgtaaatacatatttttcctggattctccatggtctaaatagtaggaaaacatttcttttgtttgcgaacgaaaattgggacttttatttgtatattttttacatttttcatggtttttctacatattactatgaagaattttttccaaaaataatccttttaagattttatttacttatttcgcgatttttattacataaaaaaagaagcccagtaagaagttattattagggatgcgatttttaggcaaatgcctaaaatttttgcgcacttgatacgcacagataatcacgaaaaacgcattttccgctagatttggggtgtttacgatgacttttataatgcctaacgttgcctattttgggagtttttgtgcctaaggtgcctaattttagggtttttgaaaaaatccttaacaaaatgcaataaaaacgaaaaacacacccctaagaaatgaccaaaaaaaaattcagaaaatacacccctaagaattgaaaaaattttcaaaaaattgatcaccaaatttactatttttttcatgataaaaatttttgactaaaaatttatccttattcaaagaactttaaacaattgaaatataagcaagtttaagtttttgattaagtttttacgttgctacctaaaaaaacgttnaataaaaaaattctatnttgcctatntaatgactatttcgcgattttttgtgcctaaaaaatcgcatccnntagtttatttaatagaattagaacttattttatttttttaagtataaaattgaaagaattatggaatacgccaaaaaagaagatgcccaacttcacaaattgttgcaaaaattaattgccgaatttaaaaaaataaaccagaactaaatcttttgtgtaagtgtatttattcgtatgtacatatgtaaataatagaaatgaacattaattttgtcagctaattggtgactccaattttctattaatggtaattagatattaaattatttaagaccctcttggggatgagcagcaatacgacactgttcactgttccgtcatagaaagtgcaaattacttggagcatcgctttggcattcatttggtcgaactttggcacaatccaacggaatttggcgaaataaattcaaaaattgtgccattgattaatttggcacgaaatcatctcataggagacggacaaaagcagcagcagcaaaagaagaagaagaggacggaagacagtggaaaagaacggaaaaaagaaggcggaagaaaggacgagcaaaaacgaacagtgccaacggaggaggggacaaatagcacggggactaatggcattttggacaattggtcgaatttggcggggcgtaaaggtctaagaaacaaaaattaattgaatcattaacagcgttttcattcttcttaattccccggcattttcagacaaacaaagaaaaacgactcttcctttgattacttttttggcccgggattttatacgattttggtgctgtgccttttgacttatcttcttagtttcattccgcggtta

SEQ ID NO: 58376 - DNA, 857 bp, Heterodera glycines
  Genomic contig location: Contig_ID=SeqID_27709; Location=210..1066; Strand=-
  SCN-specific regions: Sequence locations=1-857
atgtatgaacttctgcggcaagcgtggccgacattctcgccaacttcgtttgccattgactttgagacagctgcgcgaaacagaactgttaatgcgttccctggatgtgcaatcaatttttgcttcttccacttcgtacggaatttgcaaaaaaaaattaaggagcaaagtctctggcaggtacattaacattttctattgaattatttaatctgcgtatttttatcgctattgcgcggatgcggtatttgcagaaacagtcagaatgttgacttcggtcgcatttctaccgctgagtgacatcagaggacagctgtcatcgcattagacacggagtttgggaacgtcgcggcactcagaccgctcattgactggttggtctcatcattatcagaagtgtacttcaatttttgtgcaatttttaggttgctcaacaattacaaccgcgaccaaatgggacttggtctcaaccactcttcccaccagaacaatggaacgtctacactcgaactctgaatggagaagcaaggacgaacaactacgcagaggcagaacaccacagtcttcaaggcgccttcaattgccgtcatccatcgatctggcacttcattgacgttctccgccgtgagcagaagggcaccgatgggaagtatgcgtcatttattgctggacttgagccaccgcagaaagctaagaaataccaagtggctgacgagcgaatctttaatttggtgcagaattataatccggtgaatccaaactatgacaatgatcacaattaccacataaatcaaaatcatcatatcattttggaatttcttcgtggcatttcgcgcaattatcatatgaacccgtga

SEQ ID NO: 58377 - DNA, 1981 bp, Heterodera glycines
  Genomic contig location: Contig_ID=SeqID_5537; Location=2236..4216; Strand=+
  SCN-specific regions: Sequence locations=1-76,98-276,311-619,719 -888,912-967,989-1045,1123-1155,1178-1981
atgaccgtcggcggtgttccggaggcgatcaaagatcactgcgagagaatttgccttttggccattggaatggtgctttcttttcttaattgttttctgtcactattaaaattctttcgaagatttgggaggcacgttctgtgattgacccgatcagcaaaaaagggctcaaagtccgttgcggattgcactcggggaatattgtggccggagtggtaggcgtcagaatgccaaggtcgggaggcaatccggcacatttaagcgggagagaaatcggtttaaattttgaattttcaaagattttgtctttttggcgacaccgtaaacactgcgtcgcgaatgttaagtcattcgccacgtaagttgatcaaattcaaaaacgaactgattttggaaaggaatttcattttcagagggtttaattcactgcagcgaaacggcacttcggtagaaccattttaataattgaaaaatgatgacgaaaaaactcaaaagttcggcacaacggacgggacgattcgaatttatgtgccgagggaatgtgcaaataaaaggaaaagggccgatgaggacgttctttctgctcagatcgttcaaaaagtcactttgggaaattgtcgaaagggaaagaggtgaacagagaaaaggaaaagacgaaatagcatagggaaaagataaaagggaaaaaatagagaaaaaagacaaaatgaaacaaaagtgacattttgagatgaaagtacgaacagcattgacggatacgaagaactgacggcacaaatggaactgaaggggaccaaacaaggcgaaggcgtagccaaaatgatcgaaggactttttgacgacagaaggatggacagacggtcgacaacgtgcgcaatgatgtgacaagaaaggaaagaatgggggacaaatggacacgaaagggacaaatggacacgaaaagggacaaatggacacgaaagggacaaatggacacaaaagggggcaatggataaaggacatgcttttcaagaaatgtctcttgtcaaaaactctagcataattgaatttatgaattatatgtattaaaattttatacaaaaacattttttgatagaaacaaataaatgattatttttaaatgcaaaaactatgaatagacaaaatgtgtaagtaattctaacattttctgggcaattcacagggaatgtgagcgaaagaagcgaatggtcaaaggaaaagcattggcagtgcgatgttttcgtttctctgtcccccccctttttttggctaatttctgctgagtttggcctctcttctcctccttttgcgccgttcatagtccggcaaatcgcctcgtttggccactctgtccggatctgcgaatttcaaatggacattaaaacatttggcggaccatttgccgacctttcagctcattttggcacgtcgccccaaggtaccccggcgtgcattggcactttccgttctccgcgtcgcatcgtgcgccgttgtaacattcgcattgtctttggcattctttgccgaagaaaccctcggggcaaactgagcaaaaagtgtgccattgaatcgtgtgaaccgaggcaccactgatcgaacaaaccttcctcgcaattccttccgattcgtccgggagggcaatcgcaggcgccgctgacggagtcgcaaccgatggccgagggggaggacgaagcggacggaagatggccacactcgcaacggagaaggcaatgggcaccgaacgagcccaaggggcacaactgttcacacttgggggaggatgttcaaaaaagtatagttggcattccgtttgattattttaagcaacggaaagccacaaaaattcgtgtcaactcacgtggtcgccatggaagcccggaggacacagacattggcccgtcaccgggtcacagctggcaccgttctgacaatggcacgactcggcacattgcaagccgaattgacccggagggcattctaa

SEQ ID NO: 58378 - DNA, 2536 bp, Heterodera glycines
  Genomic contig location: Contig_ID=SeqID_5537; Location=3535..6070; Strand=-
  SCN-specific regions: Sequence locations=1-757,779-872,895-2536
  Gene Ontology: Mol. function=scavenger receptor activity; Cellular component=plasma membrane; Biological process=cell recognition
atgtccatgtgagtggtcgagaatctcgaccctcaaacccacccaaagtgatgcccttaatagtttcttattgctattgccactttccatctttagagtgtcccctcgggctgttcggtcccaattgcctttcccactgtctctgtgccaacggtggccaatgcgacgcctcccgcggcgtttgccgctgtgccgccggttgggccggcgaaagctgcgaattccgttcgttttcgcttaatccgcacccaaatatggcttttcccctctctctctcagtttgtccctttggtcttttcggtttgaattgctcggagaaatgcgaatgttctaatggagcaaattgcaacagaacggacggaaaatgccaatgtttacctgggtggcagggaaaaaggtgccacaaaagtgcgtctttgtgctgctggtaatttcgcaaacaaataaatcagatgcgatcagccatgccccgagggcactttcgggttaaattgttcggaacagtgccaatgccaaaacggcgccaaatgccatcacatcagcggacattgccaatgcagcgcggggtggcgcggtcgaaagtgcagccggggttcgaattaatccgataaaaatccctaaagagaacattttgaagcatgctcgaagggatttttcggccaaaactgtgcccaaatttgccaatgtccgtcaaaaggctcatgcgaccatatcagcggacaatgcgaatgtccgaaaggcactttcatttttttaaatatgaactctcatcaaatagttcaggtctgacggggtccgcatgttcagaggttttcccattaactctttttaattatcattaattaatgctttttaattcgtttggtttaagcggggccccccgggcacatttggcgttgggtcttcccaaaagtgcacttgcgggccaaacgaacagtgcgaccccgaaacgggcaaatgcttctgcaaagcgggacaaatgggcaaaaattgtgaaatcggttagcaaattcacaaatctttgaaatgttcaaacagtagccgactgtttgtttctacagtatccttttgcaattgaatggttttaaggttgccccactgggaaatttggcgtcggttgcgaggaatgccaatgtgaaaacggcgcccaatgccattccgagacgggcgagtgagtttttctggcccatgggagttagtttcattttgttcctctccagatgcgcttgtccccccggctttcttggcacgcgttgcgaagtgccgtgccccgccaaccgttacggcccatcgtaattaatttgatcattgctcgacccatttaaacttttttcctgtcacttttttctctcaccattcagctgtgctaatttgtgcgactgccaaaacggcgctcgctgcgacccgcgcagcggcgagtgccgttgtgcgcccggcttcacggggccgcactgcacgcaaatgtgcagggccggaagatttggccaaaactgcaaggaaaagtgccaatgcgaagatccgacaaattgtgacccaaagacaggccaatgcaaatgcgggtgagcgccaaaaccgaagcggagaatattactgcgattattttatgtcaattgtttatgtattgccattccacgctttccctatagctccggttggattgggcccacctgtcagcagcagtgtccccaggggaagtacggcttcaactgctccatggaatgcgactgtcacggctcggccgggtgtgacccgaccagcggctgctgtcattgtcccaaggggcggtacggctttcgttgtcagttcggtacgtttcactttggcctcctatgcccttttccatttgaaatttccttagaatgccctccgggtcaattcggcttgcaatgtgccgagtcgtgccattgtcagaacggtgccagctgtgacccggtgacgggccaatgtctgtgtcctccgggcttccatggcgaccacgtgagttgacacgaatttttgtggctttccgttgcttaaaataatcaaacggaatgccaactatacttttttgaacatcctcccccaagtgtgaacagttgtgccccttgggctcgttcggtgcccattgccttctccgttgcgagtgtggccatcttccgtccgcttcgtcctccccctcggccatcggttgcgactccgtcagcggcgcctgcgattgccctcccggacgaatcggaaggaattgcgaggaaggtttgttcgatcagtggtgcctcggttcacacgattcaatggcacactttttgctcagtttgccccgagggtttcttcggcaaagaatgccaaagacaatgcgaatgttacaacggcgcacgatgcgacgcggagaacggaaagtgccaatgcacgccggggtaccttggggcgacgtgccaaaatgagctgaaaggtcggcaaatggtccgccaaatgttttaatgtccatttgaaattcgcagatccggacagagtggccaaacgaggcgatttgccggactatgaacggcgcaaaaggagg

SEQ ID NO: 58379 - DNA, 994 bp, Heterodera glycines
  Genomic contig location: Contig_ID=SeqID_5538; Location=65..1058; Strand=-
  SCN-specific regions: Sequence locations=1-275,302-323,437-595,618-994
atgacccgaatcgcacagacatcgacgagtgccgcgagggcggctccgattgccaattcgcatgcgaaaatgccaacggcggatttcgttgcttgtgccccgagggaatgcaattggccacggacggacgaagctgcgaaccgtcggaggacttgtcaaatggtatgtgaagcaaagcgaaaaaataaaaacgaacgaaaataaacggtaagtcaaaaacagcggaatgttacggtagggtgcttcttgcttctcccttctattgctgggagtaatattattttatttgcttatttgttatgtttaatattcctcaaattaactctttcttctctcattttttatttattttttattttccgtttttatttttcctttttcagttgcccttttttccttcctccgtttgcttttctcagttattgtttgtttctttagagcttttctccacaaatgtgctcttccatcagcagaatccccccacctctgaacggctcaaagttcgcggcgtcgccaaccatcggacgaattcgcaaaaagcgaacaaaaaaagtccgaaaaaacgctttttattttgatttaaccgccatttaacttttcaattgttctgctgttagttgcctttgcttcacaattgttgctttagcttgtgattatggccgcttcggcgtgtcgtgcgaattcacttgcgaacattgccaaaatggcggcggatgcgaccggacgaagagccgttgcgtatgttcgccgggatggcatggtcagtttaaaacagtgaatgataagaaaatgcagtggcaatcatcatttcggcactttctcaggcgaattgtgccaatttccgtgcctcgagggcacttttggccgcgggtgcgcaaagcgttgccaatgcgacggcggggtgtgcagtgccatcagcggagaatgcctttgtcccaatgggacggaatgtgccgatgactgtccaacgggtggagaaaattagaaaaataaa

SEQ ID NO: 58380 - DNA, 383 bp, Heterodera glycines; identical to SEQ ID NO: 51114
  Genomic contig location: Contig_ID=SeqID_27714; Location=339..721; Strand=+
  SCN-specific regions: Sequence locations=1-20,42-275,297-383

SEQ ID NO: 58381 - DNA, 271 bp, Heterodera glycines
  Genomic contig location: Contig_ID=SeqID_27715; Location=39..309; Strand=-
  SCN-specific regions: Sequence locations=1-271
atgtgcacgcgttccattggtaccggtggtggcattgaatgtgccgaaaatggagacgctgcaattgcgcctcggacgaaacgacggcaacaaacggacgacgacgaagtgccgcaggggacggtgacacggagaacgacgggcgatcggatcagagatcgggacggatttagacgcagagcggtgggaaacattttttaaattcattttaaatctaaaaataaggtttttaaattttcagcggcgacgtatttttttgattgtaaagtag

SEQ ID NO: 58382 - DNA, 364 bp, Heterodera glycines
  Genomic contig location: Contig_ID=SeqID_27717; Location=280..643; Strand=+
  SCN-specific regions: Sequence locations=1-364
gcgaactcatcttggacggggcctgcaaagacccgccgattgccatcgtcgagccgaacacagcaaatgttcattccatcgaggcgttggaggacggcgccgctttcttcgaccttttggtcccgggttacaacgacagtcgctcgtgtaattattacactctgtcggatgacaaggtgtactgtaatgccgtatttctctgtccactcattggttcgttcctttgttctttcaggtcaatggtaaaattggcatcggagacttcgtttggttggagggttcagaagaagtgcctagagaatttaccatgcaacagcttcgtttcgatccattccttatgtcaaataccaacagattcgattga

SEQ ID NO: 58383 - DNA, 312 bp, Heterodera glycines
  Genomic contig location: Contig_ID=SeqID_27719; Location=40..351; Strand=+
  SCN-specific regions: Sequence locations=1-312
aaaagtgctatgagcacaaggacacagtggtgccaatgattggcagagaagtgccaaagttgggcggcggtggtacggcggacgacgtgcggtgccaatcagctgcaattgacagcggtgatcagcaacaacaacatctcggcgaccgcattgcgttggacggcacttcgattgggtcggccgaataatgcaaatttcgcaattatttttttaacttttttcagttttcccgtcaaaatgttggcccctttgctcgtcgccaaaggctccaatggaaatgggacgccttttgagatcaaagtactcttttga

SEQ ID NO: 58384 - DNA, 827 bp, Heterodera glycines
  Genomic contig location: Contig_ID=SeqID_27720; Location=26..852; Strand=+
  SCN-specific regions: Sequence locations=1-235,258-277,303-389,417 -648,682-731,753-778,800-827
atgtcgaaaaaagctcggcattgcaggtgccgcaaaagacgacgacgacggcatcattacggtgcccatttcgcgcgttattttcgcgcagacggcaaacggttggtgaggcatcgattagtccagcattttaaggacagcatcgagtggtgaccttgaatttccaaaaaaaagaaaaattttgttggtcttacttataattacaactgccgattaaggtgtgagacaatgacggattctgttccgtgattttggcagtttcaaagtcccattacggtatttaaaaaaaaaaattaatttttcggtatcctcggttttctcaatcctttaagccctagcagatgatttgagaaagctcttttttttgcaaaagcctggctaaaatatgcaataattcaaataatttaaaatattttcaacagcttgaacgtagcgaatttgacgaggaaaatgaaatttcgccattcaaccgccagcaacagttagcgcctgaagcgctcgcttcggttgcgcgtccgtgccacaacacctccttgcgcgtgcggcatgcgttggctgatgcgcgcgcattggaatgtgccggaatgtcgcacaaaagggcggaagtttgggtcagcgttcacgcgttcaaacggatgatgagaaaagcggaaaagaatttgaaagtgaagaaagaggagaagaacgcaaaacaattcgccaaatgaatcaattaaaatggcaacaaaaagcatgtgattgattctccttttgtccaattaaaaatgccaatacccaatttaaatcatttgcacaattatattcagcattgaaaaataattgaaaaa

SEQ ID NO: 58385 - DNA, 1899 bp, Heterodera glycines
  Genomic contig location: Contig_ID=SeqID_659; Location=89..1987; Strand=-
  SCN-specific regions: Sequence locations=1-15,37-210,232-991,1013 -1072,1094-1373,1395-1532,1554-1607,1639-1899
atggatgatttttacattgtaattccttcaaacacacctggtccaggaaatactgcttcaaattttacggttagacttccgcacaccttagagcttgactccaaatggtccgtcgcattatcagcaataatctatccatattcattcccgtcgatcagtgtggacgaggatgactctatctctgtcaaactggttaatcctaactacagagaagatgccggaaattctgacgtggaatcgcaaaagtttatcaatttgtcagtgaaaattccaaatgtacaattccaaagtgtacaaagtttacaaaaaacactgaatcagataatccagaatgcttacgataaaaagtttggcggctcatccttaaatgatggtacacccactaaaagagccaaacgacaaaccgaattgtcagaatcaggcgctggagttatcgaagtagagaatttcttcactcgaaatccctttgactactggcaacagattggagaactgagaaaaaaacactatcagctcagagaaagggttgaaaaaatgacaaaggagtacaattcaacagcggatgacgaacgaaaaacacttctttcgacggagcttggggtctttcaggggcgagaaacttttctgaaagaacatttgcatttgattgaagaagaggcgaagagaagggacggtgagcagcaagaagccaatgaacaaagactcattgaccgtttctttgcccgataccccgacaattatagagagcagctggacgaatggaggtcaagttacctccgagatgtgctagatctacagacaaagatgggagagtatgaaggagttaaagatttgaaaaagcttgaagagctcaattcacaaactgaacgaatgagaaattccatacacgtttttggaagaaagatggaaatattaaacaacgcagcattgcaacgtgatcagaaaaaatctcaagaggattttgaacgtttaagccatgaacaaaacctaaccttcgtccaagaattcttccaagccaatcctgttaattactggcaagcaatccagaaaaattatgaagcgcttcaacttgagtacactaagaagagggaattgagggaaaagcttgaatttgaaactgacgcaacggaaagggattcgctgcagcgacaaatagagagcattcaacggctgattgactacaggcgtaaacggtttgcagctttggaatacgaggctaaaaaaagagatgcgcagacagggaaagctaactcaggcctcagtgctgtagctgaggggtcaaataggactagctccactcgaacagactccttttcaccagatgagccctcaaacccagacgaagctatcaatagtaaaaataaccaccaaaacaccaccactactgccaccgctattttatcatccgagacgccagctgaacaaaatttagcagatcaagataatagtattgctgataaaaatgaactcggtacgccgccattaagtggattagaacagtccggtgatgctgctacatcagtgactcaagctgaagatggtggaaatttacctcaagcagccgcgttgtcttccaataacccaaaatttgttgttaagcaatcaacggtagcgacagagagaaggaaggagaaaataattgaaaagctgattgacgaacaagtggaccgaatggtcgatggaacacatgcacagcagaagatgttacaagaagaaggtaaagacaacgatagtcaacaccgcatttcaacatataaactcatcgaagaagtgctccacggagagcatgggcagttaatggtacaacagcgtgaatccaaaatggcagctgaatttgcttacaatgaaataactcagcgattcggcattagaatgggccccaggagtaatgcacgttga

SEQ ID NO: 58386 - DNA, 364 bp, Heterodera glycines
  Genomic contig location: Contig_ID=SeqID_660; Location=143..506; Strand=-
  SCN-specific regions: Sequence locations=1-19,41-42,64-364
atgaaccgacggtaaaaggattttaaaagtcacacaaattcgtcatttatttaactaaactgtttttccataatttcagttggatttgcaacgacgtttggatggacattttcccctcttttgaccgtcctcaacttggtctcaaattggcacttctttcgccacgtttcaatgcgttggtggacaaacatttcaatggcaaaagcgaattgacaatttggagaccaatcgaaattagcaaggacaaaggacctgaaccgaagctgtttgtatggttcgattacaaatgtgtgccatttccattgcccgaccgtccgttgcccagcaaaatcctttttaagagccttgagatttagtaaataaa

SEQ ID NO: 58387 - DNA, 390 bp, Heterodera glycines
  Genomic contig location: Contig_ID=SeqID_660; Location=2406..2795; Strand=+
  SCN-specific regions: Sequence locations=1-14,195-207,388-390
  Gene Ontology: Mol. function=protein binding; Cellular component =axoneme; Biological process=N-linked glycosylation
atgaaaatagcattggggaaggaggagagacggaagagaaagagaggaaaaggaaaaattcgacggaagaaggagggggagaaagaggaggaaaaggatgaaaatagcattggggaaggaggagagacggaagagaaagagaggaaaaggaaaaattcgaagcaagaaggaggggagaaagaggaggaaaaggatgaaaatagcattggggaaggaggagagacggaagagaaagagaggaaaaggaaaaattcgaagcaagaaggaggggagaaagaggaggaaaaggatgaaaatagcagtggggaaggaggagagacggaagagaaagagaggaaaaggaaaaattcgaagcaagaaggagggggagaaagaggaggaaaaggatga

SEQ ID NO: 58388 - DNA, 380 bp, Heterodera glycines
  Genomic contig location: Contig_ID=SeqID_5539; Location=1073..1452; Strand=-
  SCN-specific regions: Sequence locations=1-231,254-336,358-380
atggaattgaatcttagacattcaccaatgaaatgttggagtttataacgaaattaaatttttagttccaactaaaactctggcagctgtaaatgaaacactgttgaggaatgctttaaagctggcaacaaatttcgaatactgttatgcgaaatttgtggatatttgaaggtttttaaattggcatcgcctttaaatcaatccctttttgtgggcatttcttgtacatgaaatattttgaatattttaaaaacccatttttctatcatttttagctgttttctaaaatgagtataacttatatttaaaaataagctggctgaatattgtcttattttattcgattctttggcagttttggcgcgttttctgctaataaa

SEQ ID NO: 58389 - DNA, 893 bp, Heterodera glycines
  Genomic contig location: Contig_ID=SeqID_5539; Location=1987..2879; Strand=+
  SCN-specific regions: Sequence locations=1-482,510-893
atgagtcaaaattcggcatcgccagcatcgatgccgtgtacgagctggaagtggagaaagaaacgaggaagacattcctcggaagcagcattgccgatggcgatgtggaggagcaatgggagtaagtgaaaaattttttgttaaaacaaaataatttcctttaaattgatcgtttttttctttttgtttatgtcttgcctatcccaaacggccctctttagtagagatcggaccggtcggtttttttttcggtttttttcggtttcggtttttttcggttttttaaccgaaaccgttcgaccgaccctcttgtccggtctctactctttagggctgtaatcacccaaatggacggattgacatgcatttttttattttgtctttggtcttataaattgaatataaataataaatggcacacagcttgggtactgaccaggaaaaatttggaaaatacgttatgagatcaggcccctttacgataccgaaaattttaaaaatttcttattggagacgacaggcggccatcaatgtcacatcggtgaaaaacaatggcggaaattggaaccgaattttggaaccggcccaggggcgtagcagcgtcggggagggggttgttccccagaccacccgtactttttgtactctggtgcctaaacggcattaaatgaacatatgtatgacaaccatgcttttcgttcaatgacttaatggtttagaaaaataaaaaatatattcctgcagaatttcccaggaccacgcgcatctttgtcataccggtgattaaatggcattataatgacaaaatgtccgacagtcatgcttttcttgccatgatcgaataattaagaaaaaatcccatagttgttgagtaatttcccaagactatgcga

SEQ ID NO: 58390 - DNA, 297 bp, Heterodera glycines
  Genomic contig location: Contig_ID=SeqID_5540; Location=1194..1490; Strand=+
  SCN-specific regions: Sequence locations=1-42,64-297
atggcacctggagacaacggcatcatttatgatgttccgatggttggcgtgtccgtcggcctgtcaagaactggaagcaatggcggcatagtgttcttcgaagtggtgttagccgacccgttctacaccaactcgtcgaagggaacgacatttgtcactgccggtggcggctacctggacatacacgcaacggattcacttaaaaatgcgtacggcgccgccaaagtgatcatgcgcgaacagcgcaacaactacttggacaaagcgcatttgcatttgaatgttgtggcagcggcg

SEQ ID NO: 58391 - DNA, 425 bp, Heterodera glycines
  Genomic contig location: Contig_ID=SeqID_5541; Location=673..1097; Strand=+
  SCN-specific regions: Sequence locations=1-148,171-172,196-425
atgtgttcaatcgcttttactctctccgttggttcactattaaatattcctccaacaatttcgcataaacacagcggcccaattttgggctccaagtacaattatgctggatttttcgtcttagtggtctgtgagttagtcaacaaaaagaggggctcaggttcaattcctccttgtgtttgtgtataaaattcaattttttaaagcaaacaaataaaagataattaattacagaacgccaaaagaaaaaaatttcaaatacaaagagttacactattttttactgctgattttattgaaattttttagcttataacttggtcaatactagaacaaataaaattattttatgctcattttgaagggaaaattctgaagaatatttctaagttagtcaaaagtttaaaaaaattgtttattggcaa

SEQ ID NO: 58392 - DNA, 203 bp, Heterodera glycines
  Genomic contig location: Contig_ID=SeqID_27722; Location=681..883; Strand=+
  SCN-specific regions: Sequence locations=1-70,94-203
atgctggagcccaaacgtgagggcccaactgacggagtccggtgggtcagttttttactgggaattgaagatataataattattaaaaaatatgcagactggacaaagaactcctttttccaagtcccggtctctgccatttcaaaattaaggtctctgatttaattttgttaggaatattcaaaaaaacccttttggaataa

SEQ ID NO: 58393 - DNA, 676 bp, Heterodera glycines
  misc_feature (659)..(659): n is a, c, g, or t
  Genomic contig location: Contig_ID=SeqID_27723; Location=256..931; Strand=+
  SCN-specific regions: Sequence locations=1-59,81-676
tgaataaaatatgatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggngggactgccccgaaaac

SEQ ID NO: 58394 - DNA, 735 bp, Heterodera glycines
  Genomic contig location: Contig_ID=SeqID_27724; Location=175..909; Strand=+
  SCN-specific regions: Sequence locations=1-67,89-735
atgcacatgacaaaattgtgcatgaaaacggcgatgggagagaagaccatcgagccggaaataacgactcgtgtgctgcgtgagatggctcacgtcgaattcaccgatctgtacgactctgattttgaagcaacgcaactgcaacccacccaaacagagtcactacagccactggtcctaattggcactgactactttgccgattttgacatcaaaacagagaagcgactcccatcaggcttttgggttgccaactcaaaagtgggcagattaatcttcggcaaaggaaacctttcaaagccaaagatggcgaaaaaagtcacttcaaccgccatctctcaagaggcagtggaagtacagcttcaaaacgacgacgacggactgaattcaatggtcaaacaattctttgatctcgaagctgctggtatggctgatgctgcccatccaaccgaaaatgagcaatggttggaccatttcaataaggagctccacttcaacatggaagagaaacgctacgaagtcgcgcttccatggaacaacagggctgaagagctacagcccaattatggattggcacgaggaagactggacaacaatttgaaaaagctggacaaagaaaagttccaactttacgatcagatcatctaagagcaactcagcaaaggcattgtggaaatggtgccggatcctaaggcatggactggcaaactgcactatttaccgcaccaagcggta

SEQ ID NO: 58395 - DNA, 469 bp, Heterodera glycines
  Genomic contig location: Contig_ID=SeqID_27725; Location=70..538; Strand=-
  SCN-specific regions: Sequence locations=1-25,47-243,266-283,312-469
atggcgaggacggcactttcgggttcggcgacgaggcagaggagcatcaccgacaattccaacagcaattgttttgccgtcgatgctgcaatactaggaacagaacaacagtgttccgctcgacagcggatgaatgcctcggcgatggcaaaaattagcttgcaaaagcaatgctttccgccggagtgctgctacacacaatgctccactgatgctccacaaaaatgccatgatgataatgatgcccagaaagctgttgatgctgttcatctccgttccctcaactgcttcttctcctctttctgtcctccatttcggcactttcttccccccaaagtgctcctccgtctctgtctgctgttcctttttgctgtcggcggctgtccaattgtgcccggcggcgtctcggcaacggcacgttcacggcggacactcgttccgctcggcatggacaaacagatgttccccg

SEQ ID NO: 58396 - DNA, 592 bp, Heterodera glycines
  Genomic contig location: Contig_ID=SeqID_27726; Location=193..784; Strand=-
  SCN-specific regions: Sequence locations=1-373,395-592
atgtccaattcagtttgtatggtggcaaaagttcgtatgggtaagtgtaaaagataattcacagttcacacctaatttgtgtttaattacaggccttatggccaccagcggaagaagaaaaagcgggtcaaagcatcgaaatatcgtcggactgcgcggaagtgaattaattatatttgagaaaagccgatctcacacaattggaatttgatttgatgccatcattttctctcagaaatgcttttgtaatacatttatttgcttgcttttaaatgaatgtttggttttatgacagacacagcaatatgtttcggattacaatgtaagagattatccgcaaagtttgtattaagcgagccattcattttttaacgattaaaatagaaagtaaatgtttacctgttttttttctcaaaataagcaacagaaaaatgttaattctaagtagtgatgttcgagagtctcgactcgagaaaagtctcggtttttttttggtctcaagtctcgggatttcagtctcggtctttgagactttcgagaccgagacttttttacacccctaatgatcggctttttgtaagttagaaataaa

SEQ ID NO: 58397 - DNA, 962 bp, Heterodera glycines
  Genomic contig location: Contig_ID=SeqID_27727; Location=379..1340; Strand=+
  SCN-specific regions: Sequence locations=1-73,115-276,298-369,432 -566,595-962
atggacaatttcattaaaaaaagtgaaggagtttgtatgaataatcagtttcagcatgaggacaaaattccaaaacaacaccaacaacaacaacaacaagatcaacaacatcaaactgatgtgatcgaacatgatcactgctacgcacgccccacaaaccagttatggaaattgaaaagacaaaaatacatgttgacatttaaactatgtaaaatgtgtgcacaagagctatacaaccgtaaggacgacataacagagtgtaacgatggaggtgtggacttgaactttcacctgtgcaaacattgtacaatgctcaacatgcgactcagcgatatgaattctgtgcaatttatggcatatcatccacgtaataacaactacaacaacaccaacaacagcaataaaaacagaaacaataaaaacaacgataatgacgaaaatgacagtcaaaataacttttggtacgataattacggtcctacatactgtagaggtggtccaagaaacaactacatgcaaggaaaacgaaagtgcttggaaagaattgacatggacgacatgaattgatatttaaaatattaaatttttttatttgtaagttatgtacggcctctaaacggattaaaattgattaattacatctgtgtccaaatttttggtggccaaatataaagtttaatcctttgactaattaccgcgtatgtgtattctcgggcctaactatggacaaagcccttagtctttgtggtcctgtgcccctaatctgatgattgattgacacattcgttttgatcgtcgcattgtatgtcccccacaaccgcgccctatggcaacaaatgttctttgtgacatccctcactgagtgaaagggcggtgccggagtttggaccaaatgatctcattctgccattcttgtaccattttcctccgttcgcttcgtttttttcgctacataattttaa

SEQ ID NO: 58398 - DNA, 643 bp, Heterodera glycines
  Genomic contig location: Contig_ID=SeqID_27730; Location=455..1097; Strand=-
  SCN-specific regions: Sequence locations=1-231,253-260,284-336,358 -376,430-441,471-547,598-643
atgcctaccgtaacgattaaattcgggcgaattgtgcataagatagaaggacagactcagttgtttgtcgcccatttctggcctccccattttgcctctgattacaacggtgtccccggcgttcagtgcattttcaaattttttggaccaactttggcgttttgatttgacagcttcaggcttaaagtaaaaacaaattgaagtcgaagaaataaaatcaattatgtttgatttttaagaattttagaaaattcgaaatgaattaaaatatattttaaaaattccaaaaagtccctaatttgtcgattcatttttaatttttcagcaaattccaaccctttgaagtcgaagaagaaaaaatcatttaagagttttgaaattttagaaattaaaaaattcgaaatgaattaaaatatattttaaaaaattccaaaaagtccctaatttataaattcatttttaaattttttcagcaaattccaaccctttccttcacttggggctcttcaatactgcttgggtagacatcgcccgcaatctgagcaagtttaaattatttacatttattaaaattcgaattatatttaataattattagggcttccttttttacgtaagaaaaatcgctaaatatgtaaataaa

SEQ ID NO: 58399 - DNA, 335 bp, Heterodera glycines
  Genomic contig location: Contig_ID=SeqID_5543; Location=931..1265; Strand=+
  SCN-specific regions: Sequence locations=1-133,177-214,238-277,301-335
atgtgccgaaaagtgctcgccgagagagaaattgcgtaagttggcaaaacgtcaataaaaaaaaatcgagggtacttattagcttattgaagcatcccatcctctattgtcttttttttctttatttgcttcgtttttttttaaatttgtatagaaaaaaatagaattttttattaggtatctacgtcaaaaaaattgttgcctcacattaacgaaaaatacataaaaaattttttgtttatattggagtgatattgtcaattatgctgaattattgaagaaaaaactaaaacaaaagatgggaagaaaattgaaagaatttggctgataaaaaa

SEQ ID NO: 58400 - DNA, 835 bp, Heterodera glycines
  Genomic contig location: Contig_ID=SeqID_5544; Location=757..1591; Strand=+
  SCN-specific regions: Sequence locations=1-67,103-108,267-330,352 -472,500-708,806-835
atgaaactccacctattattcgttttatttatatttttgatcactcaaattaatcaaatcggaacagaaaagaaaaagttggaacaaaaatcatttgatgaaatatttggagaaaaatgggaagagaaagaagaagaaaaacgaaatgaactcaaaaaaagagaaattattggaaaattttataaaataaaagagaaaattaagcaaaagggaagaaaattctcaaaaaaagaatggaataaaatagaaataaaaatagcaaaaaaattagggacaaattgccaatatatttataaatggatcaaagaatttggcctatataaatacaaatcaaaaacaaatgaagaaaaatttaaaattgtgcaggaatttattgaactgacaaatgattataagcaaaaaagaaaatattcaccaaaagaatggcaacaaaattatgccgaaatttgtaagaaaattggcgtaaaccgagacataatttacaaatggaagaaacaatttggaattcgtgtaaaagaataacggaggaacaaaaaatggaaaaattgaaaatttataaataccggtaaaagcaaattgccttttgccgtttcttcatttaccgaaacaaaaatcgacgtaattggtgtggttaatgtacccattcagatgaaaagaattgaatgtcaaataccgtgtctcataacccgtgattcattttcttattgctaatttttataaattaaatccttacaatatttttattataaatgtttaatttgttattttcgaagaaaaataatatttaaatgtaatcattattttactgattcttgccaataatttgtttaataga

SEQ ID NO: 58401 - DNA, 96 bp, Heterodera glycines
  Genomic contig location: Contig_ID=SeqID_5544; Location=3370..3465; Strand=+
  SCN-specific regions: Sequence locations=1-96
tccaagtggggaattgaacccaggcgaaaaattatgaaaggtagaaagtttaaccactacaccacatgtgcatgtgtgtaattccatgactaaatg

SEQ ID NO: 58402 - DNA, 690 bp, Heterodera glycines
  Genomic contig location: Contig_ID=SeqID_5545; Location=900..1589; Strand=+
  SCN-specific regions: Sequence locations=1-11,33-102,239-444,466 -601,625-652,675-690
atgaaattctgtattttattatttttatttttgattgccctaattataccaattgaatcagctaatgaaaaattacaacagaaatcatttggcgaaatatttggagaaaaatggcaagaaaaagaagaagaagaacgaaatgaactcaaaaaaagagaaataattggaaaatattataaaataaaagagaaaattaagcaaaaaggaagaaaatgcacagcaaaagaatggaataaaattaatgcaaaaatagcgaagaaattggggacaaatcaaacatatattcaaaaatggattaaagaattaggacttaatcaacgcatgcaaaaaagctacaaatcaaaaactgatgaacaaaaaattgaaattgtgcaaaagtttattgcaatgaaaaatgaatttaaacaaaaaagaaaatattcaagaaaagaatggcaacaaaatcataaagaaatttgtaaggaaattggagttaacgaaagaacaattaacagatggaagaaacaatttggcattagcaagaaaagaataacggaggaagaaaaaatagaaaaaatgaaaatttattcgcaaataaaaagagaaaatgcaaaaatgagtgataatgaaattgctaaaattgtgaacacttcaaatgcgaataattgtaattggaagaaacaatttggagaagaaatgtttgagaattga

SEQ ID NO: 58403 - DNA, 235 bp, Heterodera glycines
  Genomic contig location: Contig_ID=SeqID_27732; Location=342..576; Strand=-
  SCN-specific regions: Sequence locations=1-102,126-235
atgccaaccaaccaaccgatgagtcgctggtcagacgatcgctttggcacaaagtgccatcacaactgttgccaaaaacggtggacggaggcggcgattcgcgctgctgctgttgttggagctgatattgttggaacatttgctggaattgctgctgttggagcactcgctgaacaatcgtaccgccattctaaaaaacaaaacaaattgaaaaactaaaatctccaaaattaaa

SEQ ID NO: 58404 - DNA, 411 bp, Heterodera glycines
  Genomic contig location: Contig_ID=SeqID_27732; Location=150..560; Strand=+
  SCN-specific regions: Sequence locations=1-82,104-302,326-411
atgcgatcgttcaacagtaaatctcatcagtatgactcatcaaagaatttccaagagcttttgtcgcctcgtctcttccagcgtcgacaacaggtttaaaaatgcataaatatttaagaattgccatggaatttcaattttcattaaattcgatctctctactttcattagcataatttttaaaatgaaatgtttaattttggagattttagtttttcaatttgttttgttttttagaatggcggtacgattgttcagcgagtgctccaacagcagcaattccagcaaatgttccaacaatatcagctccaacaacagcagcagcgcgaatcgccgcctccgtccaccgtttttggcaacagttgtgatggcactttgtgccaaagcgatcgtctgaccagcgactcatcg

SEQ ID NO: 58405 - DNA, 979 bp, Heterodera glycines
  Genomic contig location: Contig_ID=SeqID_27734; Location=584..1562; Strand=+
  SCN-specific regions: Sequence locations=1-46,71-183,205-979
atgtttatgatctgttgtgccattcttttgaagtattgggaccgtttcaaaaaaccaccaaaacaacaacgaggccatcgcaaaattgagaaagtgccggaaactgtcataacaatttgcctcgacgaaattccagacaaccaaaatgaagcggaggaaaagatggcaaaagcgatgtgaaactaaaattaaaaattgccaattttcaatttagaatttcctttttttcagtttcatctccgccgactgttggctcggagtgttcgatttgcttccgacttctcaacttggcctcggaattgcgatgatcagccaccgatttgactattacgtggacgaacatttcaaaactcgcaaatggacattgaaatttattcgaattcgatacaaaatcgaagaaaatggcacaaagcaaatggaaattgtcaattacgattggaaaccaatgccaattccgcaaaatcaattgccacgcaaagtgatcggattcgaaaggatcatcatcacgtaaaattgacgcttaattgattcttgtcaacacttcccattcattttcagtttcatcgaccgaaatgtcatcgcttttctccgccattttcgttcacttttcgcctcattctgtccaattagtttggccatcagcacgaccaatgaacgcatttcggagttcatttttcacatttggccaatgctcggaaaaaactgtcgcgtgatggaattgcccgctccaattttccgccgtttgcgacatttcgtgccgtcaattctcaaagattgtatatcgcttcgcgttatcaacacctattcctatggtttcttcaccgaattccctgccgatgacagtgctacggcaacggatggacaagcggtggctaaatggcttttcactccacgtccggacaatgtgccaaaggtgttcaaatgctacttggacaaggatgatgcgaatttgacgtccaaagttgaagcattcaaaacg

SEQ ID NO: 58406 - DNA, 100 bp, Heterodera glycines
  Genomic contig location: Contig_ID=SeqID_27735; Location=950..1049; Strand=+
  SCN-specific regions: Sequence locations=1-42,65-100
atggtgtcgccaccgtccggctcctccgcgctttttcccgtcggcaccgccgtttgtgccgccgccatccgtgccgatttcatcgcagccactgtctgcg

SEQ ID NO: 58407 - DNA, 56 bp, Heterodera glycines; identical to SEQ ID NO: 52733
  Genomic contig location: Contig_ID=SeqID_27736; Location=401..456; Strand=+
  SCN-specific regions: Sequence locations=1-56

SEQ ID NO: 58408 - DNA, 1627 bp, Heterodera glycines; identical to SEQ ID NO: 27738
  misc_feature (125)..(125): n is a, c, g, or t
  Genomic contig location: Contig_ID=SeqID_27738; Location=1..1627; Strand=+
  SCN-specific regions: Sequence locations=1-224,246-1627

SEQ ID NO: 58409 - DNA, 948 bp, Heterodera glycines
  Genomic contig location: Contig_ID=SeqID_27741; Location=367..1314; Strand=+
  SCN-specific regions: Sequence locations=1-107,131-648,670-948
  Gene Ontology: Biological process=protein biosynthesis
atgccgaggctaaagccaagaaagacgcagaagagaaggctaaaaaggatgccgaggctaaagccaagaaagacgctgaagagaaggctaaaaaggatgccgaggctaaagacaagaaagacgcagaagagaaggctaaaaaggaggacgaggctaaagccaagcaaagaagcagaagagaaggctaaaaaggatgccgaagctaaagccaagaaagacgcagaagagaaggctaaaaaggatgccgaggctaaagccaagaaagacgcagaagagaaggctaatgccgaggctaaagccaagaaagacgcagaagagaaggctaaaaaggatgccgaggctaaagccaagaaagacgcagaagagaaggctaaaaaggatgccgaggctaaagccaagaaagacgcagaagcaaagaaaaaggatgaagaaatgaagaagcaaaaggctaagcccgaagaaaagcctgaggcacctgccgaagccgtagccgtagtgccggaagcgatgaaggcggaagagactaaggaaaagctgaagcaggaagagaaaccagtggaagtgccaccatctccagcagaaaagaagagaaaagaggctgaggagaagaaggctcagaaggatgccgaggctaaagccaagaaagacgcagaagagaaggctcagaaggatgccgaggctaaagccaagaaagacgcagaagagaaggctaaaaaggatgccgaggctaaagccaagaaagacgcagaagagaaggctaaaaaggatgccgaggctaaagctaagaaagacgcagaagcaaagaaaaaggaggaagaaatgaagaagcaaaaggctaagcccgaagaaaagcctgaggcacctgccgaaagcgtagccgtagtgccggaagcgaagaaggcggaagagacaaaggaaaagctgaagcaggaagagaaaccagtggaa

SEQ ID NO: 58410 - DNA, 1448 bp, Heterodera glycines
  Genomic contig location: Contig_ID=SeqID_5547; Location=1144..2591; Strand=+
  SCN-specific regions: Sequence locations=1-42,64-64,88-98,120-167,204- 220,252-454,476-684,711-744,766-871,900-1211,1233-1323,1345-1448
  Gene Ontology: Mol. function=non-chaperonin molecular chaperone ATPase activity; Cellular component=intracellular; Biological process=reproduction
gatgccggtgccatcgctggactgaacgttttgcgtattataaatgagccaactgcggctgcacttgcttatgggttggacaagaagctgaccggagacaaaaatgtaggttccttctctccattttgaatacaatttgcctaaatttccttgaaaattcttattactaaataaaataaaatttgttatttatacaatttttagatattgattttcgatttgggcggtggcacttttgatgtgtcaattctgtcaattgcggaaggctcactgtttgaggtgaacgtaaaatctaacgtttttatgcctgaagcaattcatgtttaatgtttttttcctgaaagtggatgcttaaacaaacgcctcgggaatctttttcaatccttagaatcaaatcctcacaattaagccttgggaccgaaagttttttttaaggctttgaaaccaaagattttttctttgtgttcttttaatgcctttttataggttcggtcaactgccggtgacacgcatttgggtggcgaagactttgacgcgttgctggtggaccatctgaaagcggagtttaagcgcaagaatggcggacgcgacatcggtgcaaatccgcgcgcgatccgtcgtttgcgcaccgccgcggaacgcgcaaagcgaacgttgagcagctccaccgaggcgacggtcgattaaagatttatttgcattaaattaatgaaaataagttggatttaatggggtccaactgttttttgaagaaaatattttaaacaaatgcctttcgttgcagattgaggtcgattcgctctttgatggcatggattttcacaccaaaatcagccgagctcgtttcgaggagctttgcatgccgtaaggcatttaaaaaatttaaaaaaaaatttaatccaattttaagtctgttccgcaaaactctcgaacccgtggagcaggcattgaagtgagtgactgacagacaaatgggagggtgctgaatcaacatgacttgcagtttatggcaaaaagaagggcttgaaagatacaaaattaaaaaagactgctgcttttagagaaatgattgccaattgctgtatatttagggatgccaagttagacaagcgttccatcaacgaaattgtgatggttggcggatcgacgcgcattccgaaggtgcagaagctgctcaaagagttcttcaacgaccgggagctgaacctgtccatcaacccggacgaggcggtccgtaaaataacttaactcctctcggctttgatgactggcagtcccgataggccgtcggggaaattttgaaattattatctgacatcaatcaaatttgccaaaatattatttatcgctgtcgatcatttgatgtgaatttagtttattttcaggtggcttatggcgctgctgttcaagccgcaattttgtctggagtaaaggatgagaccacaaaa

SEQ ID NO: 58411 - DNA, 1336 bp, Heterodera glycines
  Genomic contig location: Contig_ID=SeqID_5548; Location=1745..3080; Strand=-
  SCN-specific regions: Sequence locations=1-93,115-319,350-394,416 -850,882-1336
atgtcaaaaattacaattgattatgctagcaacaatattaaagtttttaattcgtttgcagatgcttccattcaaaattccataatgcatggtttaaagaaagaaattgatgaagcgataaaaagtttagcatttcattggcaaatttcattgaatgaaattgtgccgaacaaaaaagagccgaaagaattgctgaaggaattaaaaagtttttggcaccaatttaatggccaaaagggcgcccatggagacaaatgtactgtagtgttaaagaatgggccaggattaatattttataaaaatgccgaaatctctaaagaaaaattatgaaaaattattaaaaaatttacgagaaatttttcaaaacttttgaaattttaagcggaagaaaagcaacacgaaagccattatgaaaagcgtctactgaagctgatggcggattactctgtttgtttgaatggatttgataagccaaaaagtggaaaaagttagtcattttctttatcaattgttcacttctcaagatgatttcttgaaaagaattcccttatcacctatgagagttaaaatatgattaaattcagtttctctatttttttttaccttacttagggcaacgccagaaaagcaaaaatgccctgctgtggtgctattagagctcggaatttgaaaaagtcgggatttgaaatcgtgccaggacggaataaccgagattaaaatttagatattacagagaccctaattcttttcgggctcttgatgtcattagttcagctctttccgtcgacaccaaccaaagcaaaaaaaagcagtaacaaattcataaggaaggcggctttaaagcctttggaaaatttaaaaatttatataaaattttttttcatggcatttttaaaaatcgaaagatcacgaaaccataatttgttcttcccgtcagaaatcaaatttgaatttgttttctacattttttcattttcacagaacgccgacgacgacgcgacgatgggagtggatggtcgaagaaaacaattttcggcttactgctaggagctttatttgtaatctttctaatctttgtgctcgccaagatgaaccactgtctgtgtgaccctcgtggtgatgataatgaccacaaaggacacgacaatagtgatagtgatggtgaccaaagtcgtgacattgaaattggctccccttctgctggtgaacatcgcccagcggcggcacgacacggcggcgccggtgccaattcggggagtgaaagcgaccacagcgtggaacaggtatttaacggctcacagaaaatgcgtcagtgatataattctttaaaaataaa

SEQ ID NO: 58412 - DNA, 467 bp, Heterodera glycines
  misc_feature (456)..(456): n is a, c, g, or t
  Genomic contig location: Contig_ID=SeqID_27742; Location=117..583; Strand=-
  SCN-specific regions: Sequence locations=163-212,456-467
  Gene Ontology: Mol. function=structural constituent of cuticle; Cellular component=extracellular; Biological process=cuticle biosynthesis (sensu Nematoda)
atggacttcgacggccgcatcaaggcttaccgcttcgtggcttactccacggtgtccttctccatcatctctctgctttcggtttgcttcacgctgccgatgctgaagagctacgtgtccaacgttgggctgaagatggactctgagctcagctcatgccaagtaaaaacaatggcacaatttgaaaggtgacaaaatgccaaccccttcagagcaatgccaaggacatctggtcagaagtgagtcagctgaagggtctgccgttgatcgtcagcggaaaccgtacggcacgtcaagtgtacggtggcagcggcggctacggaagctgccaagactgttgctcaggcggaggacctggcccggctggcccgcccggacagcccggacgccccggaaaccctggagctcccggatcgcccggacagcccggacactccgtccagactccctgtgagncagtgcacccg

SEQ ID NO: 58413 - DNA, 1270 bp, Heterodera glycines
  Genomic contig location: Contig_ID=SeqID_27743; Location=1..1270; Strand=-
  SCN-specific regions: Sequence locations=1-13,35-363,385-1056,1078 -1270
tttccgcattgccttttctcgccttttccacattagtacgaaaatttcgagaggcacccccaatatttcaacgggtgcaatgaaattctccaagactatttgaatcgtggcatcatcgaagaaagtacccggacaaatgcccctcaacactttttaccccatcacactgtggttggcaaacgattacgtatagttttcgatgcctcttcccatgaacgcgactcgcgttctttaaatgacacacttttcgcaggtcctaatttgtacaggatttagccggcaaattaatccaatttagggctactatttaccctgtgtgggcagacatagaaaaagcctttctaatgattagtttgaaagagtcagacagggaattttccaaatttctgaggactcgggacccgaattcccctctttccggaaataatttggtcatctatcgctttcgtcgaattacattcgggattgtttcgtgcccatttttgttagcggccactctccaacaccatttggaaaccacgccaggcactttggccaaggaaatccaacagcattccctgctgtatgtggacaatttacttttattagctgaatgccctgaggaggcgagagaaaaggccattgaggcacaaaaaattttctcatccgcaaaaatgcgtctccgtgattttgtcgcagcggactcgagaattctaagtgttgtgccatctgaagaccacctttctgaaaccgaaccccttgtacttgggcagaaatggattctcagttcggacaccttatttttctcattccctattgttccgtcaccggaaaaattgacccgtaggattattctaaaaaccattgcttcattctttgatcccctcggattatgctccccctgcctggtaggagctaaactatttttccagagtatgtgggaaaagtccaggggctgggacgagcccataccggacaaagaacaaataccatggcaagaattgcgaaacgattggcatggacaaaccatcacaattccccgacacactttccgtacgaaaaacagtacactacagctacatgttttttctgatgcttccccaaatgcttttgcaagggcagagacggacggaaatttttcctcctccttggtctattcccgatctcgagtaaacccaggaaaatgggaaaggaccagcctgacggactcactattccccgccttgaccttttaggagttttattaggagtaagggctgctaaatttgtaaaaacccatttttcctatgaa

SEQ ID NO: 58414 - DNA, 1546 bp, Heterodera glycines
  Genomic contig location: Contig_ID=SeqID_27745; Location=533..2078; Strand=+
  SCN-specific regions: Sequence locations=1-135,164-384,409-985,1007 -1157,1179-1546
  Gene Ontology: Mol. function=carbohydrate binding; Cellular component= endoplasmic reticulum; Biological process=ER-associated protein catabolism
atggctcttcccgatggttggccttgctcgggtccgttgttggatttggccgagaaatttgcacagcgattgcttccggcatttagcacaaacactggaatgccttatggcactgtgaatttaaagtactgttggcgttcctttgttttttcttttaaattaagatacggcgtcaattatttcgaaacaccgatcacatggtaagcttgttttgtctattctttcaaggttttgcaatgttttattgcttttttagtacggctggcattggcacttttcttttggaatttggcactctgtcgcgcctcactggcaacccaatttatgagagggttgcgctacgggcattggatgccctttggaacagtcgctcctcgttgggtttggtcggcaatcacatcgatgtgcagacgggtgagaaacaaacaaacaaaacaaaagcagagcaatattaatatttttccaaactaatttcccatgaatttagctacaaatagtaaaattaaatttgaggtgtttttaccgcaactgattccggaattggggctggcgtcgactcttactttgagtacttggccaaaggcgcactgctattccaacggccaaaattaatgcgccaattcaatggtgatcatttcgttttctgaccatttattcacattttttgacctcgaaaaggcactttaatcgcaattcccgcgtagaattcgaggcagccattaataaacatgttcgtcgtgacgattgggttttgtgggtggacaaggacaaggcgactgtttcgatgcaaatctttcagtcccttgaggcattttggcccggattgctggtttttatttatttaaagtttcagaaaacattattttaagactcttgtcggtcgtgttgaggatgccgttcgtataatggcatcgtatggccaaattttgcggcatttgggcgtcccacccgaattttacaatttgccgaacagagagcctgtaaaatcctttgtttttatttccattggttgtatttattctccgcttcccccgaaggtcattggtcgcgctgcttatccgttgcgtcccgaaatccccgaaagtttgttgtatcttcacagggcaacaaatgaccctgcttatttgacaatggctgcttcaattgtcgacgtacctccaacttttcatatttttaaatgttccattgtttttacagaccatcgaccaaattgcaaaaacgaactgtgggtgcgttgttgtcattagaacaacgctaaatcattctgttgttcagttttggcactgttcgtgatgttggcacgggcagtgtggaagacaggtgggcgcccgagggatcatttcactcccccccccccgaaaaagagtttttagtgtgtaaatttacaaacagttcaacttcctctttctcaggatggagtccttctttttggccgagactgcgaaatatctctacctaatctttgacgaacataattttatgcatagtgttggctctgcgaaggcaaaattggtggagaccacggggggaccatgcgtaatcgaag

SEQ ID NO: 58415 - DNA, 1148 bp, Heterodera glycines
  Genomic contig location: Contig_ID=SeqID_27746; Location=51..1198; Strand=+
  SCN-specific regions: Sequence locations=1-272,294-662,684-1075,1097 -1148
atagcgctttgtcactcctttccacgccagcttcgacaaatgccatccgaactcgccctcaacagtggagagaatcaaaaaccaaggccaaatcagcaaatgccgtgcaacaaaaccacccggcacagcaaaaaccggccacaggaggaaaagcaattcgtggacaaccgacccagccgtgcggctcatgtgttggtactgatcactggagatcagattttcgcttccgagaagcgacatgccacacgtgccaaaaacaaggccacattgctaatgtttgccgaaagggagcattcacgacaaagaaccaacgccgttcatttcacacggtccaagtcaaagcaacatgcctacaaattggcacgactcaaggacggtggtggaaaattttggtcgaaattaacggcacaaaaatcgaaatgaatgtcgacacaggagctcagacgacagtccttaccattgaaaaatggaccaaattaggacaacctaaattgttgccaaccgacattgagaatcgtaactgcaacgacgtcacatttaacacaattggcaaatttacatgtcttgacagcattaagggacaaccaaccaaaaagctaacagcttatgtgactgaagagctcaattacgatttgtttggtttgccatggattgaggcaacggaaatgattcccaaagaaatcatgtttccggagacgcacacatcggttggaatccgcgcatcatctgccgcacctttccaagaaatcgccgatgttaagtcactcacgacggctctcaaagaaaattttccggatgtttttggtaaagagctaagacagtgcaccaagattaaggcacaattgattcttaaatccgacggtcgatcggttttctgtaaagcccgaccccttcctcatggctcactggaagcagtcaacacggaactggaccgcctcttacagatcggtgccattaatccgatagaatttagccattgggcagcacccattttagccgtcaaaaagaaaaatggcaaaatcagagtgtgcattgatttctcaactggcttaaacaatgcacttgaactcaaccgccacccactccctcggcctgatgacatttatgcagccataagcggcgctgcattttcacaaatttggacttaa

SEQ ID NO: 58416 - DNA, 746 bp, Heterodera glycines
  Genomic contig location: Contig_ID=SeqID_27748; Location=1..746; Strand=+
  SCN-specific regions: Sequence locations=1-624,647-746
  Gene Ontology: Mol. function=biotin synthase activity; Biological process=biotin biosynthesis
aataaaagcacaattaaatcctgaaaatgcctttgtccctgaaaaggattggacttttacaaccacaacatcgactgctccaaggacttttaccacaaaatcattacaacgcgccgctttgatgagcgaatttcgaccattgagaaagtacggtaccatctaattggccagttgtacgataatttgcgtattgtaaaggttcgttcggccggcatcaaagtttgctgcggagggattatcggaatgggagagaataacgaagaacgggtgaaaatgtgaggcggaaaatgggctaataaccgtttgcttccatttggccaaggctcgtcacattggccaatttcgcacctccgcccgaatcggtgccaattaacaaattaatgcccttccccggcactccgttggccaatgccccggcgcccgaccccttcgatttcgtgcgcacaattgccacggcgcgtgttctgatgccaatggcttacatccgactgtcggctggcagagagcaaatggcggacgaattgcaggcgactaattttttagccataaaagcccgtttaatttaaatattacaaccaaaaattgactttcaggcactttgttttttagccggtgcgaattcacttttctttggggaaaagttactaacggcgtcaaatccaatgccagaaaaagacaaagaattatttcaacgattgggtctcaaaagagagcaaattgaggagaaaaaagctgaacggaatgac

SEQ ID NO: 58417 - DNA, 325 bp, Heterodera glycines
  Genomic contig location: Contig_ID=SeqID_27748; Location=999..1323; Strand=+
  SCN-specific regions: Sequence locations=1-325
atggccgttccaacggccgacgacactccgccaaagtcctcaagcgatgcgttcaaaagattggcatccaagcggcgcaaatatcgctccaaatgttcaacaaaacgctgtttgaccacattgaattccatgacggatgacggacgaacgaacacccaaaagtcggcgaaaagagaaaacacgcggcctgaaaatgggggggggggattgttaagtgaagtgaaccaggaaggggggggattgtttttattgatgggtcataattaattaacaaactataaatttcagtacatttggattcgaaatgacaatcttttttgatatg

SEQ ID NO: 58418 - DNA, 1418 bp, Heterodera glycines
  Genomic contig location: Contig_ID=SeqID_27749; Location=364..1781; Strand=-
  SCN-specific regions: Sequence locations=1-150,172-284,317-454,486 -683,730-746,819-865,896-943,986-989,1011-1418
atgctttatgtattgtttcgatcagttatgttggtccaaaaattcacaatcgacgacccatttgcaccatccgatgtaaatttacaggtaaaatttatctcttctaaacctttgacaaaatacgatcaattattcacaaacaatcaaatttaggattaaaaattgttgattgtttccaggcattttcacattttttggatacatattttcaaatttttgtaaatttattttaaaaactcgaaaatttttgatttttccatgagatataatatttgcacttggtaactgtactgtaaaatttattttttacagtccatcattatttgtaactcattattccgccatttgcttggacatgtgttgataattgaccgttttcttgccacagtacgcacaaattcatatgaaaaattttcaaaatttggtttcactctcgcatggtctagcactacggtatttttttattttgtaattaaaaataatttcgaattacagttcattatcgcttttttgaacataataaccaatggcgaatcgtggaccgttacacgattaaatttgatcactcaaacaatttcgacgcttttaagattgcacaagcaacgcaaaaaattatcatatcggacatcgctatcttgtaatgttaaatttttttttaaatcttcaattaatttccaaataccattataattaattaattgatttaaattttttatttctttattaattgcaaatgttaacaaaaaattattatttttaaaattttatttttttatttgtaatccttgtttttttatcacttttatttgttttttattataaaattttaacgcatattttcgtacaaatttacccaattttcgggtttttaatttatatatttttttgtaaataactgaatgttttagcggtttttgatacattaaacacatacagtctcttgtaataattatgtttttgtttaaattataaattcattttttaaggtttctgataatgtgaaaacagcaaagcaactttcgccaacttttttatgcttatttctctccaatttattcatcaattttttgtattcagccatagcatttaacatggtcactgagaattaccagatcagtttgatgcgggcatttggcatttgggctgatgctgtatttggtgctgcaattgaactcacaatgatgacgtaaatatgcaattaaaaaaatttcaagaaattctgttgctttaattagtacgtaaaaattttgtacactgtaataagaggtaatttcaaatgctaaaacaatcaaaattggttaggcacacggaaaagggcgttaatcaccgctcttggggcttaactaggctaagaatttggtaattgtagtaagtttggtgttatgtttcaatgcaattaacagccaaggctaaataaa

SEQ ID NO: 58419 - DNA, 2505 bp, Heterodera glycines
  Genomic contig location: Contig_ID=SeqID_5550; Location=1569..4073; Strand=-
  SCN-specific regions: Sequence locations=1-128,150-352,376-503,526 -940,962-1663,1685-2171,2193-2328,2351-2505
gtcaacgacaagccagtttcacttgtggcggatacggcggcccgaaaaacaatcattcaattggccacatgggaatccctgggaaacccaaaattcaaaacaggcaaaacatatggcaaattatagacaggccacaatttttcactcatgggttcattcgattgtttggttgagttcatgggtatcaaattaagtctcgaatgttttgtagcaccgaaaggcgagcttaatctcttcggtctgccatggattcgcgcattcgaatacgcactcaactgtccgtggccacaaccctgccgatcattcgtcctgaaccagcatttttggccattacacattcaactgatttggctaatgaacttaaaagcaaattcccttcagttttcagtcccgaacttgggcactgcacaaaaatgcttgctcatctgtatctgaaatcggattcgagaccgattttctgccgcgcacgtcctgttccgcatggtgccgtcgaaactgtcaatgccgaattggaccgtttgttaaccattggggcgatcaaaccggttgattttagtcgttgggcggctccaatagtcgcagtcaaaaagaaatctggcgacattcgcgtctgtattgacttttccacacgtctgaacgaatgtttagagctgaacaggcacccgcttccgcgacctgacgacattttcaacgcagtccgtggcacatcggttttcagtcagatcgacttcaaagacgcctatttgcagatcgtgctggacgaagagtcgaagcagttggtcggattgaacacccaccgtgggctgttccaatatcaaaggcttccttttggaatcaaatcagccccgtctattttccagaaattgatggacgaattgacagctggtcttcagggcatgttcgtctacctggacgacttcatcgtggccaccgacacagcagaaaatcatcataaaattctttcaaaatctttcaagcgtttacatgaatggggactccgtgttaagctcaacaaatgcaaattcctctgcaatgagctgaaatttttgggccacatcatcacctcagatggaattcgaccggaccccgaacgctcacgtacaatcaaggacatgccggctccgactgatgatcaaacactcagatcatttttgggggcgattaactattactcccgttttgtcagtcaaatgcgtgaaatcagagcaccgttggatgagctccttaagaaggacgttcaatggcattgggacgaacagcaaatggcattcgaaaaggccaaacaaattatcaactcagatttgctgttgacgcactacgacccaacgaggccgatcatcgtcgccgctgatgcgagcaacaaaggccttggcgctacgatcagccacactttcgacaatggcactgagaaagttgtggagcacgcttctcgagcgctgacctcagcggaacgcaactactcacagatcgagaaggaaggcctggcgatcattttcgccgttcaaaaattccattgcaaagatgggcgttgactctgtcgaattatgattttaatatcaaatacatttccacgaaaaattttggtcaggttgacgtactttctcggttgatcagccaacaccgagagtcacagcaaaatgaggacaaagtcatcgcccaaatggacatggaagaaagcagtgaactcgaagtggcagccgtcgatttgttccaaacaacacttgatcaactgccgatcactgccgaagagggcccaaaattgatctcgacattgataggtgggttagaaattgtgaagagtgtgccttagcagccaaagcgccacccaaagtgccgcttcaaccatggccagcatccactcaagtctatgaaaggcttcacatggatttcgctggtccatgtgcagatggtaacaaatatctggtagtggtggattcattcagcaaatggccggaaatcattaaaatgaagtcaacaaccgcacaccttttgatcgaacagtttgtttggttattttcgcggtatggttacccaaaagaaattgtcacagacaatggccccccattcaaatcgcacgaaattttcacgttttgcagttcgcatggcattcagcaaacattcgcaccaccgtttcacccacaaagcaatggccgtgccgaacgattcgtcgacacactgaagaggcaaatgaagaaatgtgcgcgcgacgatccacattgggtacaaaattcactgctcgcgtaccgcaccacgccgaacgcaagtttaaatggtcgtacgcctgccgaattgttcttagggcggcccgttcgaactgttctatcgttaattaaaccaaattcccaaaaacaaaaacagggacccgtgttaaacgagcagaacagcaaaatggcgaaacaattcaacaaacaccatggagcacgaaatcggaacttttccattggtgacattgtccaatttatcaattatcgcggcccttcaaaaacgtggctgcgagggacaatt

SEQ ID NO: 58420 - DNA, 316 bp, Heterodera glycines
  Genomic contig location: Contig_ID=SeqID_5550; Location=6367..6682; Strand=-
  SCN-specific regions: Sequence locations=1-117,139-177,199-316
atgtcggaaaaccgtcgaagtcatgagagaaattggagaaaaagagaagaaatgaagaagataaatgatcatagaaaaagagagagaaaatggaagagaaatgaaagagaaattaagttgtggttaattggaataatttgaaaagtttgtgatttaaatattttatatgatattcctatttaatttcagcttttgatcgtcgctcactgtccaatatatgctcatcctacgcttttgtcacactaaatgacccacaatttggaagaggtggtcgtcatgtaaaatacagttatgataaatttaaactataaataaa

SEQ ID NO: 58421 - DNA, 372 bp, Heterodera glycines
  Genomic contig location: Contig_ID=SeqID_27752; Location=176..547; Strand=-
  SCN-specific regions: Sequence locations=1-372
atggtggagggtaaaatggagcaactcaaagcggagacggaagcggtggaaggtgtgcaattttatgatttggggcaacacttaccgaaacaccgaaccaatgaataatgccttatttcttcgaactaactcgaaacccccttaaataagtcgttttgattaattcgcttttaatttcgaattccctccagttttaccggtgaattgttggttcaaagactacgtactctcaccgcattcttgaatttttacaatttaataaccgtaaaagccttttcagaaattctacaagaacttttcaactcgaatttgacaaaatgcaatgatgagtacaaatctcaatcgatgaacaaatatttggtggaatgcgaa

SEQ ID NO: 58422 - DNA, 247 bp, Heterodera glycines
  Genomic contig location: Contig_ID=SeqID_27752; Location=766..1012; Strand=-
  SCN-specific regions: Sequence locations=1-112,136-247
attgagaaacggcgtgaggcggtccggaaacgaatttgcccgtgctttttgagactcaaatcggcgattgacgaccaatacaacgaaaagaaaaaggttgtcaagcgagagcaaaataacaatgaaaataatacgacaaaaaatcatagactgatgaaaccataactttgatgttgtcatatgacaaaactgatagcgtatttttcgctcattatcagcacctttgacaactcatgagtgaaataaa

SEQ ID NO: 58423 - DNA, 967 bp, Heterodera glycines
  Genomic contig location: Contig_ID=SeqID_27754; Location=1..967; Strand=-
  SCN-specific regions: Sequence locations=1-257,292-381,403-632,654 -864,889-967
  Gene Ontology: Cellular component=mitochondrion
gctttatctgacgtgcattggccttatcgtcttcattattctcttcgcaatccgtcaatggattaaaggtgcacagtttcgcgagaaagtcagtgctcgtggggcggtggccattgtgacgggtgcgaacagcggaattgggaagcaattggtgcgcgagttgaacctgcgttatgtgaaggtcggttggacattaaaaaaataagaaaaaaaatccatttactcgttaaatttaccatacttttgtaaattgatcgtatattattttataaattttaaattatttttattgaaaatccgtgctttgggcacaccccgcgggaagaccttctcctacattttacctttactcagcaaatccagaagggatgagtccgcttattttgactttccgttattcaggtgtacatggcgtgtcgaagcgtctcgcagggacaagcgactgcccgagagctgttttcccgggtaaatttccgatcacccttatttacatagcatttcttttcattagtacggttgcgatatgactcggatgattgtccgtcattgcgatttggccgacttttcttcaattcatcaatttgttaaagaattcaacagaggtatgcctctttttagtttatatcctttcaatccacccaaattaatactcagatgaacccaaattggacattctgataaataacgcgggcataatgttttatccacgcttcaccaaaactgtcgatggccatgagctgacttggcagtccaactttttaggtctttatttgctactattaataaaatataatgcattaaggccattttctgttgaccgaattgctcctgccaaagttggagcgcagtgaggaaggcggtcgcattgtgaatgtgagcagcagtgtccatctccgtgccgattcggtcgatccggaggtggtggagtcgcctcgtcgatttgggataatcgcgacatacgctcgct

SEQ ID NO: 58424 - DNA, 548 bp, Heterodera glycines
  Genomic contig location: Contig_ID=SeqID_27756; Location=42..589; Strand=+
  SCN-specific regions: Sequence locations=1-163,199-225,265-299,346 -381,424-458,480-548
atggaattgtcggaggaaatggacaatttggggacgaatttggaggacaaatcggacaaattggaccaggaaaatgaaaatataaaatgggaaaattggaaagaaattgtgggaaaattgcactttcgaaaatttggcattgcaattgttaagggacgaatagaaaattgggaaaaattgggccaaaaacagaaaacattggcactttcgaatattgtcgaaaaaagagagaaaattttggaagaatttgaaagaaatttggaacaaattgaaaaggcggaaaaacagcgaaaattgggtaaaataaattaaaataaataaataaaatttaaatttaaaaaaattcttagacaaaaatattttctgtcaatatcaaagcgacacaaatttatcggaatttattgaaaagaaagacaaaataaattttagtgagaaaaattcgcaattatttccatcagaaaaatggcaagaaataaattcagtcaaagaatttgagagaacaaatttagaggaaaaggaaaaagtagaaatttaaaaattaaagaata

SEQ ID NO: 58425 - DNA, 61 bp, Heterodera glycines
  Genomic contig location: Contig_ID=SeqID_27756; Location=1688..1748; Strand=+
  SCN-specific regions: Sequence locations=1-26,50-61
atgtgcaagagaaaagagttgaggaagaaaacctatgaagaaaaggaagccaatggatacg

SEQ ID NO: 58426 - DNA, 391 bp, Heterodera glycines
  Genomic contig location: Contig_ID=SeqID_27757; Location=316..706; Strand=+
  SCN-specific regions: Sequence locations=1-13,35-343,365-391
atgaaccgacggtaataaatttttaaaagtcaaacaaattagtcatttatttaactaacaataaactgttttcccacaattttagttggatttgcaacgacgtttggatggacattttcccatcatttgaccgtgctcaactcggcctcaaattggcacttctttcgccacgtttcgatgcgttggtggacaaacatttcaatggcaaaagcgaattgacaatttggagaacaatcgcaattcatcgcaaggacaaaggaacagaaccgaaactgtttgtaaagatgggttacaaatttgtggaatttccgttgcccgaccgtccgctgcccaacaaaatccgttttaatcaccttcggatttagtaattaaaaaccagagagctatgaca

SEQ ID NO: 58427 - DNA, 143 bp, Heterodera glycines
  Genomic contig location: Contig_ID=SeqID_27758; Location=491..633; Strand=-
  SCN-specific regions: Sequence locations=1-143
atgcccccgtccgctgacgggcacaggtcgttcgagctgacttgtggacgctgcccaacattacggggcagctgcctcacgagccatgcttttggggtgcttccatacgttggagctgtggtataccgctcagtgctgcacat

SEQ ID NO: 58428 - DNA, 913 bp, Heterodera glycines
  Genomic contig location: Contig_ID=SeqID_5552; Location=332..1244; Strand=+
  SCN-specific regions: Sequence locations=1-318,350-457,497-913
atgagttcttttggcaatgattcccaaaatacgacctctttttctcccaattggtcaacggcagacactaattctactgtaattacagtagcctattttttggtcagcggtatgtcgcttattcacgtcgccacactaacaatttcatcctttaatctgattgtgttgggctcgaccaagctgcttcacccgaatttgaaatttgttttgatgtgccaaagtggggccgtttttttgtttgaaatctttcgcctaattacgatcttccaaaaatttttgtcaaacgacattttcaatccatgcttcgtgttttttcaggtgaaaaagatttcaaatgttttttaattcaattaaggacggatatttaattaccaaattgacagggaatggtctccgatcggagattaggaattttttaacactcaaatataatgtgccatttggtccttttttggtcaaaatttaattaattgataaaattttcaaaaaaaaatttcagacggcgcctatctgcatagacggacccctttgttcctagtttttgaaaaaattgcgccgaaaaaagcatttttaaaaagcaaaaaatagtcaaatttattgaccattaacagatttgatttccgatctctttttaccgtctgacccattcgaaaaatcttagtcgcccttttaatgcatcccgccagcccctaaaatttcttctcgtatttttttttggaaatttcattgaaattttttcaaaatttctaagaatccgcaatcctgcgcgtgatcctgcaaatttaaaatgcaggattaatccggccggatccggtcctgcaaaaatttttgaattccaatcctgcaaaaggatccgcaaatttgaaatttccgagctctagtcacaccgtttcaaaaaatgagatgtgtacca

SEQ ID NO: 58429 - DNA, 838 bp, Heterodera glycines
  Genomic contig location: Contig_ID=SeqID_5552; Location=2979..3816; Strand=+
  SCN-specific regions: Sequence locations=1-192,214-283,305-338,363-838
atgatggagttcgaggtagctccaattttacggcatcatgccgtacgcatttcgttcaaatgtgcagaatgtggtgacacaacctttaaaacattcgacttcaattcacgtggaagatggggcatgtatttttttaagcattaatcaattagttggaaaggattggaatgactttttgaaaaattttgttgtcaaaaaagaaggggtgaaaattaatattaattgggcttcgtttttaggcaaaaaactcgcaaaatggcattaaataggcacaaaaatagacaaataaatttttttttattaacgctttttaggtagtaaaagacgtaaaaattgaacaaaaagattaattttgttttattacaataaaaacgaagccctaattttaccgaatttttatttcgtttgggaaattgatgagggacaaaaaggcctacaaaaacattaaattttccaggtttggccgttatggagaacacaagagcatccttgacaaaaaaacattcatctgtcacacgaaatgataaatgatgtgttcaaaacaatgccggacagaggctatgccttgttaagccttaattgccagatatgggccaaaagtttttatagtaaaggtttattttgtttgtttttttgggggtttaagggattagccaatggtatcgcccagagggccctatttataaatgcatatggattaattaatgtgcctacgttatttcgactttgaacacacgaggattcgaactgcatttttgattcaggaatatgacacgaccattttcagaattccccctccccccgtgcaaccatttttgaaaaagtttaagatttttga

SEQ ID NO: 58430 - DNA, 1292 bp, Heterodera glycines
  Genomic contig location: Contig_ID=SeqID_5552; Location=3986..5277; Strand=+
  SCN-specific regions: Sequence locations=1-186,208-213,235-433,455 -684,706-812,840-904,943-1103,1126-1292
atgtgggccttactccctctgaatttcctcctcaaccaatttgggttatgttcagttgttaaattgaatatgatcgacactgctctttgcccttgtccgcttacaaatatgaaggtgcagaacgtggagcatattgaagtcataaaagaccatgaagaggagaagttgaatgaatgcccgcggaattgcgtcgttctttcaatccgttgcaagtgcaatgcagagatgcgcaggacttatgaattaacaaaatatggcacacgcaaaaagtaagcaacagctaatagagcccgtacccagaaaataaattgtagggaacttcagaaatttaatcatgggatgccaaacggcgggacggtaacggatgggcgctttccaagggaattccaaaaaaaaggggcggacgattttgtatcgacccgtttttgtctacatatttatttattttttaaaactcaggagacatttttgttgcctccttaccaaaaattgacagccccccccctcaaagttcacattatagtcgggaaaaaatggccagtgacaagcaaaaggatcatcacaaagggtggacccctagggcaaaatgtaatttttttttgagtacaaatgaaaaaagcttttgtggttaacgctctaaagtcagagggagggggagggagcacaatctgacgagctttttttctctgcccagaaatttttatttgccagtgatattgggtaaattaggagtcgtttaagaagaaaaaaacttttttttgctgttaaataatttttgttttttttgaccaaatttagcccaagagctgtaatttttgaagaaaataaaaataaatttgcctggtacggaggtacctaaagaaattttagtttcgaggtgggagactacggatccatttcttgtttctcccctcctcatcaaaattattagattttgtgacaattttctgggtacgggcctaattaataaactcaatctcctccaacatcatgacaaattttagcatcgggcggcctgaacgagaacggagtgtacacagtctcaagacgggaatcggaatggaattggttaaggtggagataatttttgcaacaatgccagccaaattcgatgaaatacatttcaaccagcgacattgggctcgtcgttttttttacgcgagtaagcagttttggaaatgttttgcattaaggggaattatcccatgggcgtcgtggtcacacagaaagtaggatttgcatttacagcccacccaaacccgaaaacatataaatgccaatttttatttcga

SEQ ID NO: 58431 - DNA, 347 bp, Heterodera glycines
  Genomic contig location: Contig_ID=SeqID_27765; Location=805..1151; Strand=+
  SCN-specific regions: Sequence locations=1-121,143-347
atgtcagtctttggcaacaaagacgagcagttaaactttaagacaatatgtatttggcagcgaaatgcagcggaaaacggaggacaatggtggacaaatgagggcactttttgttggaatcaactaaaattaaaatggcaatttaaatcagaggtcgcatttttacttatttgtaagtattttacttattttgagggtccaaaacttacaaattttaaatgtacttatttgtaagtaatgtacttattttggcattctagagaaattcaatttttttatctttgttttgaagcgaatattaatttttttttgcagtcttgtttttttctctttctattactttttaa

SEQ ID NO: 58432 - DNA, 117 bp, Heterodera glycines
  Genomic contig location: Contig_ID=SeqID_27765; Location=131..247; Strand=-
  SCN-specific regions: Sequence locations=1-78,100-117
atgtccatgtgttgggcagagccatggaattcggctccaatttggccaacactcgtccaatcttttccgtctcctctttcaacaatgactataaaatggacagagaacatccgttcg

SEQ ID NO: 58433 - DNA, 84 bp, Heterodera glycines
  Genomic contig location: Contig_ID=SeqID_27768; Location=994..1077; Strand=-
  SCN-specific regions: Sequence locations=1-13,35-84
atgtacgcggcacgggcgcgcgcggccaaggcggaaaagcgtcaagcgcagctgcgcaaggcagccagagcaagggcaggaaac

SEQ ID NO: 58434 - DNA, 56 bp, Heterodera glycines
  Genomic contig location: Contig_ID=SeqID_27771; Location=860..915; Strand=+
  SCN-specific regions: Sequence locations=1-56
gctatagggaagctattcccgaaggattcggtctccccattaatctgggcgcatcg

SEQ ID NO: 58435 - DNA, 458 bp, Heterodera glycines
  Genomic contig location: Contig_ID=SeqID_5553; Location=3445..3902; Strand=+
  SCN-specific regions: Sequence locations=1-458
atgacgaaagactatccgacgagcctgttcgaagaagaccgccaatatttcgggatcctcgacaatgaagttatgcagcagaaggatatcacggaacaggcacttcttttccgttcggtttttcctcgccgtgtccacccgttattaacgattcatttcggcacctgaaattcaccatgaataagggttgattgatcttcacgatttctccaatttcagatgatcaaagccctccatcatcacattctcgtcgaaaaggaggcggcagcagctgggatttaccgcgagattgatgtgctggtcaggaaccaccgtgtcgtcccagcaaatgaaattgcgaatgccatgtctgaattctgcatttggttcaacaccacgcaagaaaataacgacacggacgcagctacatttgcagccaattcacataaccgcttcgaaagaccacattaatttattta

SEQ ID NO: 58436 - DNA, 861 bp, Heterodera glycines
  Genomic contig location: Contig_ID=SeqID_5553; Location=4430..5290; Strand=+
  SCN-specific regions: Sequence locations=1-29,83-443,466-861
atgcgggattccgcgcggaagtaagtgtgatttttaaataaaattttatataaaaaattttattaataaaaagaaaataaaaggttctatgtcgatcgacgaaaagtgcaaattgggcgaccgacgaaaaagtgcaaaaattaaactcttgatttatgcagttgatttttaacctaattattagatattaaagtcaagaaatcgttagaaaacttaaaatcacaattttaattcaaaagttaatatagtaaatttttttgctaattttcaaatgaaataaaaacaaaaaatattttatggaattcctttttaatgaaactttattgataacatttttttattattgacaagcggcaaattgtttcgacattttttgtagcatcctatgggtttactaatgatatcttcgctacactggtggaaaaaagtctttactcaagccgatcaaatttgaaaaaattaaaatttcgactagaaaatttaattgattattttttgtttatgtgtttttatttacccctatttatgtgctttttatgcaccacataattattttgatccactcattcattctgagcatgagtcgtttgatcactctttactcaaaaaaagggcggaaaaaagtctttactcagaacatttatcatcgaatttcttaatatttagtcggtccgccctttgcccagattggataaaagcattcaaaattggaataaatcatcaatttgtgtgccatcttccgaacaagcaacagtcgtttttatttccatccactttttcgaatttttcatttgcttccattggcaaaatgtcactgtattggactcggctcattcgtaatggaaagggtggcacctaaca

SEQ ID NO: 58437 - DNA, 376 bp, Heterodera glycines
  Genomic contig location: Contig_ID=SeqID_5554; Location=2135..2510; Strand=+
  SCN-specific regions: Sequence locations=1-320,342-342,364-376
atgttcatcaaaccggtgctgtacagtagcatttatttcggctggttcttctacccttttgtcggctacagtaacgatgaccatcatcaggtgggggatttagcattcgctgatcaaaaaaatgcgttttcaattttaaaatgtaccgtaaaaatattttctttgctacagtatgaacattggctgcatgtcgttcataatatcgccgtcgcatttctgagtccggccatttaccttttctttgccagcaaattgtttttcaacgtccaaagcaatcggcgacagtttgccgttgtcgcctccgaattaaactcaatgcaaaaaagggtttggtaatttggaaatttaaagcaagcatatgtaaacaatttgctta

SEQ ID NO: 58438 - DNA, 444 bp, Heterodera glycines
  misc_feature (295)..(295): n is a, c, g, or t
  Genomic contig location: Contig_ID=SeqID_27774; Location=261..704; Strand=+
  SCN-specific regions: Sequence locations=1-444
ttaaggcataaaaatactcgagaaggctcttcaatgtaacacgtttgatttgtctctccaatgttcactccattctcaattggtgggtgatgcgttacttaaattcctttcgattacggcttttgcattatattcgtccgttatttgtttgcagggtaatgcgtattatgcccgtggtgactacaggaaggcgaggttcccttcaaccgttcggtctttttactccccgacccattaaagagaccatcacatggctgacctttgcgcttctaggttaactcttggttttattgtngtaggaaataatcaacattcgacagattgcaaaaggacgaattgcaacaagcgaagacattgtccaatttgtccgcaacttacattctgtaatggagattattgtttttaattatttgtgtgaactattagtaaataagggctagcgga

SEQ ID NO: 58439 - DNA, 1141 bp, Heterodera glycines
  Genomic contig location: Contig_ID=SeqID_27775; Location=236..1376; Strand=-
  SCN-specific regions: Sequence locations=1-296,318-519,542-1141
  Gene Ontology: Mol. function=pre-mRNA splicing factor activity; Cellular component=snRNP U5; Biological process=mRNA splicing
atgatcctgcgttatgtgaaagcaaaagcggattggtggactaactcggctcactacaaccgtgagcgtgttcgacgcggtgcgactgtggacaaaacggtgtgcaaaaagaatttgggccgtctcacgcgtctctatctgaaggttgttttattgaatgcctttctgttttctaacgaaactcacccatttcaggcagaacaggagagacaacacaattacctgaaggatggaccgtatgtgagtgccgaggaagcggttgccatttacacgaccaccgtccattggttggagtcgcgtcgtttttcaccgattcctttcccgcctctatcatacaaacacgacactaaactgctgattttggcgcttgagcgcctcaaagaagcctattcagtgaagaaccgtcttaatcaaagtcagcgagaggaattggcactgatcgagcaagcatatgacaacccacatgaggcattgtctcggataaagcggcatatgctcaccatgcggtccttcaaagaagttggcatcgagttcatggacctgtacagccatttaatccctgtctacgacatcgagccattggagaaggtcacggatgcttatctcgaccaatatttgtggtatgaagctgacaagcggagactgtttccatcttgggtgaaacctgccgacactgaaccaccgccattgctcgtctacaaatggtgccagggcataaacaatttgcagtccgtttgggacaccagcgaaggcgaatgcaatgtgttgcttgaggccaaagtggagaaaatgtacgagaaaatggacttgacattgctcaacagattgctacgactcattgtcgaccataatatcgccgattatatgacagctaaaaacaacgtcacgataaattacaaggacatgaaccacactaactctttcggtaggttttttgtttcaaataccaggcaccagttgagagttcattatttcttcgtcaatttctcttttaggcataattcgaggactccaatttgcctcattgatcgttcagtactacggtcttgttctcgatttgctcgttctcggtctacggcgcgctagcgaaattacaggcccaccacaagtggaacattatagtttttgtgttactttgtaa

SEQ ID NO: 58440 - DNA, 381 bp, Heterodera glycines
  Genomic contig location: Contig_ID=SeqID_27776; Location=86..466; Strand=-
  SCN-specific regions: Sequence locations=1-201,224-381
atgccggccccaccaaatgcttcggttttaaaagtgccaacgtttttcctcttttttcaatttttaggacctcaacgtggaagccaacggactgagtgaggactttatgttcgacatgaccaaggcggagattccggcggagactttcaaaaagattgtcgcttggatggaggaacacaagggtgagttggcaatgaatatttgggcttttctttatccaacaaaactattttctgtatttcaggtcagccggtgcctgaattcgaggaggtaacacaaagttgccctgctgatctgttgaaaaactcccattttcaggatccgaacactttcgagcgcaaatggctcccccaaaacgattttcagcagaatttcttcaag

SEQ ID NO: 58441 - DNA, 1146 bp, Heterodera glycines; identical to SEQ ID NO: 27777
  Genomic contig location: Contig_ID=SeqID_27777; Location=1..1146; Strand=+
  SCN-specific regions: Sequence locations=1-1083,1115-1146
  Gene Ontology: Mol. function=organic anion transporter activity; Cellular component=integral to plasma membrane; Biological process =transport

SEQ ID NO: 58442 - DNA, 580 bp, Heterodera glycines
  Genomic contig location: Contig_ID=SeqID_27778; Location=6..585; Strand=-
  SCN-specific regions: Sequence locations=1-580
atgcgaaacgccaaaaaattcgagtatgcgaaaggcgaaatgcgaaaagcgaaacctaggcacatccctgccactgaggtatgggtcagggatggcacggaattccgatttccgacattttggggttggaattccgatttcagaaaatttttagcgcctggaatgccatccctgttatgggtacttcaatttggtgttgatcaaatgagtgcccatacctcagcgggtataagcttagagaattgtgatcatttgcacattttagcatttagagcattttgtgctctctgatggacataatgtttttttccagaaaaattttcccaagtccctagaaattttttcgtgtattttggagtatccagatcaacatgaagaagtgatctgatcatagtgctgcaaaagacttttttcatctgcaccaaaaaaccttagcaggaattttttaggtattatgtttttacgtgataaaaattttatgcaatacatatggtgctatgtcgttatataaaaaaccatcaaaatggaaattttaaacaaaaaactgcccataacctttgtcaagctaatccaaattaaa

SEQ ID NO: 58443 - DNA, 271 bp, Heterodera glycines
  Genomic contig location: Contig_ID=SeqID_27779; Location=219..489; Strand=-
  SCN-specific regions: Sequence locations=1-271
  Gene Ontology: Mol. function=thiol-disulfide exchange intermediate activity; Cellular component=intracellular; Biological process =response to oxidative stress
agctcctctctgatcacatcgagtccgcccaacagttctccgtccaaatagacttgcggataagtgggccaatcgctgtaggatttcagtccttgtcgcacctgctcatccgcgagtatgtcaaaggtccaaaaatccacgttgtgactgcgcaatcttaaaaaaggaacgatgagatttgctccgatgcggaccgaccactcacaaatcaacaatctgacggctgaagcctgaaaagggaattcaaactaaattccgttgtgttaaagct

SEQ ID NO: 58444 - DNA, 523 bp, Heterodera glycines
  Genomic contig location: Contig_ID=SeqID_27779; Location=1..523; Strand=+
  SCN-specific regions: Sequence locations=1-30,53-111,133-523
  Gene Ontology: Mol. function=thiol-disulfide exchange intermediate activity; Cellular component=intracellular; Biological process =response to oxidative stress
cttcccattccctaaaaaggatcccaactcgcgtctgaagagactgatcaacactgctcgactcactctgttcatgaaagggacgcccgaggggccgaaatgcggtgggatgaaaagggggaaggaacccctggggaaaaggcaaatttgaaggaaattctaaggggttcgtattaccagcaaattcaaatcgttcagtccagagagattcgttttttagctttaacacaacggaatttagtttgaattcccttttcaggcttcagccgtcagattgttgatttgtgagtggtcggtccgcatcggagcaaatctcatcgttccttttttaagattgcgcagtcacaacgtggatttttggacctttgacatactcgcggatgagcaggtgcgacaaggactgaaatcctacagcgattggcccacttatccgcaagtctatttggacggagaactgttgggcggactcgatgtgatcagagaggagctcaatgaacaaaatttcgtagataaattgccgaaa

SEQ ID NO: 58445 - DNA, 1164 bp, Heterodera glycines
  misc_feature (1152)..(1152): n is a, c, g, or t
  Genomic contig location: Contig_ID=SeqID_5555; Location=27..1190; Strand=-
  SCN-specific regions: Sequence locations=1-192,215-292,314-517,539 -626,648-653,675-734,756-1164
atgatttttttggcaagaaaaccatttaaatttgtacgaaaaaatgatgacagagcaaaaaaagaagcaaaggatagctcaaaaaagacacatgtacgtgaaataaataaataacacaagggtttgtttccccaaacaggaataggtatgtcgtaacattgtcaattccttgaatcatccaatttttgaccgtataatttttcacagtcaaaaacgataaagttaaacatctgtcattattaatgactcattaagaatcttgatttttggcagcgttgggtcaaccgaatttctttttgtgccagttttacaactttttttgtatcaaaatttggcaattttacgcgaattgttgagaaaatatttaataagtgaactagcggagcgaataaagtgattgaacagtttttttgtattatgtcaatgaacaaaagtggaagaaaatgactaatcggcagaacagcagtgctttttcggtgtttgaaaattttagtattcgccgggggcgaaaatgcgtaaaataatttatttgttgtactctctgcccacgaaacaaacaatgtaaaacagacacagaggaaaagggaaatagtgttgtagttagatggcagacgaaaactgatatatcgccaaatcaaaaacagtaccatttcaaaaaagatttttattcaaatttgctcaaagtatggagccacgcgccgagattttgcgggatttcagtccgcaattttcatttgttaccaaaaacataggcatttcctaattaaaattgactcttaaatttattttatttagaaaaatcactttttttctaatttactaatggcagcttcctcatctgctgcttaccccgtgctgtttttcacgcaaaaacgggcgggcgatggtgagttattggcacataaaacaaaaatatttgtcgccgggcggtccgaaattttggaattttcgacccttttgaatttcatacgaacactttcattcatttttaattttttttctccccgaatttagacaaactttgggtgttctactggctcagcgatgagtccaaattcggcatcgccagcttccccgacacagtgtacgaaatggacgcggacagaaacacgaggagggcattcctcggcacattgccaagagtttggtggnagagtactggga

SEQ ID NO: 58446 - DNA, 882 bp, Heterodera glycines
  Genomic contig location: Contig_ID=SeqID_5555; Location=1236..2117; Strand=+
  SCN-specific regions: Sequence locations=1-618,641-882
atgtacatagcaacttcgcagtcttacaatggaatatcgggcgagcccagtgagttatattttccacttccaaaatccacgacattaaattgtgatggccatggatttgacatttcatgaacctgtaaaaatttttcaattggtatgacggtcctgccactacggatgccaatccatggccacagagacccaaaaatgccacaaagttacgaatttttaaaacagaatttcctcaaaaaatgtgtcgggatgaatggcatcaaatgttggcacattccttatctttttcaccccattttcccaggttcgtcctctccgccggtcaattggcgttccggcgcattgcgcggtggtcgaaaagtgaccaaggagccggtctacgccttcattttgcccaacttggagcagtacccggccgacttccgccactttttggagcgggacatcatcgaaatcagcacactgagggtcaaacttctgcatttatttgccatttgagtgtccgcccatgcttcagacaatttttttcagaaaactgcccaacttaattgcactttctggggctgtctgttttcactggttcagttcacccccaggaattttaatcaccaatttttaatttaaaatcccacaaaactggccctatttttggcgtaaatatgaaatttgattgccacaattgtcactcttttttccttacagtcaaagccatggcggggtcacccgtcaattttccccataattaattgcccccctttttttgctttttcagtgattccgatgaccgacaaaaaccgcaatttgccgcccgtccatttctcagtcaattctggcgccgatttcacttggttcaacgcttctaatacggatgattgtcgatga

SEQ ID NO: 58447 - DNA, 1665 bp, Heterodera glycines
  Genomic contig location: Contig_ID=SeqID_5555; Location=3016..4680; Strand=+
  SCN-specific regions: Sequence locations=1-137,161-178,200-246,268 -375,397-882,909-1233,1262-1665
atggccgtcccattgcccttctctgtgaatgtgtccaccatcggagtatgtttaaaaattgatatattcacaaatttacaaaatatttttaactgattattttgtcgttttcaaagtttgatttgtatcaccttatattttcccctttttcgggccaatttttatgtgaatttgacctaaaatcgctttttagaaaatccaactgattgatcccttttccgacgttttgtcggaaaccctttccccttgttaaccctttggccctttactaatgaaacctaaaattatccgcaaacttcccgcagaattaaacaacgaattgcttcaatttgcccccgagtttttgtgtcgaagcgttttggctaactctaattttttgttttatgatttgattcggaggagtgaaagaggcaaaaaatggaaaaccaaagtatggaaaactgaaacaccatcactcaatggacatgattttgggtccacttgggcaaatttaattgtggtttcaaatagcgataaacatatccaagaaattttcgctttcctacgcatttagcacaattttcttttaagtctgtggaagaaagtgaagcacggaccacgtacacgtacggcaatgtcacagtccggcctttcatcctacgaaaccgacgccaccacaacttcaatttcattgttgaagacctggtcgaccccaatttatttctccgctcggaccaaaacaacggacgcattggcctagtgtcaattcgtgtcggtaacgctgcacaggtgaacgaccataaaaataagtgcaaattaagtcatttttcacccatttgatatgtcttttttaatgtcgttggattttgtgttcggatattttggttcccaccttacgattagcttgtttttgttttgagttttaattacaaaatctaattatgaatttttacctaatccaagacctggtttcattcggaatccttttttattgctcatatgaaaaaaacgcccaagtgcgaaatggattttgtttatagaataaatttcaacacagagacaagaactccgacagttcttcctcaactcttctcaaaatataatggaaacgtttgaatgcatcattatgttcttctccctcgtccacgtaatgtttactctaacggtcgtaaattatttaagtaggagtaataatacgacgattttggacaatttaacagattatgcccaatttgaattgttgagattttagtctattaaaaaatatctaatatatttttatccaaatgctaagaaccaaaaactttcatttggaaatagcgcgggaatattgaaatttaataattaaaggcgtgggatgtagtccaagtacgatttttgtcggacaacttggaaacgtggactgaagtcatggaacgttttgagagggccgtaacggcagtgagtttccattaatcacctcttctgcaagcttgggatttttaacagattgaggatggcaggccgccaacgccggtgaatagtccaagtccagtgcaagaagttgtttcggctaacaattccggcgagaaattgccatcgctcaatggaagcaacgaggaagaggaggcgaattgaacggacaattcattgttgtgtttaaatatcatttgttgatttcacaatttcaaaattttacataattga

SEQ ID NO: 58448 - DNA, 1270 bp, Heterodera glycines
  Genomic contig location: Contig_ID=SeqID_5555; Location=6044..7313; Strand=-
  SCN-specific regions: Sequence locations=1-483,513-762,785-867,890 -1270
atgttcgaggagggccggaccaagatcaagcaggtcaacgacgagtccgccaccgtttgctacgccttcaaacacttcctggagtttccgcgcgtggacgacgcgacggcacggcgccaacgcattgaccgactcgtcaaatttttcatcgacgaagcgctggagaagaagcgcatggaggtaaaaattgaattcaaatttgatggaaaatgtctgaattcgtgtaatcaacaaaatttttctaaaaaaatatgcgtaattttctgcgagcaaaaattcaaaggaatttttaaaaaaattttttggtctgttttaaaactaaaaattgaatctttcttaaaaaatcttgaattttccactaggaaatttcaaacacatgcaacggtaaaaaatggcaaaaattagacctattttttgggaaaaaccgctacaaattccttcttttactctccctgggggctgaaaatttataaaaccattgagaaattttttttttttttttttgtaattttgctccgaacagtaaacaggaaaaggccttcgggttccgctaatccgaaagtttctggctacaagtttgttctgaatttgatttattccggccaagataaactttttgaaaatcactactttttgtcgtctgtccattttttttatcttttcagcagggcaaacagcagcaggtgtccgtgtccaacaattggtcaacaaatggactaccacaaaacaaaaagagtccgatcaaggtttgtttgtttaaacaaaaaaaaaaaattttttttttgggggggggggtcagtttttcccagagggggaggcctaattaaatggggctaatagcctccggccgggtcacaaaattgtatgaattttgtaaaataagttttgattggcaaccaagcaatgtaatggacagcccatccatttaccggaaatttttttaaacataaaaattaatcgaaaacttttagaaattaaaaaaaatgttttttttggttgttatttggtttttattttcaaatttggattttttcagaaaaacgggaatatggtgttcatcgggagagggatttaggcccaacaaaaccatgcgaaatgcaaaataattagcctaacaaatgtgaaatattttcagcgaaaattgccggcaaactcgcgcaaggcactccgcaagttgccgaccatgggcctgaactttgacgacgtaattgaggaggatcagcaacggttgcgcgacatgcacccggttgggtcggaaaatataaataaa

SEQ ID NO: 58449 - DNA, 420 bp, Heterodera glycines
  Genomic contig location: Contig_ID=SeqID_27782; Location=471..890; Strand=+
  SCN-specific regions: Sequence locations=1-202,224-225,247-420
  Gene Ontology: Mol. function=ADP-sugar diphosphatase activity; Cellular component=intracellular; Biological process=cation transport
cagtgccatatttgcgcagttccattcgccgttttcccgttgatgaacaacgcgtgccatggaatgtgcctcttgtggactattctccgtgcgattacaccgctgattcggtgcacggaaagccatgggctgacccatcggagccgtcaaaatgtaaattcaattcgatggacgacggggtgaacagagtttcgtttcacgggtacaatagttaaaaatgataaaaccaaatggtaaacattttcagcagttacaatttggacaccgatgggaggcctctgaaccctttcggacggacggggctcagaggcaggggactgtttggccgctggggtccaaaccacgcggcggatgccattgtgtcacgacggctggcgaatggccaattgcaatttgtggctattgaacggcgtgacactg

SEQ ID NO: 58450 - DNA, 194 bp, Heterodera glycines
  Genomic contig location: Contig_ID=SeqID_27782; Location=97..290; Strand=-
  SCN-specific regions: Sequence locations=1-194
gggaaaatattgatcataggccccaaactcaaaaatgcttaaaaacggtcagaatcgatgtaaaaaggtttgaaatgggttggaaaaatagaattaggggcgcgcttgccctttttcaggatgaaaagtgccgaaaatggagtgccaaactcaactgggactcaagtgaccgtgctatataaagcactcaaaag

SEQ ID NO: 58451 - DNA, 1029 bp, Heterodera glycines
  misc_feature (257)..(257): n is a, c, g, or t
  misc_feature (340)..(340): n is a, c, g, or t
  misc_feature (345)..(345): n is a, c, g, or t
  Genomic contig location: Contig_ID=SeqID_27784; Location=238..1266; Strand=-
  SCN-specific regions: Sequence locations=1-491,513-522,544-613,645 -702,726-737,759-810,844-847,874-907,934-963
atgtcaatattcgagaattctgaaattccagcactacaagccaaaaatatcgctccaattgacatttatcgcccttttaagcgcaaatggggacttattttgtaattctcccgtaccgttttcagttcccactaagatgtcaatattcgagaattctgaaattccagcactacatgccaaaaatatcgctccaattgacatttatcgcccttttaagcgcaaatggggacttattttgtaattctcccgtaccgttntcagttcccactaagatgtcaatattcgagaattctgaaattccagcactacatgcccaaaatatcgcctcaaattgacattnatcgncccttttaagcgcaaatggggacttatttttgtatttctcccgttaccggtttcaggtcccccctaagatggccaaaattccaaaaattctgaaattccagccctaaatgcccaaaaaaatccgttcccattggaatttaatgccccttttaaggggaaaggggggattttttttggaatttccccggccccggttttcggcccccccaaaaagggcaaattttcgaaaattgaaaattccccccccccagggcaaaaaattcccccccttgtaatttttttcccccttttaagggaaaggggggggattttttttttaatttcccccccccccctttttcccccccccaaaaggggaatttttaaaaaaattttaaattccccccccccccgcgaaaaaaaaatttccccccttttttttttttttcccttttttttaaaaaggggaggagtttttttatttttcccccccccccgccccctctcccccccccccccgaggaaatatataaaaaaataattttaataccccccccccccccaaaaaaaaaaaattctctcctttttttttttttttttttttcttttatggaaggggggggggggttttttttttttcctccccccccgcccccccccccccccccccccccccccccaaaaaaaaaaaaaaaaaaaaataaa

SEQ ID NO: 58452 - DNA, 648 bp, Heterodera glycines
  Genomic contig location: Contig_ID=SeqID_27787; Location=37..684; Strand=-
  SCN-specific regions: Sequence locations=1-166,190-292,322-382,404 -425,447-648
atgtattcatttactaccgcttccattcttttggtgtgttttatgggactaattggactcgccgaattgggcgatgatttttttgatgaattatggaaaatgaacaaagtaataacaaataaaaagcaaaattcaattcaaaaggaagtaaaggttgaagaagttgattatgagaagattgaaaatgaaagtttcgaagatgaaaaacggaccaatttaacacaaaaagtcaaaaaagagatggaatttggtgatgaaaaagtggatttggagaaatatgccaaaaaagaaccaatttttgatgaggaagaagaggagaaaattccaagggaatgtgccgaggaaaacattgtgccgacatattcaactgaagaagaaatggaaaacaaaattggcaaatttaaaagtttgaattttcaaaattggaaaagagcagacaaaattgcaattataaatcagttcatttcaatgagaaatgaatacaaacagagaagcgattataggcaacaagattgtggaaggattgaacaaaaaattgcaaatgaattggaaataccgcgcaaaaggatttacagatggaggagggcattaggcctagggcccgaatttttagggtttcatctattttttttttgcggatatcatatg

SEQ ID NO: 58453 - DNA, 324 bp, Heterodera glycines
  Genomic contig location: Contig_ID=SeqID_27789; Location=828..1151; Strand=+
  SCN-specific regions: Sequence locations=1-106,130-301
atgggacaagaccagggttcccggatatttgcaggtgacctcagggtgtatcaagtaaatttagcataaaatgtaaatttatcgaatccctggttattcccaaaaaacatttgaattttcattaaaaaattcagaaaaatcgtgatttgtttgccaattaaattttttgtcatattgggcgtaaaatgatttagaaaaattaaccacaaaaaagtaaccaaaatgcatttttttgcaaaaaaaatacccaatgggcttaaaaaccccaaatttattcaaaaaatgcaaaaaagattgacggattttttttttaaatttttttaa

SEQ ID NO: 58454 - DNA, 80 bp, Heterodera glycines
  Genomic contig location: Contig_ID=SeqID_27789; Location=715..794; Strand=-
  SCN-specific regions: Sequence locations=1-80
attttcagtcgctttgcaatttcccgagggcctcacaatgttcgcctgcgtaatcgtcgacattctcaagaagcactacc

SEQ ID NO: 58455 - DNA, 363 bp, Heterodera glycines
  Genomic contig location: Contig_ID=SeqID_5556; Location=800..1162; Strand=+
  SCN-specific regions: Sequence locations=1-38,63-72,245-363
atgggaaaagtgaaagtgagacaaacggaagaacggacaaaggaaacggaagaacggacaaaggaaacggaagaacggacaaaaggaaacggaagaacggacaaaggaaacggaagaacggacaaaggaaacggaagaacggacaaaaggaaacggaagaacggacaaaggaaacggaagaacggacaaaaggaaacggaagaacggacaaaggaaacggaagaacggacaaaaggaaacggaagaacggacaacaaactcacgtccatgtccaacgatcggatgttcaagtcgcgtcgagaaaggagcaaaatgttccaatggcaagaatggtttttgttggtcatcggagggtttgggtag

SEQ ID NO: 58456 - DNA, 2532 bp, Heterodera glycines
  Genomic contig location: Contig_ID=SeqID_5556; Location=1..2532; Strand=-
  SCN-specific regions: Sequence locations=1-334,356-704,726-1489,1662 -1791,1813-2205,2297-2532
  Gene Ontology: Mol. function=transporter activity; Cellular component= membrane; Biological process=vitamin B12 transport
atttttcagaactaaagcagaccgaacccgtgccaacagcagatggagaggcgacatctacccaagctgccgatagtgggccgtcgagcactgcctgtctgatcacttctgttcagccttcggtgcaacttcgtcccggctgatcgtttcccctccgcccggcaccgaagactctgccatttcctggcacttctccgcgcccaaccccaactcgtggattcgttttgtcctcagcgattttcaattgccccagtcggcatcttcgctttccgtttatcccatttggtgttccgttcgtcgcaattcaccggttttttcgtctttctttcgtccatcctttcctttctcttccccttcccaaagagtgacgaaatctgtcgcgactccgacgcgttggcatttcgttttgacgccgcttcgcctccccaacgtggcaaaatgtacactttgcgctctaatcgtgccactttggtgtttctcccgaatttatccgggaagttccgattgacttgggaggagatcggatgggtggaaggagaaaatgggacacggagagaagaaacggaggcaaaagggagcgaagcgccggaggggaaaggggcgacgagcggatttaaatgtgggggagagttagtgccaagatggacggcaaacacacttcgcaatccgacgaccaacatgggcatgtggtgagaaagcgatttggcacgaggggagggggaggacaattcgccgccggtgggactcgaacccacgacccttccaacccgtggaatgccctaccgaaaataccattacaataggtaccgtaacaacgaacgctgcaaatggacgctgagaagaccaatgttcgagacaattgtgatgaatgtgacggctattgagttggaacagcacccgaactgtcagtacgactttttgtcgttgagcattaagaatttggagacggaggacgaattgaggtcgaaaggggggggggtaattagcgaaaattagagatacaatataaactaattaataatcggatgaatcgaaagatgagagagaaataataacagagaaaaatgccaatttcaccacagagaactttctgacatctcccgaatatgcaagaaaaagcgaagtgcacagccaagtggaagtgaactcggcggagaacgcattcgtctatttctattcggacaggcaaatcaaaagaacagcaaaaagcgacccctccgccccttcccgccgaaattagtcccgaaattgccctttttaaggtcccgcttctaccgcggcttctccctcaactattcgttggtctgtggctccaccgaaatttggcccgtccaaaacggtcccatggactctgtgctcagttcgcccggctacccaaaccctccgatgaccaacaaaaaccattcttgccattggaacattttgctcctttctcgacgcgacttgaacatccgatcgttggacatggacgtgagtttgttgtccgttcttccgtttccttttgtccgttcttccgtttcctttgtccgttcttccgtttccttttgtccgttcttccgtttcctttgtccgttcttccgtttccttttgtccgttcttccgtttcctttgtccgttcttccgtttcctttgtccgttcttccgtttccttttgtccgttcttccgtttcctttgtccgttcttccgtttcctttgtccgttcttccgtttgtctcactttcacttttcccattttccgttggctccgcgcgattggcagtccaacgaatgttccaccgattcgcttgacttttcccacttccctttcttccgcgagtcagcaacggcaaaaacatcgaattcgttttgtggccaagagcagttcaatctgaccatcagcggtggttacgttttcattcgcttccgcagcactttttccaggggaagggtcagtcgaagagcaaagcctttccaatgctttttcccctgaagggattcaaattggcactcgtcgaaagtgtccacgattgtgcctcttccctcatccgattggatcagcttacgcccctaagattactttcttcgcccgaatttccccatttgtcgcccaattcactcgattgccaatggattttgagtgcaccgccaggcagacggctcaaatttaccgtggacccaaagacctttttgcttatgggcacccgagacgacgatggaaagtgcgcaaaagggagaaaagaaataatggaaggaaaaaggggaaaatgaagggatagagagagagagagagaggaaaggagcaacaagaaaaaggaacggattgaaagatgccattttttgaccatttcagttgtgcgggggactttttggaggttcgagacggtccctccgaagcttcgccgttggttggccgttactgcaaaaacgaagcaccgagtagcattttttcgacgggagagcatcttcacgttcgatacgtaacaggttaagcatggggaagagatggacacatgcaaattagcctgatcagtgatcattatttggccggtaat

SEQ ID NO: 58457 - DNA, 1335 bp, Heterodera glycines
  Genomic contig location: Contig_ID=SeqID_5558; Location=2039..3373; Strand=-
  SCN-specific regions: Sequence locations=1-680,702-722,775-797,836 -997,1019-1158,1180-1297,1323-1335
  Gene Ontology: Mol. function=metallopeptidase activity; Cellular component=extracellular; Biological process=skeletal development
atgtttaatcattcgccttcgatcaatcctcttgatcttttattcatctatttttcagcgtgtgagaaggatttaactgctctgaatgggacaatctctcctccgaactttcctaatccctccccgcgtccgttcaaatgcacttaccgaataattgccgggcctcggcaggccattcgcatcaattttgaccaaattggcatcagcaccgatttcaacacgtgcaattaccaccgcgagagacatgcgcaaatggaggattatgttgaagtgaaaaagggggggggatggcaaattaaagacggaatatttgcttttttattaaacttttttcagttttcgggcggtcacccgtccaacgaagtggccaacagacggtacgtttgtgcccgttatccgttcattgcgccggacggagaaatggtggtgagcagcggcatccgtcccttttccataacctacagtatgcctttggattttgtccctaccgtatcctctgctgatactttttcttccaattcaaaggcacaagtggagcagcctcaaacaaagggtttctgctcagttacgagttgatcaacatcggatgcggcggtgtcctctccatcggatcggacgaagtggcgggagaggcgccacagctgaccagccccaactacccggactcgtacatggcattcatgttttgtgtttactttctccaagtgccaacggtaaacaaaagagagagtgaaaagagagagatagagagaggagagagagagagggagagaggggggagggaaatagcaggcaatcagagccaaaacaaataaataattttagggaagggctgtccgactatcttttgacgtgttcgacgtggaaaatgttgcgcatagagacaactgcgaatttgacagtgtgacggtgtacgacgaattcttcgaggacgaacagaaccatggcaaagttttgggcaagtgagtgaaaggcaacaaaatttaagcatttccatgcttacactaattatctaatcattacatgcttaattacccccaaccataaatttcccaatttgccttccttagattttgtggcaagtctttgcccccgccgcttctttcttccggtgcccaaatggcacttgtctttctcagcgaccgttctctcagtggcgccggtttcgccgcccgcttccaagccgtcgatttggcctcccattgcgataggactttcactgcccccgaggcacagtttgacttcgatgccagtgaatttgctcaatcggacaattgcgtctaccgaattgtggtccttttttatttaaacatttattcatttgcacttttttga

SEQ ID NO: 58458 - DNA, 740 bp, Heterodera glycines
  Genomic contig location: Contig_ID=SeqID_27793; Location=139..878; Strand=+
  SCN-specific regions: Sequence locations=1-508,530-740
atgccgccaagtggaacagttcctgcaaaaggagaagccccacaaacatttgatccttgtgttgaacaaagtcgacttggtgccaaattgggttacggtaaatgcatttttcaaccggcacaaatttataatttattccaaataattcggtcacgctttattttgtaatttatagcaaaaccttaattacattgcagaagaaatggctccaaattctgtccaaggaaattccgaccatcgctttccacgcgtccattcagcatagtttcggcaaaggcgcattgatcaatttgctacgacaattttaccggctccaccgcaaggaacggcaacagatcagtgttgggatgatcggttatccgaacgtcggaaaatcctccgtcattaacacacttagggccaaaaaagtgagtgaagcgcaaagggtggtcattgttgggcaagggcgtagccaggggcccccgaaactcaaaaaagtaaaaattttcagcaaattttatgcaattgcatatttttgaaaaatggacctcaaaatggcaacaacaaaaaatagccatttggcgacaaacggttacaaattcctgtaaaatacccccccccctaattcgggatttctaaaaaagaaaaatacgcccttaaaatcgaattgttgagttcagtccccccccccccccctcgaagcaagaatctggctacgctcttgttgttgggtactaaaaaaacgccaaaaaaatttaaaa

SEQ ID NO: 58459 - DNA, 1213 bp, Heterodera glycines
  Genomic contig location: Contig_ID=SeqID_27797; Location=628..1840; Strand=+
  SCN-specific regions: Sequence locations=1-136,159-183,205-636,658 -710,732-733,764-1213
atggtcattctggattacattatgtgagcgatattgataatcattttcttttctaattttcaataatttaagacggaataccgaccgaggaaatgacaattggttgatttgttacacaccaccgacaacaaaagcaaaagaaggaaatggcaaacagagaagaagggttattgaaaagaaaagtttattccaatatttattttttctagtcatcaagcagcagtttgggcgagttgaagcgatcggacagtttgacccaattgaaggaggaattgggcaacgaaccggcaaaattcacggagcacggcaaaatcgtcgatatccatgagccggtcacttacagaagtgaaggtatcagtgcaaacaaactctttatcacttaattgtttgtttttaacccggtagggtccatcagcggtcgtttgtcctccaacagcagttgggaggacgtggaaatgccccaggtgaaagtcgccgccatcgacaacggactcgcctttccgtttaagcaccccgaccaatggagagcatgtgggtttggccgggcacctaccaaaagcacagactgacattgacaccccaattcagaccctttccaatgggcaaaactttcgatggcacagctcccgttcagtgaagaaactgtccacaaaatgttgccggttcttgaaaagagtgactttttgcgcgagttaggcaatgatttgcggaacatttttaaagtgggaaaatctaattaaaaaagaaataaaataaaaatttagacggataagggtttcgacaaaaagacgtttaacaagcagctcagtgtggtctatggccaaattttcaacctgcgcgaggcgttgagggaacggaagacgccggctcaattggttcaggtggggcttttggtgtgaggcgatatgttggaatttcttacaacgctcactagcagttgaaatgtgtctatattagtacggaataataactaatcacgtgtttcgaaaagttagtaacaataaaatgtctcataattttactccgaaaagttggcattgattttccaccttttgctttcagatgacgcccctgtacataatcgagatgaaaaagaatgtgttcaagcagaaagtgcacacgcgttccccgctcttttcatgctgttgactcagtgataggcctttattatcagacattttacgccatttaaaaagttgtaatattaaattta

SEQ ID NO: 58460 - DNA, 998 bp, Heterodera glycines
  Genomic contig location: Contig_ID=SeqID_27798; Location=303..1300; Strand=+
  SCN-specific regions: Sequence locations=1-93,115-169,191-453,485-998
atgttgagtattactcagcccattctctacacgtatttgtttccgcttaactcgcatacagaaacggcaaaagcggcggaaagtcgaattggcattccctttataattcgccacattaattcttatttggcggcaaaaaacaaagagccaacagccgatgccaaagtgaacaaagcatttgccagaaaagcgcaggaaattttcacagaagcgtacaaagggttggcgaaacacggcactttcttcggcggcgatggcatgggacggagtgtgtgcattttgatggcattcaaacggctaattgagggcattttaccattgtgtatgacggacaaaaattgcagcaatttggaacagctcaaaaagtggagtgccaacaaaaattgtgcaacggacgaatgcaaaatgaatgcattcaatgtaaaaaaagaaagaaagtgacacgaaaaacagaaaaatattaaaaattattaaataaattttacaaaggatttttagtaataaatgttgataatatttaatcttaggaacaaagaaactttatggcatctattcacttggaaatgttgaggctatacatcggagaacaaagtgaatttgctgaatttataagaaaaacgcctggcgcaaaaaatcggatgcgcaaattgttagtcaaagaggcgaattatgaagagttgatggaaagttattcagcgactgtgcaaaacgaagaaggtgcgaaaaatatatttatggttaaggttatatttttaggtttttacctcttttttcgtgagttccctcggtctgaaacgcacgaaaatttgttttttataaacaacttttcgagttattagcacctatttttaggtttttatttttagaaccgaaaccctaaaaaaattgaaaaacctatttgacatattttggcgttttgcccaaaattgtaacattttttgtaaaatattatctaatcatgaatttacaaaccaaaagggacctcccattgattttta

SEQ ID NO: 58461 - DNA, 331 bp, Heterodera glycines
  Genomic contig location: Contig_ID=SeqID_27799; Location=359..689; Strand=-
  SCN-specific regions: Sequence locations=1-331
atggatccaattatggggattgaacggatggtggttggacccctgcccctggatcacattcgttgtttaaaaaaatgggtgaaatgtatgattttttaagcgggggcaggggtctggacccccgccccggggccttatactactgtcaacaaacattttttggcactttacaattactaccctgataataatgtctaattatttcaggcccttgtcgattcaattgttatttctcccccaactgacagtctgcaaattttcaatagccctgacattcaagcgatgactcgaaaacaatagtacgtgaccagtaaaccaaaaaaataataaa

SEQ ID NO: 58462 - DNA, 291 bp, Heterodera glycines
  Genomic contig location: Contig_ID=SeqID_27800; Location=418..708; Strand=+
  SCN-specific regions: Sequence locations=1-72,94-291
atggtgaacggttttttaaaatggtgtttatacatcaattatcacaaagtaatttggtctatctgtggcctaatggttagtgtgtttagttctttcggagaggggtaaaaagttcggtcccgacactatgtgattggatttttaaatgaattattagttataaattaatgctcaacacgaatacgtatcagtggcctaatggttagtgtgtttggttctttctgagagggggtaaaaagttcgatcccgacaccatgtgattggattttgaaatgaattatttagtcagaa

SEQ ID NO: 58463 - DNA, 784 bp, Heterodera glycines
  Genomic contig location: Contig_ID=SeqID_27801; Location=217..1000; Strand=-
  SCN-specific regions: Sequence locations=1-193,251-463,485-507,541-784
catgtacttgtacgtgttcttacgttacttgctcagctcggctgtggggtttggtgtgctggcgcgactgtggggttctaattcgcgtttacggacgtaaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttggcctgctagcctccagactggggtttgctgtccttctgttcagtggcgaatggggcatttgcaggcggagtgcgctgagatgctcggagtagctgcgtgagctcggtcttgaggccagcctttcggggtctggtaccc

SEQ ID NO: 58464 - DNA, 1768 bp, Heterodera glycines
  Genomic contig location: Contig_ID=SeqID_5559; Location=1238..3005; Strand=-
  SCN-specific regions: Sequence locations=1-174,196-612,635-661,683 -720,743-842,864-1023,1046-1643,1665-1768
gccaattcattgtccgatgcttcttttccattgttttgtcgtggctttcgctttcgtttccttaagacaccttttccacattttctacctttttgttatggatgggtcttttaacaattggaaattacacggccaagtcattcattttcatcttaaaatctttgccgtcatggcaatgccatcggcggaagggaaaagggaggggggggggggaagggtgaagcaaacgaatgaaaagcgaagtgacgtcacttgcctcttctctcactttttgcctttttcccaaataatccctcccggcaaaaagggcactacgaccggcgaggaatccctcggaagaaacaaacggtcaaagagagtgagacgaataaagaaagacggaaagggagtcgagaaaacgaagaattgagagacatagataggacagacagaaggaagaagcataattagccaagggacggaggggggagaggggggattatggaaaaagggacggatcggtcggaatcggaattagtggagatgatgaagacgaagaagcaatggacggggaataattaatccacggaggaatttgagaagggcaatattgtttagtaaataatatttatcaaaaacaaaacgaaggaaagagagtcgctttgaaagtccgcttttgcaccgacagatcagtctctcttttgctgaccttttctgctccttgctcatcatcccgttcagcttgttcagttctttgaggcccggttggcacttcgccggagacaattccggtagaatgcgttttgctctttgccaaattgcattcccacagctctttgcaaatgcactgtgtatgtgcatgtcatgttgatctgctccacggtacctttcaataatgaccgattgtccgtccgttcgacaattcgtccgtccgtttgttaggtgtacatcttcgcttggatcagtgttgacagatactccgcctttatgaagccgagtcgttacgaagttgctcataccgccactcggtgcaaatgttggatcttcttctcctgggccacttctctgctcatcgcctgtccaattcttatcgccaaaatggaggtcgcatcgttcgataatcgtcactttcccggcacttcgctttagtccaaatactcgccgcagttggagctttgtctgctcaattggacctccacaatggcatattccgttacgcttgccgtgctcgtcctggtcccttctctgtgcacaatggcattcacttccgctgccattattgcagctgtaaataaaccggacgaggttccccggtgtgccaagtttcagctatctgtcccactcattcagttggaagacttgcaacgaacaattctcgacaccgacccaaacttcgtcatttgtgtgtcccaattggcccatggctttaccctccccctccctttagctctgttcatcttcgtctctttcctactctcatggcttccgatcattgtgtttcagttgttgcccaattcgctggtgggccaatcggacctttccatgatgcaatttgtaagtgtcacaattcccaagtgtcgtccgcctttgtctctgctaatgccccttttccataggcattttcttggctggcaattggcggcggttcttccaaattgctcatttacaggcacttttctcccataattcgctattacctttccacttcagcttcaccagtactgagttccggaggttcctctgctgtttttcgtgctgcttgccccaaatatcttccaattcatttcca

SEQ ID NO: 58465 - DNA, 473 bp, Heterodera glycines
  Genomic contig location: Contig_ID=SeqID_5560; Location=324..796; Strand=+
  SCN-specific regions: Sequence locations=1-210,232-473
atgaaaggaaaagagaaaggaacgaagggagaaaaggaaagagaaatgtaagtaattggtgagtgattttcaaattcaaaattcgaaacaacaacttcgaaaaactgactaacataacaagctgcagaaaataggaataaaagtggaagactccgttagctttgtagctaaaattaaatagcgacgaagaaaatggaaatgaagccgtcactggtggaagcatgaaaattggccaggaaggagcgagggagcaaaagatagtcctttcaaagcattggcacaatcaaataggagccaaaagcaaaagcttaaaacgggagaaaggaaaggaatgccgaagcgagaaagaaaaaggcaaaggaagtcctttcagatagaattaatttgaaaattgggggggggggggggaaaggacgcaaaatgaatccgtccatttgtttattggcgaaatcggcaaataattactacatgta

SEQ ID NO: 58466 - DNA, 211 bp, Heterodera glycines
  Genomic contig location: Contig_ID=SeqID_5560; Location=749..959; Strand=-
  SCN-specific regions: Sequence locations=1-35,67-86,108-211
actttggcatacgaggaagctatggaggacgttgaattgttggaggaggaggaggaaggggtggaggcaaattcatgcggcgaaatggaaactgagggcggcaacggcacgtgaaagcactgcggccccccccccccttattgtgattattcattatctttattacatgtagtaattatttgccgatttcgccaataaacaaatggacgga

SEQ ID NO: 58467 - DNA, 1490 bp, Heterodera glycines
  Genomic contig location: Contig_ID=SeqID_5561; Location=885..2374; Strand=-
  SCN-specific regions: Sequence locations=1-24,46-466,488-1003,1026 -1490
  Gene Ontology: Mol. function=ubiquitin-specific protease activity
atgttcgcgacccgtttcaacggatttgcccagcaggattcacacgaatttattgcatttcttttggatggccttcacgaggacttaaatcggcggattaatcacagacaaatttctaacaataggatggatgaaactgaaaaaagggaggacaacgaggaagagggacaatgtgccgaagatgggaaaagtgaagagcaaaatgccatcgaagaaaagcgaaggaaagagccgaaagtgtcggaggaagcggacacttcgaagcaggtgaatagtgcaattcaactattgttgctgaactcgttttgatatgttcagtcaatttacagcagacagcggaggaggcgtgggaggagtacaaaagagtgaacgatagcattgtgaccgatctgctgcatggacagctgaagtcgtcattaacttgcaatggtagccgaacctccttttgttgttgttcagagacccgaactttgaaaggctttcatttcgaatattgaacgaaaatccgaaattcgcctctgacttaacaaaattttgaaattaatgagtgaaatggtgctcttttttatgacgaaagaaacgattcttcggtttcagtttgtggcaaagtgagtgtcaaattcgaccccttctgcttcctctccgtgccgattccgcctcgtcccctaaaggaatcctcctcaattatgccgatgccaacgaatggtcaaattttgaaaactgcagtaaaaagccgtaaaagctctgacaatttgatgcaattgactgcgagagaggaggaagtgagtacatttctgtccattgactggcggaaaataaatttgtccatttcagaggcatcgaaacgcagttgaaaatcttacgcttacacagcgaagccttcggtccaattattacggattggaatatttattggcatgtttacactgtgctttgctcatttctctgagtgtcatgcttcccttccagtggtttctgataattgccagagagtggctgattcgtccatggaccggctgggccactgaactttatcgccactttttttcgggtcccatttctctggagcaatgtttgggcagttttttctcggtcgattatttgcacggcgatgacatgtacaaatgcgaacagtgcaaaaggtgaggtgggcaggaagcgctttctcgtcacttgctcgcttattcagacttcgaaatgggactaaactctgttcgctgactcgccttccccaagtgttggtcatccatttaaagcgtttccgcaacgaagggatgtacaacgtcaaattgggctccaaagtcgcatttcccctcaccaacttggacttgcgtccatttatacactccgaggcacaatttgacccacccgaatgcccaaacccaaccaaatacgacctttgcgggttaatcactcacaagggacaaaacttggaatgtaagtttactctaaataagatggactatgaaacgatgactgaattcctatga

SEQ ID NO: 58468 - DNA, 469 bp, Heterodera glycines
  Genomic contig location: Contig_ID=SeqID_27802; Location=146..614; Strand=-
  SCN-specific regions: Sequence locations=1-242,264-469
atggaaaacagtcgtcggtatatgacacgacaggagttgcgtcgtctgttagacaatggagttgcagtcgaaattgaggacaacgagataaacgtcgcacatcagcaaggattgcggacgaattggacggattatgcggcggagaacttcgaagcgtcgcggaattttcaaccggccgccgtttttctggaaaatcatcagcgcgaaatagcttttagctcacttcgggtcccaattcgaacttcaagtcccaataatcagaaccgggaccccgttgcaccaccggctcagaattttgttctccaaaacatgctccctcgccgtttagacaacgacactctttcattggcgggcgaagaagtggagttggaccagcacaacgagaacgaactgcttggacttccgttggatggccgtggccggactgattcaatgttggaacaccaagtgtccgccattcacccaagag

SEQ ID NO: 58469 - DNA, 456 bp, Heterodera glycines
  Genomic contig location: Contig_ID=SeqID_27803; Location=774..1229; Strand=+
  SCN-specific regions: Sequence locations=1-208,255-456
atggctttatactgccatcctttttttgtggaagttcattcgtttaattcaaaaaaaaagtggtgtaaaatgcagcgtccaacggtttgtatttactccgtttgaattgcttgtggcaaaaaatacaatagacagtggaccaaaccaaatggttggttctggtcggcagcattcggcgaaggtgaaaggatacgagcatactgatttgttataattatttaaattattcatattttaaataacatttattttaaggtgatatctcaatttaataaattcatttgaaagtctatgcaaaccgagatgattgtggatgaaaaacttcaaaattttagtaaagcaaaaagtcatgatccattttttatgaacaaaaagcatggccaattttatgtctactttctttagtttttttttgagattttaaattgattaagtgaaatagtgatatacaaaaga

SEQ ID NO: 58470 - DNA, 48 bp, Heterodera glycines
  Genomic contig location: Contig_ID=SeqID_27804; Location=395..442; Strand=+
  SCN-specific regions: Sequence locations=1-48
gccaggacgttttcgcgtggccattttcgcgtggccgttttcgcgtgg

SEQ ID NO: 58471 - DNA, 138 bp, Heterodera glycines
  Genomic contig location: Contig_ID=SeqID_27805; Location=82..219; Strand=+
  SCN-specific regions: Sequence locations=1-138
caaaaaaactcagtgtgggcgatccacaaaaaactcagtgtgggcgatccacaaaaaatctcagtgtgggcgatccacaaaaaatctcagggtgggcgatccacaaaaaatctcagtgtgggcgatccacaaaaaatc

SEQ ID NO: 58472 - DNA, 1556 bp, Heterodera glycines
  Genomic contig location: Contig_ID=SeqID_27807; Location=68..1623; Strand=-
  SCN-specific regions: Sequence locations=1-883,905-917,940-1059,1090 -1556
  Gene Ontology: Mol. function=microtubule binding; Cellular component =microtubule associated complex; Biological process=microtubule cytoskeleton organization and biogenesis
atgcccaaaagtgccgaagaaagcccgctgaaaagtgccgaagaaatgacgaaaagtattgacgccgaagaaatgcggaaaagtgctgaagaaacgcagaaaaatgccgaagaaatgccgaaaagcgaaggagatatgcggaaaagtgctgaagaaacgcagaaaaatgccgaagaaatgcggaaaagtgctgaagaaacgcagaaaaatgccgaagaaatgccgaaaagcgaaggagatatgcggaaaagtgccgaagaaagcccgctgaaaagtaccggagaactcccgctcagcttcagcgaaatgccgaaaggctctttgcaaaaaatgaaatctttacccaaagacatgtcagcaagcattggagaaatgccaaaggatgttttgcagaaaatgcggtcactgcccgtcaacatgccagggaacattgaagaaatgccaaaacatgcattgccaaaagtgccatcaataaacgctctgccaccacacgacgaagaaatgcggaaaagtgccgaagaagtcgaagaaagcccactaaaaagtaccgaagaaagcccgctaaaaagtaccgaagaaatgcggaaaagtgccgaagaagtcgaagaaagcccactaaaaagtaccgaagaaagcccactaaaaagtaccgaagaaagcccgctaaaaagtaccgaagaaacgccgaaaagtgccgaagaaatgccgaaaagtgccggaaaactcccgcccaacttcagcgaaatgccgaatggctccttgcaaaaagtgaaatctttgcccaaagacatgcccgcaaacactgacgaagtgccaaaggatgttttgcagaaaatgcggtcactgccccttaacatgcatggacacgctgacgaaatgccaaaaataccaccaataaatgcagtgccagcaagcgttgaaaaaatatttaatgaagaacaggaaaaattgtcagcaaagccagaaattacggcaaaaaatgataaaacagtccaagaaagccgggaagagcccggccaaaagaatgaaaaccaagaaaatgaggtaaaaagtaaaaacaaattaaattttaattaattttcatattaagctaaatgcaaatgatcgggataaaattcaaagcccgaattttttaacgccaaattcaacgtttcgcgatgtttcggactcaatggacgatgaatttttcagtgcagagacagaattaaggcgaatgtcacgggaatcatcggaaaatatggcaaaaatgcttaaaaagaacagcctaggggatgataatgccaaagaaatttctatggaaagaacagaaaacactgaagaaattccacaggatacaccgacaaaattgccctcactgaatgcgataccatcgatagctgaagaaatgccgaaaactgacgatgcaatgcaaaaaagtgccgaggaaacccaatccgatataagtgagggcgtattgccaaaagtgccatcaatcaacactctgccatcaaaagacgaagaaatgcccaaaagtgccgaagaaagcccgctgaaaagtgccgaagaaatgacgaaaa

SEQ ID NO: 58473 - DNA, 692 bp, Heterodera glycines
  Genomic contig location: Contig_ID=SeqID_27808; Location=196..887; Strand=+
  SCN-specific regions: Sequence locations=1-140,162-412,434-500,522 -556,578-609,631-692
atgtcaatttcgaacaattcaataaatgatggagatgatttgacgccagcagaaaatgagggtaaatgtttagaaaagggaaaattgtagaaaaattgaaaaattgaaatttagaatgtgaaattaaataaataaaattcaacatttaattactgtatttattgaattagagcccccaggggctctattgttcagccccctcaaaaaggggccttgattttaggagggctctaactcagagggtggctataattcagggggggggggctctaattcagtaaattcggtttaatattttcagaagtgaatggcgatgcaattagtttggacaacgatggtcaattcgatgggaaaaacagcaaattgtcactgatcgacaacagcttaaggtgaggggaaggaaaagttgaaacaatttggagaaatatttgaatttaatggaacaaaagtacttttgttgtaatttaaattcaggaatttcgtgaaaagattgccaaaatggaaatggaattgaaaatggccaaattggaactcgaaaatgtgagagttttgccataaaatttggaaaaagaacaaaagttaaaacagcagcaggaactgatgggcgaacagaaggaatttgaggaaaaaactgaattggagaaacagcaacacgaaactacgaccaaaggcgaggaagttttaagcgaata

SEQ ID NO: 58474 - DNA, 84 bp, Heterodera glycines
  Genomic contig location: Contig_ID=SeqID_27809; Location=12..95; Strand=-
  SCN-specific regions: Sequence locations=1-84
atgtgctgcgttggtagcattttatgtgttttgaaaggctgcggacaatccgtcagagggctatctgtcagtaatggacaatcg

SEQ ID NO: 58475 - DNA, 1029 bp, Heterodera glycines
  Genomic contig location: Contig_ID=SeqID_5564; Location=109..1137; Strand=+
  SCN-specific regions: Sequence locations=63-63,183-303,458-528,710 -753,778-778,862-905,951-951
  Gene Ontology: Mol. function=transporter activity; Cellular component= membrane; Biological process=embryogenesis and morphogenesis
cttctgatagagctttgcaaggcgctagtttatcagactgtcgtgaggcactaataaatgccgttgtcgatccgaccgtctgttatcagcgatcacatggtcaagttggttccatgttgcgcatgcctcctgaaggtggtcttcaatacatgcccatttacatacttggattgttaaaaaatgtaagtaaaacttataataattcttttattggtttaatttatgtccaaaagaaatccttaaccaatactcccgttaattattgttgcttgttatttttatatagtaatgatcgaatttcagagggcgttttcggattctctgcaaagggtcaccatcgatgaacgtgtggcaacttttctgcttttcaaaaatgctccgttggaagttctcttacttgagttgtgcccagctctttacgcttttcaccaaattctttactgcgaaccgaatcaggttgccggacaagcattttacccaatatagcaactgctaatcaattattgttaacgactgaaaatgattttctcaggatggacaggtcccttttcccgaccgtcttcctcctacttatgagcatatctcccaaaatggcatttatttgctcgacattggcacatttgtctatgtgtacgttggctctgccttaaatgtctgtattttgcgttctctttttggcaccgattcgttcgctaaattggattcggatgtaagtgaatgttcgactcttttgctatgactgtttcttttgagtcaacagtaattgaaattgacacttcgcaaagcaaacatttgcatgcctttcttcgccatttacaagaacagagagggaatatgtatgctccagctaaaattataaagtaagcgccttccgaaggaatagacgcgattcgaatttaatttagggatgacagtccaaggcgggaggcatttacgcgacggctcatccaggatcggtcggattcttcacattcttacaacgaatttatgcaattcctccaacgagaagtcagcaaagccagtaaatga

SEQ ID NO: 58476 - DNA, 1891 bp, Heterodera glycines
  Genomic contig location: Contig_ID=SeqID_5564; Location=1246..3136; Strand=-
  SCN-specific regions: Sequence locations=1-28,111-206,578-636,684 -728,759-759,819-819,949-993,1177-1224,1309-1353,1633-1633,1669-1891
  Gene Ontology: Mol. function=nucleoside diphosphatase activity; Cellular component=integral to Golgi membrane; Biological process =UDP catabolism
atgctgggacgcttcacgaaatcggtggacaaatccaaatcggagtcactcgaagagcgatcacaaccagcactttctgttgagaaaaaggagcgaccgaaaacagcaggtaactaagaaatgcaaaataagtgacaatttggggggtaatttggaaaaggccaaatgattggttaattgcccaattttggttagtccgccctttgaggaatgattgacatgggtggcgcttctgctcaaattgcctatgaacttccattgggccattccgatgctgcaacgggtgggcaagagaatgttcagctgctaaacctcggctgtcgtgacgacgaatcgcgtttccgtttccgattgttcgtcaccacttttcttggcttcggagtcaatgaaggagcaaaagcatacgaaaagtttttgtggaagcggttgaacaacaaaagacaagcggcaaattcgaccgaaacggacaatggaaaagacggcgcgaaagtgccgactgtcgttgacggatgtttgcctgtgaatatgctgaaattgagccatgccgaggagaattacgaccaattcgtacgaaaggttgcgtggttcaacgggggggggagtgaaaaaaatgccaaaacatttgttggcactttcagggaaatggcgactgggattcatgtgtcagcgacatcgtttcgctggttgaatttgtcaatccctaaccaacccctacgacttatcgtttagctgttcgagtccaactccaaatgttctccagccaaagaatgctttttcaacggagttcacgcccctccccaattgtccctttccgacgttgaattgtacgggttcagcgagtattggttcagcgtcgacgacgttctttcactgggcggcaaatacgaacacgacaaattcgaacaaaaggctaaggaattttgcgggcagccgtgggcagtgataaaagtgagtcactttaaccaaattcagtgagttgttcccaaattaaaatttgccattttgagaggaaagtcaaagcgcacttctaccaaaaggcggactcggagagattggagacgcaatgctttaagtcggcgtggatccacgccgtgttgcacaacggtttccacgtcgacgaaatccaacatcactttcaaagtgcatttcgaataaatggccaagaagtccaatgggtgctgatcatttaaatggttgcggtttatctattccaatttgaattaaggcgcttggtgcgattatttaccagatgcgatatttcccattgtttgctgaaagcaaagggattattcagccaaagcaaaaaaggtgtcctcagattataggtacgaattcttttacccatcgattttcagccgaattcgcccgcttttctccgcgggtccctccgttttctattttctttgtgttttgtctttggccgcgctactcattcgtattttatggaaatcaaagccagaggcaaatttcggtagcaaaaaggagagacaacggcaaaaattgttaaatattggcgactcgacgaggaactatcaaacagcccttgagaatttatattaagaaatgaattattgtcacacctcacttatttattaatacattgtatgtcatttaagttttgtcttatgtttgttttaatttttatattgtaaaatattgggactctaatgcaatttgcgcagcaaagctggcaactctcattgtcagtttcttacgcccaatgatatcagtagaaaggtgtgttctggtcggttttacgaaattttgtaacggttaaataccatggacacgtcatgggacgcgtaaaaccgactagaaccgaaaattgggccattagcggtccgaaacataagcgggtctctcagggacttgtttctggcaggataataaa

SEQ ID NO: 58477 - DNA, 670 bp, Heterodera glycines
  Genomic contig location: Contig_ID=SeqID_27812; Location=793..1462; Strand=+
  SCN-specific regions: Sequence locations=1-379,409-632,657-670
atggtattcaaccggcgaattgcactcccggcacaccgtgccattggcttctgtaaacatctgagtaagggcaccgatcagtttggacttaaaggcaacagcgaaaaacagctggacgaaatgcccaaaattcgaggaataattttgggacttcgtgaagagttcaacacttttgtcatcgaaattatgttgacaagaattgaaaatgaaaagggtgccaatgaaaatgggacgaataaatcgttggaaaaaatgaacgaaattctgaaatttttggaagagaaaaatggcagcgcattttgtgatcagtcaatcatcgaaagtgcgaaacgaaattcgacaatcggaggcgaaaaacataatacatttttgatcgaataattttaaaaataactgatttgaaagcagtttcgcaaaatgtctgatttttgccccaaaaatgtgttctgattttgaaaaattgtcgatccgagccctggttttacacgacttttaaaatttaatttttttcgaaaatggggggaaaaggtaaaaaaattcagggggatgacaaaaaggataaatgttgacacgttaataggggacgaatgcttaaacgacagaaaacttcatgccatccaaatgtctacgtcaaacagagagaaagagggagaggatcaaatttcagtta

SEQ ID NO: 58478 - DNA, 402 bp, Heterodera glycines
  Genomic contig location: Contig_ID=SeqID_27812; Location=1498..1899; Strand=-
  SCN-specific regions: Sequence locations=1-402
atgagcgcctacatgggatccggccccgccgagcctgcaccgtcgtccggcgccgcggaaacctctccatcgtcaggagtcgcgagcgcctacatgggagcctcgcccgcgcacgagccaccagcggttggtttaagggggacacgagagcaaaagcatcactaatcttttgtttttgcagcatgagaagtcccggaacagagcgcctacatgtgagaagatgcaacaacgaccggcggatggatggacgaaacctgaagagcgagcgacctgtcagaagatgcaaagataaagaagatgtctcataatcgtgatctgtatttattgatgtattgtacatttgtatgcatatatcatttgctgtgtattatcactttaattccatctgtgttccgaaataaa

SEQ ID NO: 58479 - DNA, 176 bp, Heterodera glycines
  Genomic contig location: Contig_ID=SeqID_27813; Location=261..436; Strand=-
  SCN-specific regions: Sequence locations=1-34,56-176
aaacatcgattgataatgatatgatccgttttgcatttattttatcactacaaaatgattctccttcttcttcaagaattgataaagcagctaattgtaagcaccatacagatgaaaatgatgaaaagttggaggaacttttgttgatattgaatgacaacaccataaagcgagat

SEQ ID NO: 58480 - DNA, 1076 bp, Heterodera glycines
  Genomic contig location: Contig_ID=SeqID_27815; Location=13..1088; Strand=-
  SCN-specific regions: Sequence locations=1-448,470-494,594-771,795 -880,903-1076
  Gene Ontology: Mol. function=structural constituent of muscle; Cellular component=striated muscle thick filament; Biological process=striated muscle contraction
atggcttccgacattcaaatgatgcacttgaaaagagcatttgattggtatgaagagatgaagtcacagttggaaataatccgcttcaaaaaggtacaaaacttgcttagaactgatggattagctcgcaaatgaaagcaatggtaaaacattgcataccgtacgacatatgacaacgttgtataccgtacgcacaacattgactttggctactgtaaccctctaattaattcaaattcatttttatagaaaatttgaaaattttggataaattaatttctcttcggtttcagcaagcgcttgagaatgagtcggtggaagtgaattcgcgtcttgccaacgaagagtcgcgtgcgattgaattgcaaaaggagcggaaacgcaccgaagcggagtgcgagtcgttgcggaaaaacatcaccgacatggacgttggcatgcgcaaattggaggcggagaagcaggccaaggacaaccaggtaacggaaaagagcaattaattaattaattagcaataattagacaaacgaattgaaaattaattaatcaattggcgataattagcaatctaatcgaccattaactaatgaattggcaaaattagcaaacgaattgacaattttttaagttacggacactggccgatgaactgcacaagcaggaactgaccgagtccaaactggccaaggagcgcaaacagcagcaggaacttgcagccaaactgcagaacgacttgcaaatggaggcggagcgaaacgcggcggagaaagcgcaccgacagaaactgcaacaaactttggaggtggccaaagtttcaaattctttcaacggcacgccgtgccttaatttcaataaaacaaattgtcaaaaagtacagatatattattttcttttgttttaaagtcggttgaaaatgaaatggaccgcgagcgtcgtgcacgtgccgagcaggagaaagcgcgccgcaagttcgagggcgaagtgcgcattgcacgcgagaatttggacgagatgggcaagcagcggcaggacatggagacgagtctgaagcgcaaggaggccgaccttttcgcact

SEQ ID NO: 58481 - DNA, 330 bp, Heterodera glycines
  Genomic contig location: Contig_ID=SeqID_27817; Location=509..838; Strand=-
  SCN-specific regions: Sequence locations=1-262,285-330
ccaggactcaaatgtcccgctgaggccaaaaattttttctatttctggaaaaaaatcgaaaattttccaaaaaaattaccaatcgatagagctcaaaaaactatgttttggaagtggtcttcgtttttctgggaaaattcgttaaaaaatcctaaaattcaaaaacccgaaaaccgttttttaggcctagctcgaaaaattttgaaaattttcgaaattttaaaatttggaaaaatcgggcttttaaagctctacaataagtctgctggccaccctgcgctcaggtcaaagcctaatgagttattagcctggtactgaagtgggaaaaaa

SEQ ID NO: 58482 - DNA, 243 bp, Heterodera glycines
  Genomic contig location: Contig_ID=SeqID_27819; Location=299..541; Strand=+
  SCN-specific regions: Sequence locations=1-243
actctccctcctctctctgttctctgtttcgtatgtttcgttcattttttggcaacttttcggtgggccacgcagccccgaggacatttgcgactgggagcgcctgtggggcttcttccactgtctttgggtttgggtccgtctgacgctgttggccatcggatgggcttggattgctatgcaatatttcatcggcgccctctgttgtcgcgtcgcgttgaatttcgtcaaaaatcgctaccg

SEQ ID NO: 58483 - DNA, 1184 bp, Heterodera glycines
  Genomic contig location: Contig_ID=SeqID_27820; Location=388..1571; Strand=-
  SCN-specific regions: Sequence locations=1-323,464-671,693-755,777 -795,817-1047,1069-1184
  Gene Ontology: Mol. function=microtubule binding; Cellular component =spectrosome; Biological process=neuromuscular synaptic transmission
atggcacgcgaagaacagcccgtctcattggagcaggcggagaatgtgctgaagcggcaccaggacttcatgacgacgatggatgccaacgacgagaaaatgcgcgcggtggtgcaaatgggcgaccagttgtgcgcggacggacattacgcagcggacaaagtgcacaaaaaggcgcgaaacattgaggagagacgagcagccaaccgcgagaaggcgcaggcgatgctggacaaactccgcgaggcggtccaagtccagcagttcctcagcgactgcgaggagttacgcgagtggataggtgagaacgaattggggagcaaagggggagagacgggcggggggggaagcggagagggtgcggcggggtgaacatgaaggatgaagcgggggggagagcgagtgggggaagcgatggagggggcgcgagtggggaagaagcggagagggacgcggggtaggaaaatggaacgtcgagacgagtgcggtaatgcaagaaattgcgtggcgggtgacactttcctgaaaattattcaaattaagaggagaaaatgatccgggctcaggacgagacgtacagagacgcgaagacgatctcttcgaagttcatgcgtcaccaagcattccaagcggaattggcggccaacaaacggcgcctcgaagaggcaaagccaaaagcccccgggggagggaggataaaagtgccaattcccacggtttgttgttcagattcaccacgcggcggaacaactcgcggaggaaaagcccgaattccacgagatgatcgacccggaagtgctgcaactgtcgcagcagtgggaacaattggaacggacgacggaggaaaagggacagcgattgttcgacaccaaccgacaacagctctatgtgcaatccatcggagaagttggcacgaagtgccgtgcacatcaaaccattggcattttgtgacaggtcaaagactgggcccagcaaatcgagcgacagatcggcgagccgccctcggagccgcaagatttgaccaccgtcgacttggccatgcaacggcagcaacagttggagcaggaagtgagagggagggcattggcacgacgaaatgccaaaagaatggcactcaacggaattgtttttcagatggtacgcaaagtgatgcacttggagtcgttgcaggacatggagcctaa

SEQ ID NO: 58484 - DNA, 423 bp, Heterodera glycines
  Genomic contig location: Contig_ID=SeqID_27821; Location=719..1141; Strand=+
  SCN-specific regions: Sequence locations=1-86,108-155,181-215,246 -284,306-364,386-423
atgattatttcaaagttattgcttttgttattgagtgaagttttttatttgattccgctgggctcatctgatcgctctgacaaaacaaaacaaatgcatattgatcacccaaacaaatcggaatcaatgggctcatctgatcactctgacagaacaaaacaaatgcatattgatcatccaaacaaatccgtatctatgaattcatctgatcactctgataaattaaaacaaatgcatattgatcatccgaataaaaccgaatcaatggactcatctgatcactctgataaattaaaacaaatgcatcttgatcacccaaacaaatccgaatcaatgggctcatctgatcactctgacagaacacaaaacaaatgcatattgatcaccaaacaaatccgatcaatgggctctctgatactctga

SEQ ID NO: 58485 - DNA, 8672 bp, Heterodera glycines
  Genomic contig location: Contig_ID=SeqID_59; Location=1981..10652; Strand=-
  SCN-specific regions: Sequence locations=1-8,30-84,107-339,364 -518,540-773,802-861,884-1672,1711-2006,2029-2610,2632-2758,2780 -3624,3647-3968,3990-3999,4030-4177,4199-4415,4438-4755,4780 -5246,5270-6283,6306-6306,...
  SCN-specific regions: Sequence locations=...6328-6563,6600-6631,6658 -6660,6683-6771,6793-7102,7124-7257,7279-7355,7378-7554,7600 -7721,7744-7773,7796-8471,8523-8672
  Gene Ontology: Mol. function=structural molecule activity; Cellular component=spindle microtubule; Biological process=nuclear organization and biogenesis
atgccacatgtccacatctgcctgattctggactgggaggcaatgcgcgtcggaggcagaatacgaactcccgaggactacatcggcgagtacatctgtgctgaaattccaccaaagccagatgaaaatgcacgggatgagcatctccaacggcatctttacaccaccgtgacaacaaaaaacatccacacctgtgctgaacatcgttgtctggtggatggaaaatgcgtcaaaaaatttcctgtaaattactttgaaaacaattttaataaaagtaatgaaaaatagaagccgtatgagtacgacaacgtctactcggagaatgcttacccgcgctaccgtcgtcgtcctcctcctccgagtggcgaagaagctcaacaaaatcctgaacaatttggccgagtgttcgagtacaaggaccgctacggaaagctgatcaaaaaggataacgcacatgtcgtcgcctacaacccatttttgtcttccaaatacaaaactcagtatgctagaatattttatggacaaaattttaaaaaatattcagcatcaatgtcgagttcgtagctggtgatgggtgcgtcaagtacttgtgcaagtacgtgatgaagggagccgacatggcgttcatcaagatcagcggtcaagaagggacgctcgcctatgatgagtatcaccagttgcgactggctcgctacatcacatcgatggaagcggtcatgtcaatgtggggtactccgcttgtgaaacgctcacatattgtaagtaaaaatcacaaaaatattttaaaaaataaaaaataaaggtcgatgaactggacgtccatggcccggaaggtcaccgaattgcggttgatcaagcctttgatgatgaagaagaaagagcaggtgcacttgtcgaagctgccgaaaaggaggaagagaggcgcaaaactggtgaagagcgaaacacccagctcaccgcatactttgccttcaacaaacaacgctccagcacggatggcccactacacctaacttacgccacagcctacaaaaaactgcgttacgacaagaaaaatcgtcgttggcagccatacgtgattggagcgttggagggactaaagctgtgccgactgaagacagtgtctcctacaaacatggaccttttggtaaaaataacaattaatttagaaatctaatgaacttatctaggcaatccgccttcttttgcttgtcgtcgaggacccaacagggtgggaagatctgcgcagacacaatggcaccgttcatcggacctttgttgaagcagcacaagcccggggactgctcaacgacaacgagctgtggatgcgcaccattcgggaggctttcgcaaccaaaaaaagaccgaaacagtgcataagatggttagccgtcttcttcgccacggcaaacttgtccaaaccaatggacctgttcgactacgtgatggagatctccaacacctggctaaccgtttggtcgcttaacaacgctacaccagaggcaaaacgacaatacgtgctccgcgcgttggaatggtttctgctggccaatggtgtgcatccagactccgacaaaagggaagacggaaccttccaaacagcatgtgaaaaaattgggcttccaagaccagacggagttcaactgacaaaggatgattacatacaggtagcaattttaacaaaataaaaaaaataaaagaatttaaatacaatagttggtgttcttccgggacgacttggtcaacgcaagactacccgaggaaatgcgcgccgacaacgccaacacctcaatgcggaagcgctacgccgacatctacacagcagatccgaagccaaacaacgaacaacaaatgttggtggacgctgtgtttgatggtgtaaaggcagcaaacgaactgcgaaagggagactttgacgacaaagacctgaacatgcctcgactgttcatggtcactggcgaaggcggtgccggaaaaaccttcacttataatgttaggcattattgaaaataaaaagcattattctctaatttttagaagatcattgccaaagtgaaggcggccgggttcaactttttgccaatggcaacaacaggcattgcggcggaactcctgtacgaagggcaaacggttcacaagcgactttgccgacaacgacacattgacgcgtcaacatcactgaacgttgaccttgagagcaatttcgctgaaatgcttcgcaagattgacggcatgcttatcgatgagatcagcatgcagaaccgtgacgtcctggagtatgttgatcgcctgctgcgctttgttgttccgactgaccttttgaaaagtctgccgtttggcggaaaggtgatggacagctaaggaaaaacaattttttaataaattgttcaggcagtcgtaattggtggagattggaagcagctgactcccgttgtgcctggtggtggccaccttgaccagtacaatgcgtctgtgaagaactctgctctcttcaagcactttacaacgcaccgtctggtcaccaaccaccgactccagtccggccaacaacaataccgtgacttcctgaggcgagtcggcaccggtgtcatcaacgacatccaacaacgagtcaagctgcccaagcagattgttgaacccgaccgtgacgccctcctgcagttcgtcttcccgcaagagttgctggataagccaattgagaactggcaaaaattgtcggagcgcgcaattctctgcccactgaacaaggaaacgtttgagttgaacaacaaaattatggtaaaatacttttcatggaaaaataaagtgctaattaaattttaaattaggacatgatgaacgctggtaacaataatgacaacatcgatcgcatctacaccgcgataaccgtgccaattgttgatgatgtcgatgctcttcagctcgaaaacatcgcagccaacatcaaccaggaaaatttaatacgccaaacaccacctggcattccgcaacatcaactgcgcgtcaaagtcggagccgtcatgatggtcaccaacaacatctcggtcgaagagggtctctgcaacggaactcgcgtgcaagtgctgaaactctacgaaaacatcatccgttgcaaaatcctcaccggcacgcaccgtggagatgagcacgacctgcacaaggcgcggttccaatttggcggtgacccgaaggctctgcatgaaggtcctatacgatgtgagcgcatccaatttccgctccgacctggcagtgttatgaccatcaacaagtcccagggtaaatttcttttttttggttttttaactttcgtgatctaataatttaaggacaaacactgtcacatgtcggagttcttctggacaagtcacagtgcttctcccacggacagctctacactgccttgtcccgagttcgggaggataccaacatccgagtctgcacaaaaaacaccggcagacgggtcaaaaacatcgtcatgctcgagcttctggacaaagaagaccttgacaccgccacaatgggtcctccggacgacccgaatgacccagtaaaaattgatacaatcaattattttaataactctttggttaagtacccacgaggccctccaccagaccacgactctgacgacgacgatgacgacggaaaaggaccaccaaagccaccaacatcggcatttaggacaccaacaacacgctcacgacgaccatcttcgcctgacgaaccactcgctgatgatatcaccctggacaatcttcgcaaaataaagattgtcatgggtgatatcacgaagcagcgtgccgacatgcttgtcagcgacaagcgaggcaacacggacaacgccatcctccgtgcatgtgagccaaattctgaaggtctacaacaacaactgaagaccattcgacaaaccattcaaggccgagttcctgatggttacgtcgcagtcacaccaacatatggcaatttgactgaaaaagcaaaatgtgagcagaaaaagcgaaatttaatttaaaaatttaaaaatttaaagttattgctcacgtggccactccaaattgcaaaggacgggaccacactgctgatgacattcaaagtttgaagcagtgctacaccaaatctctgcaggagctgatcaatgagctgaaaaagaatggagaacagcaaacgcagataattgtaaaaaaataatatttaaaaagctgattttattgattaaaataggcttttccaccacttggaactggcgagcgcggcattccgcgagatgtcgcttcaagagctgcttttgacgctttgctcagttggcttgcgcaaaacccatcggacgcaaagaagatcggcgagatccgtttggtgccttttgatcgccctgatgaacgcctttacaaaatccaatggcaactggtgcattattcattttttaaaaataaaattttacgaacaatttttagatcaaacgcaaaataagcgagcgaaagggcaccaaagggtcaagagcaagctctgcggcgtcaagttgccgttcgctgtcaccagtcagtagcttggccgcaacaacgcctccaaaaacagcagcaaaaacgccacagataacaccaacaacaaaagacacacacgccaaaaaacatctggcaattgactcaaaaccaggaccatccaaccggtcttctggcgaaagcgttgctgtcgttccaccaccagttccgaaagtccagcagaaaaagtcaactgcgcaaaatgaccagcacgctgaagcaacaacatcatcaacaacagcaagcaaagcatttttgatgcgtgcccaaccagatggcaactgcttcttcaatgccatttgcttgacattgttcggatcagaaaaccacgcagaccaacttcgcaagcgaatgtgcacatttctccgaacaattcttgctgatcagcggctgtttttgcggcagaatcccaactacaacaccagggagagctttttgcgtcgcattgaccgcatgttgctccacggcactgatgaaggaataacaacattggaggagtatgccggacggagggaacaagaacgggactgggctcaggtgaacgacagcatgctgttggccatgttgttgcaacggcccatcgtgatcatcatgacaacgctgacgcaacgcgaaattgagcaacagagaccgcagtggaacgataatcgccaacatctatatgtctacttcccagacggcgaaatgcgggtagataaaaacgcaaatcataccttttaatattaaaaattcatgtagcaatctctgcgcaatgttcctgtggaccagctccaaaacttcacgatggtccaagacgttggaacccacgtggacagacggcctgtcaacaatgctattgtgctctactacaatggccacaaccactttgacaccgtcacttttgtaatgcaaaatttaatgttgaatatttaatttactaagatattaaggcgccacgtagttccgcggaaagagccggaaacgaagttgtctatgacgacaactacgtacctgcagcattgacaccagctgccgcaatgggttctccagctcaaccacagccaacaacaacggcccaaccctctcgtgaagttttggacagcggaccacttaaaatggctaaacaacagccagcaagccaacaaccagcagcagctccttctgtcgaggtcaatcgaagaggcaacaagctcgaaattcattctgaaagcccgcggaaaaccctgttgctagcagcaaagtatgctgtggccatgaacacggagacgctgaaggaaaacatcagtgaagcagaaaaggcaaagaaacaacatcttctgcaacagtgcactgcgtcgattcatcgacttagcgaacacatccgtgcggctacagatgcggaattccaagccaaacaacaacaggccatgttcgaaagcatccgacagacacccgtttcctcggactctgctgcgctgcaaaagtcctttgacaagcttcgcaagccattggcagagctctacaatgcaataaggaattaccttatgctttggcaagcgcttcgccaaatcgactctgcaaagtcctcgcttgcaagtctgaaggattggcaggatgacttcgaattttgcagcgaccgtcttcaaacgcttggtgaacaatggaaagaagctgacgacaagtttgaagacaaattttccaaagtctacaacgactgcgaaaacttcaacagcccaaagaagaaaggctccagcttcttttcgccattaaagtcgcttccaaagtgagattaaaaatgttcaaaaaatatttcaaacaataataaattaaggttcatgaagagcaaaaaagacagccaggatcaacaacacctggacgcacttttgtcagcattgcgtcggattttgtcggaaaaaaaggatgagatcgaagttgagatgaagaagaagcggaccgttcgcacttcgcaaacggcaacgcgtcgaagacagctggacgaaccgacaaggcgcagaacaagtgcatcgccaagcaaaatcagagcctccgatgtcaatgttgagcgcgcaaagaaggcagcagcagcagcagagtcccgcttctccactccggcaaagatgacatcagccgaaaagtcgcaattacaacgcgagcagcagcagcaaaggaggaatgaagaagcaaagaaacagatggatgcaaggctggctatagtgcaacaacatctgcacaagcaaatcgatcgacagaataatttggcagtgcgcaatcttcagtgggacagagaggccaaaatggaacaacgtatcatacaacggtaccatgcattccgcgccatggtggatgaagaatttcgcgcagctgtccaacaaggagcaacaattgattttgagcaatgtaacaaacaaaaaataagtaaaaacaataaaataacttaattgtagtcctcaattctgacgccgcgatacgctctctctgcgaggaaattctcgagatggccggccaagatgctgacgccgatgtggaagaactgatggcacaacaccaggccgtgattgagcggcaacagcgagcattagccgagcagcagtattggcgaaaatttgccggtaattggacattttcaaaataatttctcagagaattataggagacgcatccgcagagcagcccttacggccgacagaattggaactggagatccagcgctacaatcgagagcaccaagaacaggagagaaggctggcagaggaacgaatacagaaggagcagagagaagcagaaatgcttgagcgaaagatgcgccggatcaagcttgaacaaccaaaaagccaacaacacctggcaaaggactcaacacgaaagcgcacacaacaacaagcgcaaatttctacaccaacaaaggctgaaacaaaaagtaaaaatgctatataattttttgtgattttttcatattatttgaagagagtggcaaaaatggaactctgccgtcaccaggaaacgctcggaagcaaccacaacatgcagttagtcggctttacttcagtgaagcaaatgccggtaaaaataatttttaatgatagaaaaataataaaatacaataaatcagaacctgagcatgttgagtccgcttcatcgatgttgacgactgagcagcccatcgccatcattcagcctgaccccgaagccatacgggcacgggagatcatcgaccagcgactgaacatccaagaggcagattatgtggaagatgtccattgcggcagtgacgataagggtaacaaacagaataaaaattatttgcaaaaaaatttttagctcccggtccgcaccccaactttaatgttgtacacatggagatcgtgagcagcaaaaaagaagggcagtggcgagacaacaacgagacgtgcggtgtctgcacggaaccactgcttcgcggagatctcgtcactcagctgccctgtgacaccaatgtcaagcatatcttccacaccatctgcctacgccgttcgttgaccaccaaccggacatgtccgaagtgccgccgccccgtcaacatcccagacaacatatggtgaaaaagataaaaaaaaatatagcataaaatgtttgtttaggccgaccaaagactcgcatagtcagtcctacaaagactactttgctgagcaaagtcaaagcgcaacatcagcccgacctccggacgatgactttgtgatccgagcttggtaataaaaaattgaaaaagtttgaaaaaatttatcaaaaatacaggagtgtctacgaagaccttcgcaacggccagagagacgcctacgggagtgtgattcgtcaaccaatcgcgccccgtagagctttccagctcgtgatcgaccaaatccgggagggcagctctgaccttggcgaccgtcaactggagtgggacatcaccgacccacggaatgacgaggaacaagggctgcacatgtgcgagaccctcctgagagaaagaatggaggaggatgagaaggaggaaaaggagaagaaagagaaaaaatatttggaattttgattaaatttttatttatttgtacaattttatcttatcatttgttaatgtttttgttttctttttcataaatttttagtaatatttttgacaattattcagagtgcctcgcaacccaaaatagtggaaataaa

SEQ ID NO: 58486 - DNA, 267 bp, Heterodera glycines
  Genomic contig location: Contig_ID=SeqID_59; Location=13807..14073; Strand=+
  SCN-specific regions: Sequence locations=1-116,138-267
atgtctaattctttagcacgatcttgtgtcatttcatcaaatgcattttgttcggtaggatcctcagccccagactcagatgacatttcatcataaattgttgagatagcatcaactataaatataggtttaattaaaaatattttcaacaaattacagtataaatcatctgaagcaatggaggatcggttcgatttgatccgtcctcttgaagatcgcggggtttcgctctcagatgaacttggaggccctataattacaaattga

SEQ ID NO: 58487 - DNA, 433 bp, Heterodera glycines
  Genomic contig location: Contig_ID=SeqID_60; Location=65..497; Strand=-
  SCN-specific regions: Sequence locations=1-433
atgccaaccaagacacattttctgcctgctaaagagtcgtcgacggcattcttctatgcccgtcgtggcacgcaacgtgagcgatcaccatcgccgtgcggcggtgttcgtgtgacgccttcacctgagcgtttggcgcgtccatcaggtgtggaagtgccaccaaacaccgatttaacggtgtttaagaaaccaatcccggtaattagcttcgttgaaatcaattatatgtaagaaatgtaacatctagggacgaaattgggacgaagatcgtcgaaagcgtaacgaattgctttcggcgtactcttttgcgcaagatagagggattgcggcgcaacttcgtcgcctcattacggagatgaaggttttcgccgaagaggcgaaaaagaatgtggcccattcgcggggcgttggcattgaagtgcaaggaaaa

SEQ ID NO: 58488 - DNA, 2796 bp, Heterodera glycines
  Genomic contig location: Contig_ID=SeqID_60; Location=2242..5037; Strand=+
  SCN-specific regions: Sequence locations=1-11,144-273,301-379,427 -437,465-588,617-699,721-788,837-862,929-1058,1118-1214,1241 -1241,1284-1300,1340-1345,1386-1413,1453-1505,1527-1601,1623 -1697,1725-1731,1773-1805,...
  SCN-specific regions: Sequence locations=...1827-1851,1873-1898,1927 -1959,1981-2005,2033-2086,2108-2180,2202-2228,2250-2256,2298 -2325,2354-2523,2545-2619,2641-2796
  Gene Ontology: Mol. function=DNA binding; Cellular component=nucleus; Biological process=regulation of transcription, DNA-dependent
gaaacgggaaaggagagggagagggagagggagagggagagggagagggagagggagagggagagggagagggagagggagagggagagggatagggagagggagagggagagggagagggagagggtgagggtgagggagagttaagaaacgaaaagggtgttggatacggtgacggagacgggctgagttgtagacggagaccaaatggagacgtttgagaaacgaaaaatgtgatggagatagcaggcaagacgggctgagttggagaccgagaaggagagaagagggagatggagaccaagatgtaaatgcagtatgtttgatagagagttgacaaaccaaaaattaccacgataatggagacggtgatgaagcgaaaatatgatataaaattaaataataaaatttaaaataacaaaatttctgcaccaatcttttaaaaattattttctctattttctcgaagagttttgaatctatttctaaaaaggagacgtgctgagttggagacggtgaagaaatggagaaggttaagaaacgaaaaacggtgatggagacagcagccaagacggactgagttggagaccgagaaggagaggagagggagatggataccaaaattaaaattaactctacgaaaaatttttcagagttttgaagatattcataaaataaaacttaatcgaaatgcaaagtttaaattcaaattttaaggttaatgttgatgtgagagttattaaaagttttgatcaaatttttaaagataaaactttagtgactttttcaaaaaaattttatttaaagtaaaaattttataatatttgttaaattttctaacataaactaaaccaattaagccaaataattttttaataaagacaattcaaaataatcaattcaatttttgttattttatattttttttcagcataataaactcaaaatcaaaaaatgaaatctgttgtttatattgaaaatttaaaatgcttcactcttaagcatcggtttcttaatcaatttgttctttctttgtacgccgaagagtccgcaacctgaattttaataaaaataattatctcatagtaaatttttaaattaaaaatttaataattttgtgcaactgataatttgttaatattggaaatttagaaaattgtgcacagaaagggacatgtagaaaaaataatgtgttttttgaatttgggaaaaataggaaagggaaagggaaaatgtttttagaatttggtaaaattatgaaagggaaagggaaaaggaatttagaatttggtaaaattttgaaagggaaaaggaaaggggagagggaacgggaaaaggaatggtattttagaagtttggaaaattatgaaaaggaacgggaaaaggaacgggattttcgattttgggaaattattaaagggaaagggaaaaggaactggaaaaggaacgggattttagaatttgagaaaattatgaaaagtagtggaaaaggaataggattttagaattttttaaaattattaaaaggaacggaaaaaggaacgtgattttagaatttgggaaaattatgaaaaggaacgggattttggattttgggaaattatgaaaaggaacgggaaaaggaacgggattttagaatttgggaaaattatgaaaaggaacgaaaaaggaacgggattttcgattttgggaaattattaaagggaaagggaaaaggaacgggattttcgattttggaaaattattaaagggaaagggaaaaggaacgggaaaaggaacgggattttgaaatttgggaaaattatgaaaatgaacgggaaaaggaacgggattttcgattttgggaaattattaaagggaaagggaaaaggaccgggattttcgattgtgggaaattattaaagggaaagggaaaaggaacgggaaaaggaacgggattttaaaatttgggaaaattatgaaaatgaacgggaaaaggaacgggattttcgattttgggaaattattaaagggaaagggaaaaggaacgggattttagaatttgggaaaattatgaaagggaacgggattttggattttgggaaattatgaaaaggaacgggaaaaggaacgggattttagaatttgggaaaattatgaaaaggaacgaaaaaggaacgggattttcgattttgggaaattatgaaaaggaacgggaaaaggaacgggattttagaatttgggaaaattatgaaaaggaacgggaaaaggaacgggattttggattttgggaaaattatgaaaaggaacgggaaaaggaacgggattttcgattttgggaaattattaaagggaaagggaaaaggaacgggaaaaggaacgggatttttgaatttgggaaagttatgaaaagtaaaggaaaaggaataggattttcgattttgggaaattattaaagggaaagggaaaaggaacgggaaaaggaaagggattttagaatttgagaaaattatgaaaagtaaaggaaaaggaataggattttagaattttttaaaattattaaaaggaacggaaaaaggaacgtgattttagaatttgggaaaattatgaaaaggaacgggattttggattttgggaaattatgaaaaggaacgggaaaaggaacgggattttagaatttgggaaaattatgaaaaggaacgaaaaaggaacgggattttcgattttgggaaattattaaagggaaagggaaaaggaacgggattttcgattttggaaaattattaaagggaaagggaaaaggaacgggaaaaggaa

SEQ ID NO: 58489 - DNA, 662 bp, Heterodera glycines
  Genomic contig location: Contig_ID=SeqID_60; Location=1191..1852; Strand=-
  SCN-specific regions: Sequence locations=1-134,170-641
atgcaatcattctttccggtcggcacacattttaccaaaaaaaatcaatcccaattcattttcaggtattgacaaacggaacacttctgatgatgaaactcacaaaaaaaagataagtcaaacaaatgaacaacaataattttatttataaaaacaattaacatttttacacaagcttaatttattaatttttcaggaatgccctgaaatattctgagctcgtgaggttgtgcgttataattggtaacatgcttttcaaatgttcaatgctttttcagatgttggtaattgcaacaaaagtgatgattggcgtcacacaaaacattttttgtaagacaagattggtcacatgcttttcaaatgttcaatgctttttcagatgttggttaatcgcaacaaaagtgctggttggcgtcacacaaaacattttttttacgcaaaaattggtcacatgcttttaaaatgttcaatactttttcagatgctggttaattgcaacaaaaagtaatgatgggcgccgcacaaaacattttttgtaagccaaaattggtcacatgcttttcaactgttcattgctttttgctttttcaggtgctgtattttgtcaccaaaaatttgatgatgaaaagagcacgcataattttattgaaagcaaaaataaa

SEQ ID NO: 58490 - DNA, 1937 bp, Heterodera glycines; identical to SEQ ID NO: 61
  Genomic contig location: Contig_ID=SeqID_61; Location=1..1937; Strand=+
  SCN-specific regions: Sequence locations=1-254,276-288,330-407,435 -515,537-561,588-641,663-735,757-783,805-832,861-936,958-1173,1195 -1275,1297-1324,1352-1478,1506-1540,1562-1666,1688-1715,1744 -1776,1798-1813,1835-1861,1883-1910
  Gene Ontology: Mol. function=enzyme binding; Cellular component =nucleus; Biological process=histogenesis and organogenesis

SEQ ID NO: 58491 - DNA, 708 bp, Heterodera glycines
  Genomic contig location: Contig_ID=SeqID_661; Location=2700..3407; Strand=+
  SCN-specific regions: Sequence locations=1-393,415-708
atgcttgacacaacagcggaatcttttttaaaagtcctccgacgattcatcagtcggaggggaaaaccagatttaatttggagtgacaatgccacttcatttaaactgtctcaaaagacaattgagcaattgacaactccgaaaggagttggacaatatcacgaggaattccttgcacataataaaatgaagtggaaattcatcgcccaaatcagtccttgggcaggcggcgtttacgaacggcttgtccaattgtgcaaaaattgctttaaacgtacattggggagaagaatcctcaagtacgatgaacttaataccttcgtggccgaagtggaggccacacttaaccatcgaccaattacggttgtgtctgatggggaagatggcattcagccacttcgccccattgatttgcttcaaccagatttgcagatcaattgggagataacagcagaagaagcccatcccaatgataagcaaatctcttcgtctgagagattcgctgctttatttaaagcaaccagagaagctcatgaaagcttctggcacaaatggcacaacgattaccttctccttctaagggagagggaaaaatgggatcacaaaggtcctcatcttcaggataagggagagccaaaaaaggggatgattgcggaccgcctcagttgtgccccggcacgtttgggccccggcggtttttggatataa

SEQ ID NO: 58492 - DNA, 643 bp, Heterodera glycines
  Genomic contig location: Contig_ID=SeqID_661; Location=347..989; Strand=+
  SCN-specific regions: Sequence locations=1-139,175-177,259-278,300 -471,624-643
aattaaaccaatttataaaattcatattgataaaaatttaagacctaattaattgaattctagtaataaaagaagcctccgaaatgatgcgagttttcgatcatgagcatttataatatggcatacattaatgacgaaattgaaaaactcacataaattgaaattcatcactatatgtatttattaaatgtaaataatgaaaatataatctatgtcttttaaaaatcaaaaataatttataaatttaaaattaatatacagagtgcataacaatctataaaattaattttaaagaaactagcgcaggcgcgctcgcttcgctcgcgcacttcgcgctagctaaaggttaaaaaaatatttgtcatccttatccaacttgcctcacgctctatttttttctctcatctctttgtcgactcttttctttctctcgtctcttcttaatttactatttttccatctaacctcttttctttctctctatcctctttctctcatctctttccactctctctctcctctctctctctctctcctcactcttctccccttttatctttttttttctctctctctctctgtttcatttcattctatctatctctttcctctctctctctctcctcttttctcttctcgttcc

SEQ ID NO: 58493 - DNA, 570 bp, Heterodera glycines
  Genomic contig location: Contig_ID=SeqID_661; Location=3412..3981; Strand=-
  SCN-specific regions: Sequence locations=1-391,413-570
atgttccgaaaaaatgtgttttatgcaaaaattgagaacaaaaaaatggcatcttataggatagttgcctacgatttagaatacacggtatttagttttttaggtgtaaaacaatattttttaatttagacgaatacgattttcgatgaaaaatcattaagaaaagagactattcataagcccaattttattagtgcccgatttatctgttcattatgtttgggagaaattaaggattgcgaaatttgtgggacgggacctcgtcatttaaactggtgtagtaaggatggaattgaccccctaaattgttttgttaaatggattataaatcttgaaaagtatgatacatatgcatatgcacattttgggggtaaggaataaatgaatttacaaggatttaaaaatttctttagggcggtatgattcgcattttgttttgagggaacttgcgaatttaggatataaacaaccggaattcttaacgaaatttttcaaaattgtgcaggctaatagagcacacttagggctttcgaatgataccaagaatgttggctttggttgacaaataaa

SEQ ID NO: 58494 - DNA, 695 bp, Heterodera glycines
  Genomic contig location: Contig_ID=SeqID_661; Location=3985..4679; Strand=-
  SCN-specific regions: Sequence locations=1-89,111-266,291-339,361 -624,665-695
atggatgggaaaaattatggtcttaagcatttgcaaattgtacaggatttttgggtaggtaaaacttcaaactttaaggattaatagttaaataaattactaatagatttttaggactcaaaatttccggggaaatttgaattgttgctttttcaagggatgttggacttcgtccgatttttaaggggaatggccccggtcaatataatgtgtgcgtttttcatgaaaaaaatcattgggatggtgggtttatatattttttttggtaataaaacattttttaggaattaaaagtattggacaatttttttctattaaaaataaatattgtataagctgtgaaaaaccctatcaaagagaagaaaaacatagtttggagtatgaagagaggtgcaaaaaatgctgcagaataggtaacaataaaaaagtaatcttctactggaaaatttaacgctttggtttcccatgccccccgtaaagaaatacatttaactgcgaaaaatgtaacagaattttttttaataaaaattgttttgagcatcacaaaaataaaatttgttttttgtatcaaaaatgtacaaaatgtcaatgcgaatttaggacagatacagaacatagctgctgtaaatttaaaaacataaattaaaatatttataaaattttagatcaaaaacattgcagaaaatgtcacttaa

SEQ ID NO: 58495 - DNA, 1514 bp, Heterodera glycines
  Genomic contig location: Contig_ID=SeqID_663; Location=2100..3613; Strand=-
  SCN-specific regions: Sequence locations=1-354,378-452,475-638,664 -1030,1068-1069,1091-1106,1131-1175,1197-1391,1417-1449,1471-1514
atgaatgtaaggctaaaaagcatagctattcacaatttcgtcggaaatggaaaattcatctttaaagaaatgctctcagcgtttcatgggaaaaaagtgaatggtttggctttttataattcacaaataaatttaataattagtttacattcgattataaatttcagttcgttgtgttccattacttagtgttaagaaacgacgtccgacgccacatccgtttggactctttacaggagaaaatttgtacaagatttccttaattataattgatgaagtaaattattggtttctgccttacatttcttggataacctgtgatcgatctcaccatcgaatgcagctgcaacatattaaattttctaaaaataaaaagccattcttttcaccaaccttacgaattaacgtttttttcgtagtgatatataaaacatatattaagaaaaacgctgataaatatatttttaaaataaacatagtactgagaaccaaataaaaaaattctataaaaagctagacacaaaaattcatacatacatttttagattacaaaattaacaccaaaaaattatttaaatcttttaaattgataacgcctacatctaaaacattgttttaaaaaacaatttactatttcatttagattccatttatataaaataccaagtggaatatggcagaggtctgcaatggggtaagacaacacatgaactgccttcaaacgagagcttcagatttgagtaatttagaaatatataaccataaataaatttttgattcataagtccttaaacatgtataattaattattatgaaaatatgcgagaattggtaccttaatatgttggaaggtgaagattcatttgtatcaggggtgttgttgcaagtttcgcttttcgctttttcgctatttttgggcctttcgctttcgcccttcgttttttgggctgaagagcgaaaaaaagtacacccctaaagatacagtttattttttgcaagtcaatttctcgaaaaaaaatttttttgccacaataatattttaatataataaaatttttaatttataacggaaaaaataaacaataattttcaaaaaatgcaatatcgttttataattatttatatacaaaaatctacgattaaaaattgattatcgtcaaaaattaatccaaaatttgaaatttgttggtgagtatctttaaaataatgtaaaacgtatgtaaaaaatttccaacggccctaaaaatccttattctcttaaaactgtcattttggcaaaatcataacaaaaagtttcaagaaatttatgacaaaatatgttcaagaaaacttgcttttttgagtttctcaagtcataatttttttaaacttagtgaattttttgtaattttgcaggataatagaaaacaaaagatcaaagataatttgggcgaatgaataattttggattaaaaaacttcaagttgtcgacttgaagaagaactaaacaaacggaattcctttcataaaataaa

SEQ ID NO: 58496 - DNA, 914 bp, Heterodera glycines
  Genomic contig location: Contig_ID=SeqID_663; Location=4195..5108; Strand=+
  SCN-specific regions: Sequence locations=1-130,176-450,472-498,520 -525,547-766,790-853,875-914
atggaggtaatagtagatttagaataatgttactatatttcttcatattcatcttgattgataacgtaggttcgtcttgttgatcatcgatggtcgcataattaaacgcttcaattctcctgttttttccatttattttataatttttctcaatttatatttttcttaattataagcagggatgcaaaaaacatgcaaatgcatttttttcctggcttctccatgctctaaatagcaggaaaaacactttcgtttttgtgtttgcgtataaaaatcgggacttttatttgcatatttatgcatatttcgccattttttggaaaatttgttaacaaaaatgcaataaaaacggaaaatacacccctaagaatcggcgctaaaaaattcagaaaaatacacccctaagaatcgaccgaaaatttttaaaaacacaccactaagaattggaaattttctcaaaaattcttcccccaaatttttttttcattggaaaatttttgatttaaaaaatgtcaatatttgctaaaaagaattttataaaagaaatgtagcagctcattggcaagtgcatagtaatttttttaaattgaatttgaacccctaattttcaattttttagtgcatatttgtgcagattttacgatttgtgtgcataccgtatatgctctaattatagcccatgggggattatttttaaacctcctaagaatacaggggataattagagaatgggggataaatagagactgggggattatttttcaacctcctcagaaaggtgggatttggacttcaattcctgatcattgtcccaaaaccccaaaaaatttttttaaaaaatccgagaacctcgagcataataatttatttgaattcccgaaaaaaagtctttatttaatgaatcgaattttcta

SEQ ID NO: 58497 - DNA, 502 bp, Heterodera glycines
  Genomic contig location: Contig_ID=SeqID_663; Location=5773..6274; Strand=+
  SCN-specific regions: Sequence locations=1-431,453-502
atggccatctctacacacttgacaagacaagtgccgatggaacgactaaattttggcgatgtgagttcaagaacagtggtgtgaacaagtgcaaaggacggatttggactcaggttgccatcagtttttaaattcaatgatctcaatttttttgattttaagcgttttaatacggagccaatttttgctgagtcagcaaaaatgctgatatcgattgcttttattcctattgccgatctgactgaagcagtcaatgtattggacgttgcgttccgaaattttccgcacatgcaaccgatgttggattttatgttaatcgaagtcataaacagccaacatttaccacgttcaggttgatgaacaattaaacgggtcgtacacttgaagatgggtcgcgaactgaaccgcgtttcaatcagaataattttcaattttgttattagaaaaaagtaaatgtaactggtaattagaaacaataacgaatcgtcgcccaactcaatga

SEQ ID NO: 58498 - DNA, 1821 bp, Heterodera glycines
  Genomic contig location: Contig_ID=SeqID_5565; Location=41..1861; Strand=+
  SCN-specific regions: Sequence locations=1-243,266-381,403-519,541 -693,720-794,822-1037,1061-1337,1394-1432,1455-1745,1794-1821
atgaaggtgggccgctgctcattattgcaatgcacagcttggccgtggaagttcgttggagagacgaagggcgaagccgagagtttggactcattcaatcattttcacctcattcttcatttaaggatcgggacgatcctaagggaaggggggagttgtaaggattattcgacgcatttccctcatttaagtattccctattggccattatcaattcaatcatattttatccattcacacgcttttcctttttcgctgtaatgattctccgcccattcgcttcttttttctctttcccccagtgatcagttagtcagtcagttgttgagcagacttcaattattattccgatttctcgtttcgtgtaaatccaacaacgagtgaataaatatatcgacagtcaatgaatcgttgggattttggggcttagtcaatggccatggctttccccacttcctcccatgttccatccgggatagacggtgcggttggtctggggggcacagtgcgcatccctcactataataaatatttgactatttgggtaataattaaatgttggcaaacatttccggctacttccgtcaaaattaaatatatttatgtatttgacaaatttggtaataattaagtgttggcaaacacttccggctatttcagtcaaaattaaaatgtttatctaaattttgcataattattattaatattattattattatatatgttttcaatcaatttatcgaatttatatgcatatatttaaaatgcgattgttgaaaaaatattcaattacctttttatttgaatatatttatgaataagatattcattagcgtcaactaattaccatctcagcggaaatcctaaacagcttttagacatgaaaaacactcacatgatcataccaaattcgtagagccaacaaaatttcgaattccaatcccgagcttgattttgcgagatcccaatccgcaatctcgcatttcgcaaatttcgggattatgggattttgcgggatatatatctgcggatcccgttgtgtaaaaattttttagttccaatcccacgcggaatttatacctgcgtgatcccgtcaattttgaattccaatcccgcgcgggattttgctggatctcaatccgcaatcccgcattttggaaattgcgggattatgggattttgcgggatataatataccgagggatccgtccagtaaacatgtttagttccaatcccgcagtggaatcaaaatttcagtcaaaatttggcacattcttcaaatggcacaatttgtgaatttggtacaattatttaataatgctccccatatttgggcataattatttcaaataaaaagtttttcttttaaaggtcagctttttgattttggtcctctcattattgccaaatgcattattgtcaatcggttggtgtttatttagcttttcttttttaattgtaatgacaaatttattatgattttctagacacagaagctgtgaaggatatggcagatgaattttcagcgctaacatcctcaacatgggacattgttaatcagttgagatttgtcagtgaaaatgccgtgaaattcgttcgcgtcgccggccccgtgggcgccatcattgcgacagccattgatatcgcatttagtgtaaaaaatatttgattgaaaattatggtacttttctgttattcgaaagctcatgctctattagtcttacaaaagcaaaaagatttcatacatataaaaattttttaagaaaaatttcaaaatttgattttttttttttgcaattttcgtgttatatcttttttaga

SEQ ID NO: 58499 - DNA, 1205 bp, Heterodera glycines
  Genomic contig location: Contig_ID=SeqID_5566; Location=3..1207; Strand=+
  SCN-specific regions: Sequence locations=1-161,197-197,219-281,303 -496,529-1059,1081-1205
atgcttaaaggatgtctgtacgttatcttagtgctgattgctgttagtttgattcggttgggcaaatgttagaggcgatttaagcattttggcccttaatttctccggaaaacttggaaaattcaacacaactccgcctaaaagacagatttctgtctgcaaaagaaatagaaatgtgaaaaaagatttgttctttcttatttagcttattttatcagtttctttttggtagttattgagatttgattcgtttttatcaagtgtctctattttaaattaacacccctttttcgggaaaaaattcataaaatttttttccatcgtcatttcgccttctcctttttagaatcttaatattttcagaattgctacgtacagttaaaaattcagctcgatcggttcatgggaagtggtcaaactcccaaaaaacagagtgtctttattttaaattaacacagtgtatttgggcattttataatttttgaaacaaatcgacaatttttaaatttaaaatttaaacaaaattttgagaatctatttctaaaaatgattttttcggacaatttccgatctttgggggtcaatagtctaatttagctgatgggagccgttctattagatcttttttggaaagctgccaaaatatgtacataaatatgtaaatgtggatataaatcgcggattatggaaaaatatggatatagaaattcatcctagaagcttcaaaccaagctaaaaacacgtttttcgtgcgtttcagggctcgcacagtccaattccatataattccaagccctaattataacttcacaggtgttggatacaaaaaattgctgatggcaacgaacggaaacgagaaccgctcgttcattttgctaaagtagtttggttggatttgatgagagcggtgagttttacggcaacggcgtagccagaccctttgctacgggggggggggggctcaagtcaaaaattcggtttttaggggttatattttttagttttttgaaatcccgaattagcggcatattttataaaattttagccgtttttcgccaaacaattactattttttgccattttgatctccatttttcaaaaatatggtaaaatgtgggtccggcgatgccgtcaagcgctaccgggaaaattttttgagaattttaatgcaatttgttaagaaaattgctcaacatttcaaagaa

SEQ ID NO: 58500 - DNA, 890 bp, Heterodera glycines
  Genomic contig location: Contig_ID=SeqID_5567; Location=890..1779; Strand=+
  SCN-specific regions: Sequence locations=1-313,344-392,414-474,498-890
gaaatcacttggccaacaatttcacgcactcgtgcaaaatcggcaattggtgtttcggatatcgcagagagtaaagaggcgtatcaatctgtagcggaaaagataaaggatgaggttgaccaattaggtgcagaaaagtaagcaaaattgagtgcttattcgtgagcacagtatgatcaagaaacttttaaatattatgtgtttgttgatctttcagtattgaattttagaaaatccaaaaagatggccaaaaaagtctgcctaaacaaaaaatcaatttacaaaattaattcaaaaaatgagtcgattagaaaatctttcttattttatttttaaattgttcgaattttaaacgtctttttctattataaggttggaattcttgcgccttgtaaaaataatttggttttattctgctggttttcaaaaaaccgcttatttttatgttgctgaagttttagctgatgcgcatagtttcattttaaatgattaattttcctctttttttacaagtacaatgttcagatacgattacgcggtcatcgtttttcctaattggactgacccagaagcgatggcaatcattagcgaagctaattcatactttgaattgattgacgtaaagcaaatcaatgttatcgtagtccgaattgaagacaacgaaacaaattttgaattggcatgcaaagcaaatgaatggtttactccaaggatagaaacaaaaatgaaatataccataaagtaatttgtatttggtagagaaagattaccgtaattattttaatagagccgccccggggctctgtttttcaacctcccctcccccctcaaaaggggggctttatttcggaggggtggctctaattcaggggggggggggctataattca

SEQ ID NO: 58501 - DNA, 510 bp, Heterodera glycines
  Genomic contig location: Contig_ID=SeqID_5567; Location=2162..2671; Strand=+
  SCN-specific regions: Sequence locations=1-149,179-274,296-405,429 -471,494-510
atgtggtgggatcacaaaagacatttaaagctcagtgatctcgcggatatgctgaaagaatggcttcaattttaccgtaacttagtcttggtacataattggaagtttttcagctccgctgccacaattactctcggtgaatgaaaaacattttaaatttatttttaaatttaaatttgatttttgacaggtgttactccgacctttgtcagatcggccagggccgaaaagggtttccggcacaaaattgtgccggcattatttgatgcagaaattttccatgttcacatgcttttgtgagtaatgcgccgacaaattcaatgagtcgagagcaatatgattagggataggatttttttcgtttttacaattgagtcattggatttcgaaattctttgttggatcaatttataaaaataattttattagcaaaaaaacgagcaatttttaatttttaccatcgaacacctcgaaatgtatttaatttgcaattttgcgggcgaaaaaaaa

SEQ ID NO: 58502 - DNA, 416 bp, Heterodera glycines
  Genomic contig location: Contig_ID=SeqID_27823; Location=327..742; Strand=+
  SCN-specific regions: Sequence locations=1-173,195-325,347-416
atgccctccatcatttccaaatcttcaattttgctgctttacccattgcttctcaccacgatggtgttcatttccacttcaacttcgtttcccctgctggtcacctacaatttcaatcaaccaatccaactgctcaaacttctcaaaattgacccgagggtaagcaaaatcataaataattttaattttctgaattcccgtaattaggttttagtaagcataaacaaaaaaatttttgcaagaaatatttgattaaaaataggattttttattcttgccgttttccgtaattacctttttagacaatttaaccttttttcgtaatgagataaaattcaacaaattgttaacatgtactaactcgaatatcactaaattttcagttataacttggaatctagatctaattatattca

SEQ ID NO: 58503 - DNA, 894 bp, Heterodera glycines
  Genomic contig location: Contig_ID=SeqID_27826; Location=398..1291; Strand=+
  SCN-specific regions: Sequence locations=1-105,128-160,187-415,451-894
  Gene Ontology: Mol. function=structural constituent of muscle; Cellular component=sarcomere; Biological process=striated muscle contraction
atgccggacggaaaggcgcctcatttcccccaacagcccgtggccaggcaaaatgacgacggctcgcttgagcttgaatgttttctggaggccaacccggtcccggaaatcaaatggttttatgaaaacgtgagttactctctcacaaatttcgtccatcaaatattaaattttttttattaaattcagaatgaactgaaaccaactgaacgattttcattccgactggacaacagagggtccgaggccttttcggccattctgcaaataaaagttcttgattacctttttttcattttttaaaatttttttcaaattttcaggatttggcggacagtgacgccggtgcctatcgctgtgccattgtgaatccgttcggcaagggcaatgccaacttcaatttgaaacttactggtaatttacaaaaaaaaaaaattttcttttaaaattcctaatttgcttttcctattttcagggttcagttcgccaacattcattgaaaaaccgcagatttcttcacgtgacgacggccgggtgatgatcatggagttcaaggtggagaaatgcattctataaacaaaaaattgtaaaaaaaatttttttaggctaaatccattctgaaaccgacttttgtgtggcaaaaaggggacgaaattgtggccgagtcggaccgttacaaaatcattctgaaggagacggggaaccacgaggtgaccaaaaagagggggaaggaattttggaaatttttttttgaaattttcttttaagtattacgcggcattggaaattgttgagccaaaaaaggaaaaggacgcgggacaatttgtgtgtacggctaaaaatgagtcgggaaaactgacagcaacattctcagtgaagttcgaaggtcattga

SEQ ID NO: 58504 - DNA, 1091 bp, Heterodera glycines
  misc_feature (691)..(691): n is a, c, g, or t
  misc_feature (754)..(754): n is a, c, g, or t
  Genomic contig location: Contig_ID=SeqID_27827; Location=669..1759; Strand=+
  SCN-specific regions: Sequence locations=1-612,634-762,785-865,887 -992,1015-1091
atgatcagcagggagtcgctgatgctgttacgctccgtcggggagaggccgttcatgcgcttggacatgctcaacccgcaaatttatgcacactgccaactgttgcgcaaagtcagggtaagtgagtgagtgggggatttattttaggtagaattttgaacatttattcggccataaccggggttcaattttggtatagttttcaatcggtctacgcatttttagaatttgaggcatgtgttctctctgcacgtgctgtacttgttttcctgcaaagactccgttgctgaggatgccaaacgtcgcatttggccccaaaaacattggcacgaggacatccatttgtactcaattgcggtcagtttacgaccacacaaagtgtgtcttccatgtttgttttttcgctgctgcaggactttgagagtgtggccaatgggacaatggaacgccggctgaacgcgctgatcatctttgcccaatgccatatccagggctgtcagatctgtcttcaaaagggctttttctgcgagttgtgcaacgcttccgaccagccaatttaccctttccaaacggacatcactttacgggtgtgacagtttgttgcttttctgttcagttacaaggcccattcaaaattggaccccgtaacgaaatagtgccacttttaacaacaaaatctttttcagtgtcncaattgtgcgtctgtgttccacaaagagtgtgccaaaaaggctggtctggacgattgcattgncggtctgagcagcgagcagcaacaacaacaaaataaatgtccaaaatgccttagacgcgcaaaatacgcctcgacaacgacggggagcaacagcaacaacgcattggcacagttgcaaaataacacaaacatcaaatagaaataactaactcatggtcctttcttttttaatataattttaatgccttttcattttgcaagtattttcctgtgataaattttttatgttcgatagggttgtacatacattaacaaatattatgcttttagtttttcatgattatttacttgacttaatataaaacatttggtaaaacacgaaaaattttatcaaaaa

SEQ ID NO: 58505 - DNA, 549 bp, Heterodera glycines
  Genomic contig location: Contig_ID=SeqID_27827; Location=1612..2160; Strand=-
  SCN-specific regions: Sequence locations=1-385,419-478,501-549
  Gene Ontology: Biological process=deoxyribonucleoside monophosphate biosynthesis
atgattgcgcatgtcacggggcttaaagtgaggaaattgaaaacgaaaatgcctcatttttctaattttagggcggtgaatttgtccacacccttggcgatgctcacatttacctaaaccatgtcgaatcactcaaggaacaagtgatgatgagtgttagttcgttctatatatttttttacagatgggccgaactccgaaacccttcccacgaattgttttcaaacggccggatgggaatccaatcacgagcatcgacgactttacacccgaaagtgtactgctcgaggggtacgacccgttgccacccatcaaaatgcagatggcactttaatcaaacagcaatacctttttgaacaacattccacccacccattttttgctcatttatatttttttattttttgataaaatttttcgtgttttaccaaatgttttatattaagtcaagtaaataatcatgaaaaactaaaagcataatatttgttaatgtatgtacaaccctatcgaacataaaaaatttatcacaggaaaatacttgcaaaatga

SEQ ID NO: 58506 - DNA, 893 bp, Heterodera glycines
  Genomic contig location: Contig_ID=SeqID_27828; Location=416..1308; Strand=-
  SCN-specific regions: Sequence locations=1-134,166-190,219-330,402 -527,549-561,605-649,677-775,845-893
ctaggttacaacaactatcccttgatgcggattcttcaatacaagaaagtggtgaacaagagagaacaaacagtttaagttcatcttcaagcgatagttttattggtaaaacagttaaaattggataagaaagctttttaattaaatatgtaaattttataaaaacgaaataaaataaacaattctcgtcaaaattattttaaaatgtaaataattcagaatatcttgaacaatttggtctaacagacccagtggaagaacaaccagcaccaaacttgaacagtccaaacgaaaaccatgaagggtcatcaaattctaatgaatctggccataataataataataatataaacaatgatggaatacaacaaaataatgccaatggtattaataataataatgggacacaaacaaatgctgcaacatcagacgatccgagttcatcttcaacgggtgctcaaaacaatgatgatgcgacatcggcagaaaattgtccaatttgcttggaatcattaacaaatacggcaattgaggaaatgaagcaattaagctcatgccgagttttttattaaaaaaaattatatttataaaacaataattttttgttagcatcgctttcatcgagcttgtgttgaccgatggtaagctatttgaattgagatttaaaaattaactaatttaggcttgtacaaatttttcacgaaacttgcccagtttgccgtggccaagttgcttccgaggactttccacccgatcgtcaacgattgtctttttgtaaaaaaataatttatttctctttatattattattttaattaatgtaaaattctaattaatgttttttagttattgttgggccggaaggtaaattaatgaatatttacattaattaaa

SEQ ID NO: 58507 - DNA, 1130 bp, Heterodera glycines
  misc_feature (1113)..(1113): n is a, c, g, or t
  Genomic contig location: Contig_ID=SeqID_27829; Location=278..1407; Strand=+
  SCN-specific regions: Sequence locations=1-202,255-389,415-1130
atgcgcttctactctttgtataaacgcggaattatatccgaaaaacgatggagatggatgaacaataaccaaactactgttcttcgtcaaaaagtactacttttactccgcgatgccgggattccgacaactgaaccggaatacgatgccgaaatatacatccatcaagtgcagggattgtggagcacaaaatatcccggtgattattttactttttatattgatttttattaatgaaataaattacattatttgttacaggcgagtataaaatattcatctttaatgactaccaaacccgacccatcacaaggtctgacgtcaatgaataccaattctctattattctctaccaccacgacaaacatttcgacggcatcaaaaccctttccaaattcttcaataaaaattattattgcctctcttgtgaaagcgtatacgagcgcaaatctcaacattcaatgaattgctcttcactctgccatggatgtcgggaggtgggcgttgactacccatgcgagccacaacagggatacttcaaaaaatgtgatcaatgtaacaacaatttctacaacaagatctgctatgaacgtcacctacacaaggatctatgcaccaaatttcagcgatgcgaggactgtggggtaatttataatgtaaagtatcacggtaaaacaggtcaccaatgcggggaaaagttttgtcgactttgcaagcaattccatgtaaaagaggatgatgaggataatccgtgcagtagctgttttatccaacccctaaaaccccataaacttaaaccatacaggatcatcgcttatgattttgaagcgacacaggataaaaaagtaggtaataaattcgaacacgaggtaaactttgcagcggctaccatcatttgtaccgattgcatcaatggaaattggaaggactcacttaaaggatcctcttgcaaaatttgtggaccccaccgcacaatcaccttcgcaccattcgacttctcaaacacgatagtggaccaaaaagtcaccactatgcacccgctgcgcgactttgtccaatggcttcttttcgaccacaacaaaaagttccaacagttgcctttgcacattttgngggccgctacgacatga

SEQ ID NO: 58508 - DNA, 769 bp, Heterodera glycines
  Genomic contig location: Contig_ID=SeqID_27831; Location=251..1019; Strand=-
  SCN-specific regions: Sequence locations=1-25,111-172,236-404,430 -497,533-580,602-605,627-630,652-769
atgccgtcctttttggttgttgccctgctgctgctgttgttgatgccgaaaattatgctgctgatggtaattcggaagattatgatgaggatgatcacgatgatcattatcctctattaatgccggactatgataataccccccattatttttgttcagcatggcattcgtctgatgattatgacgatgaggctgatgatgatggtggtagtaacggtgttgctgctgctgttgggcggcagcggtttcggaaccaagcgccgccgtccccacttgctgtgcccggcactgttgtttgatcagtgttgatgatgatgccattgttgtcgtcgtttccataatgacggcatttcattcattatatagctgcacaacacactgcgcaatgtgtggtggcagtggtgaaagcatcaaaacaacaacaattgagcagcagccaattccgttttgtcgcttattacggcgcgaatatttggcggcggcgtaatgatcggcggcagaacaccaacacaaaacaaataataataatattccggtcctatataacggtaaaaaaagcaatttatatatgtaaaagtaactgttcatgtgattgcagctctatgctaattattgttattgttttaattaaaaagcaattaaaatgtgcaattaaatgagaatgtgagtgatcgggtgagagttgcacagactctctctgatcaatgcataatttgattggcaaagggaaattatctgtttattccaagtctcaaatatatacaataaa

SEQ ID NO: 58509 - DNA, 1025 bp, Heterodera glycines
  Genomic contig location: Contig_ID=SeqID_5568; Location=342..1366; Strand=+
  SCN-specific regions: Sequence locations=1-181,203-249,322-468,490 -529,555-605,627-738,776-929,951-1025
atggtcatttggtcatttcttgccatggtcggcccggtcaatggtttttgtgagaaggacgagaattatggcaatcagaaccatgatgatcaaaatgaagatgcaagtaaacacagtgaaagagaactgcagccacaccaaagtgcggtacagccgagtccgtctccgattcagccgcagcatttcctcctgctgctgctgatcacttttctgaagctgccgattagtgcttttgcctctctgcacttcctctcttcccctctttctctctctcttccccccccctctcccactcactctttcttttcctctccctcttccccgcactctttctttaatgctctgcttacctgcctctgatcactctcttctccatccccactttctccttcatcgtctgctgttttgtcctccaaattggccctttctttttctttctcgttttcccttttcttttgtatttccatcggataaagaaacatttctgaagccgaatttggcaagtaataagctttgcttgatctgctgctgtaatttgttttttcatttgagaaggatggcgaaggcgcggcggaaggcgacgaattgcgaatttccgccgcagggggaggggacggagagggggcgaagggcgacggggggtgccaattggtgtccatttgacgccggcgaggagacaacgaatggtcaacgaaaaatgatcgacatttgaagaagcaaaaaaagggggtgggggggtaattattattaaaattaaaaattaattaaaataatagagaaaaatttgagagagtgcaaataataggtcatgtgatggcgaagtgttggtttgtgaggacagtcgattggctgtggcgaaaaggcggccgactaaggccaaaggatggcagccgacacaattcattgatcagtgatcaatgaacagattttttattgtgcccattttgcattgatttcaagctttaatacatttttatgtggcgttcacctgactgggcaattaattgatgaattgcattgaacaa

SEQ ID NO: 58510 - DNA, 54 bp, Heterodera glycines
  Genomic contig location: Contig_ID=SeqID_5568; Location=797..850; Strand=-
  SCN-specific regions: Sequence locations=1-20,42-54
tattacttgccaaattcggcttcagaaatgtttctttatccgatggaaatacaa

SEQ ID NO: 58511 - DNA, 3658 bp, Heterodera glycines
  Genomic contig location: Contig_ID=SeqID_5569; Location=1170..4827; Strand=-
  SCN-specific regions: Sequence locations=1-946,978-1268,1290 -1353,1375-1447,1470-1933,1955-2158,2181-2198,2233-2246,2268 -2358,2380-2428,2450-3189,3212-3658
  Gene Ontology: Mol. function=extracellular matrix structural constituent; Cellular component=extracellular space; Biological process=cartilage condensation
atgaatgtcggagagattgcgtttttcttactgagtgttttggtccattggcaactgaccgatgccataagagtgattagcaacggattagcccctccggagattgttcatagtccgatggacgttaagcgtaagtgccattcattgccttcgaagtgccatttccattgtttcggttcagctcgttgtctgatcagagcagctcccctcgacctggtctttattctcgactcttctggctcactgagaaatcaattccaagatgagattgacgtcatccgacgcatcgttcgccacgtgaccattggggacacggcaactcgcgtgatgctcattcagttcaggcaagcaaaggcttttgcctgtcaaactgaccacagttcggtgctgtttcagtggtgtacagcatttggagttcgacttcaacaagttcacgcacagggacgagctactcagtgcccttgatgttcttcgacatgtttctggggtaaatgccgggggggcatgccatggggcacagtccaccgaaccgtgataatccatttgcctgtggaaggggggatttacgcacggtcacgagctcgagaacattggcctcgagaacaacaatcatagcatttttattctacggttgcgcttttttaagatcactcgagtcggcggcgcctttgaatttgccatttcggcgctggaaaatgccagccatggcatcagaccatcggcggtgcccaaaattgtctttttactttccgatggtcgaactcatgactttcccacggacagtgaaatggccgaaaaattgcggaagaaagtgtcaaattcggacatttgggcgtatggtgagccaattctgctgacaaattgttgttgtcattcttttatgcgaaacttttgctactaaaagctccttcttttttttttttgctttacgcctttttaaaattcgaaattattttaaatgttttaaaaattaattactttaggtacgggagaatatgtggcattggctgaactgatgaaaataacaaaagtaaagtgccattgggaagtgtcgcaatgtcaactttacctttcagaacgaatcgaaaatcattacgaataaaaacttggataaaattgagccaatgttcgccccgtggcacggcgttgaggtgggccttttttggggcgatgactaaccaccatttggccagataaggtctgtgaacagcgaccagtgtgtgtgaaggggtccgataaggtaacagcgtaaatgccattcgacacagttaaaataataataattaattggccgcccattcagccgctcgatttggcactgctcgtcgactccagcgagtccatcaaccaggtgttccaggagcaggtgcagttcatcatcaatcggatcatctccaacgtccacgtccatgccgaggctgtcagattggcactgataaccttttcaggacaagcatttgttgtgagtggcattttgcagttgttgagtcaaccccggagtataagccaaccttaagcatttcgggttcaacgacccaaaagtgggcaacaattcggaagtgattcgctacttaaacaccttgcggcccatcaaaggcacaacttcggctcatttggcattggcatctgcgctgcgtttgttcaacgacccaattcagaacagtttacgtaattcatccgttgaaaagcgaaataaatgaccagtttattactagcgaagagaccaaatgcgaccaaattggtagtgcttttttcggacggacgtatttcggaacccgtggaaaatgtcgctgaaatgctccgatcgatcggagtcgaaacaatggccgtttcgctgaaccatccgacaaattcgaatgagcgcgaattgttggccattgccggacgaaaggagcacgtcttcacgcagaagaacttgcaagaatttgagaagagcttcctgaagtttgtcggctttggctgcgatggcttcgaattgggagtgaatgccagtgagtggcgaaaggacacatttccccattttaattgcttaatctcggccattctccgagtcaacccattaaagcattttcaattcccatttctcagcgcctcgcatccgcggcgccactgacatcacttgcggacccgactcggtgactttgacggtcagaaccacgaagccaatgcagggaatggtcagtaaagttttttatgggatattattttgaaaaaatattaattttttaattagaaacgcttataggaaagttagaaaattaattaaacaattttctgtttttttcacgggggagatgaattgctcccctccaaatcagtctaatctccccaaatctctgtggattggcacccactaactccccttcctctcccctccccacagatatacgcgcaacgcttccacgatgaccctcagtgcgttttgcgctcaaatggtgccaaccgcgagaattctctgactttccgagttggtcagtgcggtgttcagaagacaccgattcgggtctgtttttgttttttgcaattcttagcccatttaaatgcgcttgctccgtgttcagaattcggctgagtcgggctacgtgttcaatgtgacggtcattttgcaattccatccgatcattgtgacaagggctgatcaggtgcctttcccatgctaacggaatggcgatcactccgattgcccccccccccccttccccagggtttggacgtgtcctgcgtgcaccaccagccggtctccgaaagagaattggaactgacctctcagcggtctctggtcacttcgcgttgctcctatcgcttgcaccgattcggccccgacaattgcattgcgttggatgcgaaagtgggcgaaagtctgttccacaagtgggaatgcgagacaggtgccattgggacgaaatgaccccatcgaatgccaaaaaaaactaccgccttttaggggacgaacatcgctttttggtgcacgactgttacgcaacttccgaacggaacaatgtgcagattttggacgagaatgggtgagtaagagctaaaggattgactgaataaacggaaaggcatttttagatgcgaaatcgacccccatttcattgaaacgcccgactattcgcaaatgcttctgaaggaaggcaacgaaagtggcgccaaacacgaaactcaaaacatttttgtctcccaggtaaatgcccaattcattagtgcatttttccgttcttcgagaattcattacccaatgattaaagggaatggccgccttcaaattccctgacgatgacaaattggtcttccgctgtttgatttccctctgcgatttgagcagttcggacgaatgtgcccaaatgatcgtaagaattggcccttttaagcgtcactttttgcgctttgacagcccccaaaatgcgactcgaaacggccgatggcctcggcgggggacgaagggacgtcgcattttgtgggcagaaacatttcgctgttcggatttgatgagacggacactgaggggccgaaaaaaaggcaaaggcggcgaagggacgtcggcacgcggaagggattcgcacggacagtggcggtggagacgcggacactaaacgtaatcgaaagcgaaggcatcagaccaccgacggccgaagcactcagatattgcgatgtgaga

SEQ ID NO: 58512 - DNA, 646 bp, Heterodera glycines
  Genomic contig location: Contig_ID=SeqID_27833; Location=621..1266; Strand=-
  SCN-specific regions: Sequence locations=1-646
atgttaggggtgaaaattacggaaaaaacggtgccgtcgtccgctgtcccatcgacgagaaatgggcccacgccgccattagcaaagcaacgaccgtttgggcgggaggccaaccgtttgatgagtgaatggacaatgccaaacggagttcgagcatttgcctcaggccgctatgagccgccgggtgagcaaaaattatgtggcaaaagttttgggacggtgatccgacaaacgccaacagaatggcaccgtccgtgtccgactttgccaatttgtatttgcagcacagcgtccgccgatgcttccccgaatgccgagccatcagcccgacgacgattccttcggtgtttccgcacacaaaaagcagtcctccccgcaattgtccttccgctcacccaccgggcaatacgcgccgttgtggtcgcccgccggcgccgcattcgctgtgccgtccccggcccatctcggcgggattgcctattacgcgccgaactcgggcgatggaatgcatgggacgacggcagcggaagcggcggtgcatccgatcgctgatggaggacaggcgacgaagccgcccgttttgctcatcggcgcattccctccgtcggccaaagtgcgcccggtgagcggcgaaggaatggaatag

SEQ ID NO: 58513 - DNA, 60 bp, Heterodera glycines
  Genomic contig location: Contig_ID=SeqID_27834; Location=256..315; Strand=-
  SCN-specific regions: Sequence locations=1-14,36-36,58-60
atggcgtcaagcagcaattggaagccaacaaagccggcattgacaagcccattggaacgg

SEQ ID NO: 58514 - DNA, 868 bp, Heterodera glycines
  Genomic contig location: Contig_ID=SeqID_27835; Location=790..1657; Strand=+
  SCN-specific regions: Sequence locations=1-134,172-347,369-754,782 -786,809-868
atgattagttgctcgaaaggttaggcgctcaccgaggtcttaaatccccggcactctcttctatggttattttcttcttcaccgaaaattgatcacaaaaaagatgcttattagtattagctgtgatgtaattttgccaaaaaattcacttttttgttattttgtgagagtaaagaatggggaggagcagtgcgtatgctctgtttgctgccaatgcaatgatatgcaaacgattgttgaccaaaccgaacatggtcatgttctgtcgtgcattttggctgatagcgataagacggatgaccaaaggattattcaaaattttggagaataggaagagaagatcagggaaaagctgaatggcatgaaaggcacttttaacttattcaaatgacaattatggcgctgccgtcctccggaggcttacgcactttgctgaccaaaatgtacaaagcggtgcgttctcggaccaatttgaacaacggataaacgcaaaagagcaggaacagaacgcagagcagccaaaaagtgatttgagtgaattggcgcaattttgggtcgatcaacgactgatcagttgcactgctgcaattcattggcgagaatgcagttttttcgtaccaaaataccaagtttaataaatgcgagtgaaatgaataaaatttaattggtatgcactgtcttaaatattatacggcgaacaaattccacccttcaattatttggataacactaattatgtatgaataatttatcttttagcccaaccaaaaaataagccattgccaattaataaaaaatgccaaattataattaaatcggacatgggccacccgtatttctaaaaactaaacaagtaattacgcccaca

SEQ ID NO: 58515 - DNA, 304 bp, Heterodera glycines; identical to SEQ ID NO: 51570
  Genomic contig location: Contig_ID=SeqID_27839; Location=467..770; Strand=+
  SCN-specific regions: Sequence locations=1-304

SEQ ID NO: 58516 - DNA, 933 bp, Heterodera glycines
  Genomic contig location: Contig_ID=SeqID_5571; Location=355..1287; Strand=+
  SCN-specific regions: Sequence locations=1-150,176-473,495-622,670 -773,805-933
atgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtgggttttgttttgaattatttaaatttttttaatttttccattttggcttatgctaattgttgattttgtttagggaatttgccaagccatgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgctatacaggttgacggtgtggtgaagcaaggggaatttgtgatgagcatcgagacgatgtatctcgataagcgaaacggagttgatcacttttgcacattcctgcgcacttttggcatttgtttcttgatgtgccattgaatgtgtttatttgttgcctattcagagcagtaaattgtttgcataattctgtttaattattttttgtttacaaccaaaatattgatccgcatttttatgttataattttaattcatttttgaaatttttatttaaatggcaaacgaagacttccgcttgtccgaatgcatccgttttattgagcgaactgcccaagagtatgattgtgttctgccggttccacggcttgggtttgtcacggaaaattttcttaataattttttttttaaatagctcaaggcgcgatgagcacctggatgcctgtgttcttatggaatcagtgggctcaggccatcggctctacattttcgagtttgaggattgcctccaggtatttttaaaatatgaggtcaattaattaa

SEQ ID NO: 58517 - DNA, 156 bp, Heterodera glycines
  Genomic contig location: Contig_ID=SeqID_27842; Location=1567..1722; Strand=-
  SCN-specific regions: Sequence locations=1-156
gcatgcaaatgttcctcctctcctcaatgacactgttcacttccgcccacctgccaatccaatcggctgtcctcagttagccgtttcccccaacgtcgtcgcgcccatccatccgttcactacacaaccaacaaaactcaacccatcccggactcc

SEQ ID NO: 58518 - DNA, 56 bp, Heterodera glycines; identical to SEQ ID NO: 52733
  Genomic contig location: Contig_ID=SeqID_27843; Location=934..989; Strand=+
  SCN-specific regions: Sequence locations=1-56

SEQ ID NO: 58519 - DNA, 660 bp, Heterodera glycines
  Genomic contig location: Contig_ID=SeqID_27843; Location=190..849; Strand=+
  SCN-specific regions: Sequence locations=1-660
aaacaaaaaaatcgattttttcaagtgtccgtttggggtactcaaacaattatggggagcaaaaatccatcgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 58520 - DNA, 756 bp, Heterodera glycines
  Genomic contig location: Contig_ID=SeqID_27844; Location=301..1056; Strand=-
  SCN-specific regions: Sequence locations=1-8,30-190,222-374,420 -553,577-756
atgccattgtttggccttttgcccccatttttggctttgattttggtcagcggttcaaaggacgacagaatgaacagcggacattcgagcatttcaacaacaacaagtaaaaatgaataatgaaatatgaaggattgaaatggcacggcatttgggaatttgaaaatgggaattaattaatattgaagagaaaattaacttttattaaattaaaattaaatgttttcaaaactgaacctccgtaaaaatgaccatttaaagaaaatttgaagaaaacgtgccgaatttcacacaacaaaatgccaaaatattccgagaacttaaaacatttaaatgtccatccgtttgtcttataagtcattaaatctaccgcgaatttttttttctaaaattaatattaatttttttttttttttattgtttagttcggccgcagctcttagccaccgatgaggacgaagaacggctcggcattgacatgttccgcgggtacaatccgctgattcgtccttcgccgtgccgaaactcatccgtcgtgcacgtggactttggcatggccatggcaagtgccaaactcggcaaattttaagcagcaaattaacgaatatattttggaattgaagcataatatccaaaaacatgcacagattctgttgatcagcgtggatgagaagaatcaaatcatgcagtcaaatgtttggctgactttgcgatggaacgactgccgattgacgtgcgcaatggcaaccaattaaa

SEQ ID NO: 58521 - DNA, 1892 bp, Heterodera glycines
  Genomic contig location: Contig_ID=SeqID_27845; Location=411..2302; Strand=+
  SCN-specific regions: Sequence locations=1-173,196-1819,1841-1892
atgcggggatcctcacaacagagacggagtacgacgcggaagtttatatacatcaagtgcaagggttatggaacgtcaaatatcccggtgagtacaaaattttcatatttaacgattaccagatacgaccaatcaccaaatctgatgtcaccgactaccaattccctattcttctctaccacaacaacaaccactttgacggcatcaaaactctttcaaaatttttcaacaaaaagaactactgtctctcctgcgagtcgccgtactacaagaaaatcgagcactcattaaaatgctcttcactctgccacgggtgccgtgaggtgggagttgactatccctgcgatccccaacaaggatacagcaaaaaatgtgaccactgtaacaacaccttttacaacaacagctgttatgagcgccacctccacaaggatttgtgcaccaaatttcaacgctgtgaagattgtggggtaatttataacataaaggttcatgggagtgttgggcataaatgtggggaacagttttgtaaactttgcaagcaatttcatataaaagaagacgacgacgacgggatgaacccctgtacgaaatgtttcatccagcccctaaagcaacaacgaattaagtcatacaggatcatcgcatacgactttgaggcgacacaggacaagaaggtggagaaccggttcgagcatgaagttaactttgcagcggctaccatcatctgcaccgactgcattatcaacggcgactggaacaaatcacttcagggaaaaaagtgccaaatttgcggtcctcaccgctcaatcaccttttcaccttttgactacacggagacaacagtcgaccaaaaagtcgtcactcaacaaccgctgtgcgaattcgtccagtggcttcttttcgaccacaacaaaaagtttccaacagtcgcgtttgcacactttggggggcgctacgacatgacgatgatcatcaaggaggttttagcgcaaggaattcacaacccggacatcatcaaacaaggaaatcgcctctacgagctgaaatcaggaaaacgagcatggccccctcaccatctttcgcgacagctacaacctaatgcccattaaattatctggcctcatcaaatcttttgggcttcatataaaagataaacagcactttccccatatgttcaacaaatcatcaaactacaataaggtcctccagcaccttcctccacgtgaagactattgccctaaccaaaagaagaaggccgatctgcagaaatttgacgactggtacaatagtaattacaaccaaccttttaaccttaaggaaaaactccctgaatattgttgcaacgacgtacaaatactcacccatgccctcgtcgaattacgccgggaattcaaacaactgacacaacggaacggaaaacacggaggaattgacatcctgtggcaagccatgaccatcgccagcgcctgcgtcaagaactttgcactcaatcatctgaagcctaactcgcttgccttcgtattgtaaaaaggtatacatcaccacagattgaatagtgcactgggcatctaatacctccaatggtattcgcatattagcacagtcagcatacacacagctcacttatgttatgttgtatatgtgtgtaagcgtgaaggtcagatatgccaattggacgtttacatcacaggcgcaaatgggaagcgggaaaaaataatggaggtgaatggctgtctgtggcgcggttgtgaggagtgttttgatgagatggcattaaaatatgtaaattaagttcggaaagtctgtgagggagagtaggaaaagggaagagaagaaacatgaaatttttatgtgttaatgtagatttgtaggttatttgggaactcgaa

SEQ ID NO: 58522 - DNA, 121 bp, Heterodera glycines
  Genomic contig location: Contig_ID=SeqID_27847; Location=103..223; Strand=-
  SCN-specific regions: Sequence locations=1-121
atggacaaattcccaaacattttgttcatttggaagttaaccgagggaatcgaaggccaaatccaattcaaatgggacaatgtgatcacacagagttggatcaaccaaaaggagcttttgg

SEQ ID NO: 58523 - DNA, 891 bp, Heterodera glycines
  misc_feature (114)..(114): n is a, c, g, or t
  Genomic contig location: Contig_ID=SeqID_27847; Location=583..1473; Strand=-
  SCN-specific regions: Sequence locations=1-236,340-394,422-596,618 -632,665-891
atggacggattacgtgccgaaaagttcgacgtgggaatggcagaggcatactgcttgacggagtattcattggcacttttccatttcctgcaaattgcggtcacaatcgccacncaaagtcagccaatgtcgccgtttcagctgcatttgatgggccatttgagcaaaatgaaaaagtcggagggaacgccgacgggtaaaaagtgccaaaaagctaaaacgaatgatatatagaggagagagtgagagagagagagagagcggagaaagaaaaaagagaaagatggagagaggagtgagagggggggggggggagaggagaaatagttagagagagagcttcgtgatcaggggccccgaaaaccccggggaaatcacaaaaaattatgcaaaccaaaagagaaattttaatgggacatttttatttttcgtctcacttttgaatattttagaatttatcggaatttctacattaaatatgtttggtgcggaacgtatgaagctgctaaacatgggcacaaaagaacaaatggccgaggaattgaagtggagaagggacgaagtttggaggaattgcgtagagcaaacattggccaaaatcaaagaacacataaatatggtggaaaacaatcataatattaaatattaaatatacataaattaaggacactgagtaccaaaaattggcggaggaaaaattccatttgaatttcccgggttgggacgcactgttcgccaagagccgctttttcttcatcaattcgctgcccgaaattgattttgctcagtccaaaattttgaagagcgatcaacgggtcaaattcattggcggcttaaattttggccatccgtcggaaattgacgaaaaagcaatggaaaatgtaaaataaa

SEQ ID NO: 58524 - DNA, 671 bp, Heterodera glycines
  Genomic contig location: Contig_ID=SeqID_27848; Location=17..687; Strand=+
  SCN-specific regions: Sequence locations=1-163,185-200,222-225,248 -335,361-671
atgacagtctttggagagcatttctacggagtgccaatcgtttgtgtgccgttcatcggggaccaattttacaacgcggaattgatggcatttcggcacattgggctggcagttgacagggaaaatgaccagcaaacagtgcaaaatgatctgatcggtgcattgtcagaggcattgggacggcagcagcggaaaaagtgaaaaaatttaaaataaaaaatgtgatttttaaaaacaattagcaatgactcggccgcgcactttgatttggccaaatttaaagctgtaagcgcggcatttcgccaaaagaatgtggcaaaaacaatcgctgacgcaatgaaagaaattgaaaaagaaattggccagcaggaaaaataagccattgaatttgaaaaatgtatagaatttaaattatgcagaattatattattctctgcccggcttagttacgctagtcaatccgaattgtcattttttgattcaaagataaattaaatcgccaaatttgaaaatagtttaaaaatgtaaaaaattaagagatataaaatttacgaaattctctaaattgaataattcccttataaatttttaccatttttagggtttaaaaagttcaattcagctgaggtggtctttctaatagagaagatctttgaaaattaatttttgaa

SEQ ID NO: 58525 - DNA, 1123 bp, Heterodera glycines
  Genomic contig location: Contig_ID=SeqID_27849; Location=390..1512; Strand=+
  SCN-specific regions: Sequence locations=1-357,381-581,606-919,941 -1021,1043-1123
atgaatggtgccattgtcggtggatactcaattcgtatccaaaggtacacagagcaaaacaaactgttgtcatttattctcattgtcaggttcgatctgtcctcttctgctggtgttacgaaatcggcggatgcaaataatgagaaagcatcggatgagcaaatgcatcacatttctggcactgagtgccgcttcaatatgcagcatcttcgtccagctcagctgtaccgcttggcagttacggcacagagtgacgccggcccatcgccaaaatcggatattttggagtaccgaagtccgccgggagtacccgagaagcccagaaatgtgcacatcgaagtgattcttaaatctgaattttaacaaaaaatgaattttcttattaaggcaataagtacgacggaattgcggctcagttggatggagccgtccacagccaatggctctccgattgtctcttaccacgtgaactgcttcagattgtactcaaattctcgtcatcaactgcaaaacaacttagcagtagcaacagcattttcgagcagcaaacggcaactcgttagccaacaagtggaccatactttgttataaaattcattttatgtgctttttaacacagattgcccccggctctcaacggttgttgatcatacaatcgctggaagccgaaacggaatacgaattgaccattgaggcagaaaattctgtcggaaaaggcgaccgagtaatcattcgggtaaaaattggtaaatcggccgtgttaattataaatattcttcagcaaaaaactctcgtcgaaccgccagaaccaccacaaattttccttgcccaagcaactgcgaattcgttgaaattgaaatggagtgacggtggaggtacggacatttgaattggtaattactgtaaaactgcatcgttccattttcagaaaacaacagttccatcggtgcaaacggtcacggcaattattattactatttggagagggaaaatgagaacggcacttattcgcccgtttatgaagtgattattttttacttaattacttgctaccctttggtgttttattttcttttcggattccaaattttttgcgtttattattttgtctatatttttgcaa

SEQ ID NO: 58526 - DNA, 307 bp, Heterodera glycines
  Genomic contig location: Contig_ID=SeqID_5572; Location=62..368; Strand=-
  SCN-specific regions: Sequence locations=1-156,178-253,275-307
atgcctgatttagtgcacagtggtgccgaagtaatatcaattcagtcaacttccgaagtctgtgaaagacaatcaaatggttctgtatgtagagtcagtggaacaaccgaattaacaatattacccgctggacaaaaagtttcattagcattaaaagatgataaaggaaaaataatgggttcattagaattaattttacaatttttacgactacactgtaaccaacaaactttaaaatggttacggtcatataaaataaatgttatttcaaaaagacgctatccaacaatgggctcatgcacaaaaa

SEQ ID NO: 58527 - DNA, 530 bp, Heterodera glycines
  Genomic contig location: Contig_ID=SeqID_5573; Location=64..593; Strand=+
  SCN-specific regions: Sequence locations=1-451,473-530
atgattgcgcttgattttcaaccattttcagtggtcgaggacgaaggtttcacaaggcttttgaattttcttgcccctggctacaaacaaaagtaagaagcaatttttccgcacaatattatttagctcatattaaggaaacgaaagcatttttccgactcattaattcccaacatttatcaaaaattgtttgcaaaagtcaagtcaaacctagcaaaatcagacaatttttcatttacaatcgacggttggacttcaaggaatgaagcgcagtcattgatttcactaacagttcatttcattgatgaattattcgagccaaaattttatattttggaggcaagggcccgttcatgggcggcacacggccgaaaattacgttgaaattttaaatgtaataaaagattaatattctagaattaaatcaattttttaggattctttggaactctttggcattgagcagcacaaaatccacttatttatgcgcgatgctcaaagtacaatgcaggcaaccacgcgtggtttaa

SEQ ID NO: 58528 - DNA, 2229 bp, Heterodera glycines
  Genomic contig location: Contig_ID=SeqID_5573; Location=1..2229; Strand=-
  SCN-specific regions: Sequence locations=1-275,297-344,366-525,547 -779,802-1084,1107-1364,1467-1694,1716-2229
gaatccgaaaaaatttgggatttagaaacaattggtataaaagataacccaatggaaaaagatgatgaagtagcattaaaaatgtttaaagacacaatttacagaaaagacgggcgatacgtagtaagttggccatggaaaggcccaaaagaggaattacctacaaattttacattagcttatcgtaggatgataagcattattgaaaaattaaagaaatccgaagagcaccttaaacagtacaatgaaatttttaaagaacaattaaaagaaggaattgttgaagaaagcgaaattaaaggatatgatgaacattttttgccgcaccattgtgtattggtagccggaaagaagccaagagtagtctatgatgcttcgtcaaaaatacggggcaaaaaatgcctcaatgatttattatttagaggccctatttatatgcctgagttaccaggactgttaatgagatcaagactttctaaaattgcactttggggagatatccaaagagctttttggacattagaattacaagaaaatgacagagatactgtaaaatatttgtggttgaaagatgttaataaaccaataacaaaagctaatctttgcgcatttcggttcaaaagagtgcctttcggtgtaatatcatctccatttttattaggtgcaacagtaagacaccatttagaaaatgaaaaatccgaattagctaatgaagttaaacaaaatacttttgtagacaatatttttgttggatgtaataattcagctgaagcaatcagaaattataaaaatttaaaaatacttttcgaaaatgcacaaatgaatataagagaatttatttccaattcagaagaagtgaataatcaaatacctgaaaaagatcgtttattaaaagaaaacccaaaagtactgggtataaattggtgcattaaaagagatacgtatattataaattttcctaaaatgcatgaaaatgaaaaattaagcagaagattagtactgaaggaattaaattctatttttgatccatgtggatggctagccccatgccttttacctgcaaaaattattttttaaagtctatgggaagaagaaagaaaatgggacgacaatttgaatattgataaaattaatgcatggaaagcagggatggagttccgaggcactaaaaattttcggaagtcggaactcggaattccgaggccccaaaaattttcggaagtcggaactctgaattccgaggccccaaaaattttcggaagtcggaactcggaattccgaggccccaaaaattttcggaagtcggaactccgacccaaaaaaggtcggaagtcggaactcggaatttttgaaaaattttacagaaattttaaaatatttcataagttaactttaaagttataaatcaaaattactaaatataaatgtatttatgtattaaaaaattaatattaaaaattaataatcaaattcaacaattgataaattggactgcaaaaaaatcaatttcctaacattgtctcccttaatccggtttcgcaaatccgtacaaatgagcccggctttagaaaacaatctttcgctttcaactgatccacaaggtgcgctcagaaattttcgggcaacacgacaacatttaaaccacgcgtggttgcctgcattgtactttgagcatcgcgcataaataagtggattttgtgctgctcaatgccaaagagttccaaagaatcctaaaaaattgatttaattctagaatattaatcttttattacatttaaaatttcaacgtaattttcggccgtgtgccgcccatgaacgggcccttgcctccaaaatataaaattttggctcgaataattcatcaatgaaatgaactgttagtgaaatcaatgactgcgcttcattccttgaagtccaaccgtcgattgtaaatgaaaaattgtctgattttgctaggtttgacttgacttttgcaaacaatttttgataaatgttgggaattaatgagtcggaaaaatgctttcgtttccttaatatgagctaaataatattgtgcggaaaaattgcttcttacttttgtttgtagccaggggcaagaaaattcaaaagccttgtgaaaccttcgtcctcgaccactgaaaatggttgaaaatcaagcgcaatcatttccgaaattttctgttccaataacgcctcgttttcacttcccgattcccatttttctaaaaa

SEQ ID NO: 58529 - DNA, 392 bp, Heterodera glycines
  Genomic contig location: Contig_ID=SeqID_5573; Location=3165..3556; Strand=-
  SCN-specific regions: Sequence locations=1-118,175-251,288-324,376-392
atgtatttttcttttcccgtggcaatcaccactcctgcgccaacagctcctgtaagaagtccgcataaggttcaagcccccagcggtgccgccagcatggcgaccaaataaatcctccaaaaatttttaaaattttatttgtattttttataatgtataaaaagatttttatttgtgcttattcacattttgattatttagtttgtgaattattataaattatcttaggtatttaaatatgtattcgaagcatttttttaatattttataacaaaatatgatttaatgatattgtactccagtcattaatttctaagtataatgatataatataattttaaaattaatatttttttggaattataatttatttatgcacaaggatgaataaa

SEQ ID NO: 58530 - DNA, 370 bp, Heterodera glycines
  Genomic contig location: Contig_ID=SeqID_5574; Location=395..764; Strand=-
  SCN-specific regions: Sequence locations=1-370
atgtcaggtcctattagaatgcggataaatccgtctttaagaaaattaactgaaagactggtagaaattagaccagtaattgatgcgcaacaaagagaccctgaggggattgatttattaagaaattcgttggtaaaaataaaaagatcagtgacgttcattgatgaaagaattgaacaatggcgcacatatatgacagaaattgaagttgatgaacgagcagcagaagaagcactttttgtaaatatgaacgcaaatcagcgccatgtaactgaatggttagaagatgcaagagaagcaattgatgaaatagaaataattttagtaaatgaagcagatgatggttcggacacattatcatttgaattag

SEQ ID NO: 58531 - DNA, 1005 bp, Heterodera glycines
  Genomic contig location: Contig_ID=SeqID_27853; Location=207..1211; Strand=+
  SCN-specific regions: Sequence locations=1-97,119-157,188-619,642 -823,991-1005
atgattcgtcgcggctttcgcgacttttccatcgactacaccattctgatcatcattgtgatcgcacttctctttctgctcgtcgtcacgtgcgtcgtttaccaaaagttcaaagaccgcaacaatcgcgtggtgaacgtggacatgaaccaacgattggtgcagcagcaacagcaacaacagcagaaggagagcgatcgaggagttggaggagggcgaaatttaatgggcggaaaggtaaaaacggagggggtgggataaaaacggcataatgccattggaacaaaagcaattagccaggaaggggaagatagacggggcgaaaccaatcataggcattggttaatttggctaattaatcacgacagactccgcccatgagagtgacgtcatccgccgcgcacaaagggacggtggccactgcggcattggccaaagagagggcattggcatatgcgcggaacgcggcgagcgcacagccgccgccgttggagtcgcaggaaagcgcactttcatttccaatgcaacagctgcaaatggcagcgatggaactgaacgtaaatgcggaacaaaaacaaaaaatgtgaaaaagagcgacggatggcaccgaaaaagcgtcaaatttttattactttggtcacatttatgccaaatttatatcagcaaaaaataatttcaagatttcattaaaagccaaacgaaaacattcaatggcaaaaggaaccgacggacagtcgccaatggcacgcgccgaacgaagaacagccgacggaagcgaacaaaaggcagtcaccacgcattcgactgagtccgaatcagccgcaagaaggggaggaggaggaacaagaagggaagagagacaatggagatgaggagggggaagagagacgcaatttgggatacgagccaaaactcggaagaggaggaggaggagacggaagcggaccaggagcaggggcaggacgagaagcagcggatggcgaggaggagcatggcggacattga

SEQ ID NO: 58532 - DNA, 600 bp, Heterodera glycines
  Genomic contig location: Contig_ID=SeqID_27854; Location=251..850; Strand=-
  SCN-specific regions: Sequence locations=1-600
atggactacccaagaataaatgaaagtgaactcgcttttcccatcccttcggggattattgtcagtgggccgtcctcttcgggcaagacccagctggtccttcgcctgttacggcatgccaacgtgatgtttgacccgccgcccaaggcaataggtatgtgcaaagggggtttctgtgcagtgggctgttgctatttagtatgggcatacggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaaattggccgatctgtacaccaaaaagtcacaccataacaatttttccgtgattttcctcacgcaaaacctgttcgataaatcaatgcgggtgccaaggtccaacgcccagtacatcttcctgatgcgggctcccaacgacatgcttagcattcgtaatttggccaaccagatgttccctcgcgagcagggattcctgatggatgcctaccgacaggcatgtgctctgccgtacggttacctgttg

SEQ ID NO: 58533 - DNA, 952 bp, Heterodera glycines
  Genomic contig location: Contig_ID=SeqID_27856; Location=1..952; Strand=-
  SCN-specific regions: Sequence locations=1-143,165-306,328-952
cggggtaagcagtgctggttcgtttcatcacggcaccgaattttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacaaaaaaaataatttttttaagtggccg

SEQ ID NO: 58534 - DNA, 878 bp, Heterodera glycines
  Genomic contig location: Contig_ID=SeqID_27860; Location=160..1037; Strand=-
  SCN-specific regions: Sequence locations=1-67,89-675,697-704,737 -786,808-878
gacaagcccgagattgagctgacatgcaagacgcatttgcacgttgaccaaatgttcaaggacgtccttgacaagaagtacgacgctgtggtgatgcccggaggcagtcccggctcgaacaaattggcggaagtgagtgaaagaaaaactgtctcataggttacggtaataccgctgaataagaatcaatggggttacggtattatttttcctgtaatactgtcttattggcgggggtggcgacacattaacaaaagggtgctcccatctcaaatgtgacaagaaccgtttttcctttacgtcttactgttacggtactgatttgaaagcacttggtttatacggttcatcatgttacggtaccgctttgaaagcacttatttaatatagtaacagtttcttcaacaaagaatagaaccaagttttacagcttgcaatgtaatttttcgatttttttttgctggtggattactgtatgcatgtgcagcagcacctgtattcctacagtacactaacaaacctaccgttttcgaataaatttcctttgttcgtgttttttaaagacaattagtctcttaaatttcaacacttattctaatatgaaagccgaaatccaagcacgttctttgaatttcaagtacagaacattgacaacacaatctcgttaagatttaacaacacaaactcattaaaaaatttgactgttttatttaaaaaaaaatgttttaaattttttccaggacccccgggttggcgatgtgttgcgcaagcatcaggaagcgaatgcggtggtgggcgcaatttgtggctcaccgcttgcgctggtggcccacaatgtggccagaggcgccacactcacttcccatccgtccattaag

SEQ ID NO: 58535 - DNA, 1990 bp, Heterodera glycines
  Genomic contig location: Contig_ID=SeqID_5575; Location=569..2558; Strand=-
  SCN-specific regions: Sequence locations=1-151,173-277,300-392,415 -486,508-1990
atggaagaagataatgccggagacataataaaatggctctacaaagattcgacaaaattggattgcagcagtgaaaaagtgaaagttacaagcgaacatttgcattccaaactttgccaagtgattaaaattaattgcctaatttcaattacttatttattttaaagaaattaattccaggtcaaattgcgagggaatctgctcggttttaagccattggattttgcttctgaaccttttctgattgtatgtgaaaaaataaacgtccaacgttcggaacaaaacaaaaattctttggccattcggcaaagcaacaaagaattgcacttggaatttcagtcggagaaacaatgtgaccagtgggtagttaaggtcctttttatcattggttaatttttgttgaagaattttgtaaattcagcttatgacttgctctcatcgtatagtccaagccgaatacgaccaggtttaatgaacacattcgccctttattacgccaatttctgtcgattgtcccttgaataggtcctttacaatcgcttcactcagcctttgcccgcttcgtctctaagccaacaaatggtcaacaatttcgcctactttctcaccgcccctttcagtcgtgaacaattcttttctttgtctcaggtggcttttttttaaatatctttgaattcccctttttgattcagtctcacaattttccctctcgtcaaatcaaatgccaagaagtgatgtacgagagcaaattgtccatggtcgtgccgcgagaaatccttcgactttcgcataaatgggcgacggaattacgcgacgaattattggacaaactttggggcgtaaagaatgccgccattttggagactttgcacaacgcaattcgtcacctcaactcgaacattgaagttggtcgtctggccttcgtctgcttttccgtacggtgtgctctttttaagatttgcactcaagcgaacgaatttctcggctcttacgcgggtccttccttcaggtgttttcgttgtcccattttaaattttagcggttgtcggtccaatttcgacagaatttccctcagaattttcgcaaaaatttctataaagtcaaaagtttccttttttggccatcctgtgaaaaataccgtgtctcctttctgttcgtgcccaccaatctccacgtgcagactttccttatcgacgaccgacccgccactgcttttctcaccatcggcgcaattgccgctttgcctttgcgcttttcatccggcggacttttcagaattcggtcggttcaatttactctcatttaaaaaaaattacttttatccattaaagcagtaaattttccgccgctttgggatcaatcgctttggaccattcaaatgaaaatttattttactcgcgacgacaaattttgttggcgatgaaacgaaaaattggtgaattaagcagaaacattgacattaaatggcgcatttcgggggacggaaaaacggacgaaattggcaatggaatatttcaggaaatacagcaggtaataatggcattccaacaatagagaatcacttgcattctcatattttaagatgcatgaacaaataatcgatttcgtcaatgccttccccaacattttcaatttggtcgattctctctgtgagggtggactcgcccaattacagcacaaaggagccgactccgtcccgaaggattcgttgcgcaatcaaatggacaatctcaacgcgcagttcgagtcgctcagctccaaaatggtcgccgtcgaacgaattgcgacggccaacgaccgctcgcagaatttggcagaatgcgaacagagtgcccgtgccgccgtccactcgacgctggacgctcttcacaatttgacgtgctccctctcctccggccaattcctcgcgctcgtccaaagtctgcgcaaggcgagcgattgccaaacatttttccacttacaactgagaagcgacgcgttgctttctttg

SEQ ID NO: 58536 - DNA, 576 bp, Heterodera glycines
  Genomic contig location: Contig_ID=SeqID_27865; Location=85..660; Strand=-
  SCN-specific regions: Sequence locations=1-17
  Gene Ontology: Mol. function=transcription factor activity; Cellular component=nuclear heterochromatin; Biological process=N-linked glycosylation
atgggaggagaagagaggaagggaagagaagaggaggaacaagaagaggagggaagagaggaagtgaaaataaaagaagagggggaaaagaagaaaagaaaagagataaaaagtgaagagaatggatggagagggggagggaagaaaagagaagtgacgggaagagaggggatgggaggagaagagaggaagggaagagaagaggaggaacaagaagaggagggaagagaggaagtgaaaataaaagaagagggggaaaagaagaaaagaaaagagataaaaagtgaagagaatggatggagagggggagggaagaaaagagaagtgacgggaagagaggggatgggaggagaagagaggaagggaagagaagaggaggaacaagaagaggagggaagagaggaagtgaaaataaaagaagagggggaaaagaagaaaagaaaagagataaaaagtgaagagaatggatggagagggggagggaagaaaagagaagtgacgggaagagaggggatgggaggagaagagaggaagggaagagaagaggaggaacaagaagaggagggaagagaggaa

SEQ ID NO: 58537 - DNA, 182 bp, Heterodera glycines
  Genomic contig location: Contig_ID=SeqID_27867; Location=959..1140; Strand=+
  SCN-specific regions: Sequence locations=1-182
atgatttctttaaacgaggcaagtggattgcgtggccgtcttaaagtctgtgatggcaatttgtcgttgttacgcgagaagttggcgactgatccggacagttatgcagaggaatttaacgaacagtttgaacatttcaaacggctgctcaaattgctcgaacttcaaccggtgctccacag

SEQ ID NO: 58538 - DNA, 689 bp, Heterodera glycines
  Genomic contig location: Contig_ID=SeqID_27867; Location=27..715; Strand=+
  SCN-specific regions: Sequence locations=1-25,47-689
gagctcgaagacttggatccggaaaacagtggatggaaatattgggagaaatgggaggagcgaagacagcagcaaatgttgcgccatgacgaactaaagtatttgggtggaacgagcaaacaaaccccattttacttctcccgtctgttttttttcagatacaaatatttttggcttcaaaattcgcctgccgttcagacgcacatgcgcttcaccactgaaaaatacaaaacacacaaggtgattttacgaattcacatttgtcagctgttgttgtggttggttagtcggggtggccaactcagtcccaatcaaagtttgggcgtcataactttttgcttttttcgttcaaatccaaatgcttgccgataaaaatccgaccctagttcttaacttattttcttatcatttgccaatttcccggcgtgccaagcggaaccgctggacgacttaattttagaaatttttaataaaagggtattttatcgaaaaacttgctaaaaagttatcatttctcccgcagtacacttaattttggaaaatcatactgttctcttcctcctttcacagttcctcactattcccgtgacgacgccgggcgtttatttgaagcatacgcgtcgactgcgtctcaaacagcgggtgtggaagtcgttggaagagtcggagcaaatgatgaaggaaaatga

SEQ ID NO: 58539 - DNA, 672 bp, Heterodera glycines
  Genomic contig location: Contig_ID=SeqID_27868; Location=155..826; Strand=-
  SCN-specific regions: Sequence locations=1-55,159-565
atgtggctgaatgtgagacgaactacgaaaagtttcaagtgaccaaatttaaagcaaaataattattttatgtttatttaaaaataatttaatttttttaaaatattcgctaatcaaataaaaaaaaataattgcttttaattttttataataattttgcttttaatttgatcacttgcacttttcgtgcttcatctctcttccatttgtacagtatttgatcattgtaaatataacaagaatcaattaggctggtcggaagtgccttctgctcagcgacagttcaatggttttggcgtccagtgacccatcaggctcacaatcagttgcaaacatggccgctacttctgctccggttgttcatctgtccaatgctgaacccgaactatttgctgaacttttgtcccgaggctttgtgcaaaagtcggtaaaaattaggaatcagaactagagtgccacgggaccgggaatttttgcaaaaaccgggaccgggacttgccgggacctgagaagccgggaccgggacttcgatttttttcgggaccgggaaccgggaccaaccgggaatttttaaaaattcaaaaaaattcaaaaattaaaaaaaaattcaaattttaattttttttttttcaactgaaaattaaattttcattttgttttttatttaataaa

SEQ ID NO: 58540 - DNA, 634 bp, Heterodera glycines
  Genomic contig location: Contig_ID=SeqID_27869; Location=332..965; Strand=-
  SCN-specific regions: Sequence locations=1-7,29-324,346-393,415 -555,577-599
atgggcaatttttgggagaaagatagaactatttttagtttttgtttgttaatttaattgtttggtatgccatataaaaaatattaagctctcggttaaccaaagcatggaagtaaaacacgaaaaaattttccttggtataaaatcctgaactgacttttatatgtattaaaagggcgattttctcgcaaattttcactacgtgtagagaagtaagaaaaaaaatttccacttggtttgggcttctaagataaaataaattctccaattgtaacagatcgccttgcatcagcttaccttcactaattttctttatgtccatcatattcattttatatgaaaattttattcccgttttagatgtctcggccaaacattcagagtttcccgtgccctccgcgcgttctctgctcgacggtcgcttcagtccccgtcgttcgcacgtggtcaccacgcccgctgaggacagcgccagctacgaccagcagttcttcgataatccgttgcacctcaaatgggccgaccgaacacaacaaaacaatgattatgctgatgatgacaataaccaaatgacctccgtccgaaaaatgacactttcctaattttttctatatatttattattaactaataaa

SEQ ID NO: 58541 - DNA, 701 bp, Heterodera glycines
  misc_feature (591)..(591): n is a, c, g, or t
  misc_feature (666)..(666): n is a, c, g, or t
  Genomic contig location: Contig_ID=SeqID_27870; Location=98..798; Strand=+
  SCN-specific regions: Sequence locations=1-146,168-371,459-520,550-701
atgagtataaatgttataagaagtgaaaaaaatgaaaaaatgaacaatttatgaaaaataaaaaataatgagaaaaaagcaacttttaggactaaacgagaacatgaacaaaaaaggcagattaaacgagtccaaagaaaagaacgggaaaatttatgaaagccattcatttttcaagatggaattgctgtcaaaagaggaggaagaatctctgaagaggttgaagagaaagctcgaacatcaactctgagggtccagcaaagtctgaccgaaagcgaaaaatggaaatccggaacgtcggatgatgatccagtgggaccacaggagtgggaagaaaatgaggaagaaacgatgaaaaagggcgaagaaatgaagaaaaaagaggaggaggagaagaaaggaagagagggaaaagaaaaagagacggaaaagaagaaggaagagatgaagcagaaggacgagacggaaaccaaacgaagcctcagcgtcggaacaacgaaagacgatgaaatctcgattgtggattctgaagaaagagaaagagatgccttcgaaaacccgccgaagccgacaaacgagcgaatggcattnttgggagtcgactttgaacaatgaggcaaaaaaggattcgcgagaggacaaagagaaagccttaaaaaatacagngccaaggtattgtcgtaagctccagaaaacgaaca

SEQ ID NO: 58542 - DNA, 474 bp, Heterodera glycines
  Genomic contig location: Contig_ID=SeqID_27871; Location=169..642; Strand=+
  SCN-specific regions: Sequence locations=1-227,265-391,414-474
atgcgactgatcggccgaacgcaaacttttcaagtggacgaagaagcggaggaaggggaggacgaggctaaggaaagcgtggaaatgagctacagactgaacggattcactaattcgaccaaattcgaagtgcgcgtggagtgcgagccggggaaagtgaacgaggaaatggtgggcaaaaggagcgaccgaaatttccaatggcacggaccaaaagggagtgccaaaacaaaaaaggatgccattggcatggactaataatgtctctctcatttagtactcatttgaactaatccgggaggaggaacgttaacattgcgaaatatcaaagaatgaaatttagggcattcaaaatgatatttttatgttgtttataaaagaatattgagcgagaaaatgttaattgatttgaatgataaatttttatttcatctaattggattgatcactttcacgccctaaattagcaaacaa

SEQ ID NO: 58543 - DNA, 2057 bp, Heterodera glycines
  misc_feature (2004)..(2004): n is a, c, g, or t
  misc_feature (2026)..(2026): n is a, c, g, or t
  misc_feature (2040)..(2040): n is a, c, g, or t
  Genomic contig location: Contig_ID=SeqID_5577; Location=633..2689; Strand=+
  SCN-specific regions: Sequence locations=1-575,598-713,736-1338,1363 -1929,1961-2057
  Gene Ontology: Mol. function=carboxypeptidase C activity; Cellular component=endoplasmic reticulum; Biological process=vacuolar protein catabolism
aaagaaattgtgtcacaattatgcacaaagctaacgtcggcgagtgcggacgaaatcgaagcgttgccgggcctcggaacggcgcccaactttaagcattattctggtgatacgaagagcaataatggccgagaaaagccctaaagtcctattgtgtggccaaaaatccaattctgagttcaaaatgacgagagctttttcatttcaaatgatcagagtccaaagcccaagagccaattcccgagaatttgatcccgaaaaccctgtcttttattctcgcgattccaacacttaatcaccccacaaaggctacctgaaatcggcggacaaacactttctgcactattggttcgtcacctcgcagaatgacccgtgtcgggaccctctggtcggtcggattaggtcaaaatcggctttagcccaaaactgctcacaggtcttttggttcaacgggggccccggctgctcctcgttgggcggcctcctggaggagttgggcccttacctggtcaactcggacggacggacgctgcgcttaaacccgcactcgtggaacaaaaacgcatcggtgggccaaattcagcttggaaattttcaagagtttggccaaggtggtgttcatcgagtcgccggtcggagtcggcttctcctactcggctgacgaagaacgcgtaatgtcgggcgatgagtcggtcagtcgaaggaattcacggaaaaatattaattagcaatttatgaggcacttgcctaattgcctaattatcaaaaacatttgcttttgagaccgcccaaggcaattacgaggcggtgaagcagttcttcctcaaattcccgctgttccgtaccaatcgcgtgtttataacgggcgaatcctacgccggaatttacgtgcccacgctggttgccaaaattgtggacggacaagccgacttccccatcaatttggaggtgattggaaattgaaaaaaaaacaattacttcggcaattaaagggaatggcaattggaaatggctttatgaacgaagcaattgacactgatactttggcacgattcgcttattttcatggatttgttggagagactgaatggaatgcaattgaaaagcactgctgcggaggatgcgcaggcatttcgaaatattttttattgtcaatgatcgtttgcgattaagacaattgtaatttgggcgaacaattcggagaatgtcgcgcaatggttcagtaattatggcaaaatatgcatcgctttttccttcgcaggtgcgcgacataatattgttctgctggacgggagggattaacgtttacgacatttaccgcgactgctgtgaatttgctaattaattttttaaaattttaaacccattaatttccattagttccgcagcacagtaaaatggccgcaattcgacggggaattctccgtgcaaaagcatttcattcaaacgacacgaatctttgggaggtaatttcctaactaattgtaggtttaattcgcttattaaaacagccattggaggagattaatttccgcggaggtgccccgtgtttggacggtaaaaattaacggcgattattactaattagagataattagaccacgcgataaccaactacctgaacactccacgaggtaagttcactttaactgctactgtcggaaaaggtaacaaattttagtgcgtgaaacgcttcacattccgccgaatgtcccaaattgggaaagttgcaagtaaaaaatgagtggacataaaccaaagtttcagcaatcatttttatttagcgattgggttggcatactgtacacgacagaatactgtaattatattgattagtgatcagagtttaaatgctcttttaattttagccgacatgtcgccttttgtgaggaaggcgatcaatgccaatttgcgggtgctgctttactccggagacactgacatggcctgcaactttctgtcgggccaacacttttcagcgcaactggggccttgcggttgccnaatggttttttttggcattttnaaatcattttttanatttaacagacaatcgc

SEQ ID NO: 58544 - DNA, 921 bp, Heterodera glycines
  Genomic contig location: Contig_ID=SeqID_5578; Location=162..1082; Strand=+
  SCN-specific regions: Sequence locations=1-826,885-921
accgcccaaggcaattacgaggcggtgaagcagttcttcctcaaattcccgctgttccgtaccaatcgcgtgtttataacgggcgaatcctacgccggaatttacgtgcccacgctggttgccaaaattgtggacggacaagccgacttccccatcaatttggaggtgattggaaattgaaaaaaaacaattactttggcaattaaagggaatggcaattggcaacggacacatgcatacgtcgatgaattttgatacgatggcacgttttgcctattctcatggcttattggcggagtcatcgtggaaagagttggagaacgaatgctgcaggggatgcgtaggtggaaaaagtgtttcttacaaatggatcaccaaaaaagggagacttcagatacttgcgatttgggtgtactgtacggagaatgccacagaaaggtacggtaaccaccttttgaaatggcaaccaaatgcattaaaggttttgaatatcatgcgttttgtttggcgtggcggactgaacgtttacgacatttatcgcgattgtggtcagtcctcgaatttacccacttcccctcaaaatgaccaagggtcctaatttctggcctttcagaccatcaaccgaactcaaaacgaatgaaagcgattcgaaatggcattttcaaaagtgccaataaaaccgaccggtggaatattattggagaagagctggacgcaaaagcaggcaaagttggcagtctttcaaaatcagataacttaaaggaaaatgaaattgcgcgcgagtcattacgggagattaagccgtgcgcaaacggtgggcaaatggaaaataaataattaaaaaatatgtaaaaaggaaataaaattacaaattaaattattaagacgaagaaagtgcacaatatttgaacactccaaaag

SEQ ID NO: 58545 - DNA, 2564 bp, Heterodera glycines
  Genomic contig location: Contig_ID=SeqID_5579; Location=452..3015; Strand=+
  SCN-specific regions: Sequence locations=1-23,62-70,106-160,241 -294,320-334,365-371,402-500,521-724,750-862,897-927,949-953,988 -993,1017-1038,1060-1112,1134-1230,1252-1619,1641-1797,1819-2054,2080- 2369,2391-2564
atgaaggttagttgaataattaaatgttcaaaaataaaaatgaaaatttttaatcatttcacaatagaggtaaaaaatcaaatttttaattatacaaataaaaaactctaatgacaaaaaatattcacttttccaatttttattttgcgattttgcacccttttaaaaaattaaaaagtgaattttaaaatgaaagaataattaaatattttcatttaaattatctaatatattaattttgcaatgtgtgtgtgtgtgtcacaaatattttgaattatttattgacacgaaatcttttttaaaaaataaaaaaattattgacaaaactatttcttaagactttcatcatcatcatcacagaatgttgaaatattaaagaaaagaatgttttgcattattttacctgtttatattcatataaatctttcggactcgctaatttttcatttttttagcattgattaattattgtttcatcaatcgttacaaaatgttgaaataataaaataaaataaaataatgtttttgtattgttttatgtacctgtttatttcatactaatctatcacacccgctaatttttcactttttagcattgattaattattttttcattaaccgttactttttgtacctgtttattcatattaatctatcacacccgctaatttttcactttttagcattgattaattattttttcatcaatcgttacaaaatgttgaaataattaaataaaataaaataatgtttttgtattgttttatgtacctgtttatttcatactaatctatcacacccgctaatttttcactttttagcattgattaattattttttcatcaatcgttacaaaatgttgaaataagtaaataaaataatgtttttgtattatacctgtttttttcatattagtctttcgcactcgctaatttttgttctttttagcattgtttaattattttatattttttaatttttaataaactacgttttatatttttaagattatcaattcttatattattcctgcaaaaattatggtacgcaaaaaacaaattttttcgaaagaacgggttgaaagctcccgcgaaaaaagcagatatgacgggttccaagctcccgaaaaaagcggtaataacgggttccaagctcccgataaaagcggaacagacatacaaacacaaacgatgaaaatttttgaaaagaaagactatgatattggaatagaagaaacaatagaaatcataaatatagacgacgatgaactatcagactattcagatatacaatcttctagccaaataaataatacaactcttagaaaaatgaaacagcgaaaaaaaatgaatattgatcaaaaagaaagcgaaaagcaaaaaaatcgcgaaagaatggctttaaatcgtaaattttttctagaagaaagtcaggctgaaaagcaaaaaaaccgtgaaagaatggctttaaaacgaaaaatttttttagaagaaagtcaggcggaaaagcaaaaaaatcgtgaaagaatggcttcaaaacgtaaaaaaggattaaatgaaaaaattgaatcttatatttgtgcagatagtttaagtgttagaaaacacaaacttggaccaatgaacaacgaatgtgtgcattgtcattctttaaatttttcagaagaaatagtcgcaggcaaaaaatcagaatttaaaaattgctgccattatggaaaagtattgatttcagattttcctgaaaaaaattttcctgttggattaaaaaatttatttattcgaaatgatgtaaaatgtcgtatgttttttgaaaatattagatatttaaatagcactttgtcaatggcttcaattaatcctttaagatataaatttaaacataatcgaggaccatattgtttccgaatttctggccaaatttttcataaaatgaatatagcacttcttccggatgaaaaagaggaaccaactaatggacaattatttattgtcgatacgggggacgcagtaaatttgatgaaacaatcaaactcaaaaatagataatgacttattgaattatttatataatttaattaaatcagaaaatccttttgctaaagcttttgtaatgatgaaagaagaagaagacgctgaaaaggaaagagctaaacaagaaggaagagaaccaattgaaatgaaattattgtttggtctagccccgaatatggacaaaaatcgatataaattgcctagggcaaacgaagttgctgttgtttttgtacctggagcagatggagaaatacctgagtcaaaaattgttgtaagagaaagaggaaaagaattaaagattttagatagtcttgacaaaaatgtaacacctttatgttatcctttgttttttccaaggggaacacctggctggcacccagaaatgaaacaaacaaatggctataaaagtctaacaagactacaatatgctggatgctgtatggctgtaagatgtgagtttaatccgatgttatttggagggagattatttcagcaatggggtgctgatgaatatgtctgaattgataatgataga

SEQ ID NO: 58546 - DNA, 1387 bp, Heterodera glycines; identical to SEQ ID NO: 27872
  Genomic contig location: Contig_ID=SeqID_27872; Location=1..1387; Strand=+
  SCN-specific regions: Sequence locations=1-359,385-400,422-465,525 -1166,1188-1315,1345-1387
  Gene Ontology: Mol. function=guanylate cyclase activity; Cellular component=mitochondrial inner membrane; Biological process=transport

SEQ ID NO: 58547 - DNA, 106 bp, Heterodera glycines
  Genomic contig location: Contig_ID=SeqID_27874; Location=190..295; Strand=-
  SCN-specific regions: Sequence locations=1-106
aacaaagatgaatttttgtccaaacttccgttcgccaaagtcccagtgtttgtccatgacaatttagtgctgtccgaaagtatggcaatcattgaatatttggacg

SEQ ID NO: 58548 - DNA, 1529 bp, Heterodera glycines
  misc_feature (1071)..(1071): n is a, c, g, or t
  Genomic contig location: Contig_ID=SeqID_27875; Location=198..1726; Strand=-
  SCN-specific regions: Sequence locations=1-760,782-831,872-1109,1132 -1351,1381-1529
ccatggctttcttcaacgcgcccgcccactccacctcctggtccatcgtcatcatcaacttatgcccgcgcacgccacaacactcagcagcagcagcagcagcctcgctcttcgccgcctcccatccgtgcttgttcaatcaccgcacaacgttccatggcggcaattgtccgtcaaatgaacacaaatgatgctgctgttgcccgggacgagcgccgttcgcgtgagcgtcgtcgtcttcgtcaactcaatgctcagccgcgccagggtcgccgactctcgacgccccgctcttcacgcgggcgcaacacgttgtcaccgcgcccgccccacaacgtcatcaccattgatgagtcggatgcggaagaagaggcgctgggcgtggcgcaacagcagccgcttgcggacgaagaccagcatttttacgacgacgagatgctgacgattgaagatcaaattgcgcaagggctcgtcgagggggcagccaacgaagtggtgatgatgggcaaccacccgctggctgccgccgaccgcgtctggatgatcgggaccgcatttgagatgagcacgctgccctcatcggtcaagggcattgtcgagcacgacgaagcggggcgcagaaatctgatgtgttgcatatgtcacgaatggatcatcggcggcggccaacgggtggtgcgcccgtcatgtggacatttcctccacgcctgctgttttgagcgtgaggcgaaattgcggcgagtgtgccccatttgttcagcccattttataagtgggaaaagaatgactcgttagggtcaaatttccggtggaggacgccattgaccgctcaaaataattaattaaaaaataaaaaacattttaattttttcttcatttcgcatttttgcttttttgttcaacatttctcattcattccattctttttatcatatttttatgttgttgccaatttttatatattttttctgccatttttaataaaacattcatttttatatttcaaaattcagtaaatttattcatttttccttgtgtgtgtgtgtatgtgttttgatgtgattagggggnggggggggttgcttacagaaaatgagaagcgctagggctttgggggagagaaatggtgccatttcattggaagggctttcacaaaatggtgaaatagggacatgcgcaaaaatggctttttgcatttatagtgtaatgcctggcgtcaaattgggcgaggtcggccctcgttcaccgatcagtctgatcacgacagcagcagcaccaatggctccgaccatcagcagcacgtcagcggagcgccgccgatgcgcgacagcagagatccggcggtgtcaaatttgggcagcagcagcagcagtggaagtgccgccgaaagtgccaacgttgcgccgagcgatgacgaagccgatgccggcgaagccgacgggcagcgactgaaccgtttctgcaaagtgattggcgcctgggagcgcaccgagtgccgtagccgcaacacgcgttgtgaggcggttgag

SEQ ID NO: 58549 - DNA, 2025 bp, Heterodera glycines
  misc_feature (472)..(472): n is a, c, g, or t
  Genomic contig location: Contig_ID=SeqID_5581; Location=492..2516; Strand=+
  SCN-specific regions: Sequence locations=1-63,88-105,170-507,529 -616,686-791,814-1283,1305-1823,1853-2025
atggctttctctaaacaatttgctgtttttatatttttactgcttcaacattcaattcgatctcaacaacaacagcaacaacaacaaaatgtgatcgagcaagtgaatttaaaaatttaattttaaaatgaatttttcggtataaaaaaataaatttcaaaaaaaatttgggtttttttgaaatttgaaaattttgtcagcaatctccgtctgcaacagctgctgagcaaactttgccattgtcagagttgcacaacacgttgaaccagttcctgtaccaactgaagcagaccggcgaaaaagttgtggcacaaacgccgcaaattgcgtcgccgttgttgttcaacgccgccgccgcagccgccgccatgggacaacagcagcaacggcacagtgccggtgatggtggtgccgcaacggctggcggcgggtgggataaaagcgcgacaattagggaggggggaggaagttnggagggtttttaggctagagtcggtaggctgggtgaataaaaattttgagaaatttcgaatttccgaattaaaaatctgcttttggtattagtaaatacctaaaatttgtgcagattattggggtttccagtgagaatcggtagaaattttttaatttttttttttatttttaaacatatttttaaaatttatcaaaaatatatacataaaatgtgccgtatttttccaatacctaaaaactccttttttgtcgaatgaatctattgtacgtaattgaggatgttatctcttccgtgccccggggctgcccaccctttatttcccaaggtttggttttttcagcggcactcccccctctgctgtgcgtccgttcgtcccgcttggtcatgttccgcttttccccagctctttgctggtgccaaccgcggcccatttgccgccaacttttcgactgcccgctaccgtaatggaacaggtgggttacagtacagtgtagtcaaatcgtaacccaataaaaatgaatttattactattgaacagcataaagctttcccaatggaaggctctccatcaaatccgccggtggtcattctgtctccgatgaacaacaatcaactgcagcactcaaaacggcacaaaattggcagcgccgaaacaactgctggtgacagtaccacaaatggcacaacgacagacattgtatcaactacggtagcacacagtttcacacacatattactgtcattatccaatccgtactcttaatatttatgcttcattttttaaacagattgttgccgcaccacctttgagctttagccaaacccctgagcagcagaatacagtatccgatgatcctcccactacggtatccgagttggagaatacggtacatgacgatgggcacgcaaccgttgcagcaacagatgtaaatgccaacaccagacaacaacagcagcaggttgtcgctgctgctgtcgttccaccgttggcggtgccaattgaaattgaaacaacgaatgacacatcgccaaatgtgacgggtaaatttttttttagggaagcaattactgtattagccggcggtactgttaccgcgtttggtttcgctaagaatggcacggccaatttttagtgcctgtgccatttgcatcgccagcgcagactccgccactcagcgtggaaacaactactgtaacggagccgacggtggttgacgattacagtagtcaaaggcagcgcattttttttgtgcccggaggcgtaaaaagcattgaatccaacggaagccgacagggtacggtatggggagaatgggatgattacagtaattgtttttgctaaaacatcataaaaaatttgaattttttaaaaattttcagcacttactgctgttgatcttgaggcttttctgagatcagctaacgtcgcgcgcatactttcgacttgggtcagtgatcaatcgttgactgatccattaactgttcagaaattcggtcatcaatttttggctgatcgatcggatttagcaattttttctaatgggttttga

SEQ ID NO: 58550 - DNA, 204 bp, Heterodera glycines
  Genomic contig location: Contig_ID=SeqID_5581; Location=2820..3023; Strand=+
  SCN-specific regions: Sequence locations=1-82,128-204
atgacatcctcacaagacaccaagctgttcttggcattggtcgagagagtgttggagcaggaagttgcacgacgactagcggaacaacaaccgaacaacaacaacaacaacggggacagcaacaacagcgagtacggggacaactccacacaacgcatgtcaccgccgcaacacaaccacgcggcggcggtgaacaccgctgtt

SEQ ID NO: 58551 - DNA, 401 bp, Heterodera glycines
  Genomic contig location: Contig_ID=SeqID_27882; Location=1103..1503; Strand=+
  SCN-specific regions: Sequence locations=1-401
atggccgcttccgacgtgttcgaggcaatgttccgttttgactccgcaaatgccacgacttccacttcaaaacgtaataaaactgttggcttaaaaacattccctcaagatttgggggaaaagtaaaatttagagattttttggtattttacagttaattttcaaggacatttttttgttttttcgaaatacatagagaaattagtgcaccccctaagaatgtcctaaaaattgaaatttcccgattttcagcgccttcggatttggccagcagcagcaaccctgtggtggtcagcgacgtcgacgccgatgtgttcagggcgatgttgggctttatttatgcggacgatttgagtgggatgaacggcgacaatttgttcgacgtgctttacgctgggtaa

SEQ ID NO: 58552 - DNA, 110 bp, Heterodera glycines
  Genomic contig location: Contig_ID=SeqID_27883; Location=99..208; Strand=-
  SCN-specific regions: Sequence locations=1-73,95-110
atgtggattcttattgaaaaatcaaaaattctttttgaaaatcatctgcttcgtcattctttttccatgtcgcttttacctcatttaatctttgtcggattatcgcactg

SEQ ID NO: 58553 - DNA, 58 bp, Heterodera glycines
  Genomic contig location: Contig_ID=SeqID_27887; Location=641..698; Strand=+
  SCN-specific regions: Sequence locations=1-58
agcccgtgaacagctgcatcggatgcaagtgccgccgttgctgtacgcctaacagttg

SEQ ID NO: 58554 - DNA, 267 bp, Heterodera glycines
  Genomic contig location: Contig_ID=SeqID_27890; Location=910..1176; Strand=-
  SCN-specific regions: Sequence locations=1-38,60-267
tataaaaataaaagtgatttttggtttcgggaccaaaggggggtgacaggatttttgattgaaaaatttttttcaccaaaaatcttccaaaaacatgtcattagggctattttatgacgctgatcacgaatacgtgatcagattttacttttgacatcgtcaagacctcagaatccctgtgtgattggggattctgaggcatcattttgaggggggagggggcaggttcggatccggacggtgtaacattatttttctgtgcatttt

SEQ ID NO: 58555 - DNA, 778 bp, Heterodera glycines
  Genomic contig location: Contig_ID=SeqID_27891; Location=772..1549; Strand=+
  SCN-specific regions: Sequence locations=1-127,149-280,302-457,479 -706,728-778
atggcctctgttgatgagaatgagcagcttgtgcaggaaattgtcgggaatgttctgtcggaatcagcaaaaggtacagacagacaatcgagcaaaatgagatgtgtaaattctttccatcttttcagaccaccagcaagaggagggaacggtaggttttctgagcaattacagggaattggataactgaggaacaccatgaaaaactaagcatcttatactggtttaacataaaacgcagaatatgaggttatcgttagtactggttcaaataagaggaaatttggcaccccattctccatgatgacaaattcaggaacaccaattgatggacgaagtcgtcaagatggacagcaccgatgccgaggcggaggaccatggagggattggacatgaagtggcaatttcggtcagtgacgtcaagcaggaagggtacgcagtggaaagtccggtgggagaggaagaggagaaagaaacggagggacaaaacgacggcgcaatgcgacagattgccgacaaagttggggtaggcgaatggaacggttcggacaaatcgaacacttgggggaaaacacggagtgttttctagggactttcactggacgaagacaaaacagcgaacaccgacgccgtcgtggaaccgccgatggccacggaagagaaggcggcggacgttggcaacgacaaaccgtcgggagagaatttgaatgaggaaaacaacgaaagcaaagtgggcacaaatggggttcatttaaccctaaaaccattttttgtgtag

SEQ ID NO: 58556 - DNA, 2115 bp, Heterodera glycines
  Genomic contig location: Contig_ID=SeqID_5584; Location=583..2697; Strand=-
  SCN-specific regions: Sequence locations=1-54,76-273,295-564,591 -834,863-886,919-1135,1245-1478,1504-1870,1892-1923,1975-2036,2068 -2115
  Gene Ontology: Mol. function=electron transporter activity; Cellular component=microsome; Biological process=lipid metabolism
atgctccgaatacggtccgccaacaggtgtgctcggcttcgcctgtacgcgctctattaacagggtaattgaggtgaaggacatcaacagcattgcgcccgtcgccgccgctgcccaacccattagggaagagcgacgacgacggatttgggacattttgatggatttaatttatacccacaggattacaaacaaataaatattggaccaatttgagtggttgttcttgagttgggtgaactgtttggttggctattgaaatgacggcggaccgaaaattacattcggtaaaaatgggggggggggtgagaaaattgtgcacacatttttcaagattgatcactcaactaaactgatcgatcaattattacatcttacctgcaaaataattccagcaacagcagcaggtggttggagactcgacctgtctccacggacgagattctcgtttaaaaaagggttaaaaacggtctccggcgaaaaaaaaattaaacattaaacaacaatttttcgtaggattggactgcttgctgctgctgctgctgcatggaggtgcttttgtagtttaatcatcatcattattattattggttgatttttggttgatctgtaaaacagaaaatgttacttgcccggtggaattcgaattttgaaaaatgtaaaaataaaataggaaattggaaattgaatattcattaaaaaaaatttgaaatttttttcccataaattgtttttcattttatataccgaaaattttatcattttattatggagaaattaggtcctaattggcatgaatcgttatttaccaattttagaattgtggttttagcgaattttttttttactttaaaataaatttgttttcacatgataagaatgttatttaaaatttccaaaaatataaaacaattttttcttattctcttatctttttttttgattatttttcttacacaaattctttccaaagcaaaaactcctcttcattttcattatttttaatgaatttatcattttattatttacagttatttctcgcaagaaattaattgctttccattcataaaaatgattttgtttttgcctttacttgttttcatttattatgcacttcgctacctttgggtatgtgaaaataattaaaaatattatattattttaaataaaatttaaactttttaaatgaatgacccaattttttaatttaaaatattatcataaaattaaaaatttaaatttttgcataaaactcccctaccaaatccaggaattaatcccgcttcaaaatgcttcgaaacgcgctgtttttgtcaccggatgtgactctggttttggttatttgttggcacttaaattggcacaatatggaatgctcacatatgctggatgccttactaaacaggtatggcatgcgcaattttgcatggttttcagtaattagactcagaaaataagataattagatgataatcaccaaaaaaataaaaataaaattttattgtggtctaacaaccattttttgattattgatgacaaaaaattctgaattcttgctgaaaaagtgaaggttttacgataacacattttggcattttctcaaaattaatgcttacaatattccaatgattaatttacggcaccaatttcggcagtaagaatttttttttaaattcaattatactttttgtttggaaaaatatatttatgttagccatattattctttcactacacaatagcagtatgtttaagggacgcgatgaactgattgaggaagcaaaaaaacgtggaattgcggcaaaactcaaaacagtgccattggacatcacccaggaccaatctgtgaatgatgcagcggattttgttcgcaaagatttgaattctgttggaaacattggcgagttgttgttctgtcctggacttattttgattttttttttaatttaattaaaaaataataattttttatttacagaattgtgggctcttgtgaacaatgccggcatattcaggtacatttgcttttcatggatgatattttattaaatttaaattgaattttatagctgttttgggcctgatgcttggacatcgattgatgagtgagaataaa

SEQ ID NO: 58557 - DNA, 157 bp, Heterodera glycines
  Genomic contig location: Contig_ID=SeqID_5584; Location=2542..2698; Strand=+
  SCN-specific regions: Sequence locations=1-81,103-157
atgtcccaaatccgtcgtcgtcgctcttccctaatgggttgggcagcggcggcgacgggcgcaatgctgttgatgtccttcacctcaattaccctgttaatagagcgcgtacaggcgaagccgagcacacctgttggcggaccgtattcggagcatg

SEQ ID NO: 58558 - DNA, 1218 bp, Heterodera glycines
  Genomic contig location: Contig_ID=SeqID_5585; Location=1261..2478; Strand=+
  SCN-specific regions: Sequence locations=1-81,103-430,453-545,570 -573,614-720,743-1218
atgcttttccttcctcgtcttggtactaattgtcgtctgtgtccattagccttgggcaaaattgtcattgtgctgcttcattttgtctgctttatcaaagtggtggacggtgaagatgaacatcagcagcaacagctgcaaattgaccatggcggagctgaacaaagtattgaaatttgaattggaaaaatgattgataggcttagtcgggttttgaaatccgcttgaaaaagttgtatcctacacataaccttacttttctgccccccggcattattcggactcaattttggccaaaatacctactggactcgtttaacccgaatttttgggataaaattaaaaccctggattgggaactcttaattatagcaagattcgaactttatcagggatttggtgttttataaatgccggccaaaaaataaggaatttaaaaattatttttatttgaatttaccactaattttcattactgctttaagtctgcttcgagccaagagatttgggtgtttcgtgcccaaaggacggaccgggaaaaagcaaaatgttttattacaacaaaattttgggtatttttttaaattttaattttaaatattttttttatttaggttcttgccaaccatttatctacaaaggatgtgcaggaaatttgaatagatttatctcggcgacagaatgccgaaaaacatgttcaaaattgtccaaaaagacccaagaatgggttttaggtgaggcaaggaaattaaaatgaatcaacggattaaagcgggatttaaagctggaaagaataaaaatttgtgatccgaacattcaaaaaattcagctgaacggtgtaatgccagtcacctcatcccggatggtcattacatcgaatgtgttgcagggaaatgcccggaagggcataagtgccatcccgccgatggtatatgctgcccaagaaaaggtaaacattatctggaattgagtacggtatcatatccagacatgtcccattattaggttaacgaacggtaaaaccaattacggtattaaattattcaaaaataaattcagagtacgtctgttctcttcaagataattctggcacttttgctgacggagtgccggataagcctcgcttcgcgtggagtgccgacattaaggtgcttttagcgtttttggttttgagcaccgcctaattaggctcgctcattagcccgttttggaatttta

SEQ ID NO: 58559 - DNA, 98 bp, Heterodera glycines
  misc_feature (29)..(29): n is a, c, g, or t
  misc_feature (41)..(41): n is a, c, g, or t
  Genomic contig location: Contig_ID=SeqID_5585; Location=1..98; Strand=+
  SCN-specific regions: Sequence locations=1-18,69-98
agaagatatttcccgatgaatattttttntgttattcattntattaaattatgttaaaattttaaatagacttttccaggaataaaattcatttttta

SEQ ID NO: 58560 - DNA, 1057 bp, Heterodera glycines
  Genomic contig location: Contig_ID=SeqID_5586; Location=60..1116; Strand=+
  SCN-specific regions: Sequence locations=1-49,71-732,754-916,938-1057
atgctaaacagaaacaaagcaaagtcagtacaaacgggaccaaacccggagtttccagaaagaagcaaagcaaagtttgtacaaatggaaacaaatccccaattgacagacggaagtgaaggaaattcgataagccaaaaatcaacaaacttaagaaggcttaaaagtgagagcaatactgataaaagaaggtttttggaatcaaaaaaagaaaatcttcgaatggctgactcgtcgcgtgattatggtcccagacatcgacaattccctggccatgaaatatcgccgaatcggtcccaacgatatcatgatcattatcatacacattcaacgcgatatgcccctgaaatatcgtcgagtcggtcccaacgatattatgatcattatcatacacattcaacgcgtccttcttatcggcgaaattcatcaccagaccgacagtcttctgctatacaacaaggatcacaacattctgagaattattcaacgacagatgctgatcgaaatggaagagactcatcgcaacagcaccatcaacattacagccatccaagctcgtcaaagagtcaacggagttattcttcgcctgatcagaaaagagcatcttcgtcggaaagtcgtagaactaattattcttcttctttggaccaatatattgatcctcagtctgcacaagcacaaattattcaaaatccaacccaagacgaccaaacttcagaacacagttccaaagaaacaaatcaacaaaaacaaccggtatatgaacagaatttagaaaatcaactatatgaccctctgcagccttcatctttaaccaccaacgcgcaagcatacaatcaacctaaactgttacaaacttctcatgcttcacatggacagccaatgtttttgccgatgaattatcaccagcctttattgcaggcacaagctgttaatgtatcgactcagcctgctggctttcctttacatgcttatccactgcaaaatccgactcaaaccaattttatttatcaatcaggtatgctcacatgataacagccatagacagactcggata

SEQ ID NO: 58561 - DNA, 1207 bp, Heterodera glycines
  Genomic contig location: Contig_ID=SeqID_27892; Location=132..1338; Strand=+
  SCN-specific regions: Sequence locations=1-182,204-271,294-1207
  Gene Ontology: Mol. function=structural constituent of muscle; Cellular component=Z disc; Biological process=leading edge cell differentiation
atgccatgtttgcttgtgccagtgtgcgttggatcagctcggcttctcccccgcggagaagggatgggtgcgcgagttggccacggcgtgcgttctcatcggcgaggcgcaatttggcgaacggcacggcatggacatttcctttgtggaggaaatggcaggtgcattcattgccagatgagaaaatatttgtccccaaaaagccgcgaacgctttacagaagttgaagcggtggctgaactgctcggcatccgtgccaatgctttggtggacgcactcactcaggcaaagccaaccaatttgaaatctccagacatttacgattctcgactcattaatcacgtccgttcagccatccatccgcgtcggtgacgcgctcatccgccgctcgcagccattgcggaaaacgctttgtgccgcccagtctttggccaaatgcgtgtacgaacgactgttctcgtgggtgctgtccaaatgcaattcggccatacggcggggccgaacagggagtggccaaagcgatgaaacggacggcggaagagaggccaacggaatggtcggagtgttggacatggccggcttcgaaataatgccgtgcaattctttcgagcagctttggtttggctgtgcatcttcgaatccaaaagtggcgcccattaagcattaattacaccaatgagcgacttcagcagtttttcaacgaatttatgttcattagggagcaggaggagtacttgcgagagggaatcagctgggaatttgtgaaggtaaggcgaaacgggggatgactcatttgaaatggggcgatgactcatcaaacaaacgaaggacttcggcagagacttgcagccgaccatcgatctgatcgaaaaggttgtcgactacgtccatttgggcatttgtcatttggcaatttcagccactcggcattctgtcgctgctgcaagaggagtgcattgtgccgaatggctctgatcagtcgcttctcgacaagttcgtccttcggctgtcttccgcctcccccggggccacatttttcaaggccaaacaatccaatcggtaatcagcagctgttcttccccatgtgtactgaacagatatcccctcatcaaacagagtgccaaccccccatcacttcacaatcgcccattatgccggccccgtcagttattccgtggacggatggctggagaagaacagagacgcg

SEQ ID NO: 58562 - DNA, 1204 bp, Heterodera glycines; identical to SEQ ID NO: 27893
  Genomic contig location: Contig_ID=SeqID_27893; Location=1..1204; Strand=+
  SCN-specific regions: Sequence locations=1-214,236-257,280-818,841 -947,969-986,1029-1152,1176-1204
  Gene Ontology: Mol. function=protein kinase activity; Cellular component=cytoplasm; Biological process=synaptic vesicle transport

SEQ ID NO: 58563 - DNA, 790 bp, Heterodera glycines
  misc_feature (668)..(668): n is a, c, g, or t
  misc_feature (729)..(729): n is a, c, g, or t
  Genomic contig location: Contig_ID=SeqID_27899; Location=722..1511; Strand=-
  SCN-specific regions: Sequence locations=1-135,157-561,587-615,689-790
atggcatttgcacttttttggttgtcgggaatgtgcacagttagtgccgatgatgtttaatctttgggtttggcgtgaaccctccgcgatattttgcgtcataattttttttcttactaaaatgagttttgaatagcggcgggcgcaggaacagaggtcggtgataaaagggcattttacatttttattttcgttcgaaattttttctttgaaaaatgttccctggtggctctgatgtttaacggaattcgagttcgtttaatttattaagctaatatgccgtcttaaggtgttggattcaaaaaatgaaaaactgtgtctaaaaatggcatttgcatttattctttgacatttttttggcgaaatattcccatgatgcttaatctttgtgtttggtttgcactcgtgcgcacattctaaggactcgtttctctgaagaatgatttttcagggaaaaacgatgcgaaaaaatgtcgcaaaaattacaattcggcgaaatgagcggcgaaaaataaatttgatcacacggacaatgattgatgagcgcagcagaatgattttattctgttgctgctgctgctgatgagcaaacgcagcagagcagcgcaaatgtggaaataattatgaattataaaaatcaaaaagaaaaaatattcgaaaaaaaaatnttatttaattaaattaaataggcaaaaagaaaattgatattaaaaagtactaaattcaatntaagaaaaagtggaaaatatatcaagagaaaagtttgttgaaatgaatttgaattaataaa

SEQ ID NO: 58564 - DNA, 696 bp, Heterodera glycines
  Genomic contig location: Contig_ID=SeqID_5587; Location=881..1576; Strand=+
  SCN-specific regions: Sequence locations=1-95,119-666,688-696
atgacacaaatggctaacagacaaccgaaacggctcattgtcatcaaaagcaatataaacactacgccggcaagtaaaataccaaggttgtcgataaataaaaatcgaaagaatttaattcatatttaaatctggaaatccggtctctgggaatgacaattcatcctcccttcatgtttaagagttggagggcatgaccatttcacgccaagtcaacataaaactcctaaaaggaagcgacgaaatctgactgccgaatttaaaagttgcgggaacacaaagaggaaaaagttaataaaaagcataggataagcggatgatgaactctttaaaggtattgcgtggatgcaacttcgccattgggtcggccaaggtcggcatcgacaagcggagggagcaaaagtcggaagaacgtggaacttgtcaagccgacgaatacaaaaaaaattttggattattttgaacgggttcaaaatgctgcatcttctccatcttttcaatgatttttttttcttatttgaattgaagtaaattccaatttttcagagtaaattatgcgtgtcatccaaatttgttaattaacatttactcttttgcattaacacatgttcaaaaggaactcaattaattgttttcggatgttcgatttttcggaagaccctttggtcctctcttttttgtcctctgcgcaaacga

SEQ ID NO: 58565 - DNA, 373 bp, Heterodera glycines
  Genomic contig location: Contig_ID=SeqID_5587; Location=1..373; Strand=+
  SCN-specific regions: Sequence locations=1-110,132-146,168-373
tatgtcccctctcttaacagttcatttccaggtaattacctttatgctgtttgggtaggggtcggaattgacaaaagtactttcatgttgaggatcatatcttctaacgcattttatttcttaaatttaagtgcgaagtttgcggacaaattttgtcaattcattttttgtacaatgcgctgcttcacctttctctgaccatcttttatgtggctcctctttttcaaaggcttttatttgggatttacaggtgttcataacgtttgtaattgtttacatttgttcagttttaggaggatcgcaaatattttcacgacatttcgtctcattatggaaaaaatcatgcacataaaaggaataaaaaaatgttacc

SEQ ID NO: 58566 - DNA, 1135 bp, Heterodera glycines
  Genomic contig location: Contig_ID=SeqID_5588; Location=216..1350; Strand=+
  SCN-specific regions: Sequence locations=1-256,282-1135
atgtctctgctgaaaagcgtcgactccaaactcggcgatgaaattctcgccaccatcgtggaaacgacggacattcgactcgacgacatcgaaggaaatgcaatggcaaaattagcgctggaagaaagtgttgttctgcctgcactaaacccgaaactcttcacgggtctgcgggcgccgtgcaccggaattttgttatttgggcctccggggaatggcaaaacgatgctcgtgggttattaggcaaattcattggctaataaatgaaaatttaaggcaaaagccgtggcgagtgagtgccattcgacgttctttagcatttcggcagcgacaattatgtccaaatgggtgggcgacggagaacgactggtgaaagcgcttttccaagtggccagaaatgcacagccatccatcattttcatcggtaaaattaaaaaagggaaatgagtaattcaaagacatcgaacccaataacatcagatgaagtcgattcgatgctttgtcagcgttttgagcaagaggacggagcagcaaggcgagtgaagacggagtttttggttcagttggacggatgttcttcggaaaaggaggcaaatggccacgttttggtgttggcagcaacgaatcgcccccaagaattggacgaaggcattttgagacgatttcctcagcgaattttcatcgatttgccggacaaaaaagcacgttttcaaatgattcgaaggacttttgaactgaacagcaccaacttacaaattgaagatgccgaattggagtaatccgtccggtactcatttgtcaaccaaagccatttttcaggaaaatcgctgcaatgactgacaattactcgtattccgatttgaaggccctctgtcgagccgccgccctttttcccgtgcaaagtgcgagaatggaaaacagggatttgaggcgatgtacggctgaacaattgcgcccagtgaatgtagccgatttggaaaatgccattcgcagtgttaggccttcaatcaatgccgaaagcaggaagaaattgatcggatttgcggaaaaccacgcaaaccaacagacataatttatttttgtataaactcaattattgttttttttgttacaaaattgttgctaaaagcattca

SEQ ID NO: 58567 - DNA, 736 bp, Heterodera glycines
  Genomic contig location: Contig_ID=SeqID_5588; Location=1866..2601; Strand=+
  SCN-specific regions: Sequence locations=1-35,57-526,550-736
  Gene Ontology: Mol. function=cytoskeletal adaptor activity; Cellular component=clathrin vesicle coat; Biological process=Golgi to endosome transport
atggcaaggcggtacatgataatgtttgacagtttaaaggaacaacaagaaggggaagttcgcagcactgaagcaatgtccgaattggtcggttttggggcatcggaattaaaaatggaacacaatttgttgaagttgcaagggatcgcttccttcaccaaaagtgttcaacagacgctgaacagttacgaggtgcgcaaattgggggacaaagtgcaggggtacgtgatgaacttcacggaaacggagcaaaaggtgcgggaggcgacgaacgaggacccgtggggtgaggagggcaaatgtaccgattggaaggaaaagcaaagaatttaaggaccgacggggccgcaaatgcaggaaatcgccagcttcaccttccaatacgaactttacacaggtgactgactaatcactgcgttgttttgcaattcattttttatacagaagttatgggaatgctatggaagcgaatgtttcaggagaataaattggcatggcgacgcgtctacaaagtaaaacgtgaaccaataaattcattcatttattaatgttgccatttcagtcactggttttactgaattatctgatcaaaaatggtagtgaacgtgtgatcagaaccgcgagggaccacgtcttcgaaatgcgatccctcgaaaattacaaatgtgtggacgagcggggcaaagacgaaggaatgaatggtctgtctgaatttggttggccttttgttggatga

SEQ ID NO: 58568 - DNA, 767 bp, Heterodera glycines
  Genomic contig location: Contig_ID=SeqID_5589; Location=1070..1836; Strand=-
  SCN-specific regions: Sequence locations=1-202,224-767
  Gene Ontology: Mol. function=UDP-galactose transporter activity; Cellular component=membrane; Biological process=transport
atgctgttcggtgtcctttttgctcacaaacggtacggacttcgcaaatacttttacgtgcttctcatcgtcaccggaatggccatctttttgtacaaacctcagaagggcagtgtcggctttcagttaggcagtggcgaattgtttctgtgtctgtcgttggcaatggacggattcactggcgccgtccaaggtgccctcctttccttccccataaatgcatttctcacccccccctttttcagacagaattcgccattaccacaccaccgacaaatggaccatgatgttctcgatgaacgccttctcttccgccttcctcaccttaattcttctcgccagcggcgaactctttcagtttttccgattcgtcgccgcttaccctttcattcttcagcaaatgcttctcttctcgctgtccggtgcggttggccaggtcctctcgtcccatcccttttttccattctccgtttaattaatttgctcgttttcagtgttttatcttcaaaacggtcaccgatttcggccctctcacctgttccatcatcacaactcttcgaaaactcttcagtctcgttttttcgatcatcatcttttcccacccttacacaaatcgacacgtgctcggcattatttttgtgtttgccgcgttgattttggatgccattgacagtcggaaaagccatggaaaagcaaaaggggacgaaaagccaccagcaaaggacgggcttctccaagaagcgactgcgcaggagaaagaaaactga

SEQ ID NO: 58569 - DNA, 327 bp, Heterodera glycines
  misc_feature (7)..(7): n is a, c, g, or t
  Genomic contig location: Contig_ID=SeqID_27902; Location=34..360; Strand=+
  SCN-specific regions: Sequence locations=1-327
atggacncaagcaaaggcttttacaacagagaagaggaaaaattgacattggccattgatgtcacagtgaaagatgaaaaaatggacaaattcattttggaacaaagcaattccaatgggacaatttggatggacattgaaaaagtgtcggaatttgcacaagaagtcacttggagtgaacgtaaaagtgaagcggtgcacatcaacggattttcattgcgaatattagcacaaataagtccgaaaaatggaagcactggcaatgagaaattgttgggaatttaccttttgtgtgcttctccaacagaaggtgtaattaaaggctaa

SEQ ID NO: 58570 - DNA, 328 bp, Heterodera glycines
  Genomic contig location: Contig_ID=SeqID_27906; Location=1244..1571; Strand=+
  SCN-specific regions: Sequence locations=1-96,121-139,162-328
atggaaatttttgacgagtttaccatttccgatgaaaattcaatttcgttttttaccgactcaaaatttttaatggagtcttctttcgctgcaatgtaaaatttataaaaaaaatattatcctaattgtagaaaatacctaaaaaatattaaaatattttagcgaggccctgctcgacagtttttggctgaaattcaaagatgtgggaaacgttcttgaacaaaatgtgccattagcacaaatcattttatgggcgtgggacgacaacggggcacaagtcatcaaagaagtgattaccgaccaaaatgctgtttcacaaaattcttaa

SEQ ID NO: 58571 - DNA, 140 bp, Heterodera glycines
  Genomic contig location: Contig_ID=SeqID_27909; Location=1223..1362; Strand=+
  SCN-specific regions: Sequence locations=1-98,120-140
attagcaagaacattatggtaaacaagtttttaccgctgatcattttcgtttttctgctgattgacaccgccatatgtcgccatcaccatcggcactcccatcatcaccatcaacaaaatgagcagccggagatgatcag

SEQ ID NO: 58572 - DNA, 1065 bp, Heterodera glycines
  Genomic contig location: Contig_ID=SeqID_27911; Location=141..1205; Strand=+
  SCN-specific regions: Sequence locations=1-99,121-738,760-1065
atgcagcatgagcctgcggacccgcatttccctaaacgaaagaagcatcaagtgaattttgtcactgcaaaagtggcatgcccggattgcatttcgaccggaaaatggaaagaaagccttattggaaaattctgcaaaatttgcggctatcatccgacaataacattcagtcaaatgccgttccgtgagacaacggtcgacagacaaacaattgaccgccaccctcttgttgcattcgttaaatggcttctctacaaacttccaaatcaatacgaaacaattgcctattcccatttcggcggacgtttcgacatggtcttggtctttcgggaacttttcatggagggactgaacccctcaatgatcagaaagggaaaccgtctgttcgagatgagggtataattgtccatgcgttttttatttaataattttcccatctcaggtgaaaagcagaaagaacttaaacccgaatgtgacatttcgtgattcttggaatttgattccgggactgctcgcctcaatggtgcccatgttcggcttggacgtgcaggacaagcccttctttccacacatggccaacaaacctgacaattatgggtgcaaaattttaccggcgaaagcagattacctggccgacggaatgatcccagagaaacggaaacaatttgatcaatggtaccagcaaaacaaaaatattccgtttctgctggatgaagcattggcaaggtgaatatgaataaatcaattttgacaaaataataaaaaattaagctattgtaaaaatgatgtcgacattttaatggctggactcatcgcttttcgaggcgaatttttggagatgacaaaacgaccggcaggtctcgatggaaaagcagacagagcggcgtacaaaacagcgcataacggcattgaccctgttcgacattgcgtcacaattgcgtcagcctgcatgcgccattttcgaactaatcacctaaaacctggacatttggcacttgtgccagagaagggttacgacagctgtggagataatcagagtgaactggctctcaattttatgcagtg

SEQ ID NO: 58573 - DNA, 3413 bp, Heterodera glycines
  Genomic contig location: Contig_ID=SeqID_5590; Location=198..3610; Strand=+
  SCN-specific regions: Sequence locations=1-111,286-533,556-882,950 -964,987-1195,1231-1410,1438-1564,1599-1667,1689-1771,1793-1881,1903 -1920,2011-2769,2812-2819,2842-2895,2925-2966,2988-3252,3274-3413
  Gene Ontology: Cellular component=nucleoplasm; Biological process=N -linked glycosylation
atgaatgaagacaatgcgaaagatcgtctggaggaatttattggcgccgagaaaacagaaaaagctcaattactgcttagattaaatggggaagagtacaaaggatttgtgaaggaaatgaaagagaaagaaaaattggaaaagagtgaagaggaaaaagaaagaaacaaaaagaaaagagaagaggcggatgaaataatgagaaaactaatcgaagaggaaagaaaaaaagaagaattgaagaaaagaatggaggaaatgcaacgagagaaaaaagaaagaagactgaagcaacgagagttgcagagaatgaaagaaaaagagaccgaaatggacaacggggacggaagagagcaacagaatgaagacagagaagccagtgaagggagtcagagtgaggaaaatagttcttcattggcagagagttttgtcataacgccaaaaagtgtgccgaaggaaagaaaaaacggaatatttgaaaataaggaacagaacggagagaaagaaaaaaaggaaaatgaattattgtttggaagagaagaatggcaaaatgagttggacaaaacaaaactgatcggtgagttatttggggagcgggaagtaggagaccgggattgatcaccaatggcacaatattagcatccgccaagttatgatcaataattcctaatttacggtatataattctgacaaatttattgaaaatgtataccatttttcttaaaatttaagtaaattctcaaatagttcctcggaagcgtgtatctttaatgcctgtccccaaaagttccttagttttttatatttgatattttcgttactaataattaaaatacgcataaagtaaaaaaaataaccgcgttattttaaggtcatggtaagtaaatatactaaatattttaaattatttattctttgtaaaattggttaatttatcataaaatttaaaggatttaagagataaaaaataaattcccaaaaagaaaatcacaatttactagagtgcagcgggaccgggacctgaacacggacaactgagtaccaaggtcccggttttgaccagttttgaccgggatcgggaaattcccggttttcccagccaaaaagtcccggtttttcaacccaaaaagtcccggtcccggtcttgcccaaatttcccggtcccgctgcactctacaatttacaataactatttctttttaaataatgtttattgttcatttaagattttacatctgatcaatttttacatgaaaaaattgatgcatttctccaaaatccatcagagacaaagaaacacatgttggacattggggtattcgtaaacgaacttcggcatcggatggaaatgatcagacaattaagcaaatttgagggaaatttggaaatggaacaggcagaaattgccgtaaaaatagaaagaatggctaaaattgatgagaaatggacgcaattgaaaagggaattgatgagggataatttgatcagagatcggacacaatttgagggagtgatcagtaaaatgtaccgtcttttgaagcaaatgatttcaatcggagaagcgaaagaattgcaggaagaaaaggaagagagaaaaatggtggccaatcagttagctacggtagggcgagaatcaaacgcggaatgggaagaagatacggtagaagacagagaaaaagctgcgataaagtcagtcaaaattcaattgcacaagaataaattggcaaaagcaatcttttcgaaagaaaaacgggcaaatgaaaacgcagagaaaaacacattttgggaaatggacagagagcaaaaaagtgaaattcttatggaactctttgaatacgagcgacggaaaacaaaaatgatcagccgatttgaagaacatttggagggatggcagaaattggaggagcagcaggaaattggttatttaaaataaataatatttgcaaatttaaaaataaaataaaataattatttattaaacaataattcattgtttaaataaaataatttcagacagaaatttacggggacaaaaaaatgcccagcaaatctattttgactttgctcgcccccatttggaggttaatttccccgaaatttcccaacaaattcgcaacgaccaattggaaaacattcagcagaaaaatatggtaatttttggcactttctaacaaaattgaacacataattttacagtttaccgattttataaaagaaatcccaaaaagtgacgcaaattcagtcggtgccgcatttgacacattgaaatcaattatcgaaaaatgggtaaaaattgttgtttattatttgaatttatattacagttcatcttgggcttttgtaccttccgtaaaaataattagcatggggaagaagcgtcagtcacaacatatacattttttagtttcataaaataatattttgaaaagagccgaatccttagctttttataattaagaatttcccgacaaattattggctttaatataattaactctttaataatccgctgaccattttcccatttcagtcaaatggcgccgcccgtctcatcgtttcgggctcacatttccttggaacgcgcactgccgactcggacattgatgccatttgtgtggtgccccaaaaagagtcccttaggggggaaagggagaaatttctcggctttttcaattgcgttttgaccattcaaagggagcaacgaatttgttctgacaattcgctgcactgccaattttgcaaagtgagcaaaaacaaaatggaacagagaatttaaattgtttaaaaaaacttaattaaaaatataattaacgcatttatgagaaatatatacaaaaatttgaaaatattgttgaaaatatgggaaaattttttttgatattctttcatcttagaggaatatatttttgaaaattttaaaggccgatgattttcatgttgataattaggcacataaactcaaaatcaggtaaaaacaattcattttaatatttcagcacgcaaatgtggaatatttgaccaaattcccgagtgtccatatccaattgataaagctgaaactgctcggcgttgagttcgacctttccttggtctctgtgccggacatggaattgctgccggacgaaccgttggaagcagtcgacgtggaactgatgatggaaatgatagccaaccaaagagtgccgtccgaagttatgctcaaaacgatggctggtaaaagaatataatttacctaattgattcataattaagctttcaattttatttttaattgcttctgtccccataggttatttggacagccaccaaatgattggactaatcgcgccaagaaaccggccaaagttcagaagcttcgtcattgccttaaaacactgggcaaaacgtgaatttaatttattcaaatttttgaa

SEQ ID NO: 58574 - DNA, 861 bp, Heterodera glycines
  misc_feature (743)..(743): n is a, c, g, or t
  Genomic contig location: Contig_ID=SeqID_5590; Location=3838..4698; Strand=+
  SCN-specific regions: Sequence locations=1-209,231-316,344-625,647 -666,688-769,791-861
atgccggtgaaattaacgcaacaaattggcacaacttttgacgcgttcgcttggaacacgtcggcagatgggcaaaaaggcgcattaatgccaataataacgccgggaaaattggcgcaaaactgtgcaattaacgtaaacgaatcgacaattaaaatattacaagacgaaatgagagaaggtggttaattgggcaattaaaatgatattttctgtcccttttctttttcagctcatttgtatttgaccaaaaggaccgccgcaaattttggccaattgttttctcagcgaaatttcgttgaaaaagttggctaaatacattgtaattaatttgctaattgttcttcaccctttttacagttcgaccattttttgatcatttcatgcattgtcagcctaaacggtcaaattggtcaattttgtgactttgtccaaagaaaaattcgtcaacgtttggccaatttggatcaaattttggaaagattcgtccattatagccaagtaaatccggcaaagaatggcgcagattgggcgcacagcgacaacaaatgtcccgagaaaatgcgacagcgcttcgaaaacattgagtgaggctgaagcggcaatagcggcgccattaaatgaaaagaaattatatatttatttaatcgcttggcaatagcttaacaaaatttcctataaatatgtagagctttagaattgtgccaaactttaaaatttggccaattcggaaaaagtattanaaacctacaaattgcatccctatttattaatttaaaagaaaagagaacaggccacgaccccgggtccgatctataagaagtttagttcttggtgatttgacgggagttgggtggttca

SEQ ID NO: 58575 - DNA, 941 bp, Heterodera glycines
  Genomic contig location: Contig_ID=SeqID_5591; Location=1325..2265; Strand=+
  SCN-specific regions: Sequence locations=1-395,417-941
atggcgcccactacacgacttatgcagcacaaggtcgtctgtatgtgccatggctccgtgcccaactggcggccgaaagtggccaagggttgctgcacttccgacgccaacagatcggctctttgcaggaggtgcgtgtcaaacgatgctctattaattcctcactaattgtaagctggtcgactcggatcagttccgtttggtggtgaattgtgccggattggacggcggacgcttggcgggcgatgatggcacttccgtctacccgaacagaggcattggcatcgaagttagtggccaaggctttatttggtcagatgttaaagcgccttttctttctttgcctcttattttaaaggttgaagtgactggacattcccatttcaactactgggaagatggcatcttttgccttccgttgtatggcaaaggaatggccaaagaaaatttcttccaattttcagtgtgtcaaatggccgctttttaattggcacagttcgacaggacaattgttggcagttggaagtgactgaggaggaaaagcgcacaatttggacacgttttgttgatttgcaaccgaactttagagtaattgaaaaatcataaacacaaattaatgttgatattaacataaaatattcatgggtattttttgtttcttcaaaggatgccaaaattgtctccacgtggtgtgggctgaggccaaaccggcacggcggagttcgacttgagcatcagttgcgcaccaaatccaacggcacaggaacagtgcatgtgaattcttgcaaaaacttcaatatcccaattagagggtttagggcaatgggttttttttggtctcttaattaaagaagattcggaatgatatggggaagggtaatttggaattctgagcgaatttaattatacttttatagatcatgaagaattttcattggtaa

SEQ ID NO: 58576 - DNA, 127 bp, Heterodera glycines
  Genomic contig location: Contig_ID=SeqID_27914; Location=251..377; Strand=+
  SCN-specific regions: Sequence locations=1-127
ctatgacccgaccggcattactcatgttcgactcagcccgatggagaaacttcaggaccaaatgctggaagctgctaaagaacgtggaacccgcgattctaagggctattgggttggaaaacaatag

SEQ ID NO: 58577 - DNA, 1378 bp, Heterodera glycines
  Genomic contig location: Contig_ID=SeqID_27915; Location=296..1673; Strand=-
  SCN-specific regions: Sequence locations=1-651,673-911,933-976,998 -1324,1346-1378
atggctggacccgactctcgttttattctcgaattcttcaaccgtgaggctaaagagattggagtaacgcaggaattgcttgacaattcacaggtttttgactttatgatcgtttgaattttatttttttttattcagccgtccgatcagttgatccaggcctactactttctgtgtgatttgatttttgaaaatgtcggcaccaccaaagagaacgagtatgaaatggccactgaactgacgagggctcgtccccagatgatcatccgaacgcaacagcattggtacgttggtttttgttattttgatcttacaattagtattttcgtatagttttatatacattgcatccacaatttgttcagcaatttggtgtacaacaagttgttcgatggttctaacgaatttctctactccgatctatttcaaccggacccctgcagaacgaagatgcaaattgctcaactgattcgcttgtacaccacaaagtgtgacattgccaaagagctttcggcggtggacaatcacattgtgagtgtataatttggcggagtttactagttttagtttatcaattgggctaatttagtcggaatttacaaatttaaggatgaacaaatgaaagcgcatgactttgagaagaactgtgaacgttccacacatgctgtatgagatgatgtgtaattaattatacgcggaagagtttttcccttttagcaactgaaagatcgcgaagaagcgcttaaccgcatggagaagcgaaatgacgaaatgggcagcaaagtgcgacgactcaaggacaaattgaacgatcgacaagcgctagcggaggatgagaaaagaaatgtcgaacgcattgacaaaattttgttgggggcacagtgcgaaaatgcaagtgaaaaatgaaatgctgaaaaaggggcggaaaattgtcaaaaactttggatttattaacatattattagtgatttttcgcttatttttaataaaaattataggacgaatgcaagaaattgtttgcccaggaagaggaaaaccgcaagcgattggacaacaacattgtgaactcaccggaacgcatcatcgaagagctgtccaacatggaggtcgaagtggaggacatccgtcgcaaaaatgatcaagcagtgtcagttgtccattcgttcggtttttgtaattggtcatttattttgttaggcaaaacgaccgaaagttggagagggaatacggcgaacaactcgtgaccagcaaatgcgtggagagtctgatcaacagcatgcaacaattggagatgatgcaggaacaaatggtggagatgcgggcgaaggaagaagagcgacgaaaggtcgtcccatttggtgatttaataccagtttaa

SEQ ID NO: 58578 - DNA, 646 bp, Heterodera glycines
  Genomic contig location: Contig_ID=SeqID_27918; Location=95..740; Strand=+
  SCN-specific regions: Sequence locations=1-646
atgggtcaaatcaaaaaattaatgtgtttgtgcacatctacaaactcttggctttcgaatgacccagggttgtttgggtccggacccgggaagtgccctaaaaagggaggacaagcgacaagcactttggtcgcgatttctgtgtgtcattggttcgatttcttatttttgttttctgttcacttttgttttccgttcaccttttttgtttgccatttttaattttatttatatcgatggtgaaatttgggtgatgcaaatgtacgaaaatggcccttaagaaatgggccgttaatgtacgggacacaaaagtcgggccgtaaatgtcgggcgccgcaaatgtccgattttggcttgggacgaaaaattcaatcctttttgcgtagttcaagtcctgaaagtggttatgagtgtctttgcgattgatatacatttcgtccatttttggctctggactatatgaacgatatatgccaaatcacgcgagctatttattaattagcaaactaattaaggaattggtacaagtggctaatgagttggacaacgaggaggacacattgacattggaagccgacattcagatcaccaattaaccaagagatgaaaacaaaatatcatgtttgttttatcatttgataaggta

SEQ ID NO: 58579 - DNA, 429 bp, Heterodera glycines
  misc_feature (13)..(13): n is a, c, g, or t
  misc_feature (127)..(127): n is a, c, g, or t
  misc_feature (133)..(133): n is a, c, g, or t
  misc_feature (156)..(156): n is a, c, g, or t
  misc_feature (160)..(160): n is a, c, g, or t
  Genomic contig location: Contig_ID=SeqID_27918; Location=846..1274; Strand=-
  SCN-specific regions: Sequence locations=1-249,338-339,362-408
atgggtcaatcanaaaaattaatgtgtttgtgcacatctacaaactcttggctttcgaatgacccagggttgttgggtcccggaccgggaaagtgccctaataagggaggacaagcgacaagcactntggtcncaatttctccaaaaaagaaaganaatntaattaatttgtaagggaggtgtggaagcggaccaatagtcaagtggttagtgtgtctgcctttggttatgtggtgtcattggttcgatttcttatttttgttttctgttcacttttgttttccgttcaccttttttgtttgccatttttaattttatttattttattttagttttttcattaattaaatttattaaaaaagatatttggaacggagcgccctctagagacagtgcaaatagcgaagctatttcaattttaaaaataaa

SEQ ID NO: 58580 - DNA, 573 bp, Heterodera glycines
  Genomic contig location: Contig_ID=SeqID_664; Location=1749..2321; Strand=-
  SCN-specific regions: Sequence locations=1-117,216-274,305-395,417-573
gtgaccaaaatggaaacataaaaatgccatgcaaaacggcacttcaaatattgcaggggacgggggggaaacagaatttggcaccaaatttatgcagggaaagaaggcatgccaaagttataaattgtaaaattaaaaaagaaatatttatataattatatttttaaacttaaattaattagaattttgtcattttttaaaaaagatatattataccgttttcaattctttaagtaaccacggcaaaattaatcaggaaacaaaaagaattttgaaattaattaaaaaataaatttaattatttgggaatttgttttatgttttcaaaattagccaatttccattcattggtttggcgttatggtggcattccttttggcctgcgcttttggcggaaaacaaaacaaagcatgatggggatgaatgaatgtccatgtgccgagacagaaatgagaaagaaatcagaaaccgtgaacaaatttttgtgaaggtgttgttggctaggggccatctttttttgtcgagggcaaactgagaaaattcagtgaatttttaatcgaattttccacaatg

SEQ ID NO: 58581 - DNA, 3988 bp, Heterodera glycines
  Genomic contig location: Contig_ID=SeqID_665; Location=688..4675; Strand=+
  SCN-specific regions: Sequence locations=1-126,254-262,286-321,434 -447,470-745,837-851,873-1017,1206-1358,1381-1451,1473-1870,1902 -2197,2219-2491,2514-3057,3085-3700,3723-3890,3912-3988
  Gene Ontology: Mol. function=metallopeptidase activity; Cellular component=basement membrane; Biological process=development
aaggaaacggaggaacagtttgaccaaatgccatggcatttgttggcccatcacgcggcattgggctggtcccaatggagcgaatggagcgcatgcacgcgaaaggtgcaaagaattgggaatttgtttaaaatattttttaattttaaatttatttagggtaaaaatatttgtttaaattaaattaaatcgaatgattgttagatattttttaaaattattttaaagaatgtttaattttaaatttattttaggcaatttttaaatgaaatgaaataataaaaccaatcaaaattaattggttccattcttttaattaccatttttaattcattttcaaataaatataaaataatatattgtttgaaaatatttatagatttagtgaaattaaattaaattttacttatttttattatttatttatttatttttctaccaattgggatgtaaattatgtaagaaaaatccttaaatatgtaaaatgtatgttgtttaggtatttaaaaattgttttatgtacattttcaaaaaaaagttttatgaatttcttttaatttttttccattatttttttcaattccactttttttttggaatttacaaatttgtctttaaaattaatgccaaattagaattttagtgcggtggcgagggcatgcaattccaactgcgccgctgcctggacatgtactgctcgggaccgtcgtccaggcatcgaatttgtgccgaaaaagtgtgccttttgcataaaataaataaataataaattattttatgttaaattaaaatttattttaaaataattttttaattttattatttaatttatatttttaataaaaaaactattttcccctcccccttcaaaataatttaattcaaaattaattttccatttttaaaagctttgtcctccaaatggttccttttccactcattctgccgttgccattgaatgtgctcttcgttcatcgccagagaatgaattgttgcctgtgaccagcatacaaaatgtataaaaatatataattttacaatttaataattaatttcttttaattttacaaataaaatatttttattcaaaatcttttattttaatcgaaattattattcatttttcttttctttcattcttaattgttggttaattaattataaattattttcatattaaattaataattaaaattgtttttattcattttctacccaatttgtccaaaagtgttccgccctccattgtgtgtcccgtcggaatggcactgtgcacacttttggcatggcattacgtgatggcaccaaatgccatctgagccacggactcccaactgttgaggccgtttgtttgcatgggaagtgagttttttcaaatggcacggcaccattgtagatgattattaccgtataattataatagatcattacagtatataatttgtagggaatttttgaccgtataaaattgtagaagatcattaccgtataccaattgtagagggttatactgtatttcagtcgtcgagggttattaccgtatagcaattgtagaggcttataccgtacaccaattgtgggggattatactgtatttcagtcgtcgagggttattaccgtatagcaattgtagaggcttataccgtacaccaattgtgggggattatactgtgttccagtggtggaaaagtttttttcctttccccggcagatgccgctcagttggctgtgacggcattgtgggctcgtcggcacgggaggatcagtgcggcgtgtgcgccggtgatggctccagctgcgcggacgagctgttccagtggcgggacacgggccatttcagtccgtgcgacaaaagttgcggaccgaacagtacgccaaaaggggggaggggagggagggcaaattcaaaaaaatttaaattgcgcgtcccgaaaaaaggcattcgcgtgtcggtgtccgtgtgcgtcaacattcacacggaacgcgtggtgccggaacgcatgtgcgccgaccgggtgaggcccaggccgcaaatccggcgctgcgagcacatcgtttgtccagcaaagtgagcgcgggacggatcagtccccaaaaagtgggcaccgatcgatgatttgttgccattttggtcttatgccctgatccggtgcttaattcacttaacctggcctgatcagagctaccccattttgtctgatcagtgttggcctagtccaatcatggcttggacagatcattaatgcttgattcaatagtttgtcaccagaataaccatttttgtctaatcaatgcctgattggatgggctatgccggattttttggtttggcttaattatctctcaggaattctgtctaatcactgatacgtttgacagtgaccgttcaaatcagacatcatcaaattgatcagagtgcaaaccctcctcaatagacaaaaaaaaactggcattgatcacttgactaaggcaaacatttgtccacatttttaggggggtttaaaatttattttctagccattcgatgaagcccaaaattaggcatcagtaagtttgtttttaccctgaaatttttgccgaactgtgcgcattttgtgccgtttaaatttcgcttttcagtaccaggttcgttgttgttcgcatgtgtgttcagtgaatggttgtcgtcacgtcattttttgcaattcaaatgcttctcgctcatgccaagctgtttaagcagttcaaactgttgcttttgcgtgccaatttaattttcaattatttttgcttttttcgaaaatgccatccgtagtttttttttgtttgctaagaaaataattcatccaacttttttcaaagaaaatgccatcctcggattttgtcatgaaaatggcatatcctacatatataaaattgggaaaaatcaatcattattgaatttttcaacaaagcgaaaatgccgccattcctcaatatatttttttttctttctaaaaaatgtcaatatttaaaattggcgaacttttgccaaggcaaaatgccaccttcggttttttcccttaaccattgccattattttgtccaaaaatttcgtttttgtttaccaagaaatgccatttttaaaaacgctaaatgttatgcttattccgctagcctatgttttgcccctgttttcttattgccatttttctaaacaatttttgtgccattgtccccccccccctccctaaaagatggtttgccggcgaatgggccgactgttcggtcacctgcggcaccgggcaacagcgacgtgaggtgttctgtgttgaacgggttgatgctaatgttgaccggcgtgtgaacgtgcaacactgcttgccgagccaaaaaccggtgaattttttttttggattttttttaaattttcgaaaaatccaaaccaattttggcaccatttgtaacccccacttactgatcagttgtgatcagcttcacgattttgatcaatccttaacaaactctggtggtgctaattggccatcagcagtagtaatgctataaattgccgtcgttccttaattacattaccgtaacttaacattaatcacagtaccgtcctttccttaatcacactaccaccctttccttaactacactatcgtactttccttaattagtctaccgtattcattttctcccccccccccccccccctctcaaatggggaaggcgttataaatggaattttgtaattatatcagctctccaatgttagagcggcatttaaattttgaaggtggacgtgcgcaagtgcagcagtgaggcgtgcccggaatggtgggccggcgagtggggcgcgtgctccgccaactgtgggcgcggagtgcgacgccgaacggttggacgggcggggggggggcaaaatgccaaacaaaaatttaaattaataagtgtaaatcgaatgccaataaagcaattagaatgccaaaaatactgatttttggaggggtttatgggggcaaca

SEQ ID NO: 58582 - DNA, 1300 bp, Heterodera glycines
  Genomic contig location: Contig_ID=SeqID_666; Location=757..2056; Strand=-
  SCN-specific regions: Sequence locations=1-710,732-744,779-832,855 -879,901-915,941-992,1015-1169,1216-1300
atgccagaaaatttgaaattttccacacaaaatttgcaccgtttccattcctctgtctcctcgtcactgttgtcgtcgttatacggtgccgcagcaaccacagaaagtgacagcacaaaaacagaggacagtaaaaggaataatgaggctaactgtaagctacagtatggcgacgatggcaacattatgccaaaaagggctgaaaatcaaggggagaatggccaagaaaggaccgaacaaaatggcgttgggccaagaaccctagtgttggctacggcttggcttaatcccattgaccgagaattgccaaaaatgccagaattaaaaggaacaaaggtagattccattgaccgggaataccatattggaaagtacagtatcccctccccccatctctcagaaaaaaacgtctgcaaacctaaaaaatttgccagaaaatgtcttacaaaaaccaaacaatgattgaaaacagaaactatatgcaatacctccctcctatccctgtaaaaaagccgtccgcgtaaaatcccagcgccggaaagggtggcacgagagtgggggaaggggtcgagagttggggctcaagcttcaccctcccaccagagttgtagtgtgatgagtaagtgttttgatgggtgggcgggaggaagtgggcaagaaacaacaaaaacccttgaggggacggacggacggacgacggttggcttggccccaagcgaatgaatggccaaatggggggggggtaaaacaacggcacaaaaggaggggagggggaaaacccctcggggcattttcagggggagtccaccaccattttcgggatggaagggtccccaaaatgggcccgggggaggaaattggttggaccaaaagtgtttggcgttgtgtactgtgtgtgtttgatgatgtgatgagtgaccatcaccaccatcatcatctgctgctgggcataacaaatgcttaaggggcgcttaattgaacatttttgccattgtgcccccgggggccaatggcaatgccaaaaagatggactttgtgcaagaattgtgccaaagtgaaaattcataatgtttttttaaagtggatatcattttggttctggaataaaatcaaaatgtaaaggaaaagaagaaattaagaatttaaaagtttcataaaatcaaaaaaggatttaaaatagaattttaattatattttttattaaaatatattttaggtaatttaaatgcgaaaattatattctccgaccctttttgaagcatgaattgatgtgtttgcactatttaaattgattaataaa

SEQ ID NO: 58583 - DNA, 398 bp, Heterodera glycines
  Genomic contig location: Contig_ID=SeqID_668; Location=3140..3537; Strand=+
  SCN-specific regions: Sequence locations=1-187,210-239,261-284,327 -367,389-398
atgccacggcactgtacaattaccggaagtgccgcacgtgccgcggtacgcttcatgcgtgcaatgttcatttctggacggaacaatcggattctgtcgtcaatgccacggtaagccttcatgccttcgaacagttcaatcgcataatgaagcacctttttgtgtgattaacaattagaaacaaatccccaaaatttataatttcatttgtttagaaatattcgaatatttttcattcaaattaatttaaattgtttaaataatgtgttgaaggattataatggaaaaaaaatttttatttatatataaattaagaatttttatttgaagaattccaatttttcagattgtatgctttttcgaaatttcaaatttcaaattttcattttaatatttaa

SEQ ID NO: 58584 - DNA, 342 bp, Heterodera glycines
  Genomic contig location: Contig_ID=SeqID_5592; Location=99..440; Strand=+
  SCN-specific regions: Sequence locations=1-55,93-254,294-342
atggacacagagaattggggaggaaatgggacgaaaattacaaagacgccgagcaaaacgccaacccagccacagaggacacgcaacaaaagttcatcaaacgaaacgagtgacagcgaagtgcaaacgaccgcggcgaggccatcgacagcgacgccggggaaagcggaactgaaaagacgcaccacggaagacacaagcgacagcgaagcagaaacgccggcaaaaagcaaagtgttggcgagggcaactccgaagaagcagcagaaagaggcggaaacggccaaaaagccggcaccgaagccgacggagggcacttcctcggaggactcaagcggatga

SEQ ID NO: 58585 - DNA, 209 bp, Heterodera glycines
  Genomic contig location: Contig_ID=SeqID_5592; Location=654..862; Strand=-
  SCN-specific regions: Sequence locations=1-52,74-209
gtcagtggaagcgttgaagacgaattggccaaaatcaaagtggtcttacgacagcacgagaggaggatccgattgcttgaggtgaatggcatttatacggaaaaattaaaaaacaattcaggaccaattggcggatgccaacatggccaatgcttatggaatatgaaaatggatggccatataaaaggaatgacccgccgaagggatga

SEQ ID NO: 58586 - DNA, 893 bp, Heterodera glycines
  Genomic contig location: Contig_ID=SeqID_5593; Location=21..913; Strand=-
  SCN-specific regions: Sequence locations=1-143,165-437,459-748,770-893
  Gene Ontology: Mol. function=structural molecule activity; Cellular component=actin cytoskeleton; Biological process=signal transduction
atgtcggcaaattgcgcaggtgtcaaaccgcaaagagcaattttcaccaaggacgggcgcgtgttcagcaccggattcaccaagcgatccgagcgattgtatgctcttcgtcacccggacaatttgtcccagccgataatgcaagacgagtgagtgacaaattcgtggtacagtacccataataatgtgcctgtcatgtccaatgctctcagattggacacgtccaatggcgtgctgttcccgctgtacgatgaggactcgggcttgtgctatttgatgggcaaaggcgactgtgccatccgttactacgaaatcaacgaagacccgccgtacgtccactacattaacacgcacacaacctcggaaccccagcggggatttgcctttatgccgaaacggggaatgaattcgttggaaaacgaaatcaatcggtgggagacaaagggacgaaaaacgaacggaaaaatgcatttagcatttacaaagtgaccacaaaaggagtcgttgacatccttcaattctttgtgcctcggaaatccgatctgtggcaagtaaatgaattttggactgaaaatgcaattcaataacaaatggttttgccaaggccgacctttacccggacacgcgcagcttaatacccgctttgacagcagaagaattcgttggcggcaaaaacgcaccgccgaatttaattccggtgaaccccgaggcagcaaaggcggggccaaaagtgcaagtggcaaaaaaggcaaacattttggcacaaatgccaccgtgagcaaatgaaaagttgccaatttaaagaaagcgagactccattaagccaacaagaacatccgcccgaaccgccgatgcaaaggccggcgccccctcagcagcagcgagccgcgccg

SEQ ID NO: 58587 - DNA, 75 bp, Heterodera glycines; identical to SEQ ID NO: 54636
  Genomic contig location: Contig_ID=SeqID_5594; Location=1200..1274; Strand=-
  SCN-specific regions: Sequence locations=1-75

SEQ ID NO: 58588 - DNA, 792 bp, Heterodera glycines
  Genomic contig location: Contig_ID=SeqID_27923; Location=24..815; Strand=-
  SCN-specific regions: Sequence locations=1-168,190-792
atggccaccgcaaaaacgaatgcccgaacaaggactcaaaatgccgaaagtgagtgtggcaatgttggacactgggctgtgatatgtaagacaaaacagggctccaattggccaaggaggcaagggaagccagtaaaccaggtcaacactgagtgccaaaaagcacacgacattggaacactggccaagtctgaagaagtcaaatcgatttctgtgccaccagcgatgataaagcttcagctgagtaaaaaggcgacagatttcgaattggactgtggcgcagatgtcacactcatcaccaagaatgattggatgtccatcggaaggccgaaacttggacaaacttcaggattgatggcatatggaaaaaagccgatcaaagtccttggatcgttcaaaacggatgtggtgtacaacggcaaagaagtgaatgccgaaatttatgtcgtggacggcgaaggaaaaaatttgtgtgggagagatttgattggtgaattacaaatcgatctcaacaaagcgttcgggatccgatcagtcaacgaggtcaatagcaaggcagtgaaccgagagcttggagcggtgcttctgaagtacggcgaggtcttcaatgacggactcggtcgatgcacaaggcaaatttcgctgaaatttaagccggaagtgcaatcgaagaagtgcaaaccgcgtcccgtgccttttgcattgagacccgaagtggagaaggtcatcgacaagtgggtcaaagatggagtgttggagcaagtgacaacttctgaaagggcaacaccgctg

SEQ ID NO: 58589 - DNA, 869 bp, Heterodera glycines
  Genomic contig location: Contig_ID=SeqID_27924; Location=127..995; Strand=+
  SCN-specific regions: Sequence locations=1-783,805-869
  Gene Ontology: Mol. function=anion exchanger activity; Cellular component=integral to membrane; Biological process=sodium ion transport
atcgcttctatgcccgccttgttctacaccattttggttatgatggaccagcaaatcacagcagtgatcatcaatcggaaggacaacaaattgaaggtgggcgaagagaaatgccaatcttttgctgattgattgccattcggtgccaactcagaaaggctgcggatatcacttggatttgctgattatcaggtgggttgactattgatcagaacgaccagcagctgatcttccgctgattgatcacttcagtttgctcgtcctcatctgttcctttcttggccttcccttttacgttgccgccactgtgctcagtgtgatgcatgtggaggtgaaattaatcaatgaaccaattcatttgctaatcgctgagtgattgccaatttgagtctctcaaagaaaacggcgattgtacggtgcccggggaacgacaaaagttgcttggtgttaagtgagccgtttacaatgatcaatctgctaaatggacaattaatcccaatttccaaatccccccccccccagggaacagcgattgtccgccattctctcccacatttttatcggctgttcagtgtttctgacccctcttgtcaaagtctgttcttccatagccacctttgtttcccaactttgcttttaaaaggtcgtgcctttgcccgtcctcaccggcattttcctttatatgggcgtcgtttctctcatcggccaacaatttgtccaacgcatcgctttgctttttatgccggtcaaataccaagtgaaaaagcaataaaagagtgtttgagcaataaacaaataattaagccggattacgtgtggctgagaaatgtgccgaccaaacgcattcacacattcacaatggttttaac

SEQ ID NO: 58590 - DNA, 331 bp, Heterodera glycines
  misc_feature (319)..(319): n is a, c, g, or t
  Genomic contig location: Contig_ID=SeqID_27926; Location=1158..1488; Strand=+
  SCN-specific regions: Sequence locations=1-104,151-151,177-331
aaaatatttttaaaagatgttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagcgcgctaggttcgatgaaactttttaaaatatgagcctaaactttttggnctgtttaaaaag

SEQ ID NO: 58591 - DNA, 1248 bp, Heterodera glycines
  Genomic contig location: Contig_ID=SeqID_27927; Location=12..1259; Strand=-
  SCN-specific regions: Sequence locations=1-32,72-181,203-223,246 -295,414-447,485-564,586-649,676-1248
  Gene Ontology: Mol. function=carbonyl reductase (NADPH) activity; Cellular component=cytosol
atggccgggaaaatttttgtggtaaatgaaagaattttttatgtaaaataattttaaatattaaaaatttaggtcactggcgcaaacaagggcattggttacggcattgcgcgtgggttggcccaacaagtgaatggtgccaccatttacatgacgggtcattttttatgggtgcacccccaaaacctcgctgccgaaatttatataaaaaattccataactgaaatttttcaagaataaaaccatataatttttttcaaatttcaaacttcgaaattatgaaaattttgctagctttttttagaaaaatttaaaaaatatataataataataaataataaaactttgaaaatattgctaaaaaatttaaaattttcttacaaaaaaaattctgatatttttgaaaaattaaagtttgaattggtggcgcgattttgtcccgtgcactatttattttattttatttttttaatttaaatattttgactttcagcacgaacgccttcactgggcgaaaaggcattggatgacttggagaaggaattgggcacaaaacgcatttcaaaattggcatttcatcagttggacatcactgatgagaaaagttgtgccgattttgcggcatttttgaagaaaacccacggcggattggacgtgctcatcaacaatgccggctttgcgtacaaagtcggcatttttggatttaggatttaagggtggcaaaattttgcctcttaaaactgcagcaaaatgcgacagaatcggccgcaatccaagccgatgttacgattggtgtcaattattatggtaccaaattgatcagtgatcagctgggcccactgatcagagacgggggaaggtgaggggaaggggcgcaattgacggcacttttccgttagggaccgcaattctttaccattgccgaaaatttggcatgacgaatgacgaagaagtgccgttaatggatgacaataatacataattaggcagcctaataaatttgccaatgtatttttttgtatgtgtcagaattgtgaatgtgtgcagtcaagcaggtgtaatgggcagtcaaattggtgtgatgggcaacctgtacaaacagtcactgattgatcagttcaaacgtgccgatctcacttcggacgatatcaacacatttgtggaggaatacaaaaagtgggaacattaaatcccaaccattttctttttttcggaaattttcggtgggataaattttaaaaaaataaa

SEQ ID NO: 58592 - DNA, 304 bp, Heterodera glycines
  Genomic contig location: Contig_ID=SeqID_27928; Location=731..1034; Strand=+
  SCN-specific regions: Sequence locations=1-3,25-53,75-117,182-268,290- 304
atgggaatgggtgacacattgttgtgcaaagccatagaaccattccgccgtttaaaactgagcaccgaagaatttgtacttattcgagcaatcatttactccaatatgggttagaagttttttataaaaaatttctacaagaaaatttatataattaatgacaaattcaattaaatttttagtttcgccagggcttagtgaccaggcacagaaattattattatctgaagcggagaaatattcttcacagttaatgagcattgtacaggtagctttctttcttttttgcaattggttctcttga

SEQ ID NO: 58593 - DNA, 374 bp, Heterodera glycines
  Genomic contig location: Contig_ID=SeqID_27929; Location=90..463; Strand=-
  SCN-specific regions: Sequence locations=1-374
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacaagagtatagaatttattttcagaaagtgtccacagacttttggaaaaatatatttgcaatttatcaacaattttgagaagtgagttagaaatgataaacttcacgattcaaaccaattttcgttgctctaattaaccgcgataaaaacattcaaatcaattaatagcttctgagataataaggtttatcataaaatttcaattaaaaataaa

SEQ ID NO: 58594 - DNA, 374 bp, Heterodera glycines
  Genomic contig location: Contig_ID=SeqID_27929; Location=499..872; Strand=-
  SCN-specific regions: Sequence locations=1-374
atgcacacgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaccaattttcgttgctctaattaaccgcgataaaaacattcgaatcaattaaatagcttctgagataataaggtttatcataaaatttcatttaaaaataaa

SEQ ID NO: 58595 - DNA, 641 bp, Heterodera glycines
  misc_feature (562)..(562): n is a, c, g, or t
  Genomic contig location: Contig_ID=SeqID_27930; Location=203..843; Strand=+
  SCN-specific regions: Sequence locations=1-641
atgagccgtaacgaacttgtcggttttctcctgcgacagatcaaattccatcccatcttcgccaataatttcttctcttcctccgattctggcctaatccattgggatgccagtgctttggcccaaggagcgaagtgagttcagccgaccgaaggcaccaccccattttattggcataatcttccgtttgcagtttaaatccgccaacaaacggaagagaaatgactggccacgaatctgctgcgggttggtgatttgctaatcgacactaatgagccgaccatgctgatttccatttctttcaaatttagacatgcggacgaccggagaaaatgaacacaccaacatttggttgattgactattgtgaatccaaactaatttcatgttcaggttgtctccccatgcttcgacgagcgttaatttggttttcaaattcaattaatcacttttaatttttcaaaatcttaagcgagtgcttattgacgaggaccctcttctgctgagttctttcgacgttgtgaacggtgcgatcgtcgccgcttctcatacggctgaattgngtgtttatgagcaatgataaatttacaaattgaaaaataatcagctgactggaaatctcattattattttgttacaata

SEQ ID NO: 58596 - DNA, 660 bp, Heterodera glycines
  Genomic contig location: Contig_ID=SeqID_27931; Location=311..970; Strand=+
  SCN-specific regions: Sequence locations=1-51,73-107,135-173,207 -464,487-660
atgaccaccgaaaatgaggtatggcacaaaaatcaaatgcaattcggataataactaatattcattgagggcaaaaaagtcacacaaaataagttcttattgtagtgatcaattatttagccattttttaaaaatgtgacaacccaacaattttttggaaaatttctatataattaaagtttgctttttcaattataaataatattatgaatgtcatatttttgtgcctttgtagctgggcgaatatgatgttttcgttacaattgccattttggataaaacctgctgaacgggatttccatcccgcgcccttcaaattgaatttgccgattaaataaaatctatctgctttttggttttaagccatttttccatattttgcgtcattcgtgtttaacaaagcacctctcagaggagaatcgcagtatagcaatcatcctaatgtcatttgtattttgatgagcccaattgtttttcatggaaaatattttctaaccccctagaaatttttctttcgaattaccccgatttttcagatttttcatcgacaaaaattggggtgtaatgcattttggaaaactcaactaacactgcataaaagacagggttctgttgtgactgggacgtatatactattattcctttgaatttataaaaaaa

SEQ ID NO: 58597 - DNA, 938 bp, Heterodera glycines
  Genomic contig location: Contig_ID=SeqID_27931; Location=996..1933; Strand=-
  SCN-specific regions: Sequence locations=1-890,912-938
atggctgttcgccgaagggtagcacaccatgaagccggccacattatggcaaaccacctaaataagcatgggactgagtgcttagcagtaaaattttgaattgatagaattaaaaattcattaatttcagtcagatgtagtgccggaagggattaatgatggatacacttggatttattttcgcgaaaaatatacacttgcgcaagtaatggcaacactacagtattttttaggttggtttttcaaatttaacccaaaatttgttttgcatcttaaggaggtgcggcatcagaaaaaacaatatttggtgtttacgacaaaagtgcggccgaaagcgattggcttcaggccgacacggctacacatgcaagcgtaatttaatttttttcgtttatagttctctttattttcataaaaattttgagaaataattaaattaaaggtctaccgctacgaagataaaaaagaaaaagtggtggaaaaagtaggtatccttaacagcgcaaattaccattacgatggcaagatacgggaacgcatagcgaaaaaaatcaacaaaaactttgaattcgtgtgcaaacagttcaaaaaaagagaagtcaaggaagcaataaagcaggtatctcttttagagcaattcaaaaattcaagggtttaccttgtcaacgcgttgcttcaacgaaatgtattgcagtgcaaccaataaaacggttagagatattttccaatgatgaataatcatttttatagaattattgggcacattaaacgatcgaaacgttcattctactgacagggatggagctcgtctgaaaaaagtaaacataattatattaacaaagcattagtgtgattaatttctttgggaaatacaaatgcttattccattatcttattataaagagtaatttcactcagatttgtcattttaaaataaa

SEQ ID NO: 58598 - DNA, 506 bp, Heterodera glycines
  Genomic contig location: Contig_ID=SeqID_5595; Location=62..567; Strand=-
  SCN-specific regions: Sequence locations=1-137,159-176,365-380,498-506
  Gene Ontology: Mol. function=single-stranded RNA binding; Cellular component=transcription factor TFIID complex; Biological process =epidermal differentiation
atgcgaaaactgatcattttggctcttctcagtttgttcttcattttggtcgcatcggaaggaaaggaaggcggcgatggcgcggaaggaggtgaggggaaagcaatgccaaaaagagtaaatgaaatttattagaagagggaccaggccaaggtggtggtggtaaagaaggcgaaggaggaggagaaggaggaggtgaaggaggaaaaggcggacatggaacaggaggaaaagggggacgaggaggagggggaccaggaggaggacacggagtaggaggaggagcaagaggagaagaagaaggaggaaaagggggacaaggaggaggacatggaggaggaggagaagaagatggaggaggagggagaggagcgggacacggacgaggaagaggaggcgcacgcggaggaggacatgggggaggaggagaagaacatggagaaggaggaggaggagggagagcaggaggaaacggacgaggaggaagaggaggcggaatcagagaa

SEQ ID NO: 58599 - DNA, 848 bp, Heterodera glycines
  Genomic contig location: Contig_ID=SeqID_5596; Location=161..1008; Strand=+
  SCN-specific regions: Sequence locations=1-74,97-108,132-299,321 -356,388-507,529-677,699-755,777-825
atgccccgtttttcgggatatttttgtctgattttgtcaagatttcgacgatttggtttggtatccgactgataagctaaatatgtctgtttacaactttggacaatcataaaataattaataattaattacccattttgccactttcattccttcgtttccctttcgcttttcaaatgctatttttttcgtttccgaattttgcttcaattgattattcagcttaacgttggcattttgcaatacgggataaaatggcatttttcagttaagtccattttttagttttccgtgtatatttcattcgttcgttcctcttcagaagaaaattcatttgcatattttctgccctaaccattaatttaattatttaaagaattaattaatcagataacacaaatgaattacacattaatttgcttttccattttgcttcaatttacgctattttgggcttcaatttgtgcagcagacaatggtcctccattaacaattaaacaattaatttatatataattgagtgttttttcaaattccatttaaaatcgttcttttttctttttttacttttcactttttaagtgccttttcatttgccatttcccttcaaaactttcactgatgggcccagcaaaactttgctgaaaattatgttcaattacagcaagaaacgtttctcaattctgaaccaaaaatttgacatttttcctgcggaaaattttaaaaatgtttttttgacgcattgcaaattcgtaaatgaaaattttggaggagtcaaagcatggaaagagcaattggggcgcaaaaaaatgagaaaagccacacgaaattggccaacttttaaaaaa

SEQ ID NO: 58600 - DNA, 1088 bp, Heterodera glycines
  misc_feature (830)..(830): n is a, c, g, or t
  misc_feature (1049)..(1049): n is a, c, g, or t
  Genomic contig location: Contig_ID=SeqID_5597; Location=577..1664; Strand=+
  SCN-specific regions: Sequence locations=1-213,235-358,382-532,554 -789,814-1088
atgaaatggttggaaaacgcagtaatggacgaatcaaacggactgaatatgaagggaatttacgagaaaattttggaagaatttgacaaccgtcggcacaatcaatattcggcggaacgatcattcggaatgggtaattagcaaaatatcatttgcgttcactaattggataagtgagtcaagggtggccggaaaagccattcccgaaaatgaaaatcaaaattaaattattaattcccatcccaaatatttaattttcagcctgctcagcggaatttttcaagttgcattcgctgaattatttgagtcaatttgttctcagacaaattgtccaatcggcgctgacttcgcaagcgaattttatgtacaaaatatttcaaactgaaatgaagcatttgtacgaagaattgcacatatttctacgagaacattttgggacggtggttggccaaattggcattagcagcagagaaaaaggaaatgacgaaattgaagacggagagacggacggagacggggaagacacaacgggggagagtgacgaggacagcgacggagatgagcagcagaagcaacagcaaaaccaagcagtgccagcacaagcaccaaggcatcgtgaccaacacgagcgcaatgacgatggccatggacatggtggcagaggaaaagccgaagagagtgccgttgcggaggaacagccgcgggagcaatgccaagacgaactcaaacacccgaaacaaattggagaagcagcactaagtgagcaacaagtggaagcagtaactgaaccaacagaagcagcagcagcagacaaagggggaaacggtggntggtgggtggcggaaaaattggcgaatttgtgcaacatggccacaatcaacaagaagggggagacgagggaagagttgaggacacttccgacgaggacgaagtgtaccatgacatggacgaagaccaattttgaggaggaggagaaagagggaggaggaggaaattgcggatgagaaataccaaaacccggaaaattagccaaagaacggaccaattgngggggagaaagtgccaatgaacaatggagaaagtgaaaa

SEQ ID NO: 58601 - DNA, 606 bp, Heterodera glycines
  Genomic contig location: Contig_ID=SeqID_5597; Location=2363..2968; Strand=+
  SCN-specific regions: Sequence locations=1-233,255-567,589-606
atggccgaagtcgcactttttcaaatggcaatggcatgtatggccaatcgaatggattttcaaatggccgatttggcggctccagtgtctattcaaatagcggccggtcgaatagctttccaaatggtggatttggcggctccagtggcttttcatcgatgggacataactcgggcggacttcacggctttgggtccggcccaccttctggaggctacggatacggaagcggttttggtggaagaaaatgaaaaaatgaccgaaagtgatcggcgagagaatgatttgtgctgttgccttttatacatgcaaaattaaatggaaaaacgcatttcaccagcagaacacttttttaaatcaaatcacagagaattaaaaaaaagaaaagcgaaggaaaccgcaaaaaaaaaatcacaaaaaatcactcgccaatacataattggcttaaaaatcggtctgtttcgtttcgcaatgcttttaggattcatcttcgtcccaattgatcggctttttatcagtccgctgctgctgaaaatgccaacggagccatgccaagcatatgcaaaagcaattgagcaaaacaaacgcggggacacttctgcataa

SEQ ID NO: 58602 - DNA, 96 bp, Heterodera glycines
  Genomic contig location: Contig_ID=SeqID_27937; Location=335..430; Strand=+
  SCN-specific regions: Sequence locations=1-96
atgcaaattggcgatcaattagtggaaattgacggcgaaagttgcattgggatgagtcacgagcgagccattggcatgatcaaggagaggcaatgc

SEQ ID NO: 58603 - DNA, 79 bp, Heterodera glycines
  Genomic contig location: Contig_ID=SeqID_27938; Location=101..179; Strand=-
  SCN-specific regions: Sequence locations=1-79
ttacgcgtcccatgacattttacgcgtcccatcacattttacgcgtcccaacaacactttacgcgtcccatgacatttt

SEQ ID NO: 58604 - DNA, 2341 bp, Heterodera glycines
  Genomic contig location: Contig_ID=SeqID_5601; Location=245..2585; Strand=+
  SCN-specific regions: Sequence locations=1-407,453-520,587-726,771 -1157,1191-1241,1265-1342,1364-1437,1470-1603,1642-1729,1751 -1915,1938-2103,2128-2341
atgcggaaatttcggcagcaaattttgtcacttttccattttgtggtgctgcatattttaatcgcaattaatagcagaataataaatggtaattaattagcgttttatcaaaattttcctctgttttgggccaatttgcctccgatgcgccggtgtccgtccgcggcaacccaaattacgacggacgcgcgctgaacattccgctggacttggatggcacgttggagctgtaccaacactggatggaccaggcataattaacgaactaattaattaataatcaatcttacggtgattaaattgtgggttaaaatttttatctaaaaagtttgcttaatttcgtaggcattcagcggaatgttcgctgccgtggccaatcaaaagtaaattaattcacaaataattggaataaaatttattttaaaaattaaatgtaataataaaaaatattaggatgtcaaaaacgagcgaaaacgttcgggaagagatgggacgatgctcaaaacaagttggaaaatggaaaatatttaaattaataacaataaaataataataataattaatatttattaaatatttatttaatgaattgtctgtcattaactaattagggcaaaattataggtcaaagatgttatatcgcatgcgaattgcttgtcaagattattgaaaggcgaatttgaggacaaaaagcccatttttcagaatagcaacagcccaatggtgaaaaatattgaaatttcaataaataaattaaattaaattaaaatccgccaaaaatgattcaacagaaaaggaagtcgcggttggaattgtacaaatcaaaaggccaacaaaattacggcatcaaaaacatggacctaatgtcgtcaaaagtgccaaaaaaattattggcgcaaaattacggcacaaaatttgccgaggaagacatgcaaaagcacaagcgaatgcggcggcaaagcagcggaaaaagtgggcgaaaaccgacaaaaaaaaatataaacaaattttagacgagaaattcttcgtgaaaacagcgcccaaatattttctgcgcgaacgaaccgcccaaatgagcccattgggagcggtggcacaactgctgacaaagtcgctaatggcagccaaaaataaaacggaaatggccgagtaaaacgaattaaaatataaaaaatttaaatttaatatttgggattgactcggcgctttgggaagcgttaaattggctaaaattctctttcaaaaaatattttaaattaattttggtattcaaaaaaagccattttaaagtgttgttctgaatttaaaagacaaaactcagttcagctttacagtgttttaaatgttttcagatggcaaaatacgatagagaaaatccgacaaacttcgaaacggagaaaaacgatgagaaaacagaaaatggaaccagaaaaaggcaaataatttaaaaaaaaaaaataatataaataccgtttcagctttattgaaattgcagcagcaaattgcgggaaatggacaaaataataatgcgggggaacaaattccatttggagaggtaaaaagggggggggggaattgaaatgggcaattaaaatggagggggaataataaaataaattaaaagtgaatttatttttaaatggggaaaattaaaaaataaaaagaaggtgctaatggcataaaatctaaataaacccagcaaaattggtcccgaaatctgaataaggaatgcttcagctttcttttctttcctatctctgccgctgtactgctccaactttgtgcacaaagttggagcagtacaaaaaagcgtagaatgagtgataggcaaaaataaaagcaaaatgaaatactcaccttttttcagggtaacttttataaaaaatatactcttgagtattttaaaccatttaaagaaaagaaatttcttaattaaaagatggacgaaatattggagcgcggaaatcggacggaaattcgtcaaatcattcggatggcacagcgccaaaaatcggcacgacgcaacggcaaaaaggacaaaaaaatggacccggacaaactcgtccaggcaaattgagggggggggggagcaattagcgaagcaattaattaattaactaattaattttccaattggcttcagttggttcgccagggcgtcactttgggctttgcgctggcgggccaaaacacgacgggttgggacgagaagacaatgcgattggtgtcaccacgcttcctgagtgtggtggcagaggaggaaatggcatcggacaatgaaacggtggaaaaaatggaaaataatcgaatgaaaaaagttggcacaatgccaacggagtga

SEQ ID NO: 58605 - DNA, 245 bp, Heterodera glycines
  Genomic contig location: Contig_ID=SeqID_5602; Location=541..785; Strand=+
  SCN-specific regions: Sequence locations=1-245
gaagccgcgggaattaacgaagaagcgaagaaaatagcggacgaaacggagaaagaggaaaagggtgggaaaagaaaaggaaattggaatttaaaaaacaaaaattggcaattgttgcagaagttaaaactgtgccaacaattggtacggcggcggacaatggcacgagactaaatttgaccgaaatttggaaaaagtcgcgcggaatgtacgaaaaagaggtgcccaaattggcattcaattag

SEQ ID NO: 58606 - DNA, 1525 bp, Heterodera glycines
  misc_feature (835)..(835): n is a, c, g, or t
  misc_feature (900)..(900): n is a, c, g, or t
  misc_feature (923)..(923): n is a, c, g, or t
  Genomic contig location: Contig_ID=SeqID_27944; Location=57..1581; Strand=-
  SCN-specific regions: Sequence locations=1-46,69-216,238-607,653 -829,900-1152,1193-1460,1483-1499,1521-1525
atggccggcctgcccatggcgccaatgcaaatgcaccaaatgatggcccagcggccgccaccgccgccccaaatgggccaaatgttcgcgccgccgccccctccgatgtcccggtaaattaattatcattcattatcaacaaaaaaatttttaagttttttttttacccaaatttttaatcaaagtttatattttattaccataatgaaaaagaagctctttttgtttgcaaggttagataagaaaaaaacgagaagcatttaaattttttgaattaccggcggagaaaataggtcaaattagaaaagttgcgtgcgtgcgggactgaacctgcgcttgggttgaatcccaagtggcgtgctttaaccattgcgctttttgcgcggcaacaattgatgctgatgcaaagttttttgttttttccatttttttttggttatagatttttgtactataaatcaatttcaaacaaaatcaaaatagaaaaagtgcggaatgaatgttctcaatgagttagttacaatactgtcgtgcgaatggcgcaatgtttaaggcgcggccctaacgattcaatttagcggggttcggttccgcatgcactgagttcttttttttaattttttatctattaattaattaatctataaaaaatcggaatttgttcaaacttgtaataaagtaacatttttttaaaagaatttagtctttaaaaataacctttttttactaaaaaaaaacttgtgtcaattttttcttttaaatttgtctcctctcgtcttgcgtctgttcatttatttgtgccaccaatttcttttgcagacagagcattccgccnccaccgccgccgcctccgcagccgcccactccgaccatgacgcctcagccgccgccaccgccgcntcagcggtcttagaaactatttntattggaaaattacagggacaaaaaatttccaaaaaatcgctgaaatttttgacaaaatttgcatatttttcgcagatttacatcaaaaaattgctggttttatgtcttttcgagaaaaagtcttggagggagtaccgacaaggaaaaatcgaaaattttcagcaaaatactacaccttcgaatttcgtttgaccctccccccccacctttttcatatatggccgcctgaattttttaaaattttatttagtgaaaaaaatttttttttgggaggttgggaaacgtactgcacccgtaacggcattgggttaacgaggtttctccagtactaattgacccttgccgctaattttctcttgttgtgctaaagccttattcccgctatgaaaaccattttttttaatttgccaatttttttcagcccctccaccgccgcctccgtccgcttgaccgacgacgacaaatttggcgcttgctgctggttgatgttttgtgaaagaatgcggacaatatgatctttttgcggatgctatcacatttatttatttgttgttttctctttttccaaatcactttttcaacattggcattttgcattaaa

SEQ ID NO: 58607 - DNA, 205 bp, Heterodera glycines
  Genomic contig location: Contig_ID=SeqID_27944; Location=1764..1968; Strand=+
  SCN-specific regions: Sequence locations=1-39,108-205
atgaaattgcgcaagaattatttttgttcgaatagtgggtttaattcattaaaaaaaaattttttttttaattttctattaaaattctttgtttaagtttcagaaaattctttaaaaacacctggaatcctgaagaaatcaattccttatatagtacaatttattttgaataaattttccatcaaattccttgtttagggttcca

SEQ ID NO: 58608 - DNA, 826 bp, Heterodera glycines
  Genomic contig location: Contig_ID=SeqID_27946; Location=19..844; Strand=+
  SCN-specific regions: Sequence locations=1-102,124-156,180-203,225 -714,736-826
atggcttcatgcaaatcacccattagccttctttgcatgctgctgatcatgctgctgatcgatccatgcttcaacatcagtctctttaatcccgcttgttcgtttgtttttcaattaattaaatccctaatttatccattaattaattttgtacaatatttcagctgatgattgtgttgtggccattcgtaaccggactcagattccaccgggggtcagtcacagtctgttaaaaatcaatactattttggcgttttgcctaagatttactaacaaaaatgcaataaaaacggaaaatacacccctaataatcgattcgaaaattttcaaaaaatacactcccctatgaatcgactttatttggcataattaatcgtgccaaaaattaaaaaaaaaaattgtctccaaatacaatgtgccataattgttatttttgaaactagggttaagccccgacatgtttcggggaattacgaaagccgtaaattgcacttgaaataagatggaagtatctttaaatgagtttttaaacttttttattctggactttttctttttgtgtttttttagactttttatgaaaatttcctccccgacgaaggtgttgctccccgacattttttaaaatttctccagccatccccgacaaattctttcggggaatttcctccccgttccccgacattttgctccccgaggctcggggaggaaccctaatcttaatccataaatttttgagacaaaaaaaaaacgacaaattattttgaattcacaaaattttttttaaaaacttcatacattatgtttaaatgttaattgtgagata

SEQ ID NO: 58609 - DNA, 1396 bp, Heterodera glycines
  Genomic contig location: Contig_ID=SeqID_27949; Location=159..1554; Strand=-
  SCN-specific regions: Sequence locations=1-229,263-267,289-615,639 -673,695-1396
atgtccggagggacgagtttctttcctcaaccaaatcactttttggtggttcaacggaatggcgcgacttggccaccagcggcctttggaaatggacgacctttgggacttgttggaagaagaccaatcagaatatttgctggagaaattcgaaaaaatacgagcaaaacaattaaaaggtaaggtcatttatctaattgggtagcgcctcatttcctcccttcccctcttttttaactaaatttatttatttataatatttcaaaaatgtaaaatggttttctatgtttgtgcttggtttaagaattttcagttacaaattatttcatttgagtttttcctatcggcaccgccaaaccaattcttctatttcaagatttgactcaaaaattgtcatttttggcgagagtctcttataaaaatactgccaaatttttagataagtaattcttctcccttaatgttagccattttttgttgaaaaaactgcgttgctaaaacttgatataaaaagcaaaattattttagtaaaaaatagtttttgctgtcgaaattttagctctgttgtgcttattaatgcgaacactagacaaaaaaaaaacatctagttgtaagaaatataaattttaaaaatttatcttttttgtttgttttttgttttaccggtgggggtgaacatcctttttccaccctcaattctcatagcacacggagagaaacatgcggaggaaaacggtaccaaagtgaagctttttcccaccgatggagcggcagaaaaggaacttttgcagataagttcaacgcgtgagcgtcatttttaatatcacaaaaatttaatttttagatggattccaaatcgattggacgagccaacaagaaagggaaggggccgaaaggcgatgctccgctgtcaatcatttggccgcttttcctcacgttcaaatggccttcctttggggctgctttttgcaaaatcgcctatgatttgcttaattttgttgcccccttcttgctgagtaaactcatcgcatttaccgaagaccactcacaacccctttggcgaggcatcgcaattggtgagaccacatggaacagctaacaatgagagtttttatcatagaaacttataagaaaatttcttgaaaaaattgaaatttttttagcaatttaatgtttatggttttattaaaattttccaaacaaaataaaatttttgaaagttgtaagtttgaaattaaaaaaaaaattgggtaaaaattccattgttttctccagtgttattttaaatagttcagcgctggggaacaaaaagaaggaatttgtagccgcttttcgccaaaaaaacgacatttctccggtattgaattcggcctcaggattcaacttacaatcttag

SEQ ID NO: 58610 - DNA, 1016 bp, Heterodera glycines
  Genomic contig location: Contig_ID=SeqID_27950; Location=262..1277; Strand=+
  SCN-specific regions: Sequence locations=1-924,946-1016
  Gene Ontology: Cellular component=cytoplasm; Biological process =protein-nucleus import
atgcaaagggagcttgcattgtatgaacagcgcagcaacgaattgacagccaaggcggaccaattgcaggagactttgttggaccgggagcgcgaattggacacattgcgtgaccagttcaagaaggtttgtgcttttcttggtgctatcttttccccggatgtttcgatacttttttgcgcttatacctttattccttttgtgtcaattggcccgagaccgcaaatccctaatttttagggcactccgagtgcccgccccctgctggtgtctcggaataacttttttgttttgttttttagtccctaagtgaccagacgtcccggctgaacgagttggaggcggagttgcgtgctcgtgagcggttggccaacgtctacaaggccaacagtgaagcggcaaatgccgaaattgctgaactcaacgacaccgaagtgcgactccaagcgcagctcaaagaggccgaacaaagtaaatgatttgatcagttattttaaatttctaatttttattccgaatttcaagttgttcacagttacaccgctgaaatggagagggcggccgaggagcagaagaaaactatcacagaaaaaggtttgaattgcttttttatacaaaatttgtaaagattaaatttcagacgccgagatcaagcgtctcaacgatgaagtggtcaagtccactgagctgctgaatgccggattcagacgtaagtacgggcaatgccggaccccttacaagcacatagagttacactgatgtaattcccatcaaaaagtggaattttcttgcaactagccaaattccccattcctggtaccttcataaacatgctttttccctcaaaagtttgctcactccgtctgttttcagtgaaccgtgccgacgaagacctcatccaactgtcgccggctgccgctgtggcgagcagtttgttgaagagtggcatgtcgctgacatccatttacgcggaacattggtcgcgtggtggccgaattggacaagaaaaacgatga

SEQ ID NO: 58611 - DNA, 1663 bp, Heterodera glycines
  Genomic contig location: Contig_ID=SeqID_5603; Location=1098..2760; Strand=-
  SCN-specific regions: Sequence locations=1-619,641-987,1010-1663
atgcccccatcgaacatccatcatcatataggcctaactgaccctattgtgctaccgatacggccacctgagcagaacacagccgacactctgatgggcgaactggaaaagctgggacagtcggacggagacgaagacgtgcatggcggaggaatgagcaagcgatccctgttgctcagtgaaccggttcaaattgtcatcacctgcattgcaccgccggttggagcagctccgcgcttccaccattatcagcactggggttacaacgaaaggcagttgatccgaatacggaatgtcggtgaccatttctgcctgttccacgcgttgattgccgcccgttcttacactgatcatgacttgacaaaaatgattgcaccacagcaacaacaatgccatcaaggggacgtaagcagcagcagcagcagtgatcatcttattaacgtgccgtccgctgctgcaacagcagtgatgaggaggccggatttttgcgcaaatcatgaagtactgaatcgtcttctgtccagcccgggtcgaatgcaagaagcggtccgggggttgatgctgcatgccggcattgaccctgatgggcaagcatacggggtggagcatgtcccgcatgtccaaaaccattgggtcagtgccatttttgaaaatgctttctgccgcataatttggcaaatttttttttttaacaggatcggctctatccgggaatgtaccgcattgtgctgtttgaggaccgccctgaggaactaccgaggcctatctggaaggggccgatggggcgctgctttgtggtcgctttgttcatgtccggcggacatttcgacgcaatcaaaaaagtcaactgttttttcaagcttggccgtaaatattgtattgactgcgaatgcgtctacaccactgatgccaaacacaccatatcatgcaaaagccggtgtgctcagtgtacaagaggttattttgtgggccgtgtgcgcaaaattttgttcattgttgttgttgttgtacagtaggaccacagcaaccatgtgcgagggaaccaggcgtcagcatacattgctctcaatgcaatcgcttctttttttcacgcatttgttttgatgctcatcggagcggacaagcgtgcagactgctgaaacgatgcacaaaatgcagtcgaacattccaaaatgatgccaaaaacccgcaccagtgttacaccagtttttgtgggcgctgtaatgtacgttttttttgttaagcggtggataaggacaacaaatttttcacaaaaatgcgcaggtataccacgaaaaagatgctgcttgtttcatcaaaaaaattcctgtcccgaaacaaaagcaaaactaccgcattttgtgctgggacacggaaacgcggctcgaacacctacaagaagcgggtcatcagcggcacaaagttaaccatttgtcggtcaacatcacgtgcacggaatgctgcgattctgtgacaggcgaatgcgtagaatgtgcgatatgcacaaccgaggagggaattttgtgcagaaagaaggactggtcggttcttcttcctttcttaatacatgcttgctcacatttttgccgacaggagtgaagcgaatggtgatgaaccgctcagggattttgtcgaatgggttctccgtgcttggagcaataaa

SEQ ID NO: 58612 - DNA, 520 bp, Heterodera glycines
  Genomic contig location: Contig_ID=SeqID_5603; Location=333..852; Strand=+
  SCN-specific regions: Sequence locations=1-431,453-520
gctcatgcagatgcttaaaacatttcttctccttttttcacatgatcacacaatcaatgttttacctgacaaatagtgctcgagatgggtagcacatcgtatccccctgttatatcacgcatcaatatttttctgaactgcacaattgccttcagaagaatctccgtatcattttggcaatatgattgaagctcgtccggcaaatagaagggtgttgttgttttattttcctcatacctatgggaaatggggaacccccaccactgaaataaccctatagttttgcttaccaactgacaaatttatcgtatttttctcgtttcattgagccagcacagtagtcttctattggcggcaaatgcggaagcctcacgtcatagttttcccttaaaagcattattttttgacaaatgtcacagctttcggaaaaaccttcggttgaaagcatagggaaaaaaaggtttctctgcacagtccaaattgaaagtttttggcagttgatcgagacgaacgggcatca

SEQ ID NO: 58613 - DNA, 537 bp, Heterodera glycines
  Genomic contig location: Contig_ID=SeqID_5604; Location=748..1284; Strand=-
  SCN-specific regions: Sequence locations=1-445,469-537
atgccctgtaagaaaaagcttacggaagcgctttattgtgagtcctgcgatcaccatgcggtctcgcctttgaacaacctttacttgcgcatcgatttgcgtgactgtgaagacattgagacgagcaagcagattaccgcattttcatccacggccgtcaaatatcttggcctaaagattgacgagttttcacgtttagcggagcagcgtccaaagaagctggcctccctgcttcaatcaaaaattgaagaaactatcgcgctcaaattgattgtcaaggtaaatattttgcgcacatgacattttcacaaattttgcccaattttcaaggcaaaaggtgagacgctggactgggtcatcagttcaatccgggtgcctgagcaggtaacggcggttgatgatagtgtggatgcgcaaaaaggcgggagcaaagatggaaacggcaatgacggtgatgatgatgatgacatctacacgatcgacgatgctgagtgcacgcgaatgccgccaccgaagcgtccaagaaaaaccgaatga

SEQ ID NO: 58614 - DNA, 1120 bp, Heterodera glycines; identical to SEQ ID NO: 27954
  Genomic contig location: Contig_ID=SeqID_27954; Location=1..1120; Strand=+
  SCN-specific regions: Sequence locations=1-1120
  Gene Ontology: Mol. function=signal transducer activity; Cellular component=plasma membrane; Biological process=invasive growth

SEQ ID NO: 58615 - DNA, 1457 bp, Heterodera glycines
  misc_feature (40)..(40): n is a, c, g, or t
  misc_feature (48)..(48): n is a, c, g, or t
  misc_feature (67)..(67): n is a, c, g, or t
  misc_feature (112)..(112): n is a, c, g, or t
  Genomic contig location: Contig_ID=SeqID_27957; Location=244..1700; Strand=-
  SCN-specific regions: Sequence locations=1-266,290-343,374-394,423 -480,516-540,561-573,595-596,617-644,667-687,715-718,776-780,941 -970,1047-1075,1198-1198,1227-1233,1278-1305,1352-1382,1404-1425
atgattggaaaaattgaaaccgcaataccagcgatattgngttagttncattgattattctccccanttaatttaaaaatgcctttgacgccaaaaaatgaatttcttaaangaaaaatgatacccaacttttttttttattggatttggtccgtcaaataaggaaaaatttatttacctcataaatgggggcagccatttcggcatcctaaaatcggggattggtgacaaccccgtttcgaatcccccccccccgaaggaaatgtccgggcccgccgccccccccccctttttttgggtttcccccccttccccccttcccccccaaaaaaaatcccaacctgaaaaagggcgggggggtttggtgttttttccccccccccccctttttatgcaaaaccccccccttttccggaaatttcaaaaaaagaaaaaaaccccccctttttttggggagaaaaaaaaaaagggtggggggagaatttttttttaaaaaaaaaaaaatttttttttttgaagcccccctttttttttaaaatattttttttttttttttttttaaaaaaaaaaacacccccccccccccccggggggagttttttttttttttttttttccccgccccttttttttgggggggggggaaaaaaaaaaaaaaaaaaaaaaggggggggggggggggggtggcccccccccccccccccccccccccccggggtttttttttttttttttaaaaaaaaatattccccccccccccccccccgcgccccggattttaaaaaaaaaaaaaaaaaaaagaaaaaaaaaaaaaagggggggggggggggggggggggggggttttttttttttttttttttttttttttttggggggggggggggggggccccaaaaaaaaaaaaaaaaaaaaaaagggggggggggggggggggcccctttttttttttttcccccggggggtttgtgaaaaaaaaaaaaaaaaaacctttttttttttttttaaaagggcccccccccccccccccccggggggccccccgggttttttttagaaaaaaaatttccccccccaaaaaaaaaaagttttttttttttttaaaaaaacaaaaaaattttttttttttttttaaaaaaaaaattttttcccccaaaaaaaaaaaaaaattttttttaaaaaaaaaaaaaaaaaaaaatttttgggttaaaaaaggggtttttgaaatcccaggaaaaaaaattttttttttttaaaattttttagtataaatttattccagggaatcccataaatatttttccgctttaaaaaataattttaaaaaaattttggaaaaaattaaattaattccactccatttccctttactggccaaaggaattttatatatgttttgtttttatagcatttttaacaatcaccgatattaaaatttattaaattaaagtaaataaa

SEQ ID NO: 58616 - DNA, 1148 bp, Heterodera glycines
  Genomic contig location: Contig_ID=SeqID_27958; Location=138..1285; Strand=+
  SCN-specific regions: Sequence locations=1-4,44-474,496-573,638 -759,781-1110,1132-1148
atggtaaatttattaaatttcttattatttttttctttatttagacagttcaacccagaaatagtggtccacaaagtcggtccgcaaatgtcggctaaccctttttgggtggggggggggtaaattactacgttataacttctcccaaatgaagacgaaacgaatggaatgagccggaggagaaaatattccatttaaaagagggaggatgcagcaaaaaaccataaaaaatttaaagttcattgtcagcaatttccttattttccatttccagaaggaggaaaccaaactgagtcccgaggaggaattgcagaagcaacaggatttgaactcgaagaaagccgtcataaatgcttatgcggaaaagctgaagggtcttattcaaacggacaaagacagcacagcgaagtaagcaaattgataaatttggagtttaagacaaggaaattccagactgaataatgcgctgacggatatgaacattgcttctaaaaacagaaattatcgtcaaatttctttgagacaacggtcggcttcgacaagttcgaccagctcaacttcaagcactgtaagctccacttccaccacttcgtccgattcttcttcgaccacttcttcgtcctcatcctcctcctccacgtcgactgacagccaagaaaagaatgacaatacgcaacggacaacggggagaagcagtccgaagggagttgagcctccgaagcagccgatcatgttgaagcggatgattggagccaacagaacagtgaaaaatgggcagcacgtacccaccgtacaagtcgaaaaccgagtcccacagaaggtcacgaaaatattgcctttggagtctgcccaggcgaaaaagggccgttttgtggcagcctttaaaattgcaccgactgccgctcatttgcccattgccaactacggcacaaaaagcgcagcagtggccaaagcatttgtcaacagtgacggcggagaagacggagaggaagaaacactcccgaagaatgcgcacaacaaaatggaagaaaaccccaatcaaaaactgcaaaaacagttgacggatgacaaaatagaagagcattcatttccaacgacaatggcacacccttcaaaagtggaggaaatgaaaatgccaagcgaagact

SEQ ID NO: 58617 - DNA, 678 bp, Heterodera glycines
  Genomic contig location: Contig_ID=SeqID_27959; Location=305..982; Strand=-
  SCN-specific regions: Sequence locations=1-111,330-678
atgtacttttttctgttttgtttaccgatcggtctatgcgcttcttccgctcagatcaccacttccctgatgatgatggtgttcgtcgtggtgcccgaggtgagccgatcactctctctctctctttctctccgcttctctctctctatctctctcttccctctctctctctcgcactcactatctctctctcactctttatctctctctctctctctttctctctctctatctccccctctctttctctctctctcccccctctcttgatctctctctctcctcctctctctctctctcctcctctctctatctctctctctctctctgctcacctgtcaaagggtctgacttttcagtggcttgccgactcgcagaacgacgccaagagattcaatcaaacccgtcacatcaaagtgattccgccaaaaatgttggcccatgccgatgagctgaacaccgtcctcgactttggggtgcaccctccggcaaatgcctttgatgagtcatccccccccccttcagggctaccttcaatattcctacctcttttacgggttctacagcagtgaaacggtgctgaagggtgtcgtcattccgtataatgttccggtcgcttatttctgcgtcaatttgttcctgttggtcttcagcattttcatcattttgaagaagtga

SEQ ID NO: 58618 - DNA, 132 bp, Heterodera glycines
  Genomic contig location: Contig_ID=SeqID_27960; Location=211..342; Strand=-
  SCN-specific regions: Sequence locations=1-37,59-132
ggtcgattcttaggggtgtattttttgattttattgcatttttgttaaggaattttccaaaaaatcttgaaatagtgaaaaaatagtgacaaaacgccaaaatagtgatttttaactacctattttagtgac

SEQ ID NO: 58619 - DNA, 1153 bp, Heterodera glycines
  Genomic contig location: Contig_ID=SeqID_5605; Location=729..1881; Strand=+
  SCN-specific regions: Sequence locations=1-279,301-957,979-1038,1060 -1153
  Gene Ontology: Mol. function=chaperone activity; Cellular component =respiratory chain complex I (sensu Eukarya); Biological process =mitochondrial electron transport, NADH to ubiquinone
atgtggcaacgaatcaaagaccgagttcttatttatgatcgaatgggcaggggaacggtgcacggcgagacatcaatcaaatatgagtttaaaacggacgaagtaaataataaaatcgtgttttggttaaactgaaaattgtcaggattttgggaaatggctgaccggatccgactcggaatggagcgagggcttttccaagtgcaaattgtacagaagcgaccgtggctcggcaatctttgagggcacactcagcacacgactggtcaaagtaacgtcacaattttaaaataaacttttcaaaattatcatgaaaaaattctctgtcaaacggtaaaaagtaataaatttttgagtgggaactaattatggcttcgtgcaaaatttaatttggtttttgttcgaatttggggttcagattgtcggcatggatttctatgtataatcaccgaccctgaaaaattcctgacttttgttattttatttttttatccaaaaaatactattttaaaaccatttctggcgattttggccatcaaattggaaatcttggtatccttcgaaagctctttccatagtttaaaatttcaggatggtaaaactcaaagagcaggatggtgttcgatgcgttcgctgaacgacaaaaaagccttcgataggaaaaattttttttcggactggtcccactacacccatcttctgatcaaggtctaagcaacaaatccttgcaatttcaatattttttcttttaagtgccgtggcgatggtcgcacttacaaagtgatgttgcacattccgcagtttatggacatcacttggggcaattcctacacgtatttgctgcacacccacggcggcccccattggcaattcgaaatgattcccttttcacgcttcgttttcacagtcgaagggcgtgcaattgatgttcaatatccgttggaccctcgggcggcgaggtaacgaatcggtctgaatttacttccctgtgagcctaaaacttttgagctcgattggaatcactctcatggacagaattgaggggccatttcgtctggaaatcgactttattggtgccacacatgacataagtcacctcgaaaagcatgcttatgagaaatacaatattcccctaggcaatccgatgttgtaa

SEQ ID NO: 58620 - DNA, 267 bp, Heterodera glycines
  misc_feature (70)..(70): n is a, c, g, or t
  Genomic contig location: Contig_ID=SeqID_5605; Location=1898..2164; Strand=-
  SCN-specific regions: Sequence locations=1-227,249-267
agctcagcccatcaacacaaaccgcatatattgacacaattggtacaaaaattcacaaatttattgtacncactgtttttatttctatgagatttcagttggcggtcacttaccacacgccgcccgaaatccgacggaagacgaattagtgggaccgaataaacgaaacatttaaattgaaaattaataacggattaccaagcgagaagcacatgtgctacagacgttgttttatttaaacgaataaagaataaacggcggaaaaga

SEQ ID NO: 58621 - DNA, 1575 bp, Heterodera glycines
  Genomic contig location: Contig_ID=SeqID_5606; Location=1081..2655; Strand=+
  SCN-specific regions: Sequence locations=1-248,270-434,458-555,577 -1138,1162-1436,1458-1575
atgccacggaagcttctgcaccaactccctatcagcagcaacaaacggaggatcagctcgaattgccgacctccgtaccctccgctgccgactcccagcgccaacaccgcgccacccaacaaccgcagagattcttcaaatccggatcggttggttacatttactaaaaaatcattaaatactgggggtactttgtgcagtttacggggcaaatttcacatacattttcaaaaaaactgaattttagaaatcaaagaaaatgttttatggggttttcgaggtcgctgatcacgaaaccgggctcagaccagcggcaagaagcccatgagaattcgaatttcacatacatatatactcttaatgagtttaaataatcttttattgcggtttagatgactttaagctcattttcatgtattttaatcttgttcggtccaaaaacttcaaattcgaacatttttaattttcgactttttgttcgagttctggtcaggggttcgaaattggccgaaacggatgcctcgtcatcaccgacctcaaaaagccccttgaaacttattttcattaatttttaaacataaccatgtaaaataagtacatttataggcatttgaaaatgtttgttaaatctgccccgtaaactgcacaagtaccaatacatgtgcaagtggtgccccaaatgaacaacacgaccataaaatatttgacaattttaatgcattgtacaagcatcaaaattaaacattattggtattactaggtcgttgcataaaaaagggcgctttttcaaaatgactttttttaagacttgattaacgtttgttatgtcttttttgtgtgtaattcttttatctgaatgttctcgtcatgtttttgccaaaaattttgattttgtccttttatatctaaagttacagtccaaaaaattgggtaaggtcaacaaaatttggctaccattttacaccaatgtccataacttgagttaaaattgtcaaaacgacttaaaacttggtcagattatgaaatttgatgagcttaacaagaaaaagcctgaaagaaatttttctgaaaaagaaaaaacaaaattttttggccatgtttattttggccaagtttccaaatctattggccaaaccgaaagtcaaaaacaaaatccaaaataattccatcggggttttgaggctttttatgcccttaaataatataaaaaattacagaatcgcacaagtttccaaaattgtgttatgggcgattattcgaatttctgaaaacgaaggccaaggagaaaacacttgtctttggacaaaggatttttcttatattttttgaacacatgcaaaattattccagcatagtttatccgtaggaaatccttgttttaaatccttttttaaaattttaaacaacttccctaaagccttttttggccatttttcaaaaagtgggaaaatttgggattttttggccataacttttttaaaaattgtttgagtgcattaaaattgacgccattcaattcatctcgttattctgcatcagatgatattaaatttattagaatttgttacactttta

SEQ ID NO: 58622 - DNA, 912 bp, Heterodera glycines
  Genomic contig location: Contig_ID=SeqID_5606; Location=3232..4143; Strand=-
  SCN-specific regions: Sequence locations=1-96,118-218,240-420,442 -593,622-852,881-912
atggagaaaaacgaaccttatgagaacagtgtcgtcgaagacgatgaatttcatgtgctgcagccacacaatttcgttggtccgttcgggcagcgcagcgcactcttgaggaagccgcggaatttgggcatatgaaagagacggatctgaaaaagtaaaaaaaaaaacaatttactaatttggacagatggaaaacggatgcacccaaaattttgccgccaaaaactttaaaaaattttcaaactttgaattctttcaagaaaaaaactactatatttctccacccccaccttcctcccgacaatatttaattttaagcgttttttagtaaattaaaaaaatcagaatttttttttttgtgaaggagagagagaactctgctcaaattttcttttatgtagcattttacaaaaacaattgataaatgaaataataaaatacccgatgaaaatttgttttttgtttttttttggtttcggcctgtaaatttttttttctgactaattttaggccatatgggcgaaaaataacatgttaaaatgaccatgggaagggatgggaatgcccacacctaaagttacggcactgttgtcaattatttttttaacatattattaaaatcaaaccgtcaatagacatgcccaaagtgatgagcaagcatataagggccctaaattcaatttgtgcgctgtgaaaatttttttcaattacattgagtagaattttgtagattgcaatcggaatgtgacgagttgataccaaatgggacccgaacgaggctttagtgctgaggactgaaattggaccattggcgccttctcattgccagcctctgtgaatggaaaaagagcgaaatataaatttttataataatttttttcagtgaaaatttatcgaagtcaggcaccatag

SEQ ID NO: 58623 - DNA, 793 bp, Heterodera glycines
  Genomic contig location: Contig_ID=SeqID_5606; Location=3335..4127; Strand=+
  SCN-specific regions: Sequence locations=1-188,217-368,390-570,592 -692,714-793
atggtccaatttcagtcctcagcactaaagcctcgttcgggtcccatttggtatcaactcgtcacattccgattgcaatctacaaaattctactcaatgtaattgaaaaaaattttcacagcgcacaaattgaatttagggcccttatatgcttgctcatcactttgggcatgtctattgacggtttgattttaataatatgttaaaaaaataattgacaacagtgccgtaactttaggtgtgggcattcccatcccttcccatggtcattttaacatgttatttttcgcccatatggcctaaaattagtcagaaaaaaaaatttacaggccgaaaccaaaaaaaaacaaaaaacaaattttcatcgggtattttattatttcatttatcaattgtttttgtaaaatgctacataaaagaaaatttgagcagagttctctctctccttcacaaaaaaaaaaattctgatttttttaatttactaaaaaacgcttaaaattaaatattgtcgggaggaaggtgggggtggagaaatatagtagtttttttcttgaaagaattcaaagtttgaaaattttttaaagtttttggcggcaaaattttgggtgcatccgttttccatctgtccaaattagtaaattgtttttttttttactttttcagatccgtctctttcatatgcccaaattccgcggcttcctcaagagtgcgctgcgctgcccgaacggaccaacgaaattgtgtggctgcagcacatgaaattcatcgtcttcgacgacactgttctcataag

SEQ ID NO: 58624 - DNA, 659 bp, Heterodera glycines
  misc_feature (41)..(41): n is a, c, g, or t
  misc_feature (46)..(46): n is a, c, g, or t
  Genomic contig location: Contig_ID=SeqID_27964; Location=222..880; Strand=-
  SCN-specific regions: Sequence locations=1-82,114-212,244-265,287 -487,540-580,606-659
atgcccgtcgtttttgactcggaatcttcagatgaagaagncattnatccttttgttaatgaataattttagtctctaggtgattttttgaatatttttttaaatttaaatatgccgcagtcaaatggatgatgcagaatgccaaaaatttatctgctaaggaatttactcaaattgatcaggataatgaaaatatttggataattttggccaatttatacaaaataaataaataaaattaaactcaggaattgaagaaaaattaagagatatttcacaaattggttttggttattgatactcaatgattaatttaatcccaaattatgcataactattaacctaccgttcaaacattgagaaattataaaaaaacaacaattttttaggcttggctgacaaaagtgcccggcaacaaaacagctgcgaaaattcgccgaaacggcatggcacaaatggcaccgacaaaacgtctccggctcgtacgttaaaaaatcaaattatgttaaattaaaaaaaattaattttagaaaataattcaaagtacttgtccatgtggcaaaatcctgcattattggtcaaaatcctaaatttaaaaaatttattacacaaaactgaataatggattcaaaatcattttttaaatttatagaaataaa

SEQ ID NO: 58625 - DNA, 241 bp, Heterodera glycines
  Genomic contig location: Contig_ID=SeqID_27965; Location=494..734; Strand=-
  SCN-specific regions: Sequence locations=1-101,152-241
atgggtttaaatagtgagcaaagaggaaaagcaaaagcaaaaaagggtaagtaggtaaaagatgtaaggatacgtagaaaattaaagggatgagcacgaacttttatttttgtaattaattatttaattgtaatattatttaaattatattgttataggtttattggaagattatggaattatatttttatttggtgaattcggtttaaatagtgaagaaagagggaatgcaaaaatttaa

SEQ ID NO: 58626 - DNA, 1066 bp, Heterodera glycines
  Genomic contig location: Contig_ID=SeqID_27967; Location=577..1642; Strand=+
  SCN-specific regions: Sequence locations=1-241,289-411,446-577,599 -781,817-1066
atgatgctgcttccgccaatgattttcttggccctctctttggcatttcttttgaacaacaatggcacatttggtggcagttgtacgtccaaagatggcgtcatggtcagcaatggacaaatgaagcaggaacaactgaagaaaaaacgtcagggcacaacgccaaaagcgcgtgatttatcgagaaggaattcaagtacctcaacatcaattggatcagaaatcgacattaatggtaaacaaaatatttgaataataaataaaaatgataaaaaagataattaaaatgcatttttatttgttagcattttattatactggggaatcgaaacattttttattgaattcataataatttcttgacatttttaatttacactttgttaggaccgagaatttaatcggcaagcgaaaaataatcttattattaattaaaattaaaattctaacatgattatcatcggcatcaattgagctttatacgagaaaaattttctgtaaaaattggttaactttgcgctgtaatttattactaatttacccatagaattcggaatagcgaaactaagttaattactgattttcaggaacatttctgaaaaaactacaatgtcgaaaaaacaaaaatattttttctaaaaataatagtttttttgggtaaaaaaagactgtcagaaattacaaaaatgctgctacttctgctacttactactaagattttattttaacgatgtttttggcccagtaaaaatcttttttaaatcaaagtgccaatgccatttgcagatacaatcaacttcatcaaagagaccactcgagatggctacacatcgccaatgcaaagttctcgtttttcggattcgcagatgccttttccaccactctcaccaaacgttactcattttgctgttgataaatcgagtcgagtaagtgatcagtgaatcctttgtaacataaaactttataaaatttaaactttcacgaaattttcaaatattccctaaatttctttaaatatttccaatttttcaaagtttttcaggaatttttccaagtgagggtgtag

SEQ ID NO: 58627 - DNA, 656 bp, Heterodera glycines
  Genomic contig location: Contig_ID=SeqID_27969; Location=998..1653; Strand=-
  SCN-specific regions: Sequence locations=1-656
atggcagatgaaatttggcgggatttgacgcatcttcgcaaaaaatcatccaacggatggcaaatgcacgacagagaacggcgcgaattgcaaatgtcacatggggaaagccgcggctttttggaccgattggagcgaagtgagtcgatgttacggtaatacagaaggaaatgaccgattggcattcagaatcgtacaaaggcagacaaaggatgaagcaacgcgaaggcgagccgacaaaagagaaacatagcaaacagcagaaggggcagggcaaacggaaggaaaagccaccgaattgggagctgtacatcaaaagaataccacttgaggaaggcatggcgaagagcaaaaaagtgccaaagccaaacccaaccgaagcatggacaaagcgaaacggcacagccctaacggagaggggagaaatagagggaccgacggagcgaaaggcaatggcaaaggcacagggagtgccgacttatggggaaaaagcagcccaaagaagtcaaactgacaatgagcagcgcgtggaaccgatcgaatgtccgaaggggccgccggggtttgcagggaaagcggggcacgacggcatcccgggggtgccgggtgttcatggaaaaaaggtgaaagggaaacgaaatgagtgtaacgattaa

SEQ ID NO: 58628 - DNA, 1217 bp, Heterodera glycines
  Genomic contig location: Contig_ID=SeqID_27970; Location=28..1244; Strand=-
  SCN-specific regions: Sequence locations=1-1032,1054-1217
atgaaccgccggtaaaataatatttagacaaaattttcctttactctgatttgattttccacaatttcagttggatttgcaacgacgtgtggatggacattttccctcattttgaccgtcttcaactcggactctaattggcacttctttcgtcacgtttcgaatttttggtcgacaaacatttcgatggcacaagcgaattgccaattttggaagaatatcgtattgcgcaagaacaaagtgacagcggtgccagaattgcgtgtgtttattgacaatgccaattatgtgccctttccggtgcccgaccattcgctgcccaagaaaattcgttttatgcatcttcggatttggtaattcaaattccgacatggattaacggatacaatgttcctattttcagctacatcgaccattctgtcatcgcatttatccgtgccaatcagcaaatgttcgacaaaggaacaaacttggagttcttctatgtgtcttggaacgaaaccttttttgtccagccaatttggaatgctttgatccgccatattttgccaatttttgtgccaaatattcgccaattgaaatttccaagtgctgatcatctgtactgtttgcttcgtttcacttctccaaaagtgctctccgatctcaacattcattcaatcgatgctgatcgtctgttcccaaatgccattgattctggtgaccaattgctcgatgagatttgtggtgattctgatcagccacttgcatattctgctggccaaattctgtctgaatggcttcacatcccggcaaaagatggccaactgaagaaattgatttgctggagtgattcgtcagaaatcgctgatttagtcaacaatttcaagaaggtgtgtggacacattttcgttggattgactgtcattgattttcatttcccttttttagaaatttatccgtgccaccacttcttccgccagctatcaaattcaatttactgttcatgtgccaacggaaattgtgccatttcaattggtgaacgaacggaccaacgaaaagctcacattggagaaagcagaaaacaatgatgaaagtatggatgaagaagatgatgatgaatgggatgagcgatggataatgaagcgatgtcaaattggggagactacggccgcgctaaaccaaaattcgggcaatttgaacaatgtcagctttacgttttatgtgaattgcattgg

SEQ ID NO: 58629 - DNA, 816 bp, Heterodera glycines
  Genomic contig location: Contig_ID=SeqID_5607; Location=138..953; Strand=+
  SCN-specific regions: Sequence locations=1-54,83-125,184-219,241 -618,643-816
atggacgcaattcttgcaaccgattggctccacaatgcgttcccagagcgaaagacaacaacaacaacaacaacaacaacaatttctagtgtggaagaagaattagacgatgccgtcaaagcagtgagttttacacaaaaataaatttaaaaaataaaataaaaaaataaatgaataaataaaatcaaggaagagcaaatcagttggcttaaaattatcgaagaggaggaggagcgaggaaatgaattgcaaactggtgaaatggaagtggaacgagcgaaaggtttggttgtttacaagaaaaaaatgaaaaaaaatttagagattgagccgccaaagcgacaacacttacagtccaagtgtagctgtaacgaaaagcaaaagagtgtcccgctgattgactttctctgccaacactacaaatgttctgttaaagagcttcacgttctgcttcagacgctgaacaaacgtcgcgaaatttcggaaatgttgcgctctcagcttcagttacgcaccaaccatctgcgtcctgcctggaaaaattttcgcgtccattgcaacgaactgacaattcatcctgctcaaactgcatatgccatgcgcggttatcttggcattacggttttttaaatttaaatttatcagctcctcaattgtatagatgatatacattgtttttaggtccgtatttactactatgtgaaacatggcgtaaagctcgtttatcctcagcttccctgtgttcttcaatttggcggtggtgaccattgttctctgtttccgcttgagtgtctgagcgtcataaaagatgcctga

SEQ ID NO: 58630 - DNA, 385 bp, Heterodera glycines
  Genomic contig location: Contig_ID=SeqID_5608; Location=371..755; Strand=-
  SCN-specific regions: Sequence locations=1-277,299-385
atgaatgacgtggcaattctacgcgaaagtgtgctccaatttcgcaaaattattgctgagaatacgaatgggctcgatccgttcaaagtcgcatccacagcagctggccttgctttggcaactctgcgtcgctgctttcttccaatgaataagctggttaacgcgccagagggtggctatctaagggggaggagagcatctgctgaatcggcacgttacattcgttactatgaaatgacccatccgggggtgcatgttcaatctgcacagtggtccattggtgaagctaacgttgaggacactggttatcgccttgatggattagttacacgagatccacctgaacgggaccttgccattgagtatatgggctgcttttatcacg

SEQ ID NO: 58631 - DNA, 2279 bp, Heterodera glycines
  Genomic contig location: Contig_ID=SeqID_5608; Location=813..3091; Strand=-
  SCN-specific regions: Sequence locations=1-1121,1147-1152,1181 -1410,1478-1617,1639-1819,1841-2213,2235-2279
atgaatcgttttgaccaaaatgatttcactataacttctgttcatcaaatgcgcaatcgccctcggaacacaattggagaaattgcggaagtgagttttgcgccacttgaagaagtagaacggcccgaccgcgtgcttgagcgtcttgtgcgacggttgtttgatcgagtgcttgatgggcgttcggcacctatgctaatcgggcttcaattacacccaccgacctttgaaaatccatttacaattccgcttcgtcctcccgagcagaacaatcccgccgcaattgctgatttaattcaaagacttaacgatcaatctgccgctggcatagatctaacagctggcacaactgtgacaaaagtacttgcggtatggccaatgcaagcagatcagagcgacgctggaagatcaggtttaaatcttttttctttttttttttttgcaaaattttttaaataggtgcatgcagtcttgaggatgaacatcgattggtgaacactgttcgctcgttgattcgcattaaaaatccgaatgatcgtctttgtttggccagagctgtgttgcttggcttgcatgattggcgggcacgaacaccaggtggcggtggaattcccgctttcaaaagctacgcgaatcgccagcatacccacgggcctgaggcacgtaacttattgcgtcgcgccggaataccaagaaacaagcatatgtacacaattgacgatgttcaaaaattacaagcttggattgatcagcgttatggccatggagaaattcgaattgcggtttttgagaaggaacgtgagtaccgaattgtgttcaaggcagcatcaggcgaggcggccaagttcaatttatgtcttttgttggaaaatcaacatttcaattacgttggacgaattgagcaactatttcgtgtgcaaggatattgcattgattgtgaacgtcgcgtgacacgttggtaccacccccaggaatgcaaagtcgtttgccgtctgtgtttacgctttggtgtcgggtacccgtgcaaacaacattcacgagcagatggaacagctagcaatcgtctttgcagtgaatgtctattcgtttttcccaatgacgactgctacgcctatcacctgagcaatcgagcaccttcagctatgcatagccaggaagggggaggaagaggaggacgaacttttcgtccaatatgtgaatggagaagggcatgcagacaatgtggagccattacttatgcgaactatccgcataagtgtccagcactaattagtcaaacgggatggatgcgttgtccacgctgttctgggccacatccgattggatacccatgttttatacaacctctgaaagataaacctactagcggaagaagaagaagagagagaagaatgcgacaaccaaatcatcataatggtaataataataatgatgatgatagtggtaacgatagaggccatgatgatgatggtaatgaagtggaggaggaggaggaggaagatgatgatgacgcaaacagtccaaaaaaggcagtcaggctttgtttttttgatgctgaaacgtcccaggatttaccacttcaacttcgcaccaaggttgtacagaagcatgtcccgctgctcattattgctgaaataatctgcgaagcgtgcataaatgaaggaatttcggttcactctggtgttggacaatacgcaaatggatgtgtgtgcagtccccctgtgggaccaaggggacgtcgttggtgttccccgccatttttaaatgtgcctggagatgacagtgctctaccagcctgtgtcaattacaacccacgaagactgtttttccatagttttgacaatgccaacaatgacccagtggacgactttatcaattttctcacgggaactggcccgcatggtgtcaaaacaatttgtttgtcgcataatggtggaaaatacgacattcacttgatactggagacacttcaccggcgcaatttaccacaaaagcgtatttgcacaatagggctgaaaattttttcgatgactttgaaggggaaccaccaacgggatgtggtgttcaaagattcgctgaacttttttttctgtgagttggatgcactgccacgcacatttggattgaacaccgaagttgcgacaacaaaaccgttttttccttatctgttcattcggcgtgaaaatttgcatcaaagattgcgtggtttaccgcccaaagaattttatcaacctgatcacatgaaagcacaaaaaagagatgccttttttcattggtga

SEQ ID NO: 58632 - DNA, 1013 bp, Heterodera glycines
  Genomic contig location: Contig_ID=SeqID_27972; Location=138..1150; Strand=+
  SCN-specific regions: Sequence locations=1-52,76-278,315-409,431-1013
atggcaagcgccgaacgtcagccgttcttttacagattcggcatcttttacccacaaggaatggagaaaagagaagctgaattttcggtatggcgttttatttacatttttggctgcttttctgctcgtatttttgtaaatctccgcataaaaatgcatttttatccgtcctttttcggggcccataccaaaagaatcgagtaactggtaagtttgccctgagtagctgcggtaagattcttaccctgggttggcccagggtaaacatgtgaccttgctttttaaaaaattaaaaaagatgatattaaaaaattcattttgctaatttgtaagttgtacttaaagtctgctctattcaatgataaaattttcgttaaacttttttgtttttcactgagctagggagcatcaaaaattttgaaaattcttaaatttttttgttgattttttgtctatattacttttaccggttcaaaataatgattattcgattttggacaattttattttcccttttttttaaatattcgacctttggaacatgaaatacccacaaaaatatactgcgttttgcgtttaataactttccttataagtaatataatttcttgatataattcgatagctctaaatgtcctctataatcctataaaatttcatagaattaatgaaataatgaaagagttatgatttagtaatgatactaaaagaaacgggtaaaccaggtaattcgctaattttgctacttttctttcagatttgcgaaaaccccgaggaccacaactgccgttcgttgccgctggcggtggatgcgaatgatcacctcaattattttggagtcaattcggaggagtatctgaaggcgggatgcccccgagacatgctcctctgatgggaatggcactccctttgctcttccgatgagattggcactccttttgccattgccaattgatcctttttttaatcatttttcggtcgttttttctctgatttgccctttaattctgtaa

SEQ ID NO: 58633 - DNA, 831 bp, Heterodera glycines
  Genomic contig location: Contig_ID=SeqID_27975; Location=223..1053; Strand=-
  SCN-specific regions: Sequence locations=1-98,120-270,293-538,560-831
  Gene Ontology: Mol. function=extracellular matrix structural constituent; Cellular component=extracellular; Biological process =cell proliferation
atgaagaaacaccaaaagaaactgaaaacgacgccaaaagtgtcgacaccaccgcctgtctcaagccctgctaaaccaacaactgtaaaaccgtcagctcctcctccatctgtcacaacaccagcgcctcccacaattgcaaagccaccagtaaccacccctcctacaaccacaaaaccaacaacaccggtccctccaccagccgtacaaccaacaacaccggtccctccaccatccgtacaaacaacaacaccggtccctccaccagccgtacaaccaacaaccacccctcaaccgacaaagacaccagtaaccgtccctaccccgaccacaacaccggtccctccaccaccaaagacaacaactgaggtaaagagcccatctgctaagccaacaattccggcaccgccagcgcaactaaagagttcggcactgtctccgaaagcacccatttctactgttaaaccgccacctccagtttcgctttccgctaaatctaaatcgccgccatctcctccggaagaatctccaccacactatgatgaagaaaaagacataaccgtaaagccaacatcgcctgtaaaaccaacaattactgcgcctccagcacagctaaaaagtccggcagcaactcaagtcatcaaacctcctcaacagccaactaaaccgttggctccgcctccaggcgctccacctcgttttccagctgctgcggtgtcaccacccccgccgacgtcagcagctcaaattgacccgtcgcgtttgattcacacgctcgatccaccaaaaatttatttcaaaactcctccggccaacgttgaaagtgtttga

SEQ ID NO: 58634 - DNA, 145 bp, Heterodera glycines
  Genomic contig location: Contig_ID=SeqID_27976; Location=575..719; Strand=-
  SCN-specific regions: Sequence locations=1-1,46-145
gaattttttaaaaattttaaaaatttttttgaatttttaaaatttccctgttagtcccggtcccgaagaaaaatcgaggtcccggtcccggcttctcaggtcccggcaagtcccggtcccggttttgcccaaaattcccggtccc

SEQ ID NO: 58635 - DNA, 1070 bp, Heterodera glycines
  misc_feature (24)..(24): n is a, c, g, or t
  Genomic contig location: Contig_ID=SeqID_27977; Location=12..1081; Strand=+
  SCN-specific regions: Sequence locations=1-247,285-640,662-748,778 -793,825-1070
  Gene Ontology: Mol. function=cytidine deaminase activity; Biological process=nucleobase, nucleoside, nucleotide and nucleic acid metabolism
atgaaggacagctcagtcccgcgngaatagcaaatgctaatcgaacatgcgcaaattgtgcaacgcaattcgcacagcccttacagcaaattcgccgtcggcgctgccattttgaacaacgacggacagattttcagaggaggcaaagcaaaagcggacggacgcttttcacttgaattgtcccttcccattcagcaaatgtggaaaatgcttcttacggggcgacaatttgtgccgaaaggagcggtaaaataaaaaaataaattttaaaaattgtttattttcaaatgccaactttttcagcaatttgttccgcaattgccgcaattgggcccaccaaattttgcccaaaagcaatttgtgtagtcagtgagtcacgagaaattgagaagataatgaaaaaataatgaaagtttagccgatttgactgaacccggcgcaccgtgcggcatttgtcgtcaaactttggtcgaattcggtgacatggcggtgggttaattttataaacattctcaaagtgttcatccattagcaatacatggagaaagaatattcattcatttcacactaaacacattgaccaatttaatttcttttccattttcttttcggcaacgaattatttggtcgtttgataacattttaattattattattctttgaaaatgataattacttttggttggcgaataaatttcaagtcattaaccaaatgggtcacatttatttatacgtttgaatttggtttatcagcagaaaagagaagagattgctgaaaattaattacccctattaattgtggttatttatttatttatctttgtcaatttgtcttccattattaaatcgtccttttgctcccccccccccctctaattaaggttcttttctcccaattaaggtccttctctattcgcgtcccagcaaaaaattgttaaaaacgcgcgtccaaaatctgatcccaatggcattcactcccaacgcattgaacactttcaaaagtgacgcatcgatgagcaattaaccgaatgaatggacgcgcatttgaacagtgattgatcaaaccaatt

SEQ ID NO: 58636 - DNA, 830 bp, Heterodera glycines; identical to SEQ ID NO: 27978
  Genomic contig location: Contig_ID=SeqID_27978; Location=1..830; Strand=+
  SCN-specific regions: Sequence locations=1-171,194-615,638-830
  Gene Ontology: Mol. function=protein binding

SEQ ID NO: 58637 - DNA, 647 bp, Heterodera glycines
  misc_feature (121)..(121): n is a, c, g, or t
  misc_feature (188)..(188): n is a, c, g, or t
  Genomic contig location: Contig_ID=SeqID_27979; Location=599..1245; Strand=-
  SCN-specific regions: Sequence locations=1-157,190-475,598-647
atggaccctgagcagggcgcgggcggattcgtcggatatgcgtatgttattaatgtggatgtaagatcgatagaaaaaaggaaaatacaaccctaaaatcccaattttttgacttcaagcnccaccccccatattatgcaatagggggaggggccgacccccccccccccccgccccgcccccccccnctgaatttgttcgtatgagggcccgaaaaggggagggggggggacttcgtatttgttgggataaaatgtggggaaaagttggagacgaaggggtaagagagagtgacttcgtgaagtcggctagtaatcacaaaatttggtcatttttagtgaaaatctgttaacaaattgcactcaaattttcagaaataacccctaagaaatgggtttctttttaaaattacacttcataaaaactccgtccccttttagtattgctggaaggcattggacaagaaggaggaattggagaaaaaggaggagcaattggagaagaaggaagagaaattggagaagaaggaggagcaattggagaagaaggaagagaaattggagaagaaggaggagcaattggagaagaaggaaaagggcaacgacgcagcagcagcgaagaaagaggaaaggaagcgaaagaagggg

SEQ ID NO: 58638 - DNA, 620 bp, Heterodera glycines
  Genomic contig location: Contig_ID=SeqID_27981; Location=126..745; Strand=-
  SCN-specific regions: Sequence locations=1-199,222-620
atgtcttcatttgctaaattggatgctaaaaaagtgcttattgttgtgacgggagcaagccgtgggattggacgagaattggcccttcaaatggccaagttttttgcgacgaatgaatgttttttcgttcttttggctcgcggaaaagaagcgcttgaggcggttggggatcaaattcgcaaggagttcggtgtcatttacaacttatacaaaggcctagactaagcctttgctttaggcttaagattgcttgggctcaaccgcctattatattttcaatatagtttttctgcagaaacccctcggctgttgttgaactcgtttttgcggacttggcaacacaaccctttgcgttgggcagcattaacagccgaataaaggcgtggagaggtagtcattggacaaaagttattccatgcgcttattccgcttttaccaattcagaaaccgttccgtttgacctctgtttgctcttccacaacgccgggactgtcggtgaaatggccaaaaaatcatccgaactaagcgacgaggcgcaatggcacgagtttttgcaggccaatttggtgtcagcgattttattgaacaacggagtttatgcggccttaaacaatgcagag

SEQ ID NO: 58639 - DNA, 141 bp, Heterodera glycines
  Genomic contig location: Contig_ID=SeqID_27981; Location=834..974; Strand=-
  SCN-specific regions: Sequence locations=1-141
aatgctttatctgtgcctgtgatactttcccgataaaccgtcattttgtggccagttgctatcagctttaacctttcatttaaaacatgttctctttgttttgtcttgcataattgccaaagtataaatggtggaaagaaa

SEQ ID NO: 58640 - DNA, 6981 bp, Heterodera glycines
  Genomic contig location: Contig_ID=SeqID_5609; Location=369..7349; Strand=+
  SCN-specific regions: Sequence locations=1-615,637-1056,1078 -1321,1343-3062,3084-3086,3109-3126,3151-3187,3210-5066,5088 -5172,5194-5842,5864-6354,6386-6981
atgtcgggatttttgcggacaaaaatcgcaatagagctaaaggctcttgaaaaggcgaaaactgcaacagaattgcatgttgagccggaccaaactctgaccacattggaaaatgcgattctcctggaaagcgcggcagagagaataaagtcagaggtggaagcagtgaatgccaaaattgaacaaatttggacatcagcaagcaaatggcatgacctcatacaaaaaatggacaaggacgaacgaaaaagtgaacagacagtgtatgatcaatttcaaacaacggagaaactgaacacaaaaatggaaacagccaacacaaagctaaccgaactgaaggacctggcgatgaaggtggaagctggagcaaagctgcaacgctcaaaagcagatagagacgcgcgagtggagcaaagagaacatgcaaaagcaatgtcgaagtcgaatgcagaagcagacaaagggaataaccgtgcgagaggcaatgaaatgactgccgcattgtaccaattgccaacactaagaattaagccgtttgggggagacaaacgggaatggcccatgtttgaagaagcatttaaagtggctgtggaccaaaagccaggaagtaaaacggagaagctgaatttgttgaaatcgctggttgagcgagaggccgcattgcttatcggaggcctacgcctggaagagaaaaattacgaaattgccatgaagctgttaaaggacacctatggcgacaaaggcgaatatgtaaggaggttgcacacggagttgtcgaacctcaagagatgcttttcggtggaagacacaaagcatttttgcatggaattggaacgcctggcaagagaattggaagcagcggaagaagacattgaagggccgccaatttatttaatgcttgagaagaagctatacaagcctttcctgcgtgaaattctggaagagaaagcaaaaaatccagacttttgggacacgtcatccctccgaaaggccttaggaagtgcattgagcaaagagctagcaatcaaagaagtcatgagggagtatggcttcgaaggcaaagaggcaaatccagagcatggattcaaacgacaattaaggcggaacagattcggaggctcagtcaatgtagccacaacacatttcggaaaacccaacggagagcgaagaaaaattccggaacaaaaaatgccaaatccgaggcaaggccagcgaagttttcagcagacgccacgaaattccgcattccgagaccgtaagggacaaggaagaagcccaaaaattcaacggaatccaacggcagttaacactcaaggggaactgcttctgtgtgttttctgtggagggaaacacagacacgacagttgcgaaaaggcaaggacggtgcaacaacgatttgcagtcctccaggagaagggcttatgctacaaatgcctgaagtcaaatcatatcggaagaaattgcccatgcccgatgaaatgtttcaagtgccagcaagcacacccaacggcattatgccatcaggcaaacccacaaagggtaacagaatggaaaaacatggcaaaccgagtcatgaacgtccgggaagaagagaaaccggacaaaagagacgaattcaaagaagtctcattcacgccctcgcaatgcaattcagtgcaaggaaattcgcgagtcctgctgagaacagcagaggtgaccatcttcaatccatccaatccaaaaagaagcatggtcgcatcagtttttgtggatgacggaagtgaacgctcattcatccgtgccaatgtggcaaaacaattaggccttccggtgattgaaacggaagagtgccatttgactggttttggcgagaaagaagccaaacgctacgtgagcaatgttgtccgcgtaggatttctgggagtcaacggagacccatatatatgcgcactcaatgaaatggaattcattgtgaaagcgatgcccatcgtaacgctgaattcgatggatgaagcggaattaaacaagaaaaaactttcccttccatcgcggccaagacagccagacattctgttgggaatggatgtcagacatgacctgaaaataagagacgaaacagaaaagttgccaagtggattcacattgtcaacgtctcgagtcgggcggatgataagtggttatggccaagtccagggcccaatggacatgagtgtgcaagtgacgtacactggagcactcataagtgccttacaatgtgccagtagcagaagagatgctgacgaagaaattgaagaacagataaagacatttttcgggctgaacataatcggaatgagtgacaatccagaagaaaacgacaaagaagaagtgatgagaacgttcagaaaaagcttgacattcaaagaaggaagatatgaatgtggcctaccatggaacgaaagagtaaaggatttgccgacaaattttcaacaagcgagggcaagactttgtggcacagtgaaaaaattgcgagaattaaatttggtggacgaataccaaaaaattttcaatgagtgggagaggaacgggataatcgaaagagtgccggatccaacacaaacaactggaccggtacattatctcccacatcggcccgtgataaaaatggacaaggccacgacaaaaataagaattgtgatggatgcatccgcgaagccagcaaaccgcaaaggagccccatcgttgaacgaatgcttgcacacagggccgttgttgttaaacgaattgaccgggatccttctaagatggagaagaatgaaggatctaatcctggcggacatcgaaaaagccttcctccaattatcagtgagagaggaggacagagacgcgaccagatttctgtggctggaggatccacaaaagacagaaatttcaagcccaacatatgtgaaaaccgttgtgtttcggttctgtcgggtctcatttggattgacaacttcaccatttcttttaaatgcaaccatccgtgaacatctctcattctacgacacggttctaccgcaaaccataatggagaatttgtacgtggacaacatactgatcaatgtgaagaagaatgaagacatggcgcaaatttgccatgaatcgatcgagctgttccgtcaagggggaatgaagctgcaggaatttttctgcagtaagccgatcgccatacgaagccttcctgtggaattattggccaaaaaccaaaaggagataaaagttctcggaattccgtggacgaatgaggatgatgaaatttgcttccgatttaaaaaatttgccggaaagcacacgaagaggaacatcttggcacacattgcaaaaatttatgaccctttggggttagtggcgcctgcagtgctcccagcaaagcattttttgcaaaaacgttttgaagccaaaaacggctgggatgaaggattggaagaagaattgattcatgaatggaatcaaatcatggagacttggcaaacgaaagaggggacagaggtccaaattcgattcgcacgaagagtcgacaacgaagacgaagtggacaaggaaatgcattgcttcgcagatgcgagcggaaaaggcttaggcgttgccatttacatccgggaatcgacagaaaaaatgagcgccaatttggtgtttgcaaagagcctggtgaagccctccaacatatcagatgttgcggcaacaattccaaaaatggaattacaatccataacgctgggagtgaagttgttaaagtacgtgctccaacatctcaaactcaaaccaacacagacaacaatttggactgacagcttgtgttccgttgaacgaattaaggagcataagaaatgcgatcgatttgtttcaaatcgattagcaaaaatacgtggacagtttgaagtcaaacatttggtcagtgcagataatcccgcggacgtggcatcacgcggcacaacaccaagagagttgagcagaaatttgttatggaagcatggccccaaatggttatcagaagaaaaggccctgtggccaaaaccagcaaaggtttatcacccagatgaagagaagctcagggcaagtgcggaagatgaagaagtgaaaacagccgcagtcatgaatgaggtgcctttccaaccaaccattgatgtgaaccggtactccagctggaaaaaggccaaaaccgtgggtgcctatgtcttacgctggatacattcggtggcaaaaaacggatacaatggaaatttgttgccaattctgagcaaaatgggcccaaaaaagcacgggaaccaagacaagggcgtactgtcagtgcccgaattatgtgcatccgaacatttgctgatatgggaagcacaacaacaatttccaacggaggaaaaaacaaaggaaaatcttcgtctgttcaaagacaaagaaatctggagatgccgaggacgcattggagaagcaacagtaaaggaggaaacgaaattcccgattttcttgcctcctgaagcatggaccacaaaactcattgtgctggaagcacactggaaaatgaagcatccaactcacagtactctgttggggtacatgagggaaaagtactggatacccaaaggaagaaggttcatcagaaacacgatattgtctgatcgacacggatgtttgaattgccgcaaagagaggcttaaaccatatgcctatccacaaatgccaaacttgcccagtgaacgagttgcgatgataaggccatttgagaagacgggcgttgactattttggcccattaacaataaaaggcggagttaaagtctacatcgcactttatacctgtctcgtaatacgagcggttcatttggaagtggccgatgattgtacggcaacagaatttttgaggacctttcgaaggttcagctcacgccgcggcctcccaagcctaatgtggtcagataatggcaccaattttattgctggagcagagtgcataaaagaggaatggagaagagaaatactggtggaaaccagccactcaggagtgagttggaaattcaacgtaccacgagcaccctggcaaggtggcgcatgggaaagactggtgggcatcaccagaagtgcgttacaaagaacagtgggaaaaagcctaatggaaaggcaagaattcgatacgcttgtttgcgaaatcgaagccgtggtgaacacaaggcctcttacattccaatcagaagaagaattcacacaaccgctcagacccgtcgattttttattgccatataaacgtgtggaaacaagccttccattgtcggacgaagacccaagggatcccgactatgcataccaaccccgaaaaaagggagaattgcatcaattgatgagagttgcaataaaaagaatcgatcgattctggaaacagtggaaaacggagtacttactttcactcagagaaagagatcgaaccaaccgagcagaaggaagtctcccaagagagggggatattgtcctgattgaagaagaggaagacccacggtccatttggacgatgggaaaagtcgaaaagcttttgaaggggagggatggactcgtgcgcacggcacgagtacacacaaaaggaaaaactctggttcgagcgattaaccttttgtaccctctagaaattaacacttctgcggaggacgaagtcagtcaaattcaagtgactgccattatggattcaccaagtgctgtgatggaaggcggggacccgcaaactgtcacaacggagtcaagtctgcctccagggacagtgatgcaggattcacaaatcgtcacgacagaatcgtctcctgtcagaggaaggaatgagcggcaagctgtgaaagagagaattcgaaagagacagccaacggaggaagtcagaggcaaaggcaaattgaagaagaatgggccatatgatccactgcgaccgggcaactacagaattcctcgccgaaacccgttctttccgtcacaagtagcgtacaatgagcaaacacgcacgtatcgacgacgacgggggaggacgattgatctttcgggattgaggaagttgttcgctggattgggcggcactgaattcgtgagacgagagctgcaagagaaggctaacccggctctaagagaagaaaggctgcgaaaagataaagtcaaattcatggaagatgacgccaggcgcgtcgctgagcgtgaaagaaaggcagcagaggagaaattggaaaaatcaatgaaggattctcaacggcaaacgaatgtcgaatcatcgtcgggcggaacgacacgtaatcctttcgaatcgatggaagtgcttcccggagaccccgagccagaagttcctttggaggaattggcacgccaggagaaatttgatagggaaatggcacttgaacagaggaagatgtatgaaaaacgaagagcagagagaaatgctgagaaggatcggatgcgttggggactaccacgcggagtggttcggagaaaggggcattatgcaccgcatcgagggatcaacaaaaggcggaaatggcaccgtggacggcaccttaatgagatccaaactgggcggaagtaccgacgtccacgtggccatgacatttctccgctacggcaaccaaatggcgccacaaccgaattgctggccccaagtttggagatggaaaggcaaattcggaatgacaagcgagcacgggacgagagccagtcaaaggagcccgtgcggtcccagcgacgactcaaaggcagagatccgttggacgaacagttgaaaagagggcaaaaaggacaacaagctgaagagaaccccgacagaataaagctggcaccagcaagtcccggctaccgacgtaccatcaattattcgctgtttacgcgatgtgagcctggtgtaaagggacacgaaggttgtctaaggaattgcaccatgggaagtctgtcccacggccggctaaccaaaatcccgcaagccgaatcgaagcggtctgcctggcccaagccttcgcattcgattggctag

SEQ ID NO: 58641 - DNA, 413 bp, Heterodera glycines
  Genomic contig location: Contig_ID=SeqID_27984; Location=154..566; Strand=-
  SCN-specific regions: Sequence locations=1-413
ttgtacctcttctaatcactgttcttcctcttttaatcactattgtacctcttttaatcacagatgtacctcttctaatcactgttcttcctcttttaatcactattgtacctcttttaatcacagttgtacctcttctaatcactgttcttcctcttttaatcactattgtacctcttttaatcagagatgtacctcttctaatcactgttcttcctcttttaatcactattgtacctcttttaatcacagttgtacctcttctaatcactgttcttcctcttttaatcactattgtacctcttttaatcactgttgtgcctcttttaatcactgttgtacctcttctcacactgttgtacctcttctcatcactgttgtacctgttctcatcacttttgtacctcttctaa

SEQ ID NO: 58642 - DNA, 842 bp, Heterodera glycines
  Genomic contig location: Contig_ID=SeqID_27985; Location=73..914; Strand=+
  SCN-specific regions: Sequence locations=1-89,111-142,164-434,456 -471,523-619,641-842
atggccaaggaaaagccgaaggaaatcgaacaaaacaagacgagaaacatagagaagagcataaaagaaagaccattagtaaggggcaaaccgatggaagggacagagaatggagaggaagggacaaaagagcacatggaagagagaaaaacggaggagagaatgtgagggaagacgaacagacgaaagactgcggaacgactgatccaatcttatatttccaattttgctttcttgattcaaagtatcaaatatgtattcagaccaattactaagaaattgtgtcgtgttgaatgaggaccgcagccgggggaatccccggtcaaaccgggggacgggaagccccgtacggggacaccgtgatgaaacaatttgaattatttactaaagaaagtaggaatttctctttgattgcacatttttaaatttatgttagggttattttccctttttcttctaattgtaagttcgataaatagatttatttattttattatataatataataacttttatttaaaagggtaaaaagaggcgataaaatgtttgtttagaaagaatgaaagggtgtgaatagacccgcgagacaaagcttattgttagagaagggtcgtaaatccaatcttaaaggcaaaaacaaattaaacaaaatcgaatggaaaattgttgttaatgatgagaaagaccccggtggaaaattaaaggaaaaattaacggaatacaaaaaaataatggaaagagtgagaaacacaaaagtaaatgttacatgtgatgaggacgagcaaaattagaatatgaaagattcaacgtgtgggacgaagacgccgctaacatcgtatgaa

SEQ ID NO: 58643 - DNA, 709 bp, Heterodera glycines
  misc_feature (86)..(86): n is a, c, g, or t
  Genomic contig location: Contig_ID=SeqID_27985; Location=1047..1755; Strand=-
  SCN-specific regions: Sequence locations=1-572,594-657,679-709
  Gene Ontology: Mol. function=protein serine/threonine kinase activity; Cellular component=intracellular; Biological process =hexose metabolism
atgaaaatgtaatcattgaccagactttcgggtgcaaactcattgacttggtttcggctgcctttttcggagaaggaatagtcttntcgtatttctacggcaccatggaatactgctcacccgaaggtgcccaatccgatgaaatgcttctgctcacccaaagtattcgaattcagtgctcagtgggaacaaatacttggggcccgaggttgagatgtggtccgtaggcattttgctgtacaccctcgtcttcttcgagaatccctttcgttcctctcacgaaattgtggatgccgaaatcgaacttccctgggaaatttctgagggattgtaccaggtaagtgaagactgaacactgtttttgcatccgcttttccctccacaggtcttaagttggctgcttcagccgggcccaaaattacgcgcgactattagcgaaatcaagcgccattggtggctaactcaacgcgtcgatccgcggaattacaattttatggaagtgctcagaaaacacggtgggcttttctttgctactttggtacaatggctgactttaggacagcctccatttacttctttgctcaacatctctgatcttaatctcgaggggtcttccgtttccaatttgtgcagcaatttggccgccatttcgcttagctccgccattaactctgatcgtgaaacggatgccaacggacagaagaaagaa

SEQ ID NO: 58644 - DNA, 707 bp, Heterodera glycines
  Genomic contig location: Contig_ID=SeqID_27986; Location=828..1534; Strand=+
  SCN-specific regions: Sequence locations=1-87,110-117,139-382,404 -613,635-637,660-707
atgaatccatcccttcggcattctttcagcatcgaaaacattttaacaaaaggcgtaaattttggggccttttctgagtaagtccgaaatgaaattgtttacaaaattttttcttaggcaagaatttgccaacaaatctctccaacgattttcgccatcttttccattctcgtgagatttgtttaaaaattattatgaaaattggctaaaatattaaggccattgcttccgcaccatttcctcggccgctgttttgacaaagtgccaacatttgtcttagaaccgccgccaaaagcatttccaactgaatttagcagcgcattttttgagcggaataatggagaacgaaaaggtgttagaagttagaacactcaaataccgtaacataaatgcaaaaatcccacggtaaacccgtaaaatacggtaaagcacagtaatcgtaaggaagaagctgactgctgggcgcttaaaatgctgaaagcgataagatccataaaaagaaagagcggatgtgcctcgatagctcaatggtagagctgcccatgagtgggtggacgagtgggttctattcccacccgatgcctaacattttgccattccttatttaatatatcacctaaagaaatgtaaaatattaatagaaaagtacatttaaattttaatcgatgcgtctctctttttgattcgtaattttagtcgaatttgaa

SEQ ID NO: 58645 - DNA, 530 bp, Heterodera glycines
  Genomic contig location: Contig_ID=SeqID_27988; Location=1..530; Strand=+
  SCN-specific regions: Sequence locations=1-436,458-530
  Gene Ontology: Mol. function=dipeptidase activity; Cellular component= mitochondrion; Biological process=proteolysis and peptidolysis
agcgaagtttggaaaggtcgcggctcccccaacaaaatgaagtggtcaatttgccattttcccctctcattttgcctttccacagaatccttccgttgggcggcactttggcatggctcggcgacttcaaacagccgcactttcaagcgggagtcaaagcgattaaaaagggtcggcaaaaatggggggaaaagccggataattggccacttaattattccctttcagtgtatggcgtagagccggactttaccaggtaaagcgagaaattgaagcggcaaaacaaacaaaatgatcatttctaagggagggcggctccatcccagtgactctgaccttccaaaacctaacgggaaagagtgtgatgcttttgccgatgggcgcttcggacgacatggcacattcgcaggtcaaaaaggaggaaggatgggagaaatcaaaggaaaatgaatatttagaacgagaaactgaacgtgaccaactacgtgaacggcatgaagatgttcgcggcctacattttcgagtgcgcc

SEQ ID NO: 58646 - DNA, 1115 bp, Heterodera glycines
  Genomic contig location: Contig_ID=SeqID_27989; Location=560..1674; Strand=+
  SCN-specific regions: Sequence locations=1-135,158-241,263-395,421 -514,541-901,923-961,983-1013,1039-1115
  Gene Ontology: Mol. function=phosphopyruvate hydratase activity; Cellular component=soluble fraction; Biological process =gluconeogenesis
atgattaacggtggatcgcatgctggcaacaaattggccatgcaggagtttatggtgctgcccactggagcgaaaacattcaaagaggccatgcaaattgggtccgaaatttaccaccatttgaagaaggcatgcattttaatattgttgagtgactctaagacaatgtctattttaggtcatcaaagaacgctatggattggatgcaacttcagtcggagatgagggaggatttgcaccgaacatccaaaacaacagagagggattggatctgctcaaagaagcgttcgccgcatctggacaccaggacaaggttaatacactttttgaagtatacaatttatcctttaaggtcattattggtatggatgttgcggcaagcgaattctataaagagggaaaatatgacttggacttcaaaaagtggaactgtttttttttttgcgttgtaaaattcattttaagtccaaacaccgataaagcgcagtggttgaccggagaacagctcgccgatatgtacaagtccttcatcaacgactatcccgttgtgtccattgaagatgccttcgaccaagacgactgggaaaattggagcaagttgcaggctgccatagacattcaacttgtcggcgacgatttgacagtcaccaacccgaaacggattcagaaggcggtgcagaaaaaggcatgcaactgcttgttgcttaaggttagtctgaagtcatttaacttaatttgacaaaatattggttgaggtcaaccaaattggcacggtcactgagtcaatcgaagcttcaaaactggcacgaaaaagcggatggggagttatggtgagagggtggggatattacaccaatggaatgaaatatcactttaggtttctcaccgttctggcgaaacggaagacaccttcattgctgatttggttgttggactcgccactggacaagtgagtgaacacattcattaaaaataatggtgttttctagatcaagactggcgcgccgtgccgttctgagcgtttggccaaatacaatcgtattatgcgcattgaggaggaattgggcactgacgctgtctacaccgggaaaaggttccgaaaaccgcaaaactaa

SEQ ID NO: 58647 - DNA, 58 bp, Heterodera glycines
  Genomic contig location: Contig_ID=SeqID_27991; Location=1..58; Strand=+
  SCN-specific regions: Sequence locations=1-58
aacaaaatttaaaaaacgggcgcgaagcgcccgttcgaggccgcgaagcggcctaaag

SEQ ID NO: 58648 - DNA, 286 bp, Heterodera glycines
  Genomic contig location: Contig_ID=SeqID_5610; Location=504..789; Strand=+
  SCN-specific regions: Sequence locations=1-115,139-182,204-263,285-286
atgcttgggcaagcattgacacccgcacactttgcacgagacgcgcccattcggtgtgtgggcagcaccttaacagagataaaacgtaaaaatgattatttccattaaattaaggcctaataaaaagtttttaaaattgttttatcgtgtttctcttacatttacaacgatcacaatgcttatgaaagcaaggaaaaagactgatgcttggcgtaaattcatcattgtttgcgctgttgttgatttcggcacgacaaacatcgcagatcaaaaccatgatgtgtaa

SEQ ID NO: 58649 - DNA, 1075 bp, Heterodera glycines
  Genomic contig location: Contig_ID=SeqID_5610; Location=1253..2327; Strand=+
  SCN-specific regions: Sequence locations=1-13,41-155,177-268,295 -321,344-373,395-609,632-730,752-963,985-1030,1062-1075
  Gene Ontology: Mol. function=microtubule motor activity; Cellular component=spindle microtubule; Biological process=anterograde axon cargo transport
caaaagacatggctataattttttttaattttaaaaattaggatcagacctcaaagtggcaaagaaaaggaagagcccatttgtctgagcgtaactcctggtgaaccacaacttacaatttcgcgcgataaaacttttacatatggttccaaagattaagtttaatttttaaaaatcggctggttttttagatttcgtcttcgaccaaatgactttacaaaagactgtttatgacaaatgcgtgagggaactcgttgatggtgctttcgaaggatacaatgccactgtttttgcatatggacaggttttttgtttaaatttgaataagtttttcaaagtttaccgtcatagactggcagcggtaaaacattcaccatgggcaccagcttggagggcgacccggccaagaggggcatcataccaaatgcggcacagcaaatcttcgatgaaattgaggaaaggcgtgaacaagcccgcagatctggcaaagtgatcccctcatttgaagtttcagctcagtttattgaggttggttggtggttgtgaccagcaaaaatcggtaatattgtagctgccccacccccatgttttgaaaaaaaaattttgttttcaaaaaacatgaaaatatgtttcctggggttttcggggtcgctaatcacgaatccggcattcaattcgatcaattccgggtatttttacttggaatgaaataaataaatgcctttgcgcttttataaatattaaatgccaaataagcatttttatttgaaatatatataatattgatgatcatgcattactagagcttggatttttatgtgctaaattcctgaaatataataaaattttgctaaaaatgctgaaatttgtgctaaaaaccaaaaaaaatgccaaattatgtgcgaaaatatgattgaataaaatcgtctgccaatttttcggatgaaaatgttctgagtgtacagacattttattaattaaaaaacttgggttttactgggtgcttatttctttaaattgccatttggctctcggatggggccccctccccggggggaaaatcgaaaacattttt

SEQ ID NO: 58650 - DNA, 701 bp, Heterodera glycines
  Genomic contig location: Contig_ID=SeqID_5611; Location=97..797; Strand=+
  SCN-specific regions: Sequence locations=1-701
  Gene Ontology: Mol. function=plus-end-directed kinesin ATPase activity; Cellular component=plus-end kinesin complex; Biological process=anterograde axon cargo transport
atgggcaccagcttggagggcgacccggccaagaggggcatcataccaaatgcggcacagcaaatcttcgatgaaattgaggaaaggcgtgaacaagcccgcagatctggcaaagtgatcccctcatttgaagtttcagctcagtttattgaggttggttggtggttgtgaccagcaaaaatcggtaatattgtagctgccccacccccatgttttgaaaaaaaatttgttttcaaaaaacatgaaaacatgtttcctggggttttcggggtcgctaatcacgaatccggcattcaattcgatcaattccgaaccttggactcgagttcggataaaaagtcgtgaattcaaatttttcgaatttccatttatattgtatatttgtgcgtcaacttttgtagctgtacaacgaagaactcattgatcttttgtcaccggaccgggactcatcctccatcaagatcaaggaggacccgaaaaaccacgaaattttgctgatgggcgcatcatcgcgaaatgtcacttcgcaggaggccattctgtccgcgctggccattggtgcccaaaaccgaacaactgcagcgactaacatgaacaaacagtcgtcacgctcacatgccattttcaccttgaacatcaagcagactcgagtggtgccggttgatgtactggatttttttgggagggggcggcactggtaa

SEQ ID NO: 58651 - DNA, 1214 bp, Heterodera glycines
  Genomic contig location: Contig_ID=SeqID_5612; Location=156..1369; Strand=+
  SCN-specific regions: Sequence locations=1-36,58-659,682-1085,1108 -1139,1180-1181,1204-1214
atgggcacaggagctgaagtggaaacgttgcacgccaagttccatttcattgatttggccggctctgagcgtttgagcagaacgggcgccaccggtgaccgagcaaaagagagcatcagcatcaattccggactggtaaatgaggggagatgtgtctgggcataccaaatccagggctatatataatcatttgggctcaaaactgacaatgagaccaaaatgattttctttggttcactatttagttttttcacgttttacatttttttaaaaaagccatggtttgattgagcagattagccatccatcacacccctttacaatgacttaaacttggatttttgaaaattcaaagttttcatattgaaatattgggaaaattattaatgcacagcaatttggtaagcttttacaatccacagcttgcacttggtaatgtcatttcggctttgggcggtgcaaaaggtcgaattggtagtgtccatgttccgtatcgcgactcgaagctcactcgtctcctccaggactcacttggcggaaacaggttggaattgcaatttcttttctgacaaagtaatcactgtttagtcgaacatttatgcttacgtgtgtcagtcctaatgaagtggatgccaatgagacgctcagctcgttgaattatgccaaccgagccaaaaatataaagaacaaggtcaaaagtatttcaccgttactcaattgtcttattttttaggtggttgccaatcagaataaatctagcaccctgattacggatcttcgcatcaaaattcaactgctagaagctgaactccatgaatggaagacggtatttagattgatttcaatattgttggttcatgatcaatcaccacttttaggggaagagacgtaggtctgggcacattgcagttactgagcctgaggacaaaaacagtaccgaacaagtttttggttgcttggcgagattggatgaggaggaggaagcggaggatgctgacaatgaggaagaacctggagagatggaacacgaacgaatctgtacggacttggacaaactgcaggagaatatcagcagcaaagagcgacttatggccaactacgagaaggaactcgagaagattaagcaggaaatcaaccgcttggaagagacgaagaaggaaaacaaacaggaaatcaaccgcttggaagagacgaagaaggaaaacagcggatga

SEQ ID NO: 58652 - DNA, 632 bp, Heterodera glycines
  Genomic contig location: Contig_ID=SeqID_5613; Location=309..940; Strand=+
  SCN-specific regions: Sequence locations=1-632
atggaggaaatgcaaaaattgaagaagaaggtgggttactactttctttgataaaggactcacaacctgaatttcaaaattaattttgtgctaccggtagtaataagttcattgccgtaatttttttcaataacataggttttcaaaaaaaagccatagaattttctaaaaaaaattttgcggcgacgtttatttctcggcgcgcttttggccggcgatgtttgggtgtaccgtgcgcatgcttttatgttgtgcagcatttttttacttttaaaatattttgaaattgtggcccagaacaaaaaagtaccccaaaaaaatgttaaattttatttagaaacctttatctgctaactaaactcatattcaggaaaggcgtaagacaatgttcgaaacgaacaatccacgaaagcctctaacgccaataaacgagcaactgactccagagagtaaacatctcgagcgcctgaacacgacatacattgttgatacgccatctgaggaacagaagaaagggcgtttattgggagaattaccggaggaaaaggattccaattatcaaattcccccccttttgagtggttgttgtccgaaaggaccttctgtttaaacatatgattatatggtacaaa

SEQ ID NO: 58653 - DNA, 864 bp, Heterodera glycines
  Genomic contig location: Contig_ID=SeqID_5613; Location=1619..2482; Strand=+
  SCN-specific regions: Sequence locations=1-19,41-99,121-864
atgcaaagtgtccaatcgtcggccaccggggcagtgaccgccgcttccaccgttccgttgagcattcagaatgaagtttgttttcgctggaagtatttaaataaacaaacaagccaataaaactgattttaatttcagattttgtggatcaaacaggacgctctccaagttcgcaacgccgtcattctcttggagcaggagaaggacagtcttcgcaaagcaattcgcaaactcaaggtttgcggatagaaagaaacaaatttaacggtgaaatttgcgttgggttggtttaagcttttttaattttcatgatttttttacaaaaaaatccctttttagttggagaatggccgcctgaagacaaaggtgaaaactttgaacgaaaaggtggcaaagattagcaacgaggaaatggacgatgaagagggaaaattggcgcctgaatctgaattggactatgacgaactaaaccgaggggatttctacctaatcggaggtgtccatggtaagtttcgaacttttttgtgaagtggtaaacatatataaaatcttgaaagttgtgaaagactgaattactaaaaacctataaattcaattttagacccgatcagtcttcgttttgaagctgcgatccgtgaccaaaatgccgtcgaacataaaagtgccgaacgctactactggtacaaaatggcggaattctttggtgacgaggaagccatgaagagcattctgcacgcgcagaatgtccaacaggccgaagaggccatgaaaaacatcaaaggcttcgacgttgccgaatgggacaaagtcagttggaatgagaaacattggtggaaaggaaaagggttttcaggtcaaacttaa

SEQ ID NO: 58654 - DNA, 374 bp, Heterodera glycines
  Genomic contig location: Contig_ID=SeqID_5614; Location=774..1147; Strand=-
  SCN-specific regions: Sequence locations=1-374
cggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtgaagagcttttgaatgatatcaagattgtttgattcggtcaataacttcaagagttatattgactcaaagttggctcagacggagttggcccgttccg

SEQ ID NO: 58655 - DNA, 263 bp, Heterodera glycines
  Genomic contig location: Contig_ID=SeqID_27992; Location=771..1033; Strand=-
  SCN-specific regions: Sequence locations=1-263
aaggattcgtctccccataaatctggcgcatcgttcggggggactgccccgaaaacaaaaaaatcgatttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaaca

SEQ ID NO: 58656 - DNA, 255 bp, Heterodera glycines
  Genomic contig location: Contig_ID=SeqID_27993; Location=73..327; Strand=+
  SCN-specific regions: Sequence locations=1-255
atggccacacctactcaaattgaattatattttaatgttgcgttgagtttggtcaagaaagctggtaatgtaagtaccatattagtaaaatgtacaaaccatttttaaacggttttagcttgcgaagaatgcatatgctcagcctttgggtgtggtcaagacaaaaagctcacccaccgattttgttactgaaacggaccaggctgtggagaaacttttaatttctggactttctgaacgttttcccgaccacaa

SEQ ID NO: 58657 - DNA, 1055 bp, Heterodera glycines
  Genomic contig location: Contig_ID=SeqID_27994; Location=7..1061; Strand=+
  SCN-specific regions: Sequence locations=1-1055
atggtccccaacaccgcaaagaaggacgttcttcttcgactgttccagctcgaattgcaaaccgcgaagaagcgtgaccgtaagtacaccaacagactgtcgatttataattgaccaccgaagtcaaacggactgatttattattcgcggattcgttcttttttccagccgtcaatgggaaaatacgcaatacgatggtatttgtgaacaccaagcgagacgctgatgttgtttccacctacttgaaccaattcgactttaacaccaccacaattaatgggtgagtagtccgttctctttaattcagtcttcttccctctccctttaaagaaatcgtccgcaagaaatgcgtgaaaaggcattatccgattttcgtgccggcgtgtaccaggtcactaaaaaagcccaaccatttttcaaaaattcatcagattgtcgtcacaacggatgtttgcgcccgtggacacgacctcaaggatttggaccatgtcatcaatatggaccttcccgcgtctggagaagggattgacgacagtttcacgacgtatgtgcaccgaattggtcgtaccggtcgtttgcagcagggctcggctaccactttctttgacattcaagccgatgcgaccatggcggagggatttgtccaggcaattttagaaaacaattttcatgctttaatataattttcagagtcttcaagaagcgactcagccggtgccagactggctcaacaaattggttgctcgagagcccatcgctggttctggccaagtcactgacgaggagctgcttggcattttgtgaaacaaccctttgatcgttgcaatctttttcttttatcattattgcgatcatttggatttttattattatatgcttaccaatgattttgatcttctctcttttttatgtttacaaaatgtgcttggcgcgagataaattggagttcatatgtgcctgttttcttatgtttatttatattgttatcattcgaaagcactgagtttgaagaagttaatactaagaaattaagcaatacctattttaacatttaa

SEQ ID NO: 58658 - DNA, 664 bp, Heterodera glycines
  Genomic contig location: Contig_ID=SeqID_27995; Location=127..790; Strand=+
  SCN-specific regions: Sequence locations=1-287,309-493,515-525,547 -606,656-664
atgggaattccatggcacggatggtgggaaatgtttcatcccggacaaacattatatgattcaagtgggaatgaggtacagtatttttttaagtttgataacgaaatctttctatagataattagtatacgtacatatgtccagaatcataaggagccggcaaaatctgcctccgaaagacataagtggggcagcaatgttgattttctagcagctgcaaaattattccaaattaatgttatcgtatgtagtccaaaccctcagagaaaagaagattttggaatacaatatgtatggaatatttatactccggatatgctggatacggtatccatttaaatacgataaatcaaaatattaggcatatttagatgcttgttggccagtcgagagaatataagtcaatttttatattttttgaattgggacatttcaaagcaattatagatcctgcggagttaaagcaaaactagcttattataaaattaaaagcatttgcataattttctttaaataataacaaaaatttgctctttaaataatcaagtataattttattaaaatagtaaattgatttgctttttaattggttgattaatcatattcaaatataattagttaaaagattaaattaaaaaccaatataaaatatttagtttgctta

SEQ ID NO: 58659 - DNA, 501 bp, Heterodera glycines
  Genomic contig location: Contig_ID=SeqID_27995; Location=797..1297; Strand=-
  SCN-specific regions: Sequence locations=1-63,151-305,328-414,442-501
atgcattttttgggtcgcccgtatctatcggctcgttttggtaagattgatcagaatagtgtgtatttaaatatttaaggttaaatactttttaaataaaattacacttttcttgtattgataaaaattaaatgatattaattaataattgcatggggtttaatgtatattatattttcagttccattcattatagttggtgctacgtcatttcgcgacaagtgcaaaaagggcacttcgcgacagtgcaaaaattgggcacttcgcgaaaaatgcaaaaattgggcacttcgcgacagtgcaaaaatggtgtaaaaatggggcgtttcgcgacagtgcaaaaatgggcacttcgcgaaacgtgcaaatttaaccgaaagagaccgggcctcatcagtacggtgtctctttgggttaatttatttaaattaattattatttgtgtttcggccctaaaccgtatacacacaaagccacagcaatcaagcaaagcaaaataaa

SEQ ID NO: 58660 - DNA, 735 bp, Heterodera glycines
  Genomic contig location: Contig_ID=SeqID_27996; Location=225..959; Strand=-
  SCN-specific regions: Sequence locations=1-141,165-189,213-735
atggatttttgtaaaattttgctggtggagtgtgagttggcagtgaaaaagtgcagcccaaacatggcccgtttttaaaccttcgaattgcctcccgcccccattcctctgtgaagtatttgaaaaaccatattatgaaagagaaaagatggggaatggggaggaaatccctgtcaaatttttgtcgcgaatgaatgaagaaatttaaaaatgtcgggttgaaacataactcttcgggaggaaattttcataaaaagtcgaaaaaaaacaacagaaatttttaagaatcctttttccagaatttgttatggttttttaaattcgaattctttcactccaaaaatcttgtaaggtatttgaaaggttatattttagaattcatataaattccaaactctctagatagagatccataaacatttttttaaatgtcagaaaaaaattctatatcaaataatatttctcttctccttacctttccttcctcattaattagtggaattgattaattctaatggataaatgttttctatgcacttgaaaggacaatcaattacacgccctcccccccccccatttttttgtatttttagtcacaatgttatagttgagagtaaagtgaagcctataaaatttatatttagttgtattttagcttttatttgttctatttgctgccttcaacctttgacaaaggctatggacccaacagcgactgtgagttttgataattaa

SEQ ID NO: 58661 - DNA, 172 bp, Heterodera glycines
  Genomic contig location: Contig_ID=SeqID_27997; Location=595..766; Strand=+
  SCN-specific regions: Sequence locations=1-11,33-172
atgtttggtggcattatggttggtactgttgcggacagattagggcgccgtaaatcacttctgtacaacaatatattggcgatcattgctgcggcactgataacactggcaaaatatgtgaatatttattatttgatcatcattggacaattcattattggatcgaatgttg

SEQ ID NO: 58662 - DNA, 562 bp, Heterodera glycines
  Genomic contig location: Contig_ID=SeqID_27999; Location=276..837; Strand=-
  SCN-specific regions: Sequence locations=1-103,126-562
atgtcccaccaaccatttgctaatttcgaaattgtacggcttgaagcgatgatcattgggttagaaatcgacaaggaccaactgcaacgagatgtttatcatcttaaaaataggaaaacacaaatccataacaaaaaaatcgaattgctacaacaaaaggaacaattaataagagaaataagtgtgttgagagagacaaaggcaactttggtcaacgagatgaaagatttgagagaagaaatattggaattacgagatatggatggttccaatgacgacgacccactttgcgccgtttgctataccagaaaagtcgtcagcgtttaatgcaaaactaattttggatattttagagaaattatgcatgcattccatgtggtcatcgtgccctctgcaaccgatgcgccgaaactgtttcaattgatgggcgttgccccttttgccgtgaagaacttattggggtgtttaaaatattcagtccctaatttttttgtgaccgaacacacacacacattgttgattgatgatttttctagaattaattttagcacaaaataataaa

SEQ ID NO: 58663 - DNA, 711 bp, Heterodera glycines
  Genomic contig location: Contig_ID=SeqID_28002; Location=181..891; Strand=+
  SCN-specific regions: Sequence locations=1-272,294-397,419-711
  Gene Ontology: Mol. function=adenosylmethionine decarboxylase activity; Biological process=spermidine biosynthesis
ctgttcaatgcttccgagcattttttcgaaggggctgagaaactatttgaaatttggttcgataatgaccagcagaagcgagaaaatggccacaaaagcacactgagaaccattcccgagaacgaactgcggcaacttctgaacacggccgggtgccacattctccaggcaactaaaaagcagagaatggcaataaaaatgatagatatgtagccattgtttccggaagtttagtccgaaacgttttatatataggcttacgagaatcaccgtgcacaatacatatgacatcaatttgagcaaaataataaactaatttgtcaggtgcttagaacagctgaaatcgatgcgtatttgctaaggtaaacacaaggccttctaattgtaagtattccaatgttctttgtttctttgacccattagcgagagcagcatgttcatctcggatcgacgtctcattttgaagacgtgcggacagacgcggccgttgcttgtgatcgaaaagttgttggagttggcacggaaacattgccaaatggacacagtgaccaatgtgcgtgtggtgggaattggccttttgctctgagttttgtcctttcaatctctgtcgttattgctttgccaggtgtattattcgcgtaagaatttcttccggcctcatttacagccccaactccacgccactttcgacgaggaagtggattaccttga

SEQ ID NO: 58664 - DNA, 140 bp, Heterodera glycines
  Genomic contig location: Contig_ID=SeqID_28004; Location=109..248; Strand=-
  SCN-specific regions: Sequence locations=1-140
atggacaatgccgacggggaatgtgccgaagacggatgcgtcagcgatgttgaagccggaagtggtgccgaggacggggatgaactgttggatgacgacggcgttaatcaacagcagcacttgagaagtgatgaatcaga

SEQ ID NO: 58665 - DNA, 439 bp, Heterodera glycines
  Genomic contig location: Contig_ID=SeqID_28006; Location=399..837; Strand=+
  SCN-specific regions: Sequence locations=1-331,353-439
atgcaatagtaagtgaaccattttactgtatgttacacgtatcatattgtgttgcaatgaaaggagatttaaacttaattaattagtattttgcattaaaacaaacaaaacaaaaaataacgaaggaaaacatttctcttgacttttttgagctttatgaacaattttcttctctacattattatcattcatatgtattaaaatttcagttgcagttgcgtcttttttggattctcattaaaaagagaatcttttattaccgggccattgaccagaatcgcatatggttactcgagtaatggaaaattgtgggccaactcggcgaatcttgaaactgcacgctcctatggagaaaatgatgtggtcggatgcggcgttaatttggccactcgacagatctttttcaccaaaaatggaaaacgcatgggttggtaaaata

SEQ ID NO: 58666 - DNA, 619 bp, Heterodera glycines
  Genomic contig location: Contig_ID=SeqID_28006; Location=1213..1831; Strand=+
  SCN-specific regions: Sequence locations=1-197,220-244,266-398,420-619
atgctaatttcgaacattttgactttttgtttgaatttgagcccggggctcagaattcagaaggtatctcataaaattcttcttttatactacagtacgtaatgctacagaacattatttatttgtatcacttacgcattttccggtaacgtaaatttctttcgaataaaactcaagttcaagaaaaaaataacaactttttaaatttcaaaaaataattacaaaaatcgttgaagagttgaaaaattttcagaaatttttcctgaaattttcatagaaaaaactgccacttcggtccaccagaaatttaaaaaactttattttttagaatttaccattttataattatggaaaatgaataataaatgaattatgttttttttgttcagatgcgggcggcttgtacattttggcaaatgcttcatctctcagtgactacttcccattcgttatgctgttcaacaacgaagacatgatttatgcaaatttcgaacaggaattcatattcaatttggccactctttaaaaaacgattgcttttaattatttgcgaaaaactgaattatcaaattattatttttttgtcggcgaagagcgcgcgtgaatattttgctcataa

SEQ ID NO: 58667 - DNA, 955 bp, Heterodera glycines
  Genomic contig location: Contig_ID=SeqID_28007; Location=381..1335; Strand=+
  SCN-specific regions: Sequence locations=1-72,96-955
ggcgcggagaaagtactttctgtcagtgggcaaattcacagcccttccatcgagcctgacagaatggaagtacatggtaattcaagtctatattcacagataaacatcggagggcgtcagattaaaaattctttgagaaaattattcactttcaatagatttacagtgaaagcgatttcttcaatagcaaacaaagcttacagtaatatgtcacagtaacgtctttcgaaatttcatttagacctggggaacgtcaccgctggtagttcttctaccggtcggtctttacacacgttgtgtacttttgcctcggttggtgctgccaatgattacgttcccgctggtgttgtcacggctccgttggctctcagcggttcaaaaatcaattgcatcggtcgttctcttgtcgtttttcaagaaggttcgggttttgtttcgcttttcccttaccgtttcagtttttgcttgattatttccattccctatgtttcagggcgttccgcattgggaagtggcgtaatcggttacgcgaaggacacgcgcattttctcggacgagtttgacgaagtgattttccattattagcaaattgcagcctttttaaaatgttttttaatttttagatctttcgtaatttgattacacagtacagaaatgtgaacgtctcagattgttggcttgttctcagagacggcacaagttcaaatccagattgtcgcgcgttcttcgacatgttggatgagattttggcgacggaagaagtaagtatcttatcattggattattagttaaaattaacaacttttcagaaaccattgctttttctattacattttcaaattccaattaaatttactcattttacgctttttcaggttcaggaatacaccggacctcgaaaggcgatctgttcgttggtcaatgtggaaaaccaagctgtgaacgggtcaatcac

SEQ ID NO: 58668 - DNA, 808 bp, Heterodera glycines
  misc_feature (30)..(30): n is a, c, g, or t
  misc_feature (65)..(65): n is a, c, g, or t
  Genomic contig location: Contig_ID=SeqID_28010; Location=954..1761; Strand=+
  SCN-specific regions: Sequence locations=1-70,100-250,274-316,404 -429,451-596,619-731,757-808
atggtcatagtgtacggacactccactatnatacaatttaaaatgctgaaaaccaatcaaaaatngaaagtgaattaaaaaattttattttgtaattttgtagcgttttttatgggctatcaaatagcaccattcattattttgtagatgctctttatacatttagcaaattctcaaatatttttagattaatgatagtatttttttttgaaaatccattaaaataaaaaaatcctttcctaatttagcgttttttaatatataaatttaaatgcttttccttttcttactactgtgcataagttggacaaaatgcaaaattttcatttatttaacttaatttgaattaaataataattggaatttcaaatatttttttcgctatattattataaattaaattgagatataacactcaaaaaatcattgttttttaattaaaaatattttctttttagtcccttgaccctaattctgtgccggactctgctgaaactgtgataatgtccgacttcgccttcgctatttcagccattttcggtacgaaatttattaatttttaaatcccattaaattacgtccatttaaatctaataattattattcttttaatatgactgtgcattttctgactcattctgcgtaatgaagtgatatgaattcagatgaaaaagaaaaaaattttggtttggtcaaccaaaacgacaatatttatggtgataaaatgattataaaaaatgcaataataataatattgttttggggttctcttcttttggcgaattgagaacctgttaagtttacagca

SEQ ID NO: 58669 - DNA, 772 bp, Heterodera glycines
  Genomic contig location: Contig_ID=SeqID_5617; Location=81..852; Strand=+
  SCN-specific regions: Sequence locations=1-575,597-772
atgacagcgaaaacgaagggaattctgagcaccacgaataaaacgccgaaaatgatggatgcgacgataattttgaagaagaatgcgccatcatcaacttcgaactcggaaaaacaaaagcgaggcatttgtctttggtctgaaggtgggaaatttgatagagaattatgaaaagttgtcaaaggttttcggtacacgcacgaaaaaaacgtccgatggaggtgcactgtgtgtgctgccatgcccgcgtgacaattgcggacaaaagtgacagcacatgtccggttttctcggacaaaaagaacaatcatttgcctaagcccccgaaacaaaatgtttgggaggcatttaattcattagacaaagaagaatttggcggaaattcgacggcaaaaaactcgagcgcgtgaaagccgaaccccgaatcaggacaaattgcggctggatggcgaggacatcgtgctctacgacagtcgcactgtcagaattggagcaaagaacgttgtgctcgtttttgggtgcgaacgggttgtctcattaggggccaaagacagaatttatatttaattttttagagtttggacatttgagcaaaaacagtgcaacatggcatttggacgggacaattatgccgaaattcacgatgttattacggatcttggtctgcaggtcgaaggatacgcagaaaaattgaaggactattcgacgcggcgacattatgacgggcagcgcattaggcagagcaactttcaatagcatacatatttaaaga

SEQ ID NO: 58670 - DNA, 1056 bp, Heterodera glycines
  Genomic contig location: Contig_ID=SeqID_5618; Location=305..1360; Strand=+
  SCN-specific regions: Sequence locations=1-1056
  Gene Ontology: Mol. function=transcriptional activator activity; Cellular component=cytoplasm; Biological process=regulation of cholesterol biosynthesis
atggccaaggaggaggagacaggtgggggagggcgaaaagcattggaaaatgccggggaacactcatttgtcagggaggaagcacgccgtcctttacgtgatggacttgacggggctgaagtatgaccgcaatctgatcactctcttggcaatataaaattggccaatttggggccaattagcatcattcccttcagagaggggctctcagtgccatttccgcctttataaccgaacattacgttgagatgatccacgaatttgtgctcgtcaatgctccgagttttattagcacaatttggtaagaatgcccactaatcgacccatcgatcgatcggatatttatggccaaattaaggaccatcgcaaagccattgctgcccgagagaacacgcaacaaagtgcaaatattgggcaagtcgacttggcgaagcgaaattttgcaaatggcatgtgccgaagcactgccatcgttctggaatactgaaggggaagagaaggtgaacaaagaaaaagaaatgccgaaaaaggggaaaagtgatttggaaaaggcggcgattggcattttgggagggagaaaagactgatttggcattcattacttagtaccattttacagcacttcttggccaatctgaagcgatctccaccgattgacgtgtcaaattaccacaaaaatggtcagcttccgcccggcttttacacttcgcttacaattggcgctggcaaatgcggcacaatcgaagtggaagcgacaaaagggcaaacgcttcgttggcaaatcgaatcggacggccatttttcctttgcggttcacttcaaaagtgacgaaacttcgccccgtctcgtctacccacgactgaatgttggtggaagaacaaaaactgatcggacagaacgaattgtgtgccatttcagcaaattcccggcccaacttttgtgcctgtcgacgaccatttgcaatgcgacgcgaccggcgtttatcagatttggatttccaacgaacacgcgtggatacactcgctcaaaatgcgttaccgaatcagcaaagaatga

SEQ ID NO: 58671 - DNA, 534 bp, Heterodera glycines
  Genomic contig location: Contig_ID=SeqID_5619; Location=177..710; Strand=-
  SCN-specific regions: Sequence locations=1-338,390-534
atggctggcgcgggtttccaacatttcgacgcgtacactcagctgacggaccgctcggaggtggaggaattggacacgcttttcagacagtggcgcaaaacgcggagcaatttgcaattcttcaagttctttttcgaggaaaatggatacgaatgcgaacaggtcaaaaaagcagcggaattctattcgcaaaatgccatcaaatccgagcagttattccaatcttgctactacggcaaacgcgaaatcccatgctgcgatttgttcaagccaaattgtaagtgcggagattgacaatgagctgaccccgtccaagcgacccccccccccacgaattcttaaatagattataaatgaatttattaaatttaaatattaaaaaatttaaagtgctatcttcgctcaaaactcaaatatttttactcagcaaaaatttgcaagttttaaaatttagtgactgtgaccgcctaatttgaaaatagtttttttgcaaaaaaatataaatctatgaaaattcagaaaattttgaataaa

SEQ ID NO: 58672 - DNA, 285 bp, Heterodera glycines
  Genomic contig location: Contig_ID=SeqID_5621; Location=1166..1450; Strand=+
  SCN-specific regions: Sequence locations=1-161,218-285
atggcacgaccccaacggaacggcactgaaccgatcgcttataaagagtcagccaaagacgagttgcgaccggcaatgggactatcgggaagtgcgataagagaacagcaacagaagaagaagaagacgaatatcgaaggaagagagaaaatggaagaaataggaggagaagggaaggaaggaaagaaggaagagggcggaggaggaggaggaggagcaacgggacgagaaggaagcggatgcacactgatgtgacacaacaccggtcaatactgactctggtta

SEQ ID NO: 58673 - DNA, 822 bp, Heterodera glycines
  Genomic contig location: Contig_ID=SeqID_28012; Location=1..822; Strand=-
  SCN-specific regions: Sequence locations=1-220,243-643,667-822
atcaccgcctactcgcgggacgtcaagttggaggtggacaagcagagcgacacgttcaagcccggccttccctacagcgttgtggtggcactgaagcaaatggacgacacgccggccaagtcgtcgctgccgcgccgtgtccagctgaccaccttctaccgtggtgcgcaggcacagcaacagcaaccgctgcaacaacaacaggaggacaaggaggtcaaggtgttggagttggacgcccatgggacagcaatgctacagttgttggtcagtttactgtaatgggaagacggtactatgtgattagttaattaccggtctgatcaactttgtatataagctaagctgacgatatctgatcactattttttaattgatctgttaaatgatagtatttgattgtttttattctcagtattttttgatagaatcgatcgactgacacagtatatcccttaattacaatattacgatatcaacaaacaattaattggtctatcaattggcaatctttgattcttctctgtttcactcttcgtttcttgattgagctgctgatcaatattcattactcaattaatatgtagataattaattcatttatcggtcttcactagtaccccagttcaaccgatcaatcgatattttttgcatgaaccgatcaatctttctcactacctcataattattcgatcaatgttattccagatcactaactaatcgatttttcactcccagttcgatccgatcaatcaaagcactctccttgcccatttcagcccccgctgaacagtaccagtgcccgggtggaggcctcctacg

SEQ ID NO: 58674 - DNA, 394 bp, Heterodera glycines
  Genomic contig location: Contig_ID=SeqID_28013; Location=301..694; Strand=+
  SCN-specific regions: Sequence locations=1-17,40-208,240-394
atgtttccaaggtgtttttctcttatgggcttggcgttggtgcacttgtggcattgggctcatacaacaaatatcacaacaatgtttacaagtgattaaaattagcatgcccggcggctaattcatttggattaattagcgttaattaattcattagcctaaaacaaacaacccccatttacagacaagcattgactgtttgctgtgtgaacagcgggacaagtgtttttgcgggtattacataatcccattaattaattgttggggtaacaaaaaaattgtttaattgattttttaattgtttcttgtgccttttgtatcaatttagctaatgatccctgattagggggatgacaaaaatctccgccgctcaaaaaatccgggaagaccaaaa

SEQ ID NO: 58675 - DNA, 164 bp, Heterodera glycines
  Genomic contig location: Contig_ID=SeqID_28013; Location=1376..1539; Strand=+
  SCN-specific regions: Sequence locations=1-164
caaagtcaggcggactcggacaatgatgatgcggcgccgaagggacgccgtggccctggaggcgggcccggaaagcgccaacgcgtcaccaaatcgccggccaaccccaaactgtacgccaagctgaacgcatgtttgaacacactgctcaactacaagacgag

SEQ ID NO: 58676 - DNA, 183 bp, Heterodera glycines
  Genomic contig location: Contig_ID=SeqID_28016; Location=224..406; Strand=+
  SCN-specific regions: Sequence locations=1-93,115-183
atggctgattggaatgattttttcggatctttacgaaaatatttgaattattttcgcgcacaccattcacaaggactttcttataacgctttaacagcaagcagtaatactcagacaatttctgacgctgaacttgctggccttttgtcatggactcggtttgcttcagctgttgcaaaaaaa

SEQ ID NO: 58677 - DNA, 1030 bp, Heterodera glycines; identical to SEQ ID NO: 28017
  Genomic contig location: Contig_ID=SeqID_28017; Location=1..1030; Strand=+
  SCN-specific regions: Sequence locations=1-49,80-782,804-894,917-1030
  Gene Ontology: Biological process=mitotic chromosome condensation

SEQ ID NO: 58678 - DNA, 304 bp, Heterodera glycines; identical to SEQ ID NO: 51570
  Genomic contig location: Contig_ID=SeqID_28021; Location=332..635; Strand=+
  SCN-specific regions: Sequence locations=1-304

SEQ ID NO: 58679 - DNA, 101 bp, Heterodera glycines; identical to SEQ ID NO: 53576
  Genomic contig location: Contig_ID=SeqID_28021; Location=789..889; Strand=+
  SCN-specific regions: Sequence locations=1-101

SEQ ID NO: 58680 - DNA, 589 bp, Heterodera glycines
  Genomic contig location: Contig_ID=SeqID_670; Location=762..1350; Strand=-
  SCN-specific regions: Sequence locations=1-190,212-357,379-433,456-589
atgctcctcgccatttgtgtttccgcccgccaattggccgtcatccatctccaacaaatcctccgcgcattcaaagttgcacaacagccgacggtgtcctgcacaaacattgccaacatcgaacaatgccatattgcggtggtcagcaactcggaacatcaccgcgacaaacggtccttccctcctccacctttcgctccctcttccctccttattcatcgtccgtttccatttcagtttcgtttacattgccacaatcgacgaaattgtcgtgctccaatacgtcgccaaattgggcttcttttctccggtcgctcaaatcaaaacggaggagccgtgcacttgcatttgctccgcttcgtttggtttcgttttcggagccgacaatttccattttgcgcgatttgatgacaatttcgcaatgccttctcctcttgtggtggaaaattgtcccttcgattttcccgtcgccgctgtcgaaatttcggacaacgaatttttgttggcatttcacagtaacagcaaactcattgacaatgaatttgctcgcctaatcaatgctcatttcagactttggactgttcgttaa

SEQ ID NO: 58681 - DNA, 9261 bp, Heterodera glycines
  Genomic contig location: Contig_ID=SeqID_671; Location=20..9280; Strand=-
  SCN-specific regions: Sequence locations=1-85,107-148,170-405,433 -1573,1597-2063,2116-2209,2243-2326,2348-2841,2868-3298,3320 -3414,3436-3976,3998-4688,4710-4890,4912-4953,4975-5210,5238 -5291,5314-5420,5448-5908,...
  SCN-specific regions: Sequence locations=...5931-6036,6058-6286,6309 -6591,6614-6736,6758-6868,6890-7608,7810-7931,7964-8219,8241-9261
  Gene Ontology: Mol. function=structural constituent of cytoskeleton; Cellular component=hemidesmosome; Biological process=Golgi organization and biogenesis
atggatggaggtgatgtgcttgtgattggcgttgataccagtcgtcctccaaaggcaacgccgttcgagaagttcatgcttcgcaagaaaggagttgagggactcacttctgaggatccgctgattggtttgtttttctcatgtgtgcattattattaataatattttagttggtatttgcgcaaactatctgaaaaacccttacaaattctgcggagattattacttccagccttgcacgtttgttttccgttgtgatatttgttgggcaattgtgactaatttaggcaggacgttttggagccaactatgctgtcatacaaaatgagctggattttggacaaagttaagaagaaccgttcaaaaccaccgtctacggtaaaaaataattacaaataattgtgttgtacttaaatgataagtaaaataaatttaagattttcatcattcgcgatggtgttagtgagggaatggttccgaacgttagttgggctggaagaatcacgacggattgtaaaagtgtgctttagaacattcacgacgaatttccttcctatgtgaaggcgtgtaagaaatatgacccgacttgggagcccaaattcgtctattgcatcgtcgacaagaatcacaacaaacgtttcttcgttaaggggcagcaacaagtcgagaatactgctccaggttttattcagcgaaaatcattttgttcatcgttttttgtaggggcggttattgattcgaaagtggtacgcgtcgacatccacgagttttggatgcagtcacatgttccgctcaaggtttcggttggaatgacaaatttatctatgtattttgttttaggggacatcaaaaatgccacaatacatttttcccgtcaatgatcccaaggccaacaacaacgaattgcaggggtaactggcaatcagttgcggtattatacacaactaattttttgtagtttcttgcttgctctctgctgcagctggcaaattgttacgctggctccggctttgccaaattctcgtgcccaccagagggcggctgtcgcaagagatcgcagggtttgttagttgtagtgacgttttcaaaaatttcattaaggtcattctggagcatgggcagcctcttatttgcacaatttgccttcagcgcatttacgtgaaccaggtgcacatctccacaacatgcggccatttcttccattctcgttgtttgtggcgctatgttttccgtcacaacggaaggcattgcccggtgtgccgtgggcgtttgaggccttggacgattggcgttcttcgggagcgtcacggagagtaatatcgggtattttgatttgatctgacataatcttgatccatgcctttcgacaacttttatttattctttcgaacttaatttttgtttaacttttgggattgccacttggcgcttgccttttattttgattttgtgcgcataaatctgcttgctatccaatcaaatagattgttttcttcagggcggtgcatatattacggttttttaagtaaatgaaaagggaaaatttttggcaatcatgtgaccattggtcctgaaaattttttaaaatttttttttctgaaaattctaacaatttctgtgggtattttgaggcgctgagcacgaatccggcttcattttaacctatttataacacctgacctgaactcgaattaagtagaaattagggattttttcgatttttagtctaaaatggtttaaacgattttattgaagcactgatgagtatcagtcatgactttcagttcgtttccgtgtgtgtaaacaaaggttgaagaaaatgtgaaatttaaaagaagttgaatttttgttagaatttgtcggggttcggaattagagtactcattgggtttgggtccacattttggtcctacacttcagaataaaaaacattaactatactaatttgatgtgtaggtatgtcacattttaaatggattatttatcgaagcgaaaacctttgaaaaaaagaaagtaaaaaatgaggtatttatgtaaacaaaaaaacacaggagatagtgttgagaaaaagataaacaaaaaaagaaagagaactaaaggaagaaagaaagggagggaagttggggatatagtgagtgacactgggcttgaccccatagtgccttccatgacgcactttgtttgtgttgcatttttgatccactcacataaatttttatttgtttgtttggttggtatttacttacacataaatgttgaaaatattgttttttttaattacaattgagatttttttcttaacaatttaagaagaaattcagagcattgtttgaaaccaaatattaaacatgtcatctctttctgaggaggtcaagaaagttaagtaggctgctgtaagactcaatgtatttgtattcagtagatttttactaattgtttaagaacattcctcctccggcagcttgtaacagatatgtcgaaggcttttcaagtgtttatgtgtatgtttgcagttaaattaatgcgtttgagacactgaagttatttaggttcgaaactcgaccatcttcacatggcggtgcttttgcgttccgctatgacgttgaaatggtgcagctcagccgaaacaaaagtttgacttcgggcggtggcgacgatgggaaaaatggattgcttcgcaccgtttgtttcgatttgatcaagttcgtgcacgactcgacgcagggatttggacaagcggtaatttcctcttaaatcgcatgcaattattttactttacttttaggcacacttcgtttacgacaaccgtaaaatcttattcacgaacaagcgaatcgaacaatttgtttgttttttgtcttttaacattatgtaattatataattttaggcattggaaattgacacggaaaaaatccaaggaatcgttcgcgatttcttgcgtgggtcttcggtcaaaattgagattaaaccttgtcagactgataaacatgagctggatctcaacgacgtcttttcttccatctcgcgccgtcctgatgagcagtctgacagatctttgcgcactttccttgaaatgctgacttcccagccatttctcaatgcgtaattagcagtatttaattatttttcaagtttaatcttagtgggacccatgacatcattggtgctggtcgtctttttaagcgtcagatctgcaaagagctcgaagatggaattgtcacacgcgagggcattgctaagggagttcgcgttattgacaacaatggtgaaccaaaggcggctttggttgctgacggtttgctttgttttctgtttgttgagtgcttaagttttctttttagtgaagacttgtgcattcttcgcaagtcgtaaccttgaggaaatcgtcatggagatggtgcagaaaagacggttcaacatcaacaatgcttcccagatggaccgattctggtccgatttcaatcacttgtttcgcggcgttagcggctacctgacctatgcaccgtcgcgcgtcattgtcattgatgcgatcagtcaacggaagatggccgagattaggttttgagagttttgtggatcaattaaaacttggttctagttttgacgttgatggtcgtcctatgtctatggtcgactttttccgtactaagaagaacattccgataaatggacaattgccagccgttcgccagcaacaggaccgagaggttttctttttttaacaaaattagaactgtttttaaccacattatcggttgtagacattgttcccaatgtcgtgtgttatcatcttgcctggtcagcgagtgcccatcgacaagatgtccgaatttatttcgcgcgagcttcttagtgtaaaatatttttttttatccctcgcattctcttatactattataggcaaacacgactaattcgagcaaacggtacgccgacattgaagcggaagtgagaaaaatcgggaccggcacgtcaagtgcatttatgagtcattttggagtgaagcttatcggtggaaagaatgatgtgaaaattggcatgcacgaaatgccccaggtaatctattcttacctttttgttcacctaattaaccaattttagatcaaatttggagggaatgtgatgggctatttccaagacagagtagcaatcttatttaaatcacttgctatttgctcgttataggtgaacccaggtgttcgttttctcgagacgagcactttgatgaaggcatgggtcgttggttttacgcgtcaagttggagagggagatgtccggtagaattatggaatagggcattcgcctgtttactgttttttttaaattttagtaactttattcaacaagttgtggttatgggtcgaaagaggggcatgcatttgccagacccgcaatacgagtgcatcgaattggagaacatttctgaacgtatgcagcaactctcggaccgccgaattcagtttttgctctacatcgacaaaaaattcgtcaaatcacacggtggcaatgcccatatttttttttgtttaacttaaatctgtagcaattttgaaactcaacgagaagaagtatggtctgctgactcaacatgtcacattcgaagtggccagcaaagcgcgtgctatgactctgtcgaatgtgctgaataaaatgaacatgaagtgggcttagcgaacattcagtgactttattttgttttcaggcttttcggcttcaattacatgcctatgttcccgcaagcgtcgttcgtttttctgcattaaaatttcttatattctatcttatagtaagagcaaattcaacatggatggaggtgatgtgcttgtgattggcgttgataccagtcgtcctccaaaggcaacgccgttcgagaagttcatgcttcgcaagaaaggagttgagggactcacttctgaggatccgctgattggtttgtttttctcatgtgtgcattattattaataatattttagttggtatttgcgcaaactatctgaaaaacccttacaaattctgcggagattattacttccagccttgcacgtttgttttccgttgtgatatttgttgggcaattgtgactaatttaggcaggacgttttggagccaactatgctgtcatacaaaatgagctggattttggacaaagttaagaagaaccgttcaaaaccaccgtctacggtaaaaaataattacaaataattgtgttgtacttaaatgataagtaaaataaatttaagattttcatcattcgcgatggtgttagtgagggaatggttccgaaatccctatcttttaaacaattgttggtttcgaggttaattccatttcgagcaaattaattctctaaaactacatcagcagcaaagtttttgactgactcatagttatatgtttaattaaatccgacttttaggcatttttaaaacaaacaaaaacattaatgggggaccagcttcgcaattttcaaattacttccaaaatgtgcatttgggagtttttttaagtgcccatcatcctttaaattgtctcatttaaactttattagcaattggaaattgaacggctccaaaatcaattggaggagagcacaaacacaatacgaagggtccaagaggaattggaaattgcgaggaaaacggccaatggcgttctgtgggaattggaagagagtgaattggcaccgaaatcggaggcagaaattggcgaattgaagaacagaatcactgttttggagacacgacttaaaaaggcattcatttgcgaacccaaaatttggattaattaaaatttgtagaaaaaagtcgaaatggaactgttgcaagagacgatgaagggccaaacagaatcattccaccgcgaaattttggaattaaaagccgaaaaaagggtcaaagaggcggagattgcagaaatgagggaaaaattgcgaacgaacgaagcaaatggtcagaaacgagaggtaattaattaattagcttaaattgagtcaatcggttgtgcttttcgaacttgttattaattgacgtttcagtacctggaccagctcaaccaaaagttgggctctttggacacaaagaacgaaagccttcgcgacgaagtcggcactttgaagaaggggaacaaagagatggagcaggttttggcacggagcggggggaaggggtcgaacggaattgaccatttaagcgctacaaacaatgtgaggaggaaaaagcggcactccaacaggaaattaactcacttttgaaacagatcagcgcttcatctgggttattttccccattttttgcctccccctcaaaagcatctttcagctcttccgacatcgtttcgtcacgcctcatggatgagattgaacggctgaagcaacagaaggcgcagttgcgctgtgagcatgttcagcttaagcggaaatacacggagttggaaacggaaactgccaaattcggtggacttgcggtcctttccaaaatctaaatgcaatttttaaattcgttttttattattctattcagaaggaaatgaaactgctgaattcgacagtcggtgaattgcgcagcaaaatcgaatcggccgaagctgagaaaaaagcgattgaaaatgaaaatgaactgctcaaagaacgccaaaaaaagatggaaaccgaaatgaaagagaaggcatggcattggcccattgttaagcggctttttagtgcaaaggaccaattgaattggcatccttttgtcctttgctttttattagtcacttttagctcgaaaaagaatgattaaaattattcaatcagatttgtcaaattcattcggtgtttttgttggtgtcattcgatattctaaaactgctttcatttggctaatagtatttccactttcagattgataaaatgcagcggctgtgccgtgagaatgaggagtgtgagaattcgcggctgaagttactccaatccgagttggaccttcagaggagaaaatgcgacggaatgaaacggtcaatgggcgaattggacatgcaatgcgaaaaactgatggttgattttgaaagacagcgaattcaattgaaatattaattaattggcaatttagacgcaacttcgcttaacggacgcggagaaacgaaaggcgcaaaacgaaaacgaattgctgaaaagggaaatcgaaaaactgagcggccaactgacggaaaagatcaaaatggaaaatgaaaacgcatcgctgaaggaccgcagcaaatggctgaaggacaaaatagtctttttggaggtgcatttcaatgcttgtaaagtcatgtcattcctaaattttaagagtgagcttaaagagacgagcactgaccatcggacggtgccaatgcgaattagcatacataaaataagcaaaatgtttaaggaattggcaaatttggctgaccaattgggcgcaacttctgcggggacatcaaagggaaaagagagtgaaaatagcggagaggtgagaaaggtttaaaaacggcaccaaaattggcaattgaaggtgccgaagatggaagcacggttgaggcagcaagaggcggagcttcgctcattacaacggaaagtggaacaatacgaaagggagaataattcacaaagagaggaaatggagaagatgagagaagaagcgacgaaaacaaagcaggagaacatcattttgagacaggtggcagagacagagagaaagagagagacggaggagaaaaggggcgaacagagagagagatgggaagagaggggaggacgacgaaagagaaaagggatcgtaaagagagagagaggaggacgaaagaaggaatgccaattataaattaatgtattgaatcatttaagaattttgacgtctgtctgaagaaggcggaaacattcaaatccgaattggacgcattcaaagaagcgaatgatcagctgaaatcagaaaacgagcgagaaaaagtgaggacaaaaaacaccaaaataaagaattatggaaaaccttttgttttgatcagaattccaccagtgatcagttgtacgaattgcgagccgacctcgaacagaaggagaaattgatcgcctatttgcaaagcgtcgttcagccgaagcaaatgcaaaagctcccgcgccatcgctcctctctcctctccgatggctctgatctttcagtccgtcggacaattagttctgtttggatttttagagattaatttaggaaatcgaaatggagtacaaacagtgccttcagctggaaaaggagagaaatcagctgaaaaataatctcgagaatcgacgcagaggtgaaattcctttcattgataaacaaattacgaaaatgattaacagggcacttctcatttcattaattaatgccttggctttagtgttggatgaaaagcaaaacgaaatgacgccgacacggccaatgctccgcgaagagaccgtacgttttcacgacgcattgtcaccagcgcgcaactctcagtcgaagctgaagcaagcctttgcttttgattttctatcatttggttttgctttgcaggaacagttcgactgactccgcgcacagtgcgccccgatttccgggcagaatgcggcacgacattccccaccggtggaagcggcactttgtcacagtggcaacggtcctatcggtctctttccgtcaagttttgaagtccctctatttccagaataaatgccaagtctgcatggacggtctcccccactttcgactcgtcctccgatgccgcgactgttcccttacggtgcacccgcactgtcgtggcaacgtggtcaacacgtgcggtcttccgaaagaatggtggccatttctacctggacacacattcgatctccttccaaccaatgacccgctggggtaaactttggcctttttcctccgcctccgctgctttgcccagtcctgatcaatcaacccattggctcaacgcatgggcagtgatcgacgacaaccgactgtccttttacgacagcgatcagttggcagtcagtgaaggcgcactgccctttttgagcatcgatttggaccgggaccactggcgcatttacaaccaaacgacggacaaaccgctggacgggattcggggcactgaaatgtccatgttgatcgaacttaaactgcccgagtaacaaaatacagtaaaatgatcatttttaatggaatattctgttcagctacattctgttcatgttggctccgactgttcaggccaaacaacgctgggtctattccctgcaaatggccaccag

SEQ ID NO: 58682 - DNA, 191 bp, Heterodera glycines
  Genomic contig location: Contig_ID=SeqID_671; Location=9340..9530; Strand=-
  SCN-specific regions: Sequence locations=1-133,155-191
actcaacgagaagaagtatggtctgctgactcaacatctccccttcgaagtggccagcaaagcgcgtgctatgactctgtctaatgtgctgaataaaatgaacatgaagtgggcttagcgaacattcagtgactttattttgttttcaggcttttcggcttcaattacatgcctatgttcccgcaagcgtc

SEQ ID NO: 58683 - DNA, 114 bp, Heterodera glycines
  Genomic contig location: Contig_ID=SeqID_672; Location=143..256; Strand=+
  SCN-specific regions: Sequence locations=1-6,28-114
acaagaaaatttattcaatgctttttagacttagctcgtcaagagctttcggatgataccaaatttatcaagattagatcgttttaaaaaagttagaagtgtcaaatctctcaa

SEQ ID NO: 58684 - DNA, 477 bp, Heterodera glycines
  Genomic contig location: Contig_ID=SeqID_5623; Location=2459..2935; Strand=-
  SCN-specific regions: Sequence locations=1-46,68-253,275-278,309 -348,372-392,446-477
ttgcaaagaaattctgtgggacttattgtggcacctctctattagactcttgtctaatagctcctgtaatctggttttgcaactttcaaaaaagtaacaaattacgaattagcaattttatattcgaaaattttgcagttgataattgttgctataaccacgatgtgtgctacataaaaaaatatcagaaacgttacgattgtgatattaaattttgcaattgccttaatgaatatcctaattgctttctaacaaaagtctgttctccaactcatatcttaaatattttattttttagaatatattatgctggtcagttcatatttttggagaacgttttaaagaaggataaaaataattattttattttaccgtcaatagatatgcatatgtattttaaattttttattgttatgtaaacttctaatatatatatatttatatacataatcatatgagttggcggttttaagaaac

SEQ ID NO: 58685 - DNA, 804 bp, Heterodera glycines
  Genomic contig location: Contig_ID=SeqID_5624; Location=1710..2513; Strand=-
  SCN-specific regions: Sequence locations=1-514,553-804
atgccgacggagctgtaccgtacggatttgctgcagcgcgtcaggcagcacaatgccgttggtctccccgcgggtggtgccgtgccgtggcagtcgaagtcgtcgtttgctcttcagcagttggacggtggtggcaccggtgccaatgccgaggagtgccgccacggtgagcaaccgccggtgctgctccgcgtgacggacagatggcgtgaggaatggagccacggcgtgcaaattccgtggggcatcggtggcggcggcgcacagagtgccaacaatttcgagcgcaccgaactgttccctcacctgtcgttgttggccgccaacgacatttttgaactgttcgttatatattttttttttgcctaataaatctactaaaaataatgactctttttgtggcactatgggacatttttctgcgaatttacaaaattttcaaacaaatttctattaaaaaaattttcaaaaatttgatcgactttcaagaaattaagcctaaaaaagtcaaaaagccttatttttgaacattttttcacccaaatttttatgccgaagagcaaaaaattaaatggaaaaaaattttcagaccttccgaattggtgacggcggacggaggcgacgccgacggcgactgcgtcggggcccaaattcgacggatgacaaacgaaaagccggacaaagtgtggcaccttcgcctcttcttcgaacgggttggcaaaacaagcgaacgcgcaaaaagcaaacgaaaaacactaaaatttttcaaaaaatggttaatagccttcaacctcgaaaaataaa

SEQ ID NO: 58686 - DNA, 264 bp, Heterodera glycines
  Genomic contig location: Contig_ID=SeqID_28027; Location=412..675; Strand=+
  SCN-specific regions: Sequence locations=1-109,187-264
atggctagtcagcgattcatactttatggcaaatcctatttttattataatattgatgattatgataaggcagcacagatgattaatcaagtaagattctttaggaatcattaaaaattaaaatttaaaaataataataaagtaacttaaaaatacatgaaaattttataaaatattatttatttactattacagtttatgcgcgtgtcatgtgatgcgaaaaatcaatttcaataggtgaagctgatttatttgcaaatgcaa

SEQ ID NO: 58687 - DNA, 317 bp, Heterodera glycines
  Genomic contig location: Contig_ID=SeqID_28027; Location=840..1156; Strand=+
  SCN-specific regions: Sequence locations=1-289,312-317
atggaattgcagaaagagcttgtttcaatttgtcgttccgcatgggtacgtttaatattttttacaaattttcggggtttttatttatacataattttattatagacctgcgaggcaaggggtcccgcgtgggattttgcgggtcccagtctgcaatcccgcatttttggaacatgcaagaaggaggggttaatccagcggagtcccggcagataaaatttttttagcttcattcccgcaacggacacgaaaatttgattttttgtacggtcccgcagggtcggagataaaacactaaatattttttgactaattta

SEQ ID NO: 58688 - DNA, 356 bp, Heterodera glycines
  Genomic contig location: Contig_ID=SeqID_28027; Location=1513..1868; Strand=+
  SCN-specific regions: Sequence locations=1-356
  Gene Ontology: Biological process=DNA damage response, signal transduction resulting in cell cycle arrest
atgttgccaaattgttcaacaaatgatgaacgaattttctatctcagtttaaaggttgatttgcttcgttacgcttgtaaacatgaaacattagagtcgtgtaagttaaaagatgaaaaatattactaataaacattttgcttaatacattatgttgcttcagaaaaacaaaatttacatattttcccgtttcagttaaaacccaagctgaagccgcatataatcttgccaaaactgaagctgtggccaaattgagacctgaaaatcccattcgcattgggattgccttaaattttggcattttttatgaaagcattctcaaaagcaatgcacttgcctacaaaattggaaaggaa

SEQ ID NO: 58689 - DNA, 1029 bp, Heterodera glycines
  Genomic contig location: Contig_ID=SeqID_28028; Location=3..1031; Strand=+
  SCN-specific regions: Sequence locations=1-85,107-281,305-447,523 -540,718-767,789-814,849-922,949-974,998-1029
  Gene Ontology: Mol. function=DNA binding; Cellular component=nucleus; Biological process=N-linked glycosylation
atgtttagcacaaatttcacaccgactgtatcgataaatggtaaaataactaattttactgtgcatcatcagattatacattgttacagggttaaacaacacaataattgtccaatttgtcgcacacagacatttaaaatttcaattctcagaagaggtttttaagattacgtattattgtgaataaattgctttgttaagcaaagccaattgcgcaacaacaagaagagcaagacggacatcgtcaagttgaacaacaagcagatgagcaccaacaattagaacagcaagaagggcagcagcaagaacaaccgagacaagttgaacaccaagtagatgaaatccaagaagggcagcaagaacatcaagagggccagcaagaattaggacaacaactggaccaacagagacaagtcgaacaacaagaagggcataaaggggattggcaagaagaaaccgaacaagaagtagaacaacaaggggatcgccaagaagaacaaaacgtacagcaagaagaagaagggcatgttgaacaacgtaaagagcaaaacgaacagcaaggagaacaactgcaaggagaaagacagcaaatggagaaggaagaaatacaaacagaaaaacaggaaattgaagaaggagaggaggaagaaaagcaccaaatggaacaaaagagtggagacaatgaggaagaaggagaaggaggacagcaaaagaagagcagcaatgactatgaggacaacaacaacaaggagtaaaacatgaataatccaatcaaatgcaaaaattgcaatcgatgagaaagtcattgtgatacataatttattataataattaataatttttaaatagtgaagaggcttaacaatttcccatttctctcttccttgctccaaatatcgtactgtataatttttgtagtcattaaattgtgtaaacattaaaatgattattttcaaacattttgatatatccaacaaatgatacaattttcattaaatccccagacagcatttggaaatttattttcaa

SEQ ID NO: 58690 - DNA, 395 bp, Heterodera glycines
  Genomic contig location: Contig_ID=SeqID_28031; Location=329..723; Strand=-
  SCN-specific regions: Sequence locations=1-21,62-395
atggtttttagccatgacagcaaatttaattctttaaaaatttcatataattataattttagccggaaaatgaagcattaattgtatttgtgaggggcaagtccaattttgacaaattttgcatggaaaataaggagagattgcatgaaatttgcgataaattgccaaaagaatccactgatgctcaaagaaaagaatatttgacgcagaaatatgaggcccatcttggcgttttgtatttaatgagagagaattggcattgtgccaaaattgttgatgaaaatgcaggacaaaatcgtgcagattgtgaaatatttcgcaaatatttcgaaattttctatgaatatttattcacagtgaacgccgaaggttttttggcatattatttaaaatag

SEQ ID NO: 58691 - DNA, 440 bp, Heterodera glycines
  Genomic contig location: Contig_ID=SeqID_5625; Location=2439..2878; Strand=-
  SCN-specific regions: Sequence locations=1-359,383-412,437-440
atgcctttgaaggactgccaacgtttcatccgtaagcttgtgatcaatgggtatttggacgaacggttggtcaccacggcacaccaaactgtgatcggctacataagcgtagcgtcgaaagggcgtcagtttttgatagattacaaaaggaacccgggagcagtggaacgggtgagaaaacaatgaaaggggcccaattatttggcggcttttcaggtcaatttgtacatgggcgaaccgaaaaaacaggacaagcgacgcagttcgaccgcctcaaatgcgtcgaatttgacgaggcaaaaatccatggaggagtaatggtggtattttcatatgattgtgtatctctttgcgggttttaatgcattttcttgtttcttttgcctatttttctatgaccattttctgtaagatatttgcatctaaatttttgtaataaa

SEQ ID NO: 58692 - DNA, 1274 bp, Heterodera glycines
  Genomic contig location: Contig_ID=SeqID_5626; Location=971..2244; Strand=-
  SCN-specific regions: Sequence locations=1-266,293-1028,1066-1274
  Gene Ontology: Mol. function=ATP dependent DNA helicase activity; Cellular component=chromatin; Biological process=DNA replication
atttcctgtgcccttctccgagggtcaatggattctgttgaagtggagtccatttattcagatttgtcgtccgttgaaccgaccatcaaattgctatatgtcacacccgaaatggtatgaagtaaagtaaatctcgatttatttattcattttttgcagattagtgcatcaagacgattaaacgacgcattcatttccctttttcggcgcaatttattggcacgatttgtggtgagtcattattttatgcctgattaggtgtagtcttccgttgtgtttgtttcttgccccaattttcaaatttgctttttcctttaaggtggacgaggcgcactgtgtgtcccagtggggccacgactttaggctcgactacacccggttgagcaccgttctcgagccgtaccgttccggcaaagacaaagtgccggtgatggcattgacagccaccgcgactcaacgcatcattgacgacgtgaagcagcagctaaacatcgccaattgcaaaatgtttggtgttttttttgccattggactgcgatgttacagaaattgcgttacaggttcacctccagttttgtgcgccccaacctcgtctacgacgtggtggacaaatcccaggccaacttcaaaaaggtggtggatcacattcgcaagatgtacccgaatggctccgggatcatctactgtctttccaagtgaaaactttgcatcttttaaattaaaatctctttgcgcttccacagaaaagactgcgaggatgtggcgaaaatggtcggcggtggtgcgcagccataccatgccgatttggcggaacagcgaagagtggacacacagcgaaaatggatgtccaacagtattcagatactatgcgcaactgttggtgggcaaaattgttactaatatcatgcatatttgaattttgttgctgtttttttttcaatcggcttaaaatttaattgggatttttgatagttacaactgcacattccattcgaataatccttttttagttgaatcaaaaatggagtaatacaataaatgtattttgctaatcgtaaaatttataatgaatttaaattcggttaatatttagcgtttggcatgggtatcgacaagccggacgtgcgcttcatcatccatcacacaatcccacagacattggagtgttactaccaggagactggccgagctggacgagacaaccaagttgcgcattgtattctcatgtacaatttcaacgaccatttgcggatcaaaaggctaatcgaaagtga

SEQ ID NO: 58693 - DNA, 1150 bp, Heterodera glycines
  Genomic contig location: Contig_ID=SeqID_5627; Location=400..1549; Strand=-
  SCN-specific regions: Sequence locations=1-399,421-694,716-748,775 -1061,1083-1150
atgatgccaggaactcttccgcaagttactcgttacaattttgttccaattgatgaaactataaaatttcccgtctttcattgctgcaatggatctcatcaggaatctttccaccaatcgtttggtcaaaaagcgccgaatgagccattaaaaaaacgcgattcttctgtagaacttctcaatgacaataattcatttttcaaaatacgcgattcttcggcagaatttcacaatgatggtaattcatttgaattaatagcctattcttggactttttgctgagttttagtaaagctgctcggagttggaggacagtctcatcaagggcctttccacgagtttatcgatgacggtaaaacattgagtccgatgaataaatctcttttttcagtttcggattggattttttaaatttaaaccaacccacaaatataacctgtacccattaagatatgccaatttaagattttttctagattttctattcgagaaggcggagcaacacccaccaattgtcgttgccaacccatcagcaccgaatggcccattcaaaatacgcgattcttcggcagaatttcacaatgatggtaattcatttgaattaatagcctattcttggactttttgctgagttttagtaaacctgctcggagttggaggacaaaaggatgtgttcagaaaattgaaggtggtcttccattatttatttctcatttttcgcggaagtttaagattaagacaccttttctggaataaatttattccaatattataacacaataagagaacaaatagttattttcaggcccgtagctaggggcgggaattccctcttcccgaaatggaaaaaaatttcaacataaaattagtgaccccgttcgttcattttattggcctttgcattttcaggacgtgtttggcttttcctatttccgcttcaagcaaaagccggcggtggtcgccgctcttttggggcacgattgttttattgtgatgccaacgggtggagacagtattggaatttgaatgttttaccaccacttttagggtctgggaagagtttgtgctaccaactgccagctgtgctccatcccggcgttacaatcgtcatttctccgcttctttccctgatgcaggatcaaattattaa

SEQ ID NO: 58694 - DNA, 1365 bp, Heterodera glycines
  Genomic contig location: Contig_ID=SeqID_28032; Location=385..1749; Strand=-
  SCN-specific regions: Sequence locations=1-27,49-136,158-647,669 -732,754-763,785-808,830-1200,1227-1365
  Gene Ontology: Mol. function=transporter activity; Cellular component= membrane; Biological process=ER to Golgi transport
atgtccgaaaatgttaggggccgaaaagcaaaaaatgttgtttttcaagaaaaacctcctccgaattttttctggttacggacctcaccaaagttttttttttgaaaaagaaaaattccaaaaaatatttattcaaaatttgaattttcagttgcttgcgcgagattgtgaacaattttgcgcacacacgcatcaccgaaactgcgctgggcccgaccatccaggcggggctggacgcgttgcgcagcgcggaccgggccggcaaactgttcattttccacacgtcgttgcccgtgctggacggtgcgccgggccagctgaagaaccgggaggagcgcaagctgttgggcacggacaaggagaaggtgtgttttttgaaaaatttgtttttgaaaaaacactaatttagcaaaaatttcaaaaaaatcggtgaaaaatgccagccgaaaagttgcaggacaaaatttttggactattaacagttttaccattgaaaattcaaaatttatattctattttacgcacagaccatgctgacgccgtccatcgacttctacgccaagctgggcgaggagtgcgtgaagtggggctgtgccgtcgacttgtttctgttccccaacgcttttgtggacgtggcaaacattgcgccggcggtgaccaccaccggcggcatcatctacaaataccaatactttgacgtgcgtttttgcaatatttaatttctgaattacgtcctaatttgttttaaaatcccatgcctgacctcaaaatgatgagcatttttgattgttgctgtaaaaattctacttaaatttcaaaaatttggtaattcgtatagtcagagtcaggtcaatatcgacccttaaaaagcgccggaaaatgtttttggtggttctttaaacaaaaaaggaggaagggggtacaagctagacattattaccaacgtttgtcttaaattgtatttgcaaaatttggaacccgaacatcccatccattgagaattttccttgctggtacccccccccagacctagcctcacccaaattttccaagaaatttcgctaaatttttcaaaaaacccacaaatttttgatgaaaatatgctaaaaatggctcgaaatcacaaaatttggtcattttttggacaaaatctgttaacaaaccgcatttaaaaccgcaaaaaatttcccggcccggaccccctgtcccccaaaaaatgtttttggaaaaaccgcgccacaaaaaaaacgggtgtgaaaagcaaaaaaaggtcgtcgccgggggaggtaccccccccccaagccaaaatcctgggaccgtccctgcacccccgccctcagcgttttttttttgaatcgtaataaa

SEQ ID NO: 58695 - DNA, 176 bp, Heterodera glycines
  Genomic contig location: Contig_ID=SeqID_28033; Location=434..609; Strand=+
  SCN-specific regions: Sequence locations=1-176
aactattttctgaatttgactggccctgatggggccgaaaaagaggaaaagccccgctggcagttgctgtacacggccaaaaccgagtacggcatggagcagctgaatgccgaggcatggaacgcggtggcacaacgcattgagcgggagccggcgatggcgcggaaattcaatcg

SEQ ID NO: 58696 - DNA, 1545 bp, Heterodera glycines
  Genomic contig location: Contig_ID=SeqID_28035; Location=1..1545; Strand=-
  SCN-specific regions: Sequence locations=1-785,807-1233,1255-1545
  Gene Ontology: Mol. function=alpha-L-fucosidase activity; Biological process=fucose metabolism
tggtggtattggaagggacaacgtgacgcaaaatcgaaagatttgttcaaaaacactacccaaatggcacgacctatgcagactttgccaaatccgtaagccaaacgcataaaaatcacatgaattgaaaaacaccttttttgttcaccgccgttgacttcgatgcaaataatttcgccgaaatcgtaaagtcctcgggcgcacggtgagaaaggaaaagcgatttgttctgattcgttgccctttcgtgtcaccgaagtcataaggcataaaatgccaattttcagatattttgttttgacttcaaagcatcacgaagggtttacggtatgttttctgtttggtcgatcttttgcaattttttcgttgattcgaagctttggccaagcgcgacttcgtggaattggaatgccgtcgatgtttccacttttcctttctttccttaatgccatttttgcaagatcggcccccatcgggaccttgtgaaggcactctccgattcgattcgtgcccaaaatattcgtttcggactttatttttcacttttcgattggttccatcctctctttctgaacgatgttaaaaagtaacgcttttgaattattaaggggggttaattattaaagtgtttaaggcacagaacggacttcgttcaggcaatttgtaaaataattaatttgggacttcgttctttttttagacggtttcttatcctcaattacttgaaattgttaacggatatcaccccgaagtcatttggagcgacggggttcgcttgattgagccattttttaattggggaatttcttcctatttttgcgaaggattgggaacagcccgacacttattggcgctctaaagaattccttgcgtggctttataacgaaaggtcactttcggatttgatttttccataataaaggaatattcaaatgcttcagtccggtgaaggaaaaagtggtggtcaatgaccgttggggcagtggaatagccggaaagcatggcggttttttgacttaccaggatcattacggtaggatttggacagagaatcgagaaaatgaaaaaaaaacaattgcagacccaggccatttgctagcacggaaatgggaaaattgcctgactgtttgatttcaccttaagccttcgcaatatgttactgtatttgacaatttcagttggacaaacgttcgtggggctatcgtcgttatttgaaggcactcaattccgtttttaatttttggtttaaatctgattaagccctccgatgttctttcattggccgaattgatcaatcaattagtgcgtacaatttcgtgtggagggaatatgctgcttaatgttggccccgaccacaccggtcgcattgtgcccatttttgagcagagacttcgcgaatttggcgaatggatgaatgttaactcggaggccatttatggaaggcaaagatttttgaagtcgttttttgacttggtcctcttttagcaaggcatggatccaccaaagcgatggcccaactatttggttgctattggtactttcatt

SEQ ID NO: 58697 - DNA, 687 bp, Heterodera glycines
  Genomic contig location: Contig_ID=SeqID_28039; Location=181..867; Strand=-
  SCN-specific regions: Sequence locations=1-396,420-503,532-687
atggatttggtgaccagcttggagatgatggatgcaatttacgagggcggaagtgttgaccgacgaatgatggacagtgccattgagaaggcacttgagctacagcaagagagagtgagcgttgagtaccatgacaattagcaaacagaattttgaataccataagattagcatttggatgtgccatgagccaatgagcattcagaaattcaaaaagcaaattcgaaatgccaaagtcggcgttccaaaatgccaccaaaatttggcacaccattttgccacttgctcaagggcgaaatgatcacccagctgactgagcaagacgacccggagggtcggctggcacaaaactgtctgcacgccatggcagtggcattttgcatctcagtgatcgccgctgtgctgctgatcagttttgcggtgctttttgttgtggtgattgtgaagcggaaggtgaacagaaaggcaacgttcgattttcagttgaggaattttttgttttgaaaattttttaatttttaaaatatttttgaaaccctaggtccagcattgcaaagtgatcagcgaatttgccaacaaaagactgatatattcgataatgtgataaacaaaagtgtgcaatttgtctctttaattttcattttttcatatatttttctcaattttacccgaaacattccgaataaa

SEQ ID NO: 58698 - DNA, 150 bp, Heterodera glycines
  Genomic contig location: Contig_ID=SeqID_5628; Location=3129..3278; Strand=-
  SCN-specific regions: Sequence locations=1-150
gcattggctgaagggaataatacgaaaatgggcatcttcatttttttacccggctctactggcatataccgtatctcctgtatcaaatacccaccgttcctctggttaatactcataccgtatatatcaaaacaaaattcaaattggcac

SEQ ID NO: 58699 - DNA, 1501 bp, Heterodera glycines
  Genomic contig location: Contig_ID=SeqID_5628; Location=918..2418; Strand=+
  SCN-specific regions: Sequence locations=1-287,309-723,747-1308,1339 -1376,1495-1501
atgaagccgaacctcgcggtgtataattatgcagctggtagtgcaactgctgttcccagtgatcagtggaccaacaacgagactggcgaagaactgcttgggaagggccaaatgctggcaactttgccggatttgagtgagtgtggggaaggcaccgaaaaatatgctatatgtcgaaaacggcatttgccggtcgtcattcgtggaacaataagcagttggccaaaggagcggcacacccggacattttgataggggacaaatgcccaaaaaggaagaattggcacccatggccatggccattgatggaagatacaaaaatcgaaatccctttgaatttgtttttcccatgctcaggtgatccgtgctttcgacgctatgctaacaggtgcctgcccttttatctgccgtggctttactaattcagtgccattcattaatcccccgtccccgaccatttagtattattgtcaatgcgcaaccgttcgagcgtcggtcgagcatttcgttgatcaactgtaaggtaattttctggttgaccccaactcgacctcgagagggaaattgccagaaagctcgacagtcccggaaaatttattccatacgcttattcccaaaggtgcaatgccttcgctctccggtgggcctttactcgtgccgctccttcgtctacgacaatttgaaccaagtgtgcgacttgtttgcccacgtcggtgaccaatcgccggcaaagtgagcgtggaaatcgtgccaaataactcaaattatcagtgccataatttaaatgtcaattattggtgggacattcgaaattgggcattaaaaaaactttatttttgcctcggtacttattctacgctattcaactgctccctttccttgtaaaggcttctccgtttcaaaacgcgtgactatttcgagccgacctccgccattcattgtgccatcgacgaaaatggcaacccccggggcaccgttgttgttccgctctctgccgcaatggcaccgacacccgtgccactgactacggacatttccatcagcaaagcatcgctatcattcactgacagtggggccatagaccatggggaattggaagaggaatctgagaaaagtgcaataataatcctaagaaagtccgggataagatacctcttcgggatgccgaattcttaaaacagaattcatgttttgtgcccatgccaagtttcttccaacaatttcggcatttttatcaggtcccccctccattgtgccgcctcgtcagccgacttcggtggcacccgcaactgcaactggagagcagtcggaggaggccgaggaagaggaggaggaggaaaatagtcaacaattggccacaatgagcagcaccagcaaaagggaggaggacgagcaggggaagaagcggaacggagcagggacgggagagcagcagaaggagagagagtgcacggagaagcaaagtgagggggagggaggagaaaaagaggaagacgaatag

SEQ ID NO: 58700 - DNA, 791 bp, Heterodera glycines
  Genomic contig location: Contig_ID=SeqID_5630; Location=453..1243; Strand=-
  SCN-specific regions: Sequence locations=1-28,51-240,389-767
  Gene Ontology: Mol. function=protein binding; Cellular component =axoneme; Biological process=eye photoreceptor cell development
cacaaagagaaattggtcgccgcttattcggaggcagggcaaaaaattgaggcattggaacggaaattgcgcctccaatgtttgatcgaggtaagtgttgttttgggagataatatatgatggaaaaacaggccatatgggtttaaaacgcggaaagtattgttaatttttataggaccatcagcagccgacggatgagtctcatgtccaagaggcggacatagatagaaacgaagaagcggaggaggaagaggaagagccgagaagaaggaaaggagcggaagatgacgagggggaggaggaggaagatggacaggatgaggacgaagatgaacaggatgaggacgaagatgaacaggaggaggaggaacaagaggatgaggaggagctggacgaagacgagtgcaaggacagcccggcgtacatcccgaaacaaggttttgataaatttgcataatgtacgggacacgggctattgattgtgtgaaaaatccactttttacacccctcaccccatttgcacgttaaaatcaaattgctttttttttgggttttctgcattgaaaacaagggattgactaaagtacatttcaaacataaaccagacttaaggaaaaccgaaggtgctattcccgaatgtcatgtgatttcaaaaattgctcaaatcgttgatttttcgttttttacataatttttttaacattaactatttgagctgaaatagttttattatacaatttggtgttctgcaccgaattatcgaccacatctattttttaaattacattaaa

SEQ ID NO: 58701 - DNA, 649 bp, Heterodera glycines
  Genomic contig location: Contig_ID=SeqID_28042; Location=1..649; Strand=+
  SCN-specific regions: Sequence locations=1-38,60-627
aaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttgggggactgcccgaaaacaaaaaaatcgattttttcaagtgtccgtttggggtactcaaacaattatggggagcaaaaatccaacgcagaattaaagtacaggctatagggaagctattcccgaaggattcggtctcccataaatctgggcgcatcggtttggggggactgcccgaaaac

SEQ ID NO: 58702 - DNA, 483 bp, Heterodera glycines
  Genomic contig location: Contig_ID=SeqID_28042; Location=482..964; Strand=-
  SCN-specific regions: Sequence locations=1-41,63-153,175-316,338-483
gtcccccctaccgatgcgctcagatttatggggagaccgaattcttcgggaatagcttccctatagcctgtactttaatttctgcgttggatttttgctccccataattgtttgagtaccccaaacggacacttgaaaaaatcgatttttttgttttcgggcagtccccccaaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcgggcagtccccccaaaccgatgcgcccagatttatgggagaccgaatccttcgggaatagcttccctatagcctgtactttaattctgcgttggatttttgctccccataattgtttgagtaccccaaacggacacttgaaaaaatcgatttttttgttttc

SEQ ID NO: 58703 - DNA, 158 bp, Heterodera glycines
  Genomic contig location: Contig_ID=SeqID_28043; Location=73..230; Strand=-
  SCN-specific regions: Sequence locations=1-158
ctcattttaagtggtacaaaatgagtattattgacattgacgctgaacaaaataaccattcttttgctgttgattctcagtccaacaattattttttggtcggccgcggcggtgacaaatcgattttactcaacgaaacgagcggcaattcgtatgct

SEQ ID NO: 58704 - DNA, 56 bp, Heterodera glycines
  Genomic contig location: Contig_ID=SeqID_28044; Location=951..1006; Strand=-
  SCN-specific regions: Sequence locations=1-56
tgaaccgtttctgtgaaattatgcctatttttaggccacataaattcgtaatttat

SEQ ID NO: 58705 - DNA, 479 bp, Heterodera glycines
  Genomic contig location: Contig_ID=SeqID_28045; Location=123..601; Strand=-
  SCN-specific regions: Sequence locations=1-213,235-479
atgtatttaactgtgcttttccgcttcatttttgacgattatcctcatgttttgctatacaaactaataaatattcgttctgaaaaggcagtatatatgtttgaacagctcgaaaaagaatttgatgaagacggtttaacggaaataatcaaacataaattatatgggtttatcagtgatggagcttctgtaatgcgtggaacacgaggtggtttatttgctcatttagaaaagttcataaatcatgataaaaaactcacgggaatccattgctttgctcatcgtttttcagtcatgtcataagaatgtttatgactggcaattaaaactcagactatgaggctgattttctgtgtgcaactgatggcaaaagatatgaacatgctcaatatatgttaagacaacaagcacatacacgatcgactgccgaagagaatctagttgttggaatttcccctcctattcctgaattcaataaa

SEQ ID NO: 58706 - DNA, 927 bp, Heterodera glycines
  Genomic contig location: Contig_ID=SeqID_28046; Location=11..937; Strand=-
  SCN-specific regions: Sequence locations=1-105,147-398,420-868,890-927
atgagttacagtgacagcagtcggcatttgaaagctccattcatcttattgttaaacaaagtatttttaagttatggaccaggcgtggatatttggagtgccgggtaaatttttatttgttttttaattaaatttttctttttttacttacaattagatgcattttggccgaatttttcaccaaaaagcccgtctttcaaggacaatctgaacaccaacagctggaattaatttctcaattttgtggctcctattcgcccgaggtttggccaggagtgttgaaattgcccaattattcgacaatgcgacaacggacaatttacccgcggaagctgcgcgaaaaattctcattgttcgaccaaatgattatttttttactaacgctttatttttcaattccaccaacttcctctttattacagtatgccggatccggtgctcgacttgctcgacctgttgctgcagttggaccctggcaaacgaccaaccgcgtcacaggcgttgaaccacagttggctaagcaaggtggaaccaagcctggtgccgacgctggaactgccgcaggatcaggactgtgtacgaacccaacaatgcattacattttacacatttattacattgcattacgcttttgaatttgacggggtggggaattggccaaaaattaattggaaagcattctcatttaaagcattttacatgccattattcttggtgtcttcttttgatgctattgatttatcaaatttttttggagccgacaatttgccctaaatttagcatgaaatgtggtcaaaacgtcgtcgacagttggcacgtcaacaaagtgccacttcttcactgacttcttcaaatttttcggcggacaagaaacagcagtcacaacagtagtgatgaatgtgcattgaccattttagccgtaataaa

SEQ ID NO: 58707 - DNA, 1141 bp, Heterodera glycines
  Genomic contig location: Contig_ID=SeqID_28047; Location=31..1171; Strand=-
  SCN-specific regions: Sequence locations=1-499,524-634,660-1141
ggtcaaaaatcaatacatcaacatttttcgatgtaaaagaaaatggaagaattgtggtcaaaaattcagacaaatactgtcttttttatagtgttgttttgagtcaactatatcaaacaataggcactgaaatttcgtactcaatgtttcgaagaattctcagtaacgctaaacgacaacgaatttatgtggatgatttgatccgaaatgctaaaattgaaccgaataagaaaaactatggaattgacgagttgagacaaattcaagagtatttgaaccaagaatttcccggaaaatttttaattgcggcttttacaaaggtaaatttttaagattattttttccctaaatatatttaggaatgggggataaaaccaatatacaagggagacggaccaaaaaaatacattgtttgcgtttttcatgagaatgatcactgggatggtaagcgtgtttttcaattagattattacaaaaaaaatttaggattaaaaagcgtaaaacaatttttcaacataaaacattattattgtatatattgtgaacagacattccgagaaaaaattagacacacggtcaactgtgtaattaaatgtcagcgttgtggcggatggggtattattttagggacgggtaataataatttataaaaatttttaggtttaaattttccatgtgaaaaagaagggcgtgagcccattgaatgtttaaaatgtaatcgacttttctttagcgatttctgttttcaaaatcatctaaaattagcttgcaaattatacagaaggtgtacattatgtgatagcgaatacaacactcgtaacaaacatatttgcggtaaaatgtttcttttaaaaatgttttttttcacatgtttaggaataaaattctgtaacgtttgcaaagtaaaacacgccaaatcagagagttgttacatcaagaaaattaatattcccaagaatttaccaagatatcgtattgttagctatgatattgaatgttcagtaagcatcgaaaaaagctaatttacaaatttttaaattgaatttagacggataattctttttccgagggaaaattcgagcataaagttgtctttttatctgctcgattcacgtgcagcgattgtgacaatgaaaataaa

SEQ ID NO: 58708 - DNA, 2018 bp, Heterodera glycines
  Genomic contig location: Contig_ID=SeqID_28050; Location=1..2018; Strand=-
  SCN-specific regions: Sequence locations=1-7,38-172,194-389,433 -435,458-486,562-563,585-622,649-712,754-784,807-902,924-1165,1187 -1277,1299-1317,1339-1633,1681-1902
  Gene Ontology: Cellular component=extracellular space
atttaagaattttttttttaaattttataattaaatacacattttgttggtccaagaagtccgacaaattgtttcgccatggataagccaagttgttcgacttgttgccggaaaaccgtacattgaattcgattttacagtaggacctcttccaaaaaatttgaggtggactaattaatgaattaatgaatttgatattaaattgggcaaatttatgttattttggtcttaatttagtgaccttaaaacaattgaagtgatcacacgttacacaatgagcgaactaaactctgaaggaattttttggactgattcaaacggacggcaaatgatgaaaagacggtgagaaaacaattagctcattaattaaatgattttatcgtttcttgaaataatttgaattaattaaataaacaaataaatttattatttgagtatttaatgaagtagagaaattttagttttgacgtgtttcttaaatttgccattataaatttttaaatctaaaaaatatttaaagaaatgtaaaactttaattaattcgaaaaaatttaattttttcaaagaattttaatggaaaaatttttgacaaaaaaggaatcctaagactttgaatcgaaggattttttttttaattttttaatatttgggaattttgcttgatatatttcttcaaaatctaaatctgagtcttttcgttttaaagtattccattaattaaatattctttatttttttaattttaaaaattttcatgatttttgaaaatttgtggggaatggcacttttatgaaatgtactagtaaaatttgaatttcagccgcaatgattcgtcattctttgagggcaccgaaccggtggcagccaattattacccagtgaacaggcaaaatttaattacctaattaattttttttttaaaactttccccaaaatttagccgaatttatgtacatgacgacaaaacgcggatggtcattttgacagaccggtcccagggtggcgcttcactggcggacggacaaatcgaattgatggtacggtaggggcgggcggtagtggaaatggttgaagcggggatacggtaaatgctttttcggcagagcatttatctgtttgcctttcttggacatgccgtaaactgtaacagttgcagcgcactaacaaacaatttttaaaagggtttgttcagggcgttgccattcgtccgtgaatgacaaggacgtccttgaaataggacactcttacttgaaaatttaaaaatattcctgaattcgagatgtccttgaaaaatgaacaaaaaaaaatattggataaattcattctggcgaaaaatactatttttattgcatatgataaattttaagtgtccttgaatttaatgaaattttcgcgttatgtccttggatcgtgaaaatcagagggggggggggggtgaaatgacaaaattaggcccaaagattcagaatttttttgttttttccattagcttcatcgccgcgctttttgggatgacggattcggcgtggaagaagctttggacgagccgggcgaggacggcaatgggctaatcatccgaggccggcattggctgttgcttggcgatgcttcatcggccgcgcatcggttggccaaaaaatttttgaaaattctatttaaatatagtttattttaatttttgacccttttccctggaaatgttccaaattggcgcctcacaaatgttggcattttcgccatttgttgatggagacattatgcaatacaaggccaactatcgaacacaggtgattggaatttatgaaaaatataacgaattaaattttaaaaattcaccgaattcaaactgaaaatttacagaatttataaattcaaaaatatataatgagggggaatttctcatctcgccctctctctctctctcgccctcgctctctctctttctcttctcgctcctctttctcccgctctcttctctatgtttctttctctcgcacagtctctctcttgctctttct

SEQ ID NO: 58709 - DNA, 852 bp, Heterodera glycines
  Genomic contig location: Contig_ID=SeqID_28051; Location=536..1387; Strand=-
  SCN-specific regions: Sequence locations=1-173,195-237,259-679,717 -736,758-852
atgagccgtcttcagcagcgatttcattcatcgcccggaaaacgtgaagggattgagccgttgaatttgtctgaatgttgcaacacgaaggattatacgaacagttccgcttcagcttcggcacgttcattgcctcgggcaaaaagtgccgtttttaccgaaaacggcgtcgtagatgaaaagcagcgggacaaagacggacagcggcaaacatcagcctcaaccgatgaaaagtacaaatttaataataatttaattggcgattttcaaccggcttaagactggacggcaacccgccttctgcctgcactgtcctttcggctgtcgtgctgcaaaagagtgccgatgtatggccaattcggtccagtccgagcgttggcggcactttggcggcgccatttgactcggcacactccaggcaattgtggcactaattgcttcaaaattttattgctttgcttaatttggctcactttgatgcccgttttttgccttttcagcaaagaccttcacccgctgacggaccgtcgtcgccgctcgagcatcattctgaacaagcggatgccaatgcgcaagacggagtccggcgaattgggcgatcggaccgcgtccaaattgacgctggacgaggagctgtacgacattctgcacgcatttctgtacgtttttgatttgtgacttaatatttaaaaaaaatatatatatatatatataaacaatagctgccaactgtacttattttgacatgaaatattattttgtgcttattcgttgattttagtacaaaaattgtaatttttaggcccgaaaaattttaaaatcgcttattttagtataaaatctgttaataaa

SEQ ID NO: 58710 - DNA, 2984 bp, Heterodera glycines
  Genomic contig location: Contig_ID=SeqID_5631; Location=1026..4009; Strand=+
  SCN-specific regions: Sequence locations=1-913,946-993,1015-1465,1510- 1743,1777-1885,1926-2104,2126-2378,2400-2405,2427-2625,2677-2984
atgccatttccggcctgtctaactcttatttttacagttccgtccggcattttaattgcagaagaagtggtcggcattgaacaataccgtagccaatcgaaaatgtgtggcacttccgaaggattactgtacggcccattgcaattcccgagccattggcgaaatttgacatttgggaaaattattttggacattgaaaaagtgtcggaatttgtgggagaaaaagtggggagtcgccgattcagtgaaactgttcaaatcagaggacttccttggaatattttggcaaaaataaacggaaaaactgatgaaaaatgtctgggcttttatcttaaatgtgcagcagcagaagaaggtaaagtaaatcaaatgctaattattttacattaaaagttgtcttaatttaaattaagatgagaattggtgctgtgaatgttccgcaacttttcgaattgtttcgcaaaagttcgacgtggagaattctactggcaaatttttcggacaaatttttgatcacacagcggatcaagcaggattccatggattcatttcatttgcggtgagtggttgtttattaattgatccattatggttaattaaggaattgctggaccctaacaatgaattttacagcaacaatgaggacaaagtgacattgacagttgactttatcttaaaagatgctaaaatgggccaattttctgctccaaaaacagcagacaaaacaatttttatggaaattgaaaaagcttccgaatttttttgcgaaatcattggaagtgagcgaaaaagcgaaactgtgctcatcaaaggacttccgtggaaaattgtggccaaaataaaccgaagcgctgatgatgagaaatgtttgggcttttaccttttatgtgccgtcccgaaagaaagtgagtggaattaattaaaaataatttaaaacaataaaaaccagcagggctttattaaattatgctattatatggtggcaaaatctgttaataaatatcacaaaaaatcaacattttcgggcggggcaccaccggaacctctctaagttttttttttgaaaattggtacaaaaacacaccagaaaaaacgggatgcaataaaaggggctgatgggtcgactaagatttttcgaatggatcggacggtaaaagttgatcggaattcaaattattaacggtccataaatttgactagtttgttgcttttcaaagcttttttgcggcgtaatttttcaaaaaaaaaaccaggaacacgaggggtccggtggtgccgtcggcaccgtcggagaatttttgaaaatttacggcgatttgttaacagattttgtctaaaattgaccaaatgtcgcactttttgactcaatttctacaggattattaagtaaaagccgatccggcggtgccaaaaggcgccgccgggaaattcacaaattttgaatgaaattttcgatgaaaatgagttaattttaattaaatttattatttaattaattcaaaaatatttggcattttgtccataaaatttttcaaaaaaatcaataaaatcccgcagaatcccgcacaaaaaatcaaatttgccgctacgggaccggaactcaaaattctttgcggactgggatcccgcgggattaatcccgcattttccaaaaaatgcgggattgcggactgggatcctgcaaaatcccgcgcgggatcccgtcccgagccggtctctgggaatactgaaaataatcagcggaagcaaaaaattattgtttattgtttattgtcagtaaagaaaaaagagtccacaaaagggaaaatccgcttacattgaggacaaaacattaattaaaaatgtcctcaagaaagcgcaaaacaattaaaacgagatcaccgccaaaataaaatataatatgaaatcaataaaataaataaatagcgaccaaatcacttttagttttaatggattaaaaattcgactttaatttttccggtctattttacaggaatgaaatagttttagttttatttttaaattgatttaatgagtttatttcaataagctttttatcgagttggttccaaattttagttacccgccctgcaaaaggtataaattttttgaataaattttgaccaattttctacataatgtccttgattccgttatgtccttgtaaatcagtatatacgtccttggaaagagagagtttaaacgatacgagcactgaataatataatattaatttgctttaagcaccgaattggagtcgcaagtgttcggcaacttttcgaattgtttcgggtgtacctagggaatggttcgaacgccgcattgttatcaatgaaacacctattcacggatttgattatttcgttacattttcgtatttggtaagaaaatattttctttttgggaatacaaaaaatatttaattaggacatatatttttaggtatttaccttttcccgagctccctatattatgaaacgaacgaaaaatatttttttatttgtgcttgttaagctattttttattattagtgcatattttctgattttattgttagggtggccgaacgtttcgtcactgaacctttcgtcactaaacttttcgtcactgaacctttcgtcactgaaataaaataaagaattatttattagtgaaaactatttttttttaaataaagttatgtatttgaaattttggagtgtctgatcagtgatcaccgtaaaaaatttttaatggacgtcaaaatttctcgtttcccaaacatgagtgcctaaatgtaattccccaaatgctatttccaatagcggtaaaaaattcttaactatctacttttacatatttctgtaatttagctatggaatctgactcatcgcctcgaaattgctctttcaagaatctacaattcgttagaagcgtggcatatcatttgtcgggaccttcttgatttgttgcctattttcacaatgcaccggaaaatcgtataa

SEQ ID NO: 58711 - DNA, 958 bp, Heterodera glycines
  Genomic contig location: Contig_ID=SeqID_5632; Location=508..1465; Strand=-
  SCN-specific regions: Sequence locations=1-101,124-174,280-707,729 -806,839-880,906-958
atgacacataaatcagtgagtaaggtgtatagagagagcgcagcagacgcagaccgatcatcagagtaagagaaaaaaagaccagcaaattgccgacgaagaaatttaaaaaaaaataaaattgaaatttggccaaaaagggagtgcgttttcaagggattggcgtgtgttttgtccttttccaattctttccctcctcctcttccttccgctttttcttcctcctcctccgactgttcgattctctcctcccttttcactcgtccgctttcttctcttttgttctgctctggaacaaaaacattatcagttcgatcgtattttaccaagggcggagtctgtatttatttgatcaaaattatccctcggcctatcggcccttttccttcaccaaaacccctaggttttttacgaaaatcttccccattttaagctatttgggtgtgattaaacgagaatttcgagacgtcctcggtgagctgctgcccattagaactttgatcagcagagacagaacactttctattagagaccggacgggatcggggtcccgcgggattaaattcgggatcccgacctcgggatccgtcccgagcgatatttaaattcatcgggattgatcgggatcgggatttcatcgggatccctcccgaccattttaccaatcccgcggggtcccgcgtgattgaagtcacgataatttttcgaaaaatctccattttttaattaagatcttgaattttcaattaaaaaatattgtcatttgctaatttttcttaaaaatcccaaaaaaattttcacagttctccaaaattccattaaaattttcaaaatttgacgcaaaagttgaccattttgtgacttttttctttcaaaaaagaattataaaatttttttttatattaggtagtcatggcacaacgatttctaagaattctgtccaaaaaatcataataaa

SEQ ID NO: 58712 - DNA, 618 bp, Heterodera glycines
  Genomic contig location: Contig_ID=SeqID_5633; Location=160..777; Strand=-
  SCN-specific regions: Sequence locations=1-64,87-384,407-618
tactttgtcctcctgctcatcctggcaatgatcgagttcgtcacggtgttggcactgtacacgaaccgtgccgagctggtcgactcggtgcacaacgcgttcattgcgagtgccaaaacggcggacggccggcgcaatttgaagcccatccagacggcgctgcactgctgcggggccaccatcgagacgcagaagctgtacctggacgagcagctgtgcccccaggaattggccaaggcggtaaattcaatattcttaatcaatttgtccaaaatttaaatgttcacttacggtgcctaatgagatcgctggtcccaattgttccatttttttgaaatctgatccaaaatggcaaaattgacgaaaatggctaaaaattgcttattttttaaagataaattattacaaattttcacattagcgcacaaatggcattatttgcaaattgtgccaccctcttctcaggaggactgcttctccgtgctgaagtacaaaatggacagcaacgcagtgctggccagtgcccttatgctgttggtcgcccagttcttcgccatggttttctcctgcattctgtgccgggcaatccgcgagcgcagtcccgtctattatgcttaa

SEQ ID NO: 58713 - DNA, 662 bp, Heterodera glycines
  Genomic contig location: Contig_ID=SeqID_28052; Location=45..706; Strand=-
  SCN-specific regions: Sequence locations=1-662
gttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgatggatttttgctccccataattgtttgagtaccccaaacggacacttgtaaaaatcgattttgttgttt

SEQ ID NO: 58714 - DNA, 573 bp, Heterodera glycines
  Genomic contig location: Contig_ID=SeqID_28054; Location=1019..1591; Strand=-
  SCN-specific regions: Sequence locations=1-8,30-36,70-146,169-213,235- 487,509-573
atgaatacatattggcattttgaaatgtatctatgcaattttaaattaattaaaattaagaaattaattctgttgttgaatcatgaagatggcatcaattgggccagtgccgactgcgccgacccaaaattggcagccaaatttatggaaagcatcagaaaaattccaaattgggctgaccgagttcatttcgacgcactttcaaaattaatcccaaaatttgcgtattttcaaggcattttttgctacggaacgcccactgctgatttctttcacataaaggccaaactcaacgtaattgtgcagacaaatgttttacacgccattgaacgaacatttcccgaaattttgcattttggtaagaaaaattggggaaaatcaaagaatgaataaaaagtaaatatgaaaaatgagttattttttagggtttacgaaaaattttttaaagccctattaattgcccaaaaggctcatttgaagcaaaaattattaatgacaaaatcctttacaaaagttaggtccgtcggttgagaagggaaaaaagttggcgaattttcagtacgaaataataaa

SEQ ID NO: 58715 - DNA, 661 bp, Heterodera glycines
  Genomic contig location: Contig_ID=SeqID_28055; Location=312..972; Strand=-
  SCN-specific regions: Sequence locations=1-661
atgagaaacaaaacgaaggtaatacgcatagaattacgctttaatttatattatttatgtcaaaagaaaacaacatttataagtttggtgcgcaaagcgttttttctatgaaaacaaattaaatacgtttctttattaatcgggatgggaattaagtcgaatgatctttttttgctgactttaaatctttttttgctgactttaaatgacctttaaataacaaagtgttctacactttgtttgaagcttctaacatgcattttctttgactttttttttctactttttgggattttatgaatttttggcacttttataacaaggcttccaaaaatatggattaattgcgaaatatggccataaaatatggaccaaaaatcgatggacataaatttttcaaaattgaggctataatttctcaaaattgagggtataatttcttaaaatttcttctaattcgataaatgcatggcttcgatatctgaggatttttcctcattttgtggtcttttagagggtcgaagaggattttttggaccaaatggttgcattctccgaccaacgacggacagccgaagcgattgcgttgtttttgttattgttctccaacaaatttggaatgggtcaacaatttgaagaaggtgtgaccacattccgttaa

SEQ ID NO: 58716 - DNA, 720 bp, Heterodera glycines
  Genomic contig location: Contig_ID=SeqID_28058; Location=256..975; Strand=-
  SCN-specific regions: Sequence locations=1-9,32-720
atgccagcgggaggacagcagccagcagctgctgtgacccaagccattgcacaagtgccagccatacctgtggcgatcaatgctgctgctggtgccaatattcagcagccggctgctgcgaatcatgcttatcagccacctccagtaccggtcgccaatgctcttaatatgccaatgccgccggcagctgctcctcatgccactgctcggcttccgcagcttagtcttcccattttttcgggcgaaccgatggaatggccttccttttggcaaagttttgagagtgctgtcgatcgtgccaccctcgagcccgtcgacaaacttaattacctccacgggtgcttacgtggtgaggctgctcgcgccgttacagcctaccgtggaggggaaaattacgtccatgccatcgccgcactgaggcgactcttcggggatccacggaaaattgccgaggcacttcagtccgaactgatcaatcttcggtcggtggacgatagcgttggatcactgcaacacttcctcgagactttggaacgtgtgtgccgccaactttcgaacctcaacatgccggatgacagcccattcatgtaccaaatcatccgcagcaaactgccgtccactggaactcgtcaaaatggaacgtgcggcaggcatcccatggggtactcctcagctcagagctggactcgccaaagttctcggagtcagagaagaggttga

SEQ ID NO: 58717 - DNA, 666 bp, Heterodera glycines
  Genomic contig location: Contig_ID=SeqID_5634; Location=114..779; Strand=+
  SCN-specific regions: Sequence locations=1-5,27-201,223-459,481 -585,609-666
atgactgacatttattataaaatagcctcctttgaccattcctacttgaataaaattaatcaatctgaattattctcaatgattgatgaaattgttgaaaagtttcaactttgtaatgttgaagaaacgaggtcattatcgagatgggtatactgtatgctactagttttgctgtggatagcaattgttatgacaggaatttttctctattttaattccttgattcgaaatatgtgtaagcttatgcatatatgtagagacgaaaatgacacaacgacgataaatcggattctagcgggaaacacaaagaccagagaacactacttgggatgcttcccttgcgacaaactcccaaacaaaatcaaccagtatccttcaacattggtggcgaacaatgacccatccaataaagagggaacgcattggatagcaatgttcatcgttgacgacagaaccgtctactactttgacagttttgggcgtactccgaacagatgtatcagccactttttgcggaattatgaaaaagtgatttcgaataagccaactattcagtcagtgttcagtgagaattgcggctactattgcatttattttgttcattttatgtgctcatttggaggaagaaattatgagagtaattttgaaaaaatgacaaaaaagtag

SEQ ID NO: 58718 - DNA, 541 bp, Heterodera glycines
  Genomic contig location: Contig_ID=SeqID_5634; Location=1337..1877; Strand=-
  SCN-specific regions: Sequence locations=1-62,84-477,521-541
  Gene Ontology: Mol. function=general RNA polymerase II transcription factor activity; Cellular component=transcription factor complex; Biological process=transcription from Pol I promoter
gttttttccaacgattaaaaattgtgttgcagttattgatataaagactaggcttaatctcgaaaaaatttatattatttctccttctacaaaatatacccctaaacgaatgaatgcagtcattatgaatgtttacaacccaaatgcaactgctattatctttggtacgggaaaatttgtgtgcacaggagcagctaatgagaaagaatgtaggcaagctgcggagcaagtcaccgaacgaattcgatagtgcgggtattacgatgcccaaattcaggaatttaaagtacaaaatttggtagcaacagcagacgttggttttcatatacgcttaggacctctgtccgactttctaggcgccaaatattgttccttcacccccgagttatttcccggtctcgtgtatagaaaccaaaacccaaaaatatcaatcatagtattttcaagcggtaaattaaacttaacaggctctagatcaaaagaagaaattgattttgtatttaatcaattttatcaaattatctgcaatttcaaatattca

SEQ ID NO: 58719 - DNA, 2347 bp, Heterodera glycines
  Genomic contig location: Contig_ID=SeqID_5634; Location=867..3213; Strand=+
  SCN-specific regions: Sequence locations=1-119,146-491,535-928,950 -1014,1058-1058,1177-1360,1382-1429,1478-1551,1716-1910,1933 -1953,1975-2010,2032-2043,2081-2169,2191-2347
atggatcgattagacacagtaattgcttctcttctgaactgtcccgcacgtaacttgtgcgactgcttaaatcacctggatgagattcaaaaagtagaaaaatacctcaaaggaaaaactctacaaacaacatacaaaaatcaactaggtgagtacaaaggttttgagtacggtggaattaccaaagaatgtgcccgtaagcaaatggcttacaatggtttcaagaatgtgaccgtcgaccagcatttttatgtacggcaccgcatttgtcttcgctacgctaataatccttgcgtgattgagaagcatagaaatggacacgaacgattctacccacttgagcttgtgaaagtgaaacacggagacaaaagcgatatttatttgggacaaaatttcccaaagtctatacctttacttgacgaaaataattcaaaaataatgacaattattatgattcttgtcgtttatggtgaatatttgaaattgcagataatttgataaaattgattaaatacaaaatcaatttcttcttttgatctagagcctgttaagtttaatttaccgcttgaaaatactatgattgatatttttgggttttggtttctatacacgagaccgggaaataactcgggggtgaaggaacaatatttggcgcctagaaagtcggacagaggtcctaagcgtatatgaaaaccaacgtctgctgttgctaccaaattttgtactttaaattcctgaatttgggcatcgtaatacccgcactatcgaattcgttcggtgacttgctccgcagcttgcctacattctttctcattagctgctcctgtgcacacaaattttcccgtaccaaagataatagcagttgcatttgggttgtaaacattcataatgactgcattcattcgtttaggggtatattttgtagaaggagaaataatataaattttttcgagattaagcctagtctttatatcaataactgcaacacaatttttaatcgttggaaaaaacattttaaatgaataatgggagaaaatttttcctatttatacaaaataaattgaatttagttataatttattcctaaattaattttaaacttttaattaatttttatttaatattaatttgaattttatttcaactttaattataataattcatttaattttatttttagctaacaatttatcacaatcgggctctcaaatagcccctgcgggcgctcaagtggtagcatacctacactcaatagaatttgagttacctctgaccaacagctggtgctttccattatcaccagcgggctcttaaatgacacacacgtgcgctcaaatggtccctgcgtgcggtcaaatggcctggcatccctttcctccccaaagggcacgacggctgatgtccgtcccatcgatccctccaataggcttttaattttttttaattttattattttatttaattaattttttttaatcaatcaaaacccttcaataggcttgggttcaccccgcacccgtccaataggctttggtttttaaatttattatttttaatttatttaatttaattttaattaattttattttaatttaatttattttttaatcttttttttatttatttttttttaatttcaattaatttgaactttaacttttatttaattttaatcctattttaatctaatttcatttattaatttaatataattttagttttatcaactttaattctaattcatttaactcgaattttatttttagcgctcaaatttaacaagcgggctcacaaaaggcccctgcgtgcgctcagatggcacgcgcgagcgctcaaatggtccctacgtgcgctcaaatggcatacgcgagcgcttaaatggcacacacgcgggcgctcaggtggcatgcgtcccttcccttccccataaggcatgacagctgacgcccatcctctgcctccctttcccttctctaataggatttggccttgggttttatacttcagatgttttttcaattatttacctcttctgggattggatatatttattataggtgttttttaaaggtttaaatttggtactgaaacgtccctttccactgggactgaaatggcggggctgaaaattaagggcgaaaatctgcaccagtaactactaggaaccccaaaaaaaatattaaattaaaacctttgaactcccgatcccgctcccggaaaattggacactagaaaattggacaccaatggaaatttggacaccggaaaattggacaccgaaaattggacactagaaaattggacaccaatggaaatttggacaccggaaaattggacactgttgtaa

SEQ ID NO: 58720 - DNA, 802 bp, Heterodera glycines
  misc_feature (772)..(772): n is a, c, g, or t
  misc_feature (775)..(775): n is a, c, g, or t
  Genomic contig location: Contig_ID=SeqID_5634; Location=4188..4989; Strand=+
  SCN-specific regions: Sequence locations=1-502,524-653,693-802
atgagacttcggcaacaagccgcttcacaaaatccattgccaacaagacaagcaattgccaatgttcgtgagaatatgccatttgaagccattattgctggaccctcttcttcgagtctggcaaggaactacagaaactatgttgtccaagaacggggcgaaaggggtgatgatcagcttgatttggccgatactgcacaaattcaaattcccgaaaatcttcgggtaaactttgtctttgatggatttgtcgataatctccggatgttggtttttgctaccgaatctggaagaaaccttttggcacggtttgggcagcatgcggcaatcgatgggacttttaaggtgtcaactattcaatgttaaagttacagaaattaattgtttagtgtgctccggcccatttcactcaaatttacacgatttctgttttggtggataaggtcgctgttccttgtatttatgggcttttgcgatcaaaatccgagaatacttattcaactgttagtcaatttgtaaattaattgctttaaattaacacaatcagatgtttcaatcagtgattcagcatgttgttgattggcacccacaaacattcatgatggattttgaattaagcgcatttaatgctgttaatcgggtaaaatatacatatgttaattttgttttataaagaaaatttaaaggtttttccgaatgccgaacggtctgggtgtttgtttcattttgcgcagtgcgtttatcgaggattgcaccgattgccaaatcttanccnccattttaaaggatgagcagcaaagaa

SEQ ID NO: 58721 - DNA, 517 bp, Heterodera glycines
  Genomic contig location: Contig_ID=SeqID_28063; Location=739..1255; Strand=-
  SCN-specific regions: Sequence locations=1-308,330-517
atgtttgtcatgcaaaatgctgaccaacaacaacttcccgatttggccattctgcgttcgagcacttcccatgtgccattgtttgtttcttccgggtgggcaattgagttcgatctggccgcaaatattgcgctggaatgcattgatcaaaatccgatcagattggtgggtgatcgatcaataattgatcagttaaaattgtaaaatccagagtgatcttcggtcgagaacaaagctgaacgaactttttgagagatgataaaaagagaatgctttattgtattatattctaagtgttgttaaaatgcttttaatatattttttattttcgtgattattctcttcgaattctaactgatgaacaatgtccgctgcccaatcacattaaaaaaattgctttggtcatgtagagcagagtatggttgatttgctactgataattttcggctttttggctccgtccaaaagtttctgttctgaaaacacaaaatgtgtcgcaccagaaacacctaataaa

SEQ ID NO: 58722 - DNA, 434 bp, Heterodera glycines
  Genomic contig location: Contig_ID=SeqID_28065; Location=1165..1598; Strand=+
  SCN-specific regions: Sequence locations=1-434
atgccgagcctcgaatctgtgcctgaacgcattaactttgacgaggaggaggaaaagaccttgcagaaatggcgagacgaaaacacttttcagacatcgcttgagtaagtttcgaatttgattttttcgacaaattgagagccctttcggctatgttttggtcattgaccgtttcgttaagcatgagtcgtggtcgacctcattacactttctacgatgggccaccatttgccaccggacttcctcattacggacatattttggccggtccttagttttttccaatgtgaaaaattggcgcatattcgttacattttagggaccatcaaagacattgtcacgcgctgggctcatcagagcggcttttatgtcgaacggcgttttggttgggacacccacggacttcccgtggagtacgaagtggacaaaattga

SEQ ID NO: 58723 - DNA, 230 bp, Heterodera glycines
  Genomic contig location: Contig_ID=SeqID_28067; Location=5..234; Strand=-
  SCN-specific regions: Sequence locations=1-150,173-230
atggaaagggaggcgatgaagccgaaggagacgaacacggcggaaaaggtacttctgtcgcagagactgcgcgagacgggcgtcgagtcgggagtggcggcgagaagggccaaatttggggacaaagcggcggagcccgcgggggaaaaacgcggcgaaaaggcagtgaaaacggcaccggacagagaggagaagaaagctcaacatactactgacgaaacagcggaaaa

SEQ ID NO: 58724 - DNA, 615 bp, Heterodera glycines
  Genomic contig location: Contig_ID=SeqID_28069; Location=559..1173; Strand=-
  SCN-specific regions: Sequence locations=1-144,166-427,449-615
  Gene Ontology: Biological process=regulation of protein activity, epigenetic
tatgaggcgttgtgtccttattgtcagcgttttattgccaataatttgggcgctttgctcaatcgtttcggaagtcgcatcaaattggacttggtcccttggggcaacagcattttgctgcggaatggccaaatttcgtaattattttttgctcctttctctgtacattttgcacatttcagttgtaaccacgggcctaaggaatgcgatgccaatcggctgatgtcctgcgtacttgacgaagtgtccgctgatcaggccgtccatttcgtcatttgcttcgagcgttcactgtccgttggttccggtgttgaacagtcactgcttcagtgttccagctttgtccgcaacagctacaaacgcataaagtgggagacgtgcaatttgtgatttattccaatttttgatggtttcaggctttgctatatgggagagcgtggatttctattgcaacgacaagcggcacaaagaacaatgaccgccaaggaaaatccgatcgttgaagtgccgtatatccttgtcaacggatattcacccaacacggacgcgaattctgttaacattgtcgctctttcgcatcttatccaaaagtggttgaacttacgtgaaaggaga

SEQ ID NO: 58725 - DNA, 310 bp, Heterodera glycines
  Genomic contig location: Contig_ID=SeqID_28070; Location=524..833; Strand=+
  SCN-specific regions: Sequence locations=1-11,33-310
atgttaccttcaatgtcaaaaaagcaaagaaagccagaacagaataaccggcaactacgcataattgaagtccaattgttcactccaactgcccgacggtacccacactttgattacgaagaaatgtgcaaggaattgggagtgaattggaagaaatgattccctcataaacatttttcaattttagctcgaaatttcgaagcaaaaggaaactgcggagagcaattcttttcacgaccaagacgcagaagaaattgtgcgaagattggaggcgaaatatgtgtgtttgagaaattgtaaaatcagataa

SEQ ID NO: 58726 - DNA, 689 bp, Heterodera glycines
  Genomic contig location: Contig_ID=SeqID_5635; Location=557..1245; Strand=-
  SCN-specific regions: Sequence locations=1-96,125-215,289-445,582-689
atgcccaatttggcacttttacgaaacgcccaaagtggcactttttacgaaacgaccccaaaagcccgatatttctccacaaatgcacgttagtcaatataaaaatgaaaaattcttgcgacttgcgagaataaaaattgcgaaaagatatcttattaaaaagtacatatcaataagaaaagcaaataatcttaaaatgaggattgctacaggtgtaaaaaataaaatttttaattcgtatttaattataaagataaaaaagtctaatgtaattttttttttaaatttgtaaatctaatgctaaaatgctggggtaactttttaaattaaatttttcatttctatttcgcataattattacaataaaaaaatctctgggattttccacgtgagaatcgtttgacaagattacaatttataatcacttattaataatttcagaaacttaaatttattatttttatttatttagaaaaaagctttaataagattaaaaattatgttctttaaaatcattgacatttgaatatacattgaattaatttttatatattattaaaatctctaaaatttattttattcttttgttggatatttttgaggaacaatttgtgagtttttttctttataatcttgcaatttttctgatcaatggtggtcttgaaaaagataccttgtttgaaaataaa

SEQ ID NO: 58727 - DNA, 302 bp, Heterodera glycines
  Genomic contig location: Contig_ID=SeqID_5635; Location=1611..1912; Strand=-
  SCN-specific regions: Sequence locations=1-302
ttttcttcgacaaaaaccgactcattgatcattatgtcagcgttttgttgaacgccaacattgtgcctgattccgttgatcggatgcgccgcgatataaaatcagatgatctgatcgtttgggcccaatggctccaatcactcattgagcagcagcacaagggaccatctcggcattccttacaccgggactacgtttggatgtatttacgcattgcgtatgacatgtacgaactcggaacggagaaaagcgaatttgaacacacttttaccaagatggaaacactgatgaaaagtaattag

SEQ ID NO: 58728 - DNA, 1163 bp, Heterodera glycines
  Genomic contig location: Contig_ID=SeqID_5637; Location=406..1568; Strand=-
  SCN-specific regions: Sequence locations=1-59,81-890,934-1163
atggcaacttccgatgagaacaacagcggtgcttatgcgaaatttgcggacaaagtgaccattttggcaaagctgacaatgcatttgagggagtgtttacaggtgcgcgtaattaaatcatatagaaaaaagatggaatatttttgaacaggtgaacaatcaacacaatgcaaagcagggcatgtttattgtcaaaagcattcacaagaagaacttggcaaatgtttttgtcagaagcatttggaaaattccggtgcgttttaattaatggtttgttgatctgaagtctcaaaacaacttttagttgcatgagaagccgggtatcgacactgtgaacacattgctgaagctgctcgaaggaatggtgacgaaaaacggcgcagaattcggagcaatgggcgcgcgttcttatttgttgccatccttctcttatgacccgcgctcatttcaatattacgacgacgatgacctgactctcagccgtgctacctttgaggagatgggtcgaccggcaaccaacattgacccacccattgcttcgactccccgagaagaccaaaacgcacaccaagaaaatcatgcggcaattcctaacgaacatggagacgtggaacaattggacgaatcgatgggcgaacccgggcacttgcgaggagatattatcgacagtatgttggacaccactcaagaagagaacgaggatggaggggatagtgaagaggagtcgcctcatgactcggaagaggaagacatggacaccggtgaagaattgacgcagcaaagacccgcggtgcacgagggcgcaatggaggacgaccacatttccgaggcagccgacgccaatgagcaggttctgcaatcgcacttggtcgctgatgatgacttcgaggagatggatgatgacgacgatggcgaggaggacgaagaagacgaaaccgaagtcgagggagggggggagttggccgattttgacgtatgtcatattcgttctgttcacttaagtgtaacattttgtttaggacactctgcttgactacgtgacagactttaatgccctcgcccaacagatgcacgacattcgacggcggatcaatctgaatattgatacgaacgctttaaccatacgaccacaacaggtgcagaaaaggaacgatgaatattaa

SEQ ID NO: 58729 - DNA, 1559 bp, Heterodera glycines
  Genomic contig location: Contig_ID=SeqID_5638; Location=208..1766; Strand=-
  SCN-specific regions: Sequence locations=1-532,554-792,814-1268,1290 -1559
atggcttctccggagtgttcgacatatgatcgaatgtttaatctcttcgaagcgcgtatcaatggcaattgttgcgaaaaattgacgagcaaattgctgacgccgatgttgctgttcttcaacatgtacgagcaggagcggagtgcagacatacgacaggatctcttacaggaagcattggacggaactcaatttcaggtcgcgtcttttgtttgtggaaagtgcagcacataaaccaagttttagtggttctactggacagcggatgaccattacacgggcgcgggcgagtggcgcgaattcactccgctgtcggttgcgcagctgaacaaagctgtcagggagaagaagacttctgttcgtctgacggttgcccagcgcgtttacttcattgacctgaacgagatgaccaagcgtttgttgcctgaccagcaacagcagggcttccatccgcttcactcatcagtgccaatctacgcaaaagccaacctgcgcggagacttcaatatggagaagcttgtcaagctggaaagtgaactcaggaagggcactgaacgacaccgactgcttgtcaaaggcatcctgaaactggtaaagtcgagcagcactcaaccgttggacaacgaattggcacacaacgcgctgacattgttgcttcgcctcgtttcattggatgggatggcgcaggagtttctgaatgtaagtctgtctaaatgcattttcattttgaacattcctttttaaggaggatggagtgaaggcactgctggagatgaagcgcaatccgatttcggcacaaatggtgccaaatggcacgtcaacgcctccaacactgaacacgttggcaacgctcattcttcgccagtgcatcgactcggacgccgctcttctgcagtcagtcttcgaacaaatgatcaccgcaacttgcaatggccagccaatttcgatgcaggagatcacttcgcgcagacatgcaatgcgaacgaagcgttatcagaaggatgttaaggtttgttcattttcattcaaagtctctgtatagtagtaattcatccacttttagagagttctgcgcatgttggtacctttggcggcgcggtcgcccccactttacatggacgcggcgaagaaatgcatggccatcaaacaaaacgaaattctggtcaaagaacagcggggtgacgtcacaggcaatggaagtgcagcggcggcttcagaccaatttattcaagcggttgttttcattcttattgtcaaatgtaattgttgctattcatatttagcttctgagtcaaatcgtgacggacttggcgcaatttgacacattggcggacgcagacaaaaacacccgtcttatgcagcctccaaacctgctcaaattgattgccgaagtgcttcgcagttatccaaaggtggctgttcgtcaagtcagcgcatcaccgatcatgtcgtgggcaacatcaaatcacttctcgtcgaaagtggcgacttggacaatgcgatggcaacttccgatgagagcaacagcggtgcacatgcgaaatttgcggacaaagtga

SEQ ID NO: 58730 - DNA, 439 bp, Heterodera glycines
  Genomic contig location: Contig_ID=SeqID_28072; Location=943..1381; Strand=-
  SCN-specific regions: Sequence locations=1-135,169-439
atgtgcaaaactgtaagaggcactacaaaaagacgacacacttgggacagcgaattgaagaagggagatgagggggacgacaaggaaaacataccgccatcagattatcacaatttaacgacatttaacggacatgggaacgaagaggaggaagaggaaggtgaacataacacatttgaatatactaacatgccatttatttgacttggttgtttagcgttgtcgcccgaaatgcgttcatttctcagtgagtcgaccgcccatttaagcgattctgaagtgacttatgcgcggcggtgcattcgacgaattttggcccaatgggcggaagcggagcgacgtggttcaatcaaaaagctgttttcaaagagcccatcagaaaggtgaaaaccccctcttggtttgaaaatgagctagaaagcagctatccaaaaataaa

SEQ ID NO: 58731 - DNA, 72 bp, Heterodera glycines
  Genomic contig location: Contig_ID=SeqID_28073; Location=282..353; Strand=+
  SCN-specific regions: Sequence locations=1-3,26-72
gaatctgttcacccaatttacaatgtgcatatcgacgcatattccaaagcgcaacgatatttcaaagcatga

SEQ ID NO: 58732 - DNA, 432 bp, Heterodera glycines
  Genomic contig location: Contig_ID=SeqID_28074; Location=148..579; Strand=-
  SCN-specific regions: Sequence locations=1-147,169-432
atggaactcattaaccaattctggcgcgatgatagcgaaaagcagtttgaagactaccaaattcccgaatctccgccctattggtccagcggtttcctgtcgattcagtacgcaatcgaaaaggcgttcatcgaattggtccgtatcaatatatatatttttgaaaatggacttattgttagtttgtcgtttttcacagtgtgcccaattaaaaaaatatatagagatttcacttttttacgtgcttttaaggccaaaggtgacgatgctttggcaaatgtttcgctccgtctccaccgtttgcccattccgtcgtacatgaacaagcaaatggccaccataacggtgcccctttttctgaccatgcttttgtttgtgttcgccttttccatgctgaaggacattgcggtggaaagggagtccggcatcatg

SEQ ID NO: 58733 - DNA, 883 bp, Heterodera glycines
  Genomic contig location: Contig_ID=SeqID_28075; Location=380..1262; Strand=+
  SCN-specific regions: Sequence locations=1-301,324-883
aaatttgcaaaaccttctacttccgtcagtttcattgttgtcatttggtttccggcgttttttgcttactcctttgagccctttaatgagaacaacgaattgactcgggaacaattgacatttaaaaagactaacaatagcagatgttttctgcttgtccgttgtccaattgcgcgagaagaaagcaaatggatcgaatgggaggaggaagcgattggctgggaatttcttcatcagccgaacagaatcaatattcaaattgatgatgaggagaacattggggacgggtcagtgagtattttttattcaaaaaattcaaatttattcgtttccatttttaggcttctcgacgcaactcccggcccaagtgatcagcagcagaagtgaatgaatgaattgttgcgaagtgatcgaccaatttgaattgcggaatcgaagaatgaatttgagcccatttgacgtgctcataaaaatatattctaattttttggagttttcacaaaaaaaaatttagtgttaaatgttgtggattcaaatttgataaacgaattttaaaattcggaacaaatttaattttgtttgcaacgaaatgaaaaaatggtttcggcagtgaaactcgctgttgacccactcgcgcatcaattcagatttggatttaattttaggcattttcaatattttatcctaagagatatatattcaaatcggaacatatttgacgaaaaatggcaaaatatgcaaaaaaaaatctaaaaaaatatgtacaaaaaatggctaaatatgcaaaaaatctgaaaatatgtacaaaaatggcaaaatatgcattaaatttcaaaaaaacccaaaatattcaaaaaaacccaaaatatgcaaaaatatgcaa

SEQ ID NO: 58734 - DNA, 436 bp, Heterodera glycines
  misc_feature (409)..(409): n is a, c, g, or t
  Genomic contig location: Contig_ID=SeqID_28076; Location=22..457; Strand=-
  SCN-specific regions: Sequence locations=1-436
atgcctcaaaaagaggtcattcaagttgaaagtgattacgaaattcggcgcaaaccaaacatttcggaggcgctgaagttgttcaaaaggcatccgaccaaaatagacacaggcaagcgcaagaggaaaagccaattgaaccgacctttgcttatagtgggcgcttttgctctcattccgccgacaactgcattcaacagaatttgcgaagcggttaaagctttgtttgagtctctgaacaatcaattggcctcagtttgttgattttagcaaatttgctcctcaatcccattatatttcagaccaatttgattgtctctttcacaaatttggtgattagacgaacaaagaatcgccttgacgaattgaagcggcaacgcatttcgatcaccgaaaatgtggaatgctncatttgtagaaaaaggatcatgaacag

SEQ ID NO: 58735 - DNA, 1417 bp, Heterodera glycines
  Genomic contig location: Contig_ID=SeqID_28077; Location=92..1508; Strand=-
  SCN-specific regions: Sequence locations=1-474,496-1203,1225 -1353,1375-1417
cctaacccaacaaagggaaggctcattcggccatcgccgccgctcattcgcctaacccatcaaagggtaggcacattcggccaccagtcgccgacttcttcgtcttgcccaacaagaggcaagacacattcggccatcaccgccgacccaagtctcacccaacaaagggagacacaaccggccaccagcagccgaatcttcgagtcttcaatcgggccttgtgccgcccgtaccaaggcctacattgaggcggccactgtcaacctcggaaaggacacgacagacgtgagcattcaagcagacctcacagcggagcgccgtggactccgccgagcgattcggcttttggaggattgcaatgacaaatggcaatccctcctgctcaaattcaatggagccgaccgccaacaagaggagcaacgctacgatgactttaagccatcgggaaagcacttcatggaatgggcggacaaagcccgaggtgaagtggacacgatcgatggagtgatcggtccagaggatgacgacgaaataactgggagcattatctctcagcccgccaatcctccacaaattcaacatgttcagcctcccccacctcgccatgaggtgtacctacctcccatctctctcccaaaattcacgggagagccaagggagtggccaatgttttggaggctcttccgttcctcagtggacaaccttccaatcgacgacttcaagaagcacatctatttgttggggtgccttccccacaactcgccagctaggcgggcagtcgacttgtacccaccctcggacgaaaattatccgagggttgtcgacatcttgaagaagcgatttggtgatagtaaaactatcactgagtctttgcaggcagagctactgcacctctccaagccgggagagtcagtgctctcgctccgcaacttcgcggagtccgtggaacgaatctgtttccaactaatggacttcgtcgaatctgaggaaaacatgttcatggcttcgacgatcaagtcgaagcttccgttctccatcctcacccacgtggtggagaaagagctttcctcaggaaggacattttcgtgccttgacatccgaaaggcacttcaagcaatagtggaagtaaaagaggaagtgcagagatgtgcacatgtcctccgaggcgatgaacgaccacgttcatccaccttcaattccccacctcaacagaggggtgcctgggatcaaaggggtgacaaccgtcactccaacaaccgacagagccaaccaccaaggccatttaatcgtggagtaacgcaccaaccagaatatagggcgttctccgcgattaacaaaaatccggaaagggccaaaaccacagcaagaaaatggggtcgtccctgctcgctctgctcgggaactgatcatcttccca

SEQ ID NO: 58736 - DNA, 279 bp, Heterodera glycines
  Genomic contig location: Contig_ID=SeqID_28078; Location=253..531; Strand=+
  SCN-specific regions: Sequence locations=1-153,196-279
atgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatga

SEQ ID NO: 58737 - DNA, 961 bp, Heterodera glycines
  Genomic contig location: Contig_ID=SeqID_28080; Location=535..1495; Strand=-
  SCN-specific regions: Sequence locations=1-403,425-503,525-590,620-961
  Gene Ontology: Mol. function=lectin; Cellular component=plasma membrane; Biological process=cell adhesion
ggtgaatgggtcaaggaggagcgcaagagcaatccatataaaaagggggacgacatcgatctccgagtgagttgccccggggtggcaccgaatgaatgactcatccacccattggactcccttcagattcgtgcccacgacagcaaattcactgtttatgcggaccaaaaagaattgaaggagtttgagcatcgcgttccgttaaggtgggcaattcggatgattcatttcctcaacagcctccatttgttcagtcatgtcacacacttttccatcgacggcgatgttctcatcacgcaaatccattggggagggaaatattacgtaattatcggaaaatgaaatgcgattattttcgtcagcgtttttcagcccgttccttatgagagcggaatcaccggcgatggttttgcacccggaaaaactctgttgattttcggaacgcccgagaaaaagggcaaacgtttccacataaatttggtctgcggaaaatttaaaactgaatttacttttaaattttagctgaagaaaaacggggacattgccctgcatttgaacccccgttttgacgaaaaggcaaagccaaaaacaattaaaataaaacataattttatttttaggcaattatacggaattctttgataggtcagtttatcagagaaatgtttatctttaaatttaccaaaaagtgattatttatagccaatgagtggggaaacgaagaacgcgagggcaaaattccactggagaaaggcattggctttgacctgaaagtgatcaacgaggagtacgccttccaagtgaccgaccagcgcaatggcaatgctttctcatactgaccgagtttcagattttcatcaacgatgaacgctactgcacttacgcacaccgagtggagccgcacgacctccacggactccaaattggcggggacgtcgaaatcaccggcattcaaatcttc

SEQ ID NO: 58738 - DNA, 284 bp, Heterodera glycines
  Genomic contig location: Contig_ID=SeqID_28081; Location=1..284; Strand=-
  SCN-specific regions: Sequence locations=1-139,161-284
caagtctatccaaattcccttcgtctccgtccctgtcaaatgcatcgacagagtccgtttgctctccgccgttcgtgcggtttgtcttgagagaatgccccgcctaaaagtgaccgaacactttgtcataagttattcatgactttcttaagccatggcatacaccgccaaattgcgacggatcagtcgaaaggcttttgctgtttgaccccgacaaattcggagaagaagcgacgaacgacttgatcggcaactttcccaaacgatggattcgtcgccagaat

SEQ ID NO: 58739 - DNA, 4093 bp, Heterodera glycines
  Genomic contig location: Contig_ID=SeqID_5639; Location=1040..5132; Strand=-
  SCN-specific regions: Sequence locations=1-96,141-145,167-584,617 -803,832-953,983-1184,1206-1267,1290-1534,1563-1571,1598-1656,1711 -1836,1874-1891,1913-2034,2063-2066,2100-2107,2147-2158,2225 -2276,2306-2338,2365-2594,...
  SCN-specific regions: Sequence locations=...2637-2818,2862-3008,3031 -3136,3193-3245,3268-3371,3413-3756,3785-3987,4073-4093
atgtcttcaaattttatcggttcgccaaattgctttttccgtccaacagctgatcagggtaagagaaataattaaaaaaagaattacgaaaaaaggaaaattattttatcttttttaaataaaataaaataaaaatttatcaccattagcagcagcagcagaagaagtggacaagtatgaagtgttcagttggcacggagatttgagcgaccaattggcagcacaatttttggtcagtgatcagcagctgttgaaggtgggacatttcagaacggacaaatgagcacagaggggggagcacaaatgatcacagtggggggggggaggacaaatgagcacagatgggggggggggagagaggccggacggatcagtcacggacaaagggccgaccaattccgagagcaatcaagagacattttgccaaaaatcatgcaattaatgagtgaaggaaattggaaattatttagtggactgaaaaaactttttttatttaaggaatgccgagaaaaacttgccagtgccgaattgagagaaacgaaattgctgtgcaaaaacggggaattgaatgcagagaatgtaagaaaaattaattattaaaaaaaatttaaaaaatgacgaaataactgagagcgaacgcgcataaaacagaaactttcgaattttgtaagaaaattcagaaggcgcttaaagcagagttggagaaacaaaagctgatgtcggaaaacagtgaattgaaggcgaaagttgagaagatggagcaggaaaagcagcagcaattggacaaaaaatacggtagagacaatttaaaaaaataaataatttttattaccgtactcggacagtactgtatgcttcaaaattatttcagtttctgtcgatgtgttcaattcattggtggagcgaatcaaacaattggaaaatcggcagaacaaagaggagggcagaaagggtaaataataaatttaaaataaataattaacggaccgaaattttgcatactttaaaaaggcgaaaaaattttaacggaccataagcttttacaattttgatcagttacaaattttaaatgaacatatttaattagctgaccaatgccaattattttgaattttcattttctattattcaattggatacatttgtttagcagaggaaaagcagcagaaggaaagtgttggtcaacagaacaaaaacaccgaacagaaattggatggaaaatatgccgtggtggacaaaaacaatgttttgggtgggcacaattggcaaattatttaaaattaaaaattggcgttataaaaaaaatgcattttttgagaggggacaaaaccctcgtattatatcgggattttatacatatttggtacatatttcggacatttttcttacatattttcattttttttacatatttgaggattttttacggaaatttttggaaattctcaaaaaaaatccaaaaatttcggcaaatttttcatttttttacatagctattctgagaatttttgaaaatttttagaaatttcttgtgaaaaaattaaaaaatcttttttttaaatgtacccctccaaaaataatttttcaaatgttaaaaggtgattttaaacattttggtcatttttatggcattttgtgcctatttaacactttatgaaaaaaaaattttccaaaaaataacaattaaaaaaaattttatttacatattttcgtacatattttgggtttttatacatatttcttacatatttcgggatttttttttacatatttatgtacatatatgaccactttttgtacatattttttacagccctaattataaatatttaggtgttaaaaaattaatttttctttttaaaatgtatttattgctaatttagttgctttagtgacgtcatcgggcgaccattcgccgccggcggttgtctcagcgaaagttgcaaaggtgggaaggaaaccttaattatttcacaaatgccatttaatttcaggaagtgcctaattcgcagcaacaaaatggctgggatgccaaagtttgccacaaagacatcgaaatcattggggaaaagcaattgacgatcaattgcaagggcaacagatttggtatttaatataaaaattaaaaaatgtaattaattaattactttcttaattaggatggcgctctgtttttgcgaaatttccaattacgaacttttgtcgtcccggaattttctacttcgaaatgaaagtgttcaaattggaaaggtgttcattttgatgatttcttagcgttttatttataattttgaatttattttaacagttttgctgcgattggaagtgccattggacgggtcaattggtcaaattttgaacagttacgggtaccgaagcgatggctcatttggctgtaatggcatcaatcggccgtgcaaaatgccaatgtcattatttggttcgtcattttcccccgtggcaatgcaatcggcggacgtggaaatggcatacaaatcatcggagttttccactggtgacgtggtcggatgtggcattttcttggatactcgactgatcttcttgacgaagaatggccaacgaatgggtgggccaattaaaatgaaaaaacaaattaattaaaattttatttttaagattattcctcttttttcattcaaactcccgccaattctctcaattctctgtttccgtgcgtttctttgtgggtgggcgacaaaatcgaggcgaactttgggccaaatttcaaattcaatttggcgactctctgaagaaagcaaaaagaatggaagaaggagaaattcatctaattgctgtcatttttactttatttatgtttattttttaaattctttttttttcaattttgattttggctttataatactaattactattttatttgctattaatttcgtttattaaaacgtcgattttgtgactcagtttcaagtttcttcgaaaaaattcctatgaatattaaaaattaatacgagaaacttcacaaaataatttaatttctcttaaataaggatggcatttcttgactcttggttttaaactagggtttctccccgactccgagccccccccccaggcccataccaaaggaatttttacaaatatttgttctattctcagatattaattaaatccaatttttcaattgcatttttaaataaaattctgaattggggcattcttttttaggtcatcaattaaaatttacatcttttattgtgaactttcattttaggaacttaataaaaagtttgtcaaaatggaattcgtattgaaaatcaccaaactggagcttaaaaatgtgagtgttatttaaagtgtcatttttttgaaaattaaatgggaattgctaattaattttgaaaaaaaaataaattttctaatattaaatgattttagaagggactccaataaaagttgaggcagaaggaaacgaatgtactgctggcgaaatcgaagcggaaaatgggaaaatgaaaacaaacaaaaaaactaattttgcggatcaatttttgagaaaaatttcaattcttagagttgtatttttctttttattgcatttttgttaaggatttttccgaagatcccgatgcaattagtgccactaaaagcaaaaagaacacattgttacaattgtcttggcctcggaagccgcggtcgagaatcgcggatcgcacaaaaaaatttgctgggaatcgcgcatttaaaaccccaaaaatttccaagttttcaaacataaattttttaaactttttaaaattttcctgattagaaaaaataattaatcaagtgccggtgcacgggcgaaaagaaaaaaaggtcgtcgctagcgcggcacaaaatgggaatatttctaactagagttgagcgggaccgggaattttgggcaaaaccgggaccgggacctaagaagccgggaccgggacctcgattttttttcgagaccgggaaccgggaccaacagggaatttttaaaaattcaaaaaatttttaaaaaattcaaattttaattttttttttcaactgaaaataatacaaaattaaatttttactttgttttttattgaataaa

SEQ ID NO: 58740 - DNA, 908 bp, Heterodera glycines
  Genomic contig location: Contig_ID=SeqID_5639; Location=6476..7383; Strand=+
  SCN-specific regions: Sequence locations=1-2,63-210,232-237,281 -311,376-456,488-521,552-853,875-908
atgaggtggaaagaatttaaattttataaatgcaattacctatttttattttattttccattggaacagaaactaaatgcgaatgccgaatttgccaattccatccaaacaaaatgcaccaaatttgaagaacagcaaaacaaattgaaaaattgtgttgacattttgaactaccgattcggaaatggtaaaattgcataatttaatatgtgaaaaataaagcatttatttaatgtcattttaaaatttaattatgtatatatatgtgattaaaaattaagttaattcaaaaagattaatagggaatgctgtaaaattactttttttaaaaagaataaaaacaattctaataaatatttgtagtaatatttttaagcactgattgaacaaatcttggaattacaaaatgaacagaaggaaattttgggacgaatgagtgaaatggagaagaaacagcaaaatgacgaggaaaaggaaacggaaaagtacggtaagtgaatgaatgcctaccgtaatgaagcatttttaaatttaaaaataataaaaaattaggcaaactgaatgcaattttgggacggattatcattgtttatgagtcaaaattggatatttgttaatcattttaattgattaggaacaataatttttgcgctgtaatctgctgatcgtcttttgcaaatgcaaaaccagcagacgaagctttgtgccaaaattgatgcggtggaaacgaactcttctgcaaaatggagtagtatgattcttgagttgttgaatagaggggaggcggaaataatgttacatttagttgatttatcagtttttgtgttttcgctcgcaaatagttacaaaggatatttttaaaggatgaattatcttcagtgtcgagaatggttagttctgcttgttga

SEQ ID NO: 58741 - DNA, 149 bp, Heterodera glycines
  Genomic contig location: Contig_ID=SeqID_5639; Location=7599..7747; Strand=+
  SCN-specific regions: Sequence locations=1-149
atggcaaggaataaagtgatacggacatcaatattctttattcttcattgctcatttaaacttacatatgtcagcggattaataatttgcttctatatcacttcagctcatcgctcgatgtcgaagaaggattaacgcggcacaattga

SEQ ID NO: 58742 - DNA, 927 bp, Heterodera glycines
  Genomic contig location: Contig_ID=SeqID_28083; Location=499..1425; Strand=-
  SCN-specific regions: Sequence locations=1-78,100-606,642-758,794 -876,919-927
aaaaattttattcatctcccttttcgatagaaaaagcatcagagtgcctaaactaacatgtaaataaaatttggtccgtttcagagcattttctgaaaaaatatttatgaaataaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatcgggaagctattcccgaaggattcggtctccccataaatctgggcgcatcggttcagggggactgccccgaaatccaaaaaaaaaattttttggataaaaataatttaaatgaactgactagataatatttaaaataggttatttctcttcctttcagtatccctgcaaagtttggtgcgcttctgatcagtttctgaaaaaaaagtaagcctaaactttttggcctgtttaaaaagaaataaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 58743 - DNA, 99 bp, Heterodera glycines
  Genomic contig location: Contig_ID=SeqID_28084; Location=321..419; Strand=-
  SCN-specific regions: Sequence locations=1-3
taaaaagtttacaacaccttcgattcccaggacgtctccgttccaagtactaagaaggcccaacgttgcttaacttgccagatcggacgggatggcgtg

SEQ ID NO: 58744 - DNA, 200 bp, Heterodera glycines
  Genomic contig location: Contig_ID=SeqID_28084; Location=546..745; Strand=+
  SCN-specific regions: Sequence locations=1-30,85-89,120-200
ttttttttctttttgattattttaattgtatttcatcctgaaattttttaataaacattttcaaactttcaccttattaatttaaggcgaattttgccttttttaataaattctcttgtgaaaaggcaaaaaaataggctcttttaaatatgcctatttaaatgactttaattgctgtcctttcgcttacgaccatacca

SEQ ID NO: 58745 - DNA, 1439 bp, Heterodera glycines
  Genomic contig location: Contig_ID=SeqID_28091; Location=67..1505; Strand=+
  SCN-specific regions: Sequence locations=1-7,38-78,100-379,403 -413,436-547,594-607,630-724,746-829,873-1078,1100-1161,1183-1439
atgcctaaacacaatggaaatgaaaaacaaatgacggtaatactaccgatggtacccccccccattttttttggtagaaaaatttatttcttataaaaaaccgggaaaacatgattctgaggcgtattgtcgacgtgcgcatcacaaaagaataaagtttcctgtactagataagatatttctctctaactttttgtgctaaattaggaataccgagaacggcagattttgttcgcaaacaaaaaagaagttagtatttattcaagccttacgaaaggaacctcgtaatattggacagagaaaggcatgtagactaaatgaaaacaatattaattaagtcaaattaagggatacacaaggcaaagtgccaccaaatgtcttaaaataatttacaatttgcttcgtcgaaaagtacataaaaacaatttgtttttcgggtctttttattgtaaaatataatttccggacattttaactgattggcacattacgtcaaagtgtttcatggtgaaatttttgtactttaaattgttttcaacacaattagtaatttaaaaaataaatttaattttcttttctttttcattataaatgaagtcttacattttcacactcagaagacaaatattttttaaatactctgaataaactttttcaatttttttaattgtaaaattgccaagaaaatatttattctgctttgttatttcgtaattttttttaatgttttcaaattaattaagctaaatgttgtccgtcctttcttttgtgtgttattccatttatgaactcgtctccattttggtaataatttcaatttatgggtcagataatttatttttttataaatttaattgtttttttaaataaatgtaaggaaattgcccattttgtggtcaatgttgtgttctatcggttgcccatttttgctcccacttgcccatggttcggcacgtcgccctcggcactttacaccattggcacatttttggtgtattttttcgaatatctaatttatgtgcttcatattgccatcacccttaatcgttgctcgtgcgtttgggccccaatccggcacaaagaagtaaaacaaacacataaacaatttacaccattacattttctcagttttggtgccgtgcttgtgagccgacaattgcgtttgcttttgctctttctttggcattttctgcccaccgtttggtcactattgcccagttggtccaactcgacaaaacggacccgtccaagggctcaattccgctcattgtcacctaccaactttattttgtatgttcaaatttttgcgaattcatttgaaatttttgtggcacttcgtatcgctctttgattttcttgggattttcagaaattgaacctaacttttttttaatcaaaaacaggaaaatcgcgttttctaatattttattgtgaaaaaa

SEQ ID NO: 58746 - DNA, 476 bp, Heterodera glycines
  Genomic contig location: Contig_ID=SeqID_5640; Location=495..970; Strand=-
  SCN-specific regions: Sequence locations=1-287,310-476
atgaataataatttagtggtctggttaaacgtggatttgttcccacggcttttcttcatcggattactgttgccaaatttgaggactttggcattggcaaaaacaatgtaattaatatttattagcaaatctaattatatatttttcttaagtttgatgtgcgtcaatgcgctgcttatgttgaacaaatatttaatttttggagcaaaagcaaagataagatgacagctgatagaattgataatcataatataattactaacgatgatgtcgaaattatttatcccatacaaaatcaacatgtaaaaagtcatttccatctaattaattgaaaattattttagttaaaacaacaattgttgggattaaaccatcaaaatctgtgtaattttgttgcgaaaaaaattatgatggacaatccaagtgaagaaggactgaatgaaaagaatattgctgatatggagatggatgactga

SEQ ID NO: 58747 - DNA, 373 bp, Heterodera glycines
  Genomic contig location: Contig_ID=SeqID_5640; Location=1352..1724; Strand=-
  SCN-specific regions: Sequence locations=1-144,189-193,215-238,260 -293,338-373
atgtcaaatttttgttattttgcaatttttgcatgcatttctcaaatttttggcactgcaaatggaatgaacacagaaatgggatttcagcctcattttcaacaaaacacatcaacatttttaaggaaattaggtaataataccttaaaatttattttgttgtttttaatataattaattattttttagaatttgctaatgagccaaaattactgataccaattgaaaatgttattgcttttttgaaaatgttttcccaacttagttcatcgctcaattccaatgattttagcacagtttgcttttaatatttttcaaaaatattcagaaaaatattttagcaatgcgtcgattttcaaattttgcaaataaa

SEQ ID NO: 58748 - DNA, 664 bp, Heterodera glycines
  Genomic contig location: Contig_ID=SeqID_5641; Location=49..712; Strand=-
  SCN-specific regions: Sequence locations=1-145,167-183,220-451,503-664
atgctcgaccaaatttataatttgtcgctcagccatcgacagttatttaattattttggaatttgcattgacattccttcgacaattgtttatattttggaaatgattactatcataaagcataaacaattttcaaagtcaccattttacaaattattcttcatccgtggcgtttttgtaagctatttaaaaaaatatatttcaaaatttatttaaattggaattttattttaggatattcttagtttagtgcccaattccttgggcaatttgcttccagcattctttggccaacaattgttgtcaatttacagcaccgtaccaaattgggcaatcgtcttgttaacctttttcacaaaaactttggtattccaagtctcaaacattgtgacagttttcattttgttgaatcgtttcactgcaattgcatttccattgcgtcacaaaatggtaattaatatttaaattaaattaattaatttccgttttttaaaaatttttagctatggaaaaaacactttaggcatctgatggtgtttttgttgattgtaccaatgctaattacttttccaataatgcgaatgcgcacaacaattattttttatgacagcaacagttttctcttagacgacaaagacccggtaaaaacttaaataatattaaa

SEQ ID NO: 58749 - DNA, 702 bp, Heterodera glycines
  Genomic contig location: Contig_ID=SeqID_28093; Location=108..809; Strand=-
  SCN-specific regions: Sequence locations=25-226,254-411,433-702
atggcagcagcagcagcaacattcgctgttgccattcgctgggcgccgtcacaggcgcgaagactgatcaaaagcagcagcagaagcagtgtacagcagtgcggctggccaatggcgacatttgttcagcctgtggcagtgttcagcggaccgcagcaatggaaaggaggggtgagtaaagttcataaaacgggggggggcattcgtggaaggatggggtaaaaggactgccaacatttaaaaagggaaaatggcatttttgtgaatgacgcggaggtgtgagatcgggtaacagagaaccgtgtactgctacaccccaggctcgaatcagcacaacgtgtgactcacatcgacacgtaagtcagtactagtaattacaatactataatcagatcattgtaagacataaactaattaatatgaaattttcctaattacctgataaagatattgcaaaaatggaaatcaattatgaggatgagtgtccctacaatttgggctttgcccgtgccatgttcgacttggccgctgctgctgatggccatgcgggcaacgacacagaatggcaaaacatgaaaagcaaatttgtacaggaaagccaagcaatcaaagcaattggccaagaaaagaacattgaagttacggatgtgcacattggaaacccaagcaaaggcaaaaaaaaactaattatttgataataaa

SEQ ID NO: 58750 - DNA, 816 bp, Heterodera glycines
  Genomic contig location: Contig_ID=SeqID_28097; Location=20..835; Strand=-
  SCN-specific regions: Sequence locations=1-203,225-367,389-503,525 -656,683-765,808-816
aaacaaaaaaatcgattttttcaagtgtcgtttggggtactcaaacaattatgggagcaaaaatccaacgcagaataaagtacaggctatagggaagctattccgagggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 58751 - DNA, 1281 bp, Heterodera glycines
  Genomic contig location: Contig_ID=SeqID_28100; Location=6..1286; Strand=-
  SCN-specific regions: Sequence locations=1-100,162-301,323-395,417 -539,563-684,758-815,871-1163,1223-1247,1271-1281
atgaattcagacaattcattgacttatgaggagatgaacaacaccaacagaagagcgcattcttcttcaaacattaaggtgaatgagaatcttaaaaaggaaaaattattttatgagaaataataaaatttttcgcaatttttatttattttataaaaattctttgcgtatcgcttttctttagactccgcggttaatgccatcgacagagaattggtcgcgcaatcgaacatcagccgaaacgaaacgaattctgctaactcggcactacaaacatgaaaacatttttaaaggtattcaaaaatcaatcaattaattaattggtctaattaatttgtgatttcagatttgggcattcgaattgttggaggaaaaaaggtaagcaaaaacaatgcaattttaaatttatattttttgtgttctaatttagctatcaaacggcgatttgggtaagtgaaatcggagaaggcaaaacgtcgccagacgaatttttggacaataacttttttaacaacaccaagaaagaatgcttaatttggttgaaaatgaacaaaattattgtccaaaaaatcttccggcgacgttttggcaattcttcgaaataatttaaggtttttgaatgattttacgctgtttaggtgcttttataacaaagattgacaggtaaatcaaataaacattaagtaaattataaataatttatttaatcaattatttaattacttttgctttgttaatttaaataatattttaatttccaatttttagcagcaaagctcaagaaatgttgggtgaattaagagaaggagatcaagtaaaaattaaaattaaataattagataaagtatattttaatacttattttttattggttcaaaattttttgccaaaattattttgaaaatgtttaccttgaaaagattctcgaatggaacggcgttttgttgagcggaaaaacgtttgaagaagtggaacgggtgattcaggcgagcaatttgggcgaaatagagctgattgtgcgctctcggtatatttttattgaattttgaaaaaccaattaattaattaggttggtaaatggtcactgagtttagtgatttgtatgaatctgggctgtcctgatccgggcaaaattgactcggaagtttcaaacaaaacaattcataatataatttagataattatttcaaaactaaaataaaattaaatttttgtttaatttcagtcgaaatttacacgacaacggcgaattggaagacgatgatgatgagcatgatggaa

SEQ ID NO: 58752 - DNA, 1137 bp, Heterodera glycines
  Genomic contig location: Contig_ID=SeqID_5644; Location=313..1449; Strand=-
  SCN-specific regions: Sequence locations=1-318,340-402,546-611,633 -766,793-862,884-1137
  Gene Ontology: Mol. function=transcription co-activator activity; Cellular component=nucleus; Biological process=negative regulation of cell proliferation
atgccgccatatggtccggctcacaaccaacagcaacaaatgatgccaccgtcggcgatgggctctgttcaaccgggcgcagccgcaatgaacaattggatggactggaactcggcagcggcgatgccaccacgcggcaattacccggtggcgccgacgaacgccatgaaggccggcacaccgacgggcgcgtacattccgccgcagagtggcggaatgatgccaccgcctgctgggcaggtgccgtactacgccgttgggatgcccacgtcgacagctgctgcgcacggtcaaccgatggagccggcggcataccatcagcaacaacagcaacattaccaagccgttcagcagcagtacacaaattaccaccagcaacagccgaacatgacgtacaacacacagcagcagcaacaaatgctctttcatcagcagcaacaacaacagctccagcaacaaatgatgatgcagcagaggcagcaacagcagcatcgccaaatggtcgcggcggcaacggcaccaccggcggcaggcacaacacagcacaaagcagaacttggcggagtccaggcaggacaaccggcggtgcaactgggaagctacgcgtcgtcagcagctggtggtggtggcatggcgccggcggcgggcggtccgtcggcagtgaattctgctgcacagcagcaacaccaatggcctggcagtgtgacgcctgttgaggatctttacgtacgttttatcggcgggttgttttttggaagaaaaaatgcttgggaatttgtttttccatttttatgtccacatttctcctgtatttaaccatcgccgtgtatgacaattgacttaaaacatttcaacaaaacgaaattttttgtatttttaagagctcgatggacgatttgctgcccgtgccgagtgaacagagggaaactgctggccattttggtggtgccgtcacctcatccgctaacacggcggtgatgagcagtggaggcggtattggcaaagtgacagtgaacattttgcacctgccggagatggtccgcggcgaactgaacagcgtggagcagcgcttccaattcgacccgaccgttgagctgaacacggacgccaacgcattcatcgtcaaatgcattctga

SEQ ID NO: 58753 - DNA, 2576 bp, Heterodera glycines
  Genomic contig location: Contig_ID=SeqID_5645; Location=1130..3705; Strand=-
  SCN-specific regions: Sequence locations=1-308,330-580,609-705,727 -810,869-1083,1110-1330,1352-1421,1443-1472,1514-1697,1756-1828,1865 -1895,1918-2005,2029-2075,2115-2319,2341-2513,2535-2576
atgcccgacaggtcggcggtggtgccattttaaaaatatttttttactttttactttccaggtggaggattacgtcttccaaaagtgcagcagcaaagacgagtacatgagaacgattgcgaaagtgagtcaattgtatttttcaaagcaatttctattgaattaatccaattttatgccggttcaaatttcgtaaatcctgctttttggctttggcacattaatgccgtaattttttgtgtataggtaatcaatgctatcaattgcaactcgaagagcagcgccgtttctcccgtgttccaacagcaccaacttggcggcggcggtgtgccaaaaccgtccgcgacgccccaaagcgttgcccagtcgcagggctcaccggcaacgggcacagtcactgccacgggcggcacggttgtcgctgcttcggcggtcacttcctccgcctacaaagtgtgtatttgtttggggtgggggacggagagcagcgcaatcttaattgatgctgcgaatccgagccgtgccatttcctatactgtttttaaaaaaatggggttttcgtttggatatatcgtctccgaaattatatattttttattttattttttgccaaaaaagcgctcacacaccccccattttctatttggcgcagttggccacaaatcgcgcagaatattccaatggatttaccccacatttgcgccttgggtatttccaccgaaacactaaaaatcgggttcaaattcatgtttttttcaatcaaagaaagcattgattgctttcaagttaagaaaacaacaacatcttgtgatacaataagtataaaaaattcaaaaattaaatgtttgaatattcattttttccaagaattcattaaaaatgaagtttcggttataaaatctttagctattttcctgacaccaatcaattaatgctgcttatgctatgtgcgattgaaaaagcatgcattttacacttgattttgaggttccgctgctctggtttctcaaatgagcgagagtcggttctgttgttcaaccaatttcctcaaaattttcaggtgcctcccgacccacagccaacgcatcagcaacaacagcagcagcaaaggatggccgccgccgtccaacatcagcagcaacaaattggcgccgccgatgcctttcatcaaccgatgggacagccgccgccggcgatgtcttccgcgccgtccatggccatggcggcgtccggcacgaccgccgccgccgtaatggtaggcgcaacgtcacatgccggcaccgtcgtcgacacgagagatgttgcgggtgtaattagcagcagcaacttccaaccagcgcaccagcagcaacagtacccatgtgtgtattggtagttggcactgtacttttctggggccttttgccatcgactgccaaatttattaagccactttttctcgagagtctcgtgcattttgccctaatttgcaattggcatgggaaataatttgtggcagaatccatttcttcatttttccctgtcaacttttaaaacttttttttttcagacagcacagcgccgtccgttggtcagccgatcacaatggcgacaagcagtgcgagtgcagccgcttacccggtcgccacgcctcaactgatgatgggcacggcgggtgccggcggtggtggcaaaatgccgaacgccgtcctcaccgcgcaacaaatgcagcagcaacggcactggcaaagacagcagcagcaagagcagatgcaggtgaggagggagtcaacacgattcacttttgccactagttcatcgagtctttaagaaataacaatttctcaacaaaaaatttttttttttagaattttcttataaaaaactgagattttttctcgaaaaatttctgttagtaaattttttataaaaaaatttctcgggggggggggaccatgcgggtggagtgcaaacttattctcgactttcaatgtcgtcgtctttagagtaaatgtcatcgcattctaaaattctgtttaaaagacaaacaacttttttgaaagttgtcctagttagaaaaaatgttacttataagcaaatttttttttattattattatttaacaaaaaataaatctttaggggagcggcaaacgaactgctcccaattgaaactttgtgtgtgtacataacattttccatttccagcaccaccatcctccggccaacatgccgacaacgacgcttcatcagcaacagttcagtgccggaggcccattcatgggaccaccacaccaacagcaacaacatgccattgtgccgggtgccgccgctgcaatggcccagcagtacggcggctccgccgcggggttcgactacccgccaacgttggcacccgaaattgtgcaacaactgaaggcacttggggaggaggaacgaccctactacgagaaggtgtgccaactgcagcagtttgtcgccttcctgcacaattcgctaaacaaatacgcggccgacccggcgatggttggtcattgtgatcagaattttaaatggtcttgctaaatgggttcaccgccaaaatcaagggcaaataaa

SEQ ID NO: 58754 - DNA, 624 bp, Heterodera glycines
  Genomic contig location: Contig_ID=SeqID_28102; Location=357..980; Strand=-
  SCN-specific regions: Sequence locations=1-135,158-624
atgggacctattgaggagaaggaagcgattgagttgaattttaaggacccttggaacacaattcaaattgctattaatgaggaagaaatcggagacgggtcagtaaattgagaatacaatttaattgcaaatttccattttcaatttttagtcttatcgatggcacttccgacccaagtgaatgaattctgacaatgatgagtgagggacaaaagaacaacaaaaactgtgatcagcggaagaaatgaatcaattaaatgaggaataatgataattatctgtgataagaatgtattttatgaagaaaaaccgcaaatataaaagtacatgttaataaattggaggtattaaaatgggaaagataattttaaaaatctctaaacttcaaatcgtataaattttaggttttatttagagcccggcgcaggaccggatcctgcacaggattttgcaggatcccagtccgcaatcctgcattttttggaaaaaacaggatttgcaggatttgcaggattaatccggccagatccggtcctgcaaacatttttgaattccaatcctgcaacaggatccgcaaatttgaatgtttgtgcaggattatgcgggattttattgattttttaa

SEQ ID NO: 58755 - DNA, 674 bp, Heterodera glycines
  Genomic contig location: Contig_ID=SeqID_28104; Location=302..975; Strand=-
  SCN-specific regions: Sequence locations=1-91,124-445,471-477,501-674
atgtgtgctcaaaaggcattgcactcagcaacagttggacgtgccactttttcagacagtgaggagatgccatttggagatttggaccaacaattttattttaataatttttgtttttttttagcgaaaacttggccttgaccaccggttttccggcactgtttgtgtgaacggccaaaagttttgctcatcagtgacacaaccgaacgtcaaaatggcggaacaagtacacttcatacgaaatttctctgaatgaatatttgtgatccgagaatttttgaaggtggccgctttggtggcgctgcacgggctcagaatcaggcacaaattggaaggcgattgggaagagtaatccattttcttggtgacaattcgagaccggcggatggactgggatttatttcattggcattttggatttttctaggacccggaagccgttttttcaaaaagaaatgccttgaaatagacactgaaaccgagattttgtccaatttccattgttactacggaataatccaaggtctaaaagtcatccaaaaagcgaatttaatttttcatcaagtcccggttcatatcgctttttattattgttctcctgtttttgttttattattattgtttgttattacaaggtattgttttgccactctttaattagtttattaattaaa

SEQ ID NO: 58756 - DNA, 549 bp, Heterodera glycines
  Genomic contig location: Contig_ID=SeqID_28105; Location=234..782; Strand=+
  SCN-specific regions: Sequence locations=1-199,221-461,486-549
atgatcatttttcataattttgagaaacggaatcaaaaaatcagagtccgatcttcactttctttggccattttagggcgtttgtttgatgcaaagaatgttggcattgaccaagtaagaaaaaagtacaaagttatggccaagaaactgaagattgtaattataaaagtcggttggacttataaaaagcaatagaaccaaattatctttcatacattcaatatcgaaatttatagagttcattttaaaattcaaatcttccaaccaattcctcatcaaaatgctttctcgcttctcctacgatccgttctatcgccgttcgttgttgcctatgaccactgttggcaacggacgacaccagggatgttgatcgtttcgtgtttttagggtgtttcgtgttcgtatttcgtattttggcacgaaacatgaaatttttaagcactggtaaggatgggtgaggggtgagagaaaatattttttgaaaattggagaaggaaaatttatttgaaaaaaaataatttgttcagttcttttacaccataaaaagaa

SEQ ID NO: 58757 - DNA, 59 bp, Heterodera glycines; identical to SEQ ID NO: 52421
  Genomic contig location: Contig_ID=SeqID_28106; Location=1651..1709; Strand=-
  SCN-specific regions: Sequence locations=1-59

SEQ ID NO: 58758 - DNA, 59 bp, Heterodera glycines; identical to SEQ ID NO: 52422
  Genomic contig location: Contig_ID=SeqID_28106; Location=1781..1839; Strand=-
  SCN-specific regions: Sequence locations=1-59

SEQ ID NO: 58759 - DNA, 59 bp, Heterodera glycines; identical to SEQ ID NO: 52422
  Genomic contig location: Contig_ID=SeqID_28106; Location=1911..1969; Strand=-
  SCN-specific regions: Sequence locations=1-59

SEQ ID NO: 58760 - DNA, 59 bp, Heterodera glycines; identical to SEQ ID NO: 52421
  Genomic contig location: Contig_ID=SeqID_28106; Location=2041..2099; Strand=-
  SCN-specific regions: Sequence locations=1-59

SEQ ID NO: 58761 - DNA, 469 bp, Heterodera glycines
  misc_feature (380)..(380): n is a, c, g, or t
  Genomic contig location: Contig_ID=SeqID_28111; Location=88..556; Strand=+
  SCN-specific regions: Sequence locations=1-469
atgcagtacaatgcttttaagccccgccgtgaggcgggacagttacaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaataattttttttggctttttgaaataaattgtgaaaaatatacgaaaattattttagcttttaattatgcagtacaatgcttttaagccccgccgtgaggcgggacagttccaaaattttgtaccacattttactgtgnaaagtccaagtaccctaattggacaactacgtgtcaatgagcacagtcgcctttggccagttgtggaaacgaaaaaatgggaatattaa

SEQ ID NO: 58762 - DNA, 392 bp, Heterodera glycines
  misc_feature (367)..(367): n is a, c, g, or t
  Genomic contig location: Contig_ID=SeqID_28111; Location=25..416; Strand=-
  SCN-specific regions: Sequence locations=1-392
gcttaaaagcattgtactgcataattaaaagctaaaataattttcgtatatttttcacaatttatttcaaaaagccaaaaaaaattattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttgtaactgtcccgcctcacggcggggcttaaaagcattgtactgcataattaaaagctaaaataattttcgtatatttttcacanatttatttcaaaaagccaaaaaaaa

SEQ ID NO: 58763 - DNA, 2864 bp, Heterodera glycines
  Genomic contig location: Contig_ID=SeqID_5647; Location=615..3478; Strand=+
  SCN-specific regions: Sequence locations=1-265,294-435,460-567,595 -853,875-1090,1128-1167,1189-1205,1227-1300,1329-1948,1976-2125,2147 -2178,2200-2220,2242-2269,2291-2555,2577-2713,2735-2864
atgagttcctcttccgctaaattggacgagttccaaaatgctcttccgttcggtgtttttttgaatgatttcgacggcgcagcgcttggaattgtcgcatttgaaattcattgtgccattggaacaaatgacgtgaacacttgcaaaacgatggtaaagtgaaacttaaaaaaataaatttgaatattttgaatgaaaaaaatggttggctacggggggaatagaacccatggctacaaaacaactgagatttgaatgtattaagaattttttttaataaaaattataattttgtaggctaccgaagaaaaaagtagaaaattgaccactcggggaattcgaacttccacaaccactcgggcaactccgccaaaaacaaagctgaaaattgtaactccattcaaaactgaaacaccacgcgttgtaatcgttttcattttttaaaaatttaaaaataatgcctttttctagtctgaaattgaaaaatcaccgaaactgaccaccctggaaacccatacaaaaacaaacccaaatgtcggaacttcatctgccgtaatcatttccctcaaattaaattaaattaaaaattttttagccgaatctgttcactccacgtgattctactgtgaagcatttcggcacaaattgcgtccaaattgattttccagcagaaattgcccagttttcgctgaacatttccgcctcattattcggcattgcctgtaaacaatacctaagaaagtacaaaattggacaattgccaaaaaattacgacgaaaaaatggaaatgaaagacaaaatggaagcgtgtggaaaagtgccgacagagacaaattgcaaaaagttaaaaaaatggaaattaaaattaaattaacacctaattaaggtcatatgagctaattggatgttctgaaagcaaaagtcagcagaaaattgccaacgaggaaattgccgaagtttgccgaaaacacctcgcaaatgccaagttttcggatgggtttcgaattcggaactgtgccagtcgtaaaccagggacgaaagtgatcgttgtcgaatcaactttggaattttcattcaccgagaaaaagtgaattaaataagaattgaaaattttttaatttttttatcaaagttataccatcacccgaaatgcttcaattgatgatgtgaaggaatttgaagctgcaacaaaatcaactcaattatttttcatcgaatttggccaccaaattgggcaaagtgcgctccgtgggaaaagcggcggcacggatttgtcattggacgatttggtcaaaaaggcaaaaattatataaaaataatttaatattgttgtttctttaaatttagaatgaaacaattggccactttttgggctcaatcgctgagcagtcaattgatgagggttgggcgaaatcaattcattttattccgccgtctgacagatttctggatgtttttttccaaatttcgaacccgccattttcaagactgatcagtaacgagacaaatttgatgccatatgaaaatgacccgaacaaagtaagagttgggaaagaaaatagaaaaaggttaaatattactagacgattccgacgagatgcgatttgctgggaaatgattgtgaggcgacacgcgaaattctgcggaaaactcggaaagttttggagtgctgctccccctctaatgctgctggtccatgtatttgtaaacttccgaagcccgacctggtaaattaataatttaagctaattgtactgtcattttctgttagagtgaatttgcggtgcctaagggtacaaatccgtctcagccacaaaagtcacgcttcagcagtaacagccaatcggacgacccattggattggtgggacgatattttatatacgaaagagcaggcgcaacaaagatacgactatttggttctaatttaagtgtgcgcaccgtgtttcccaccaaaaaagaaggggaaacggagaaggaaaagacaggcagagccaaaattaaaaaaatggaccaaatttccaattgcgatccatttcagtgacgaatgtatgcattaagttttataactatttcttaatggtattcagtgggcgacccgactccgcaacaatatgttgaagctgttgaacaagggataaaattaatcatgtgggatcattttatcaatcattaaaccgataaatagtgagataaatagatactttagataaacttttgtccaatattccttgctttctgttaaaaagccgaaaaataaaacacttctcaaaattaatattgtttaaaaattgtggattgataggattatttagtgaccattttcctcgggtcttcccgcattttatagttttgatcatttaaacaaaaatatactagggacaaaacttgcgtaacattcaccacggatctgagccatgggccggacgaaggcattgaaatttacgataagaaggacggatactgcggtctatcttgggttggacatattaaggaatggcaacgtgtttcaattaactgtaccaatgtttgtttttattatcgttatcaatttaattaagttcatttctaaattatcagtccgacactgttgcccacgagtttttacatgcgcttgccctcaagcatgagcaagaccgggacgatgccaacaaatacatcaaatggaatccaacgccacgaaatgttagccaggattacaagaatttttttttgcaattttacattaaaaaacactggcataatttaatattttagcaaaaagaaccgtcgaaaacagaaaattacggctttccctatgattttcattcaattttgcattatgctgctgtgaaaacaagcgggtcagttattttaaaggtataa

SEQ ID NO: 58764 - DNA, 496 bp, Heterodera glycines
  Genomic contig location: Contig_ID=SeqID_5647; Location=4790..5285; Strand=+
  SCN-specific regions: Sequence locations=1-84,161-184,206-355,377 -407,451-456,486-496
atgattaagctaaacggccaataccgcgagatcagaggcgtaaacgaaagcaaagtcttcttttttgagtgttttgtaagtgacattaaataatttaattaattaattgtaattaaaatacattgtcaattaattaaaaattaattgattaattggttaaatttatttttaaagaggcgagaaggagagacgaaaagcttttggggttattggaaggacaaaagcaaagacccaattcgcattgacgaaatgcaatgcttgagctacgaacaagccggcattgtaaaaccgccaaacaaaacggtgattgattacccattgcgcttcaaaagtgccaacacaaacgaataatgatgccaaaaagatgaaccaactgcggagaatggatgtgatgcatagggcgggtgtttttatttaaaagtttttctttttataatattttattttttagtgtatttaactttggttttgtattttaaatttatttgtattgtaa

SEQ ID NO: 58765 - DNA, 553 bp, Heterodera glycines
  Genomic contig location: Contig_ID=SeqID_5647; Location=7400..7952; Strand=+
  SCN-specific regions: Sequence locations=1-553
atggaaatttcgaaaagcgtgaacaatactaatcagacatttgccaatgcttcttcatctcctgcccaattcatcattgtcctttactttcggatttcacattttgacctttttgtccctcctttgccctttaatttgatcaataatttgacccgggaacggctgacattggcactcattgaccaaggcacttttttactcgtccgatgtccgctggtgcgtgacgagcccaaatgggccaattgggagagggaggcgaaagagtggccaattgatggacaaatgaacagaattgtcattggtgaacatgaacaggaacaggaggaagaaagcgaagatgatggtctctatttggtcaatttgttgaacaccggctgaacaaaagggtccgactgaaatggcatttttgaaagtgccaatgccaatgccgcccatctcattaaggggtggggaaaatggtttttttcgagaaattggtaacaatttaaaaaggtcaaaactttaagctcagcaacaccaatatgatttgtctttgattctttcaatgtttgaa

SEQ ID NO: 58766 - DNA, 497 bp, Heterodera glycines
  Genomic contig location: Contig_ID=SeqID_28112; Location=108..604; Strand=+
  SCN-specific regions: Sequence locations=1-497
  Gene Ontology: Mol. function=plus-end-directed kinesin ATPase activity; Cellular component=microtubule associated complex; Biological process=anterograde axon cargo transport
aggatcagaccgcaaagtggcaaagaaaaagaagagcccatttgcctgagcgtaattcctggcgaaccacaacttactattgggcgcgataaatcttttacatacggttctaagcttaaaagttttatttgtaaaagttggctgattttttagatttcgtcttcgaccaactgactccgcaaaagaccgtttacgacaaatgtgtgagggaactcgttgatggtgccttcgaaggatacaatgccacagtttttgcatatggacaggtttttgtttaatttgaacaaagttcaaaaaagtttgtcggccgttcacagactggcagcggtaaaacatttacatgggcactagcttggagggcgacccggctaaaagaggcatcataccaaatgcggcacaacaaatctacgatgaaattgaggaaaggcgtgaacaggcccgcagatctggcaaagtgatcccctcttttgaggtttccgctcagtttattgaggttc

SEQ ID NO: 58767 - DNA, 112 bp, Heterodera glycines
  Genomic contig location: Contig_ID=SeqID_28115; Location=745..856; Strand=+
  SCN-specific regions: Sequence locations=1-112
atgcactccgccgccgccttcaaccagctgatgtgttgcccggccgctgcggcgatgagttttttgcccgcggcgctccaatcgtcggccaccattgcctcgggcaatgcct

SEQ ID NO: 58768 - DNA, 319 bp, Heterodera glycines
  Genomic contig location: Contig_ID=SeqID_28117; Location=115..433; Strand=-
  SCN-specific regions: Sequence locations=1-319
atggtctgtgacaatgtgttcaacgagcggcaacggctcaagaatcgggtgaccgcccacgccaaaatgctcgccactcttttgagtccgttagactgcaacgatgtaagcggtggatgagaaagctccgagtttttgtaacaccgagacaaaaatttcgatgaaaatgggtatttttggattctttgggatttgaaaacttggaaaaactacaatttttcgttaatccattatgagatttcagctggaattggttgcgttggccgaccgattcaccgcctgccggtacatccctcgcgaggagtacggaaaagtgtga

SEQ ID NO: 58769 - DNA, 609 bp, Heterodera glycines
  misc_feature (145)..(145): n is a, c, g, or t
  Genomic contig location: Contig_ID=SeqID_28118; Location=59..667; Strand=-
  SCN-specific regions: Sequence locations=1-496,518-575
atgcaattttctgtcgtaataatcattctttttacattggcaatgtttttccattcgtttccgttatctgaagctgatggaatacgttagtccctataaaaaaatctttataaaaacaataaaaatgactacctattattataanggatgcctccccgaaccccgagcccccgaccctcgacattttttggcctattctccgacccgaccctgacatttagccccccccccccactaggggtcgggtagcaaccctatttattattaaagaataaaatttgagcaattcatttaaattttctccataatttacaaaaaaaaaaagttttttcaatcagtgtttttgttgcatcaaaagagaaaaaaaataaggaaaattcatttcctatgaaaccactgaaaagctaacaaaaaggaaatttatttaagagaatgccattgatgtatatggtagtgccaattctttcgctgactccgatggcccacaaattttggctattccaaggaaaataaaatcggcatttcacgaaatggtaatctaattggcacaggaaaaacttaactcagtaatttgctttaaaaattttttataaaagtaaatataataaa

SEQ ID NO: 58770 - DNA, 743 bp, Heterodera glycines
  Genomic contig location: Contig_ID=SeqID_28121; Location=375..1117; Strand=-
  SCN-specific regions: Sequence locations=1-7,40-401,424-743
atgagttcaacaacaacagcagcagcagcggcgacagcaaaccaaaatgtgttggaattgcgtcgattggtgagtttgaattgagcggaattatactcacaatcattcggcaacaacggctcatttcagctccaaaattgttttacatatccatccaatttgtggacatcgttctgagagcgcttaagttcctctgttgtcatgcaaaattacaaaacagggacctgaatttcctaaaaaaaaaatttttgactgaaaatttgacagaatttttcaaatttgtactggctaataaagaactcaaggcaatcgaatgatacacaaattggtgtccattagtacaactgtgaaaatggggtatttcccgaaaaaaccgagctggcgcccagttgttcctctcttttcaaactgtgcaaaccgttcatcaccatcattatttgttctttcagatcaagaaatttttcgctgcccgttccctttatttgagtgagcaggcgctcacttatctcgtggatcagttgaacagttttggtcgggcacaatgccaaacagtgatggcacgcgttgtgcagctggttgagcggaaaggaggtcggagcccttttttgttgcttaattaatttattgcaaaaaatttagttgtgtccgatttgttggatttggattgtctgaagacgattctgcatgaagtcaatcggcaaaaacgaaatgagaggtgagtgggttgggtgggtataaataaa

SEQ ID NO: 58771 - DNA, 2420 bp, Heterodera glycines
  Genomic contig location: Contig_ID=SeqID_675; Location=840..3259; Strand=+
  SCN-specific regions: Sequence locations=166-215,237-261,283-467,589 -703,727-1081,1103-1480,1502-2095,2117-2250,2291-2308,2332-2420
  Gene Ontology: Cellular component=mitochondrion
atggccgacgcgggccaactcgtggcactgacgggcgacggcggagtggacaaaacagcgcttttgaacacgttgctggaccacaacctgaagactttgagcgtggagggtcaagtgctgatcaacgcgcactccttgggccggttcatcacttacgtcatcggggtgagtcggaaaactgctaatcttctgttaaatgtcaaattttgaattctaaaacaaataaatggtaaacagaattacaataatgtacaatttttcctttgaaaacttgggttttcaagcgtactttaccaattaagtttttcaattcttcgcgccgttagttttaaattcaaaacttgaccgcataatataaagtgccggaatggcaaatccaaacatcgacgatatgtcggttgagaccgttaattgaaacgggattagtggttattaaactatagtgtgttttcccgttctcaatttcagtacgtgcaacaggacgacttgttcatgggcacgccaacggtgaaggagcatctgatggcgccggcacagctttggatggtcggacacacccaacggacgatgcgtagacgcgtcaatgaggtgggattttggatcagtacaaaatggaaatcactaatttgctaatggattagtttggttgctaaagtttcgtcgtgcggctattggaattggcgaacgagttttttaagaatgaatttctcattttcagttggaagaagccatttcggatggtgaggcgcgtcgtttgccgttcgccttcgaaccgcggcacaacccgcaaatcatttttgccctccaaccgactaaggttccaatttttttttgaattttccaaaattcctgattaggacctcgcctcgtcagtggtggacagcgtggtctcgcacattctgcgtaccctgaatttgttcggccggcgaatcgtcgtcacaattcaccgtccgtcagaaggaatgtgccagaaatttgagcgggtaaaatttgaccgattttccataaattgagttgggatgagtgccacccccaccctaaatcgccaaaatttacgcatttgtttttatttgtctgttgataaattatatttactattaaacgttactttttgaagttgccatctgaatgtacctttataataaaattgaacatgtcaaaatttatgccttttctcatcccattggcagccacaaagcacaaaatggaggtagggaaaagaatttttttttttgaaaacattctgttagcaatttttgtaatactaccgaggtatcacaaaaaatggtgtgataccatcggtagtattgccgaagttttttaaaatttctcatgggggaaacaagcttctcccagtgctgacttcttacaaagaagcagcaattgtttttagatttagcgcaaaaaataaattctctttggcgttttgaccaatttgtctaacactgaaaggaattcaaaaattttcttaggcatagtttttccaatcattttattttttgaatattatttagaaaaagtaatcctttataaaaaatgcacattccaaaaatagaattccccaaagaaattgttccaagtttggccaatttgtcgctaaatcgtcaaccaattgatgtggttttttcttcttttgactttctttttaatatattttttgagtcctcggaaagggtaaaatgatttgattttattgttagtctgattttgtgcccttagccctgggttcaaattaagtaatactttgaaataaaaaagaatttgattttaggaccgtcttttgaagttactcgaacggacgcaaaaggatgtccagcgcctgacgaccgccaaccaacagctcaccaccgccaaccaacagctcaccaccgccaaccaacagctcaccaccgccaaccaacaacttactacaacaaaccaacaacagcagaacacaatcaaccaccagcagcaaaacatccaacaactccaaaacttattgggtttgtgcaaaatttattggagatttaaatttcttttctcgagcaattgattgtaatgcctaatttttcaagccggtcagcaaccgcttgttccagcgtttgcccccggggtttttggtgaacaacagcagcatcatcatgcgccagcggactttctcggcgaccagcatgcgctcggcggccagaatccacacgcggcaccttttggccccgactttttcggtggtcagcccgaaaattttggtcagtgccttggttaagtcaggcactttctccattttctttcgtttaggtgttcagcagcagcacatgcaggagcagcagggtccccctcctccgccgccaccgcagtaagacgttgcaagtggaagtcgaatgatgagttgacgtttgaccttttaacctcttatgttttaacgttattttgtctgatgaaga

SEQ ID NO: 58772 - DNA, 1132 bp, Heterodera glycines
  Genomic contig location: Contig_ID=SeqID_675; Location=3560..4691; Strand=-
  SCN-specific regions: Sequence locations=1-497,523-638,661-800,822 -1132
  Gene Ontology: Mol. function=chaperone activity; Cellular component =actin filament; Biological process=protein folding
atggttaccgtaccgcttcagggcgaggacaaatacacttttgtggaggagtgcaaaagtcccaagtcggtcactttgctgctcaaagggcccaacaagcacagcatcacgcagctgaaggacgccatttatgacggacagcgggcggttgccaatgcgttgaaagacggtgggttttgcgacgaggggatgggacaatttggatgaaaatgactaattacctaggcaattaatgccttggcactttgggttatttgattttgcacctcttttcccagttttgggctttacttatgactgtcatttggtcgtcacatatttaattttcatggtttctttaggtgccgttttgcccggcgccggtgcatttgaaattgcgggatattgtgcactgaaaaaggtagcaagtagagtcctcccactagacttcacaaccaatctctgttttagcttgccgacaatgtgaaagggcgtgccaaactcggtgttttggtgccgtaattctttctttctttcttaatccctttcaattattgtcatcattctcattcccaggcttttgctgaggctttgctggttattccgaaaactttggcggtcaatgccggattcgacgcccaggaggtgagggaaaaggcttttaaaaaaattatttatttactcctttcaattgccaggccattgtcaagctggtggagacgttcagtgctgctggtgagctggtcggattggacctggagagcggagagccgtgtgttcctcaggtgtgtcatcagaaatgggcggggacaaatgtgtcgtgccacaaaaaatgaacactttcattcattctcttcccccgtttagagcgtttgggacaatgtgtgcgtgaagcaggcgagtctgaacgcctgtcagaacatcgcctccaatctgctggaggtggacgaggtgatgcgtgccggcatgcgcgacttgaaggggggacagtgaaaatgaacggaacggaaatgaaggagcaacaccaataaatcacaaaatgttaatggctttttctttgttgaactctgcgctttattgtttgaatcagaccactgctgtttttgctttttcaatctcgcttttctgaacgaatgaaaattttgacaataaa

SEQ ID NO: 58773 - DNA, 231 bp, Heterodera glycines
  Genomic contig location: Contig_ID=SeqID_675; Location=6392..6622; Strand=-
  SCN-specific regions: Sequence locations=1-136,165-231
atgaccctcaagtgctcgtcagcagagcatctttcaacaataacaccatgccttgctcagattggccagaagggtgccaacatgtccaaggaagagttcgattttcgcgagttggaaaaattgatcaattgaagggtaaaaaaaaatgaaattaaataaaatttgcaaaatttcagatttaacgataaaatgagtgtcctacggatgtttcggccttgtctaaccgtttga

SEQ ID NO: 58774 - DNA, 1408 bp, Heterodera glycines
  Genomic contig location: Contig_ID=SeqID_676; Location=108..1515; Strand=-
  SCN-specific regions: Sequence locations=1-116,152-349,371-923,956 -1106,1220-1408
cattgacgtgcaaggcgggctatgccaatcatttatcgggtgaaaatgccacaaatgaaatatgcgagagcaaagcccatcactgcttttccgtgatgtgcatggagcgtaagtgcaaaataaaagattaacaaaattaaataattaaaatcactgtaatttatttattgtccccaattttatgacgcgcagaaggcctgcttgagcctcggcttaggcttaagcttcggatcctgtttttctaagagaaaattgaaatttttttaaaaagaaacattttggtctggcgattgctagtcaaatatgatcatgccatttttggcgcctggttaggccccggctgaaatggcaaatttttgtttttcaaaaatttcagaaaactacacctccacagcactgatcacctgggggtgcagcggggacgcggacaaaaaaggctgcgaacaattctttgtgaacgcggccaactccgcgctgcactcgacgaagcagcgctgcgagtgccaatttggtgacgagggcaaagacatggccaatgagcaagcgaaactgcccgaaaaggagaagcccggcccgattccgaccctttcgccagaggcacttgagaaaagtgggggcaaaatgccaaaaaaaaaaaatttgcatgaaaatgacagtgaactgtgtggcacaaataatgagggaaaacaatgccaaagggaaaaatggatggtaatgagtcgagaattgtgccataaaaatgaggaaaatagtgccaaagaattttatgtatgaatggggggataaatcagagaaatagtgccaagattgcataaaatgccacgaatattatgccataattggaaatgcatgaaaattaatttatatacccgattagaccgtaattgctagaaacggagaattgaactttaaatagatcgtcgaaaatttaaaaaaaaaaacatttaaattataaggcatccggtgcagggcgggctattttcgtggaaacggatacggtactacagcggccagagaatgccgaggcggagagtactgttacacggtcagctgcgaaataggtccatttttatgtgtgatttatcaatctccatttcacaaatattttgatcaatcaatcgatcaataatcgatttttatattaaatataaaaaactgattgctcaattgattgattagttgaccgatcgataaatcgatgcggcgatctgattgattggcaatcaccctttttttacagtctctgaaatgttcaccttttggggttgttccttggacaacgattgtgaggaggtcagcaaattcctggcatttggccaaaagtgccaatgccaatttggcgccaagggagaaaatatgggcaatttgaattttgacagcccattttatttgccgatgaagggaaaaa

SEQ ID NO: 58775 - DNA, 503 bp, Heterodera glycines
  Genomic contig location: Contig_ID=SeqID_5648; Location=191..693; Strand=+
  SCN-specific regions: Sequence locations=1-503
atggacacaaaaaggacgacgacggggacggctccaacgccgacgcatttgagggaaatgccaatgccatcgagtgagcaacagatgacaccatcagcatcaggaacaagttcagtcactgacgaaattgttagccaacaagcgcaaatgccatggcatcaccaaatgtcagaggcagaatttggacaaatgccaacggacgattatccattttatcaaaactgggaacaatcatttgtattaccaaatgttgagcaggaatttgagggattagatcacttttatcaaaatgattttcaaatgccagtggaaaatgaatggcatcaatccgagagagaacaaccgattgacaataatgagccatcatgggatgggtggcaaagacaagacagagaagagaacgaagaagtcaaccaaagtgatcagaaagcgcaaccattgcaaatgacaaaaaacgtgggcaaattcgacgccgctaagctggacaaccaactgagtccgac

SEQ ID NO: 58776 - DNA, 3488 bp, Heterodera glycines
  Genomic contig location: Contig_ID=SeqID_5649; Location=2484..5971; Strand=+
  SCN-specific regions: Sequence locations=1-348,370-786,810-939,975 -997,1073-1188,1210-1398,1420-1587,1609-1756,1778-1846,1868-1926,1949- 1976,1998-2522,2544-2615,2639-2684,2707-3116,3142-3488
atggtcataaattgtactgaactgccccaaaatctctcttcccatttcagcgccggaaaagtgttggcgcgcaaaaaggcagcaaaatttgagcccggacaatcctcaacacaatcagccggacaacagcaacaaaaaactgttgttgttggtgttggccacggggaacacatgcaacaaaaaggacaaggacaccaaggaattcaagggcaagaacaccaagtaattcaaagacaaggaatttacaacaagggcgcaattgcaggctttttatgtgagttagggcaaagtttaaaggtaaaaatttagcaaaactcagaaatatgacacaaaatcttccaaaatgacaatttaaaaaaaattaatttacttgcaataattcatagccaaataaaactattggttcttcattacccatttttgagcaaatgcatggttaatacgagagaatcttttttaatgccaaaataagggccagcaggcgatgcgatgccaggaatatgcttaaaattatcatggccaaaacagtcaaagattaaacaaatattcgatcaaaatatttgtcggaaaataaattgaaaaaaatgcaaaacccaaatattggaaaaggtaaaattatcggaaaaatttagtgtattgcgtccgtcatattgttctgatgagtctccgctcgttgcaaattgcttcgcccgactcttttctcgatggcacaattcaacaaattcgaaatggccacccgctggaaatggcattgggtcccccaaaaatggcattggcacaaaaattgagccaaatgaatgccatggaagtggcaaaagggatcaaaatgcatttgttgaacgatggagagatcaaaaactacaaaatattcgccgaaatcatggaccaaaccatggaaaattgtgtcgcggtgctcggccaaacggcgttgacgttggcattattttaaaaacaaatattatataattttaataccactttggttgggacaacttcttataaaaattcagaagaaatatgtatataaaaatattattttataaaatcttttagaaagttaaaaatattttaagtttgacaattttttttggggggggggaaagacgaattcggcattttcagcatttgcttcgtgacttttttttaaccaaaatatatgaataattaaggaatggtgacaatgtaaatgttaatgccaacagcaatgacggtgatgatattagcccttccgttgtgctgtttttcttttctcgtttattccggaaattggccggctttttgaatgcgccatttatggaagaaatggcatttagtgtaagccaaaaaacgaatttagggataattaagcatttaagtgttaaactcaaatataagtttaaaggaagcagaaaaatgtatagatttgggatttaaatatttacctattagcaatttaaagagccatttttaagaattgaaaaatatttaaagaaacagagataacattcgagttttatttacttctttttaaaacaaagtatcaagaaaaatgaatattttttaaaaaatgttagattttttgaaaacttcaagaaatatttttcatagaaaaattttcaataaatttctcaagaccttttaaaattctatttgcaaaattttctcgaattttttaaatgagtttctattgttgactgttgagatttttatgtcatttttctaatttttatatataatcgaattaattagcattattgaatgatgatattaagaattttaattttgtttttgagcatacgattttatagtttcattattactcgtttttcagagctcgtatcatttttccaaaactcattgacccaaaattaagttattattttttaatgtgtaattatgctaaatatatcggaactaatgcgcaaaaaaggcatatgcctcaaaatacattctctattaataaggcaaagtcacttaagggaagggtacggatcgaaaatttttcaaaagcagaacatcgagcccaaaaaccaatggggtcgaaaatcagaacattttgtgaaattgcttcataaattagcaaatcgtaaattttaatgcattcgggaccaaaaaatcagattttatttttgcagtacaaatttttaataattttctcaattttaggccgaactgaaaggaacaagtcgcgttgcgatgttcattttgattagagagattagaacactttttgtatcacaatttgacgcatcgttcaaattcattgttcacaagggacagaaaattgtgagttgattagactttcttagggaaaagcaaagaaaaaaattatgaaatttgaaaaaacttgagaataaacataaaacctccattaaaacatggcgattagggattttttatggcgtttgcaaaattcaattaatgtggtaaaattggcactttgagttttttcgtactcgacaccaaaaaataattttaatagcatatacgaaaaacattgaaaacaagtacttaagtagttgaggacctaaactaagtgatttcatgccaaatgaggattttttagggctctatgagcattttcaaatagctgatctgaaaagaacgatcattttaaattgccctaagttttccgaattcttttttcaatttaaatttaaaaaacaattttgaacactgattaactcaatccaattcagcaacaggcaatggaattgaataaattggacgcttttgaaacggccatagaacacttttcgttggcccatttggccatctgttcgacaatttcggcgttcactgacaaaaaaatttgccaaatggatttaaaaatttttttcattttgttggcaaaatttttgcatagaaattttgcgtgtttattactgagcaaagagaacatatccaatttcgtgcaaatgttcactcattatatgacaattgagtttggcaggtgggcaaaagaatttaatcaaaataatttggtgggatgggcggggggagtgacctctgatgactaattagtaattcgttaattacataattctttacataagtattggcgagcttgaattataaaaatttccccatttgttttgcacagattcggcatatcccaaaatctgcttataattttacaaaattggaaaaatgaaattaaaagcgaaagtaacagtgcgatgccaattaacttaagccgatacgtggccaatttaattgtcaatttatttactattgtaagccaatttctgccaaaaaatgccaaggattcgttggccgacaaccaattcatggcccacggatgggatgagatgggccattttttgagcactgctggaaaacagttgacagagttggtccaacatttagacaattggagagcagcagaaagtgccaaactgggcgaaaatgattacaaaaatgaggctgaacagagtgccaaaaaagatttttggcacaaaaattgtactaattttgcatcgagcagcggaacaaagcaacaaaactga

SEQ ID NO: 58777 - DNA, 548 bp, Heterodera glycines
  Genomic contig location: Contig_ID=SeqID_28122; Location=1223..1770; Strand=+
  SCN-specific regions: Sequence locations=1-288,312-403,426-460,484-548
atgacacaaacagtgcaaaggattctgctcatttctgatagcaacaaaaagaactcgggtgcgaatgtcgcgcagagaattgtgccgttggacccccaggaggacattgcagaaaaagcgttctgtcgccactcacacttcgtgcatgtcctgctgaactttcatccgttcggacaatttggtaattgctggataattaactaatggttgctaattaattgcccatttgtattagcttctgacgggcagcggcgattcaatttgtgcaatggtcggcttttgttgcggtccaaatcaaataaaattatttcggcattcagtaggacgtggagagcggtcaaatgatccaaaatttccatggccatcttggcgacgtttttgccattgacatccccaagttggacaccggcaacattttcatttcaggcgtaagaatgtggcttttgttttttgccagtgccttacaaaactcaaaggatgctgatcggcatgccctcgtctgggacattcgaaccggacagtgcagtgcagaacttcgaggggcatga

SEQ ID NO: 58778 - DNA, 141 bp, Heterodera glycines
  Genomic contig location: Contig_ID=SeqID_28124; Location=511..651; Strand=-
  SCN-specific regions: Sequence locations=118-118
atggccaccaaatgccttccgctcgaacttctgtacgaaattgtgcctctcatccctgccgaaaatgccacaccgaatgcgctctcgtcctgtcggctgctgcacaaacttttgctgtcacgtgtcatcaaatggaaagag

SEQ ID NO: 58779 - DNA, 603 bp, Heterodera glycines
  Genomic contig location: Contig_ID=SeqID_28125; Location=160..762; Strand=+
  SCN-specific regions: Sequence locations=1-281,303-603
atgagcacagtcccttttgtccagttgtggaacggaaaaatggaaatatcagatggggtgcgctcttttctaaaaattcctcttttcgtctaaccatccctcccttttgtgcactatttcgtttcaaaattgaatcattttttttggctttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttggctttttgaa

SEQ ID NO: 58780 - DNA, 386 bp, Heterodera glycines
  Genomic contig location: Contig_ID=SeqID_28125; Location=441..826; Strand=-
  SCN-specific regions: Sequence locations=1-365
cttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaa

SEQ ID NO: 58781 - DNA, 133 bp, Heterodera glycines
  Genomic contig location: Contig_ID=SeqID_28126; Location=228..360; Strand=+
  SCN-specific regions: Sequence locations=1-133
taggctaatagagcctgtgaagagctttcgaatgatatcaagattgtttgattcggtcaataacttcaagagttatattgactcaaagttggctcagacggagttggccagacggaattggcccgttccgtag

SEQ ID NO: 58782 - DNA, 661 bp, Heterodera glycines
  Genomic contig location: Contig_ID=SeqID_28129; Location=667..1327; Strand=+
  SCN-specific regions: Sequence locations=1-100,130-229,251-285,307 -444,501-619,641-661
atgctctattctttttttataatttattttcttctaattattcatcgttttctaatccacatttcaaatgcaattcaatttgtgagttaattaatcagggtaattaatttgtttaataatttttaattagggagacgacaaaatgctaatagcgtttgtgagcaatggtcagaaaacgcaaatcagtgagtattcaaagcaaaaatatgagacacaccttggcattgtgtattatatgagaaagaattggcactgtgacaaaactaggagagatttgatgaatatgaacgaaaagaatgtcaaaaatatcgtaaattgttggactttatttacgaatatttgttcagagaatacgtcggaattccaacagtgaagccaaaatttgtatttaaaaacaaaattgaaattgaaggaccaataatttatgcgataaattgcttggcgaaaattttgaaattttattttaactcttatttgtataattataattataaattaaacaaactttatcattttgaaccaaaaatgttgaacgtggagaaagttaattatgaatcaaaattgtcaattaatgaaatgattttgcaattggcaattgacacagcaaatgaatagcaaacaaatgaaagtttatacgaaattattctacaaaattgtggaa

SEQ ID NO: 58783 - DNA, 382 bp, Heterodera glycines
  Genomic contig location: Contig_ID=SeqID_28130; Location=1219..1600; Strand=+
  SCN-specific regions: Sequence locations=1-45,67-382
atgtctgacaatccgaaggaagcggagagagaaatggaaaaagcgatgtgatattctaaatttgaatgtccatggctaatcattttgcttttccgttttaagtttcatcgctgccgactgttggcttgaggtgttcggtttgcttccacgctcacagcttggccttggcattgcgctgattagtcaccgatttgactattacgtcgacgaacacttcaaaatctgcaaatggacatttgacaaattgaaaattcgaagcaaaatcggagagaatggcgcaaaggaaatggaaattgtcaattccgatggaaaagaattgtcaatcccacaaaattcgttgccgaacaaattcatcagattcggatgcattttgattaagtga

SEQ ID NO: 58784 - DNA, 961 bp, Heterodera glycines
  Genomic contig location: Contig_ID=SeqID_5650; Location=462..1422; Strand=+
  SCN-specific regions: Sequence locations=1-201,244-599,622-743,772-961
ggagaaaacgcgaccctcgaagaaattgacaatttcattgagcaaagaagagatgcagcatccaccggacaacgttctcagcgacgtccttgtgtgctggagacgccggaggcaccaccaaagcctctggtgggtcaacttagttagaaccaacaaattaagggattttggtatcaatagatagcccttttttctaatttcaatatataatttcaaaaatttatttaaaaaaaaattattttagcaaagttatgggtagtttttatcgattaaatgtttgataaaaagttgtcaaaaacaagcacaatcatatttatttccgaactgtaaaagaactgaaattttttggctagaacttttgaaaaacttaataaattttttggctagaacttttgaaaaactcaataaaattttttaaatttggcaggctaatagagaactcttagggctatcgtatgatagcaagattgtacaatttggttgagtctgagaaaagttatgagtggatttagtcaaaaaattagcaaattttgcactttttgtcctttgacctaacaccgacgtcaatccttttgcccattcaaccctaaaaagtccaataatttattttatttggttttccgcggttgtattaatatgagatatagtacttttaaaaaatagatacagtataacaatgaattctgatatttttttactgtattactgacaactttagatggtcgtaggtatttttttactccacttaaaaaatgttcaaagaaatactgagctgtagacctgaaaatataaatttacacaattttacaatttttagaactttccttgcacgaacacgaactgtgatcgatctttcccctcaaaaaaagcactttcaaatcataagagggcgtgcagtgcccctgctcgtgtgacgcctccccctgctgctcagatgacgccccgtcgacgcgtgctcaat

SEQ ID NO: 58785 - DNA, 2082 bp, Heterodera glycines
  Genomic contig location: Contig_ID=SeqID_5651; Location=102..2183; Strand=+
  SCN-specific regions: Sequence locations=1-150,174-361,383-441,463 -471,493-564,588-611,754-937,959-996,1018-1079,1103-1436,1473 -1514,1544-1555,1595-1622,1644-1795,1817-2082
tttgacgaatcggatgccgaggatccagctgaagaggtgccgccatgcactgttgaaattggccttcgctcacttggtaaaaaatgtttcatattgtacggtaaatgcctaagaatagtgattggaaatactttcctcatcagatcattgtttttaattatttttgcacattttcaaggattttctaattcgtgggaaaccatccggaagcactaaaataattttttaccgttaaaattaggaattcacaattcaaagctgaattttgttttgactcacagcttggaatgtaattttgtcggatttttttgactgaaaaagattgaaaactcgaaaaaatgcggaaaagtgttttaaatgcttttttaactaattaaaatatatgatcaaaaatgtttttttcaatttaattctatgaaagaaatttaattgattttgtaaatgagcagtttaagagcttttccactgaaacttttggttttcaatcaatttagtgtctaacaaagaagccccggacaatcagtccatcactggtcaatcaatcagtggagaaaatccattagcaaaattaaaatttaaaaaaaattgcaaggcttttacaatatttccacatattaaattttaaaatcttttatttaatttttttaaaataataaattcttcactaaacaacataaattattattttaagttttatcaaatttattatattttcataaaattttaaataaaaaaattgtttgtttattttttggatgatttcagacacgccaaaggcgcaacggacgcgcagcgccactgtccaacggaagtctcgtcggctcgcggctgtcaacaatgccgcttccgctggtcaaagtgccgacaaagcgcacgctcaaagtagggatgggattttccgaggcaatattataggggaagtgtggacgaaaatggcaattattaaatatttttttatccaacagaaacgaccaattttgtttatttttgtgtccttattaaaaacaataaaaattttgagcagtgtgccgatagtcacatcagcaggagggaaattttggcaaatttaacgaaatttgtttaaaaaaattttaaattatttctctaatcgtgcattccaaattttacaataatttcgtctgactcatttgatttatatttttacaatattaaactctcaaaaaaatgtatttatttgattgttgtcccaaactaaaaagagcttttgctttaattaggctcaattactcgccgtgtgtcaaatgggacaacattggccgatgtgatcccacccgatcacttgcaaacattgacggacaatggcactgatgcattgctgccttcaacatcggatgcgccaaggaggtctcgtcggatcgcggcaaatgtaagttttgggcgggttgtaaaaaatgaaatttgattttcaaaaactgatttattttttaattaattttatattttttaatttaccgattgctttttgattagtttaaaaaaattaaaaaacgcccattaaaaattttaaatttattaattaattgcatccaaaggcattttttttatttcaaaatttattaaataacatttaattcatacataaaaaaggtgtggggggggtgtcaaaattttttggaaagggaggtcggccgtcgacgatccttttttttgcttttcaaaaacagttttttcggcgcggtttttcctaaaaattttcttttttatttttgggctttatttttttattacaaaaaacccataaattgaaatttttgctctttgttgaaataatgagttaattattttccaattttttaggtgcgctgcgcggacgaaccgctgctggccaaggcgccattcaatgtgccagggcggccctacccaccggagccactgtacaccaccgacaaatcaatcatgctcaaatgggaacgaccgtcgctggacagaggcacgccgatcactgactacgagctggaaatacgcgagcgtggcaccaagctctgggagaaggctaccaccaccaacgcttcgctatgggagaaggaagcatttggcaatgtgccggacacacgaatcaag

SEQ ID NO: 58786 - DNA, 4658 bp, Heterodera glycines
  Genomic contig location: Contig_ID=SeqID_5652; Location=817..5474; Strand=+
  SCN-specific regions: Sequence locations=1-521,543-556,597-898,949 -1237,1261-1664,1700-1718,1740-1791,1814-1840,1922-2066,2103 -2162,2184-2291,2316-2392,2414-2661,2684-2721,2765-2953,2976 -3103,3125-3153,3181-3210,...
  SCN-specific regions: Sequence locations=...3299-3730,3777-4201,4225 -4590,4622-4658
atgggaccgttggcatgcgacatgactgtgctggtgggtgaacaggccaagctgctggtgccctacgcagcgaattcttcacggccgaaattcgtttggagcaagaatggcaaaccgatggatccgcgtgacgacccacgcgttaaggaggaaaaaagcggtaagtgagcgcgcaatcctggcacttaacagggtggaggcgcagagccatacaataaaaaaagggaggggggttaaccaaattttttgctaaaatggtctggaaagagggggtcgacagggggggggggtcagcggccaattttgcgaaatggtccagccttgaatttgacgacctttcaaacagatttttttgcagtggcttttttaaaaaaaaatagttaacatattttcactaaaaactgccaaattgcgattctttagcaaggcgatggctttttttgtttttaaaaaacgtttttttcgctgtacacttttttaaacaacttttttttgcaatttgttagaagattttgtctaaaaaatgggcaaattttaaaattttggctaaatgctcttttaaaatttttttaaattaaattttatttttttatattcacgttttttttctcccatttttagacattctcatccagctgtgctatccgaaatgcgaacaatcggacaccggcacctattccattcgcattgtgaacgacttgggctcggattcggtggacttgcgcctgaaggtggtcgatcgccctgcaccgcccgaggggtcattgaaggtgcaaaacattgggaatatttttgtaaacagaaaatgatgagaggggcatatttgtaaaacaattaggaatggatttttgaatttttttagaaattaattttaacggagtatttttcgtttttactgtattttttttttacaaaatattcttttaaatatttaatgtataaaaatatgaacaggagcggaccgcgtccagtagcggaaggcgacgcgttggcagcacagcggcggatcggtcggcacaggcggcagcagcggcttgcgctgcggacgaagaggcaaaggacgaggtgtacaacaacgaggaggagcgacaggacatggcggtggtgacaaaaaggatggcaattttggtaaaaaaaaaatttcaaaattattgtgtatgcttttcgggatttttgtgcttaatacctaggcgccttttttgtgcctatttcgccatttttggcgcctattttttggattttttatttattaatatttttccttgagaaaagcagcacaaaaacaaaaatctttcactttttaattgtttttttcaatttttgggcaccccttttttatttctattttttaaaggacctggaaacatccggcacaccggcacggattgtcgaaatcccagaaaatgtgacggtggttgagggcgaattggccatcatcaaatgcgtcgtggagggcaacccggcaccgacaattgtgtggaaaaagggcggccgaaaaatgccattgaccgacgaccgagtgcggtgccaaacggacggtgacacgggacatgtaagtggcaacttttaaatgaaatttttaaacacagaaattaaaaaaaattgctgttttttggaaaaaactttttttgtgaaaaagtcatttatcataaaactgagaaatcataaaaaattttttgttttaatttcaataaaattacatttttcataccgtagccctcaaatggaggacaagaaaactttttactgtagttctaatcttggaagggatttttacggcactcaattaattaattaatgtagctcatttatttctaaactaaattcaaaacttagcagcaaatttaataaaaaaaaatttatcaaatcctaaaataatgttaaaaatattttatcaaattaaaataatgttaaaaatattgtcaggtttctctgatcatttccaaatgtcggccacaagatgggggcgagtacacattggtggtgaagaacgcgcatggcaagcacaaagttggcgccaagctgcttgtcacgccagcggccgaagtgaaaaaaaattgccagccaaatttaaataataatatttacaaaaaataaatttacagtcaaatttggacttccgggccaagcagaaaaaacgtggcacgggcattagcaattcggaacaggaaaaacagcgccaacggagtgatgccgagcccaaaagcaaggctgaacgacggtgagccaaaaacagctaccaccaaaaaattttgcaccgaattttggaatggtgccaaaaaatcgatgccaaattctgcacttcgcttattttctttttaatttgactgaaatttcaaaaaaaaaatttcagtgcctcttcttttttttttgatggtgacaaaaatttaaagacatggcaaaagaaattattgaaattcaatttttcgattaaataaaaatctcgaacggaaaatgggtcagtggaaaatgcgtcagtgaatcaggatttctttaaattgagatacagtagtaatattaccgaaatcacaacttgttttttagggatttgggaaagtttcaattattttgacttttaaaaacttaattgataaaattcagaacaaaattattagacaattttgtccttttgtaataatacaatacttaatgctacagtaactttattttaaaaatacagtattattgacaccttttccactgacgcatttgccaggagccaaaattattattatttttaaaaattaattttcatttaaattatggcacaaaaatttccagcaaacgccaagtgtatgtggtggaggagccccgtgacacatttgttgtgccgttgaactcgcagcatgccaacgaaaaggaaaatgccacttttgaatgcgaagtgaacgacaaggagatcgatgtgaaatggttccatgacggtgccgagatcgggatggacgggcggcactttaaggtgggaaggagggggcaaatctcttgctaatcaaagaatacattcatattttgtgttatgaaagatcaatttaaaaaattgagtaggagtttaaattacctattttgggattcctttaatcccaaaaatccctaagtatggatatttccaaaattcaaaccaaaactagctcaaattcttcaattcaaatgcctatcagaaatttaaaaaatatattagaaaagtcagaaacaaaaccatttttttaacaatattttttttaattttatatttttttacattatctaaaatttgtttttatgccaaatttcattttgttttcctattgtgtattttattgatgcttcttgttttacaggaacgggctggatgccgtcgtcgcctgctgatcatcaatgtactcattgaagaccacggggagtacaaatgcacagccaaagacgacgaaacaatggcccaactcattgtgcaccccaaattcgtcaaaaaaagcggagcgcaagccggtgaccttctggttggacgatgagttgtattaaatttttttgtttttcactgttcctgttttatttgtgcccatctcttttttaaactctgtgaattgaagataaaattttattttcctttaattgtcctattttatggtatatcccaaccagggctggccgtgattgaatttccaatcacggaaatccgtgagccgtgatcacggggctttaaaaaaaatccgagatcacggcaccccaaaaactccgtgagccgtgatccttgattaaaaaaattttttctaatgatttttttaatttaaatttatttagaaaaacggaatttaatcgctggaaaaatgggaagtggcggaacatttttgaggagagatttggtgaaaaatgaaaaagaactgtcaaggcaaagagactgtggaaatgccaatgtgaaaatgccaatgatttaatttaaaaaatgatggcaccacattcccaacgaacgaaggacagacaaaactcttacaaaattaggcaccaaaaataagaaagtctttgtgaaagggaagtgatcagacgggcggaacataaggcaatgtaaaaaacggcacggaatttagtcaccgacggaagacacataaaacgccaaaaacgcccgccacaacactcatttgtcaatttgctcgcggtcaaccgcccttcgtcgcctgttgaaattaaaaaagattaataatttatgtaaaattgtgagaatttgaaggccaattaaatgctatacaaattattaaaattctgcctcaccttcaaaatctcaacatttaacaatgcgaggaccgcaaaaagttgtatcttgacctcttcgtccgaaaaatgtgcaggaaaaaataagcgcattctgtcttcgggctaatttaatgaatttaaatgagtgtcaatgcacaaatcaattataatttggcgttctttatccataccaggcccgtgtcgagaaaaaattttgggatgagaacccgaagagccattttaattggatgccgtggaaaaactatgaaattttttaaccattttagccaaatttggccattggggtaaattttgcaaaaaacatggaatgccggggatacggctgtgcccttacgcgccaccgggaaaatttaaagaaaattttatttaaaaaatagtaagatttaaaaggattgcccatttttcctgtaaaa

SEQ ID NO: 58787 - DNA, 667 bp, Heterodera glycines
  Genomic contig location: Contig_ID=SeqID_28132; Location=93..759; Strand=+
  SCN-specific regions: Sequence locations=1-76,122-179,201-217,239 -273,316-530,553-667
atgtgcccattatgtcgtgcagaaataacagacgatttcaagaatttattaagcggaaaagatcaggcaaaagttgaaaaaataaatttttaatatttttattattattatttattttaaaggcaggcccatcaaattcaaaaagagaacagacggacatgggtatatttagggttctattttttaagcacaatattaattaatttatctaattactaataaacttttgaacaaaaaagtcagaataatcaaaaaaaaaatcgaaaaattgccataaatagtaaaataaacattaaaaattaatttaaaaaataactactcacaaataaaagttgaatttttttgaccaaatttaagattgtaaaaacggaatttcttgctatttactaatcatttgatttttaatttacaattaagatgaacaatttgcacgagctctaatgtatgttgattatgatgatgatgatgatacaattacacatggtaataatccaacggcaaatgacgcagcaatggcacaacggatgcaaaaacagctgcaggagcaacaggaagaagcggatgccgaattagctaggcgtttggctgatcaactttagggtaataatttgggctggcaatttttaattactaacaataacaagttattcaaattaataattaatta

SEQ ID NO: 58788 - DNA, 788 bp, Heterodera glycines
  Genomic contig location: Contig_ID=SeqID_28134; Location=6..793; Strand=+
  SCN-specific regions: Sequence locations=1-123,145-416,451-788
atggccttaaataacctgtttgcttttgcgtcgacacatggcgaaaaggcacccgcggaccaaatgggcggccgattggacacgtgcaaatacaacggttatgaatgaatacattatctaaaaaattttatatttttaggacagttttcatttctgttcagcgatttaattgcgccgggggtccgtcgtccgtcttttgctcaggtgtataccctggcacccgaagacgcattgaatgtccgcgaagaggcgcttgacaccgccgtttcaccacacgtcagacgcacaatcctcgaaagacttgaggcactgatgcgacaaaacccatttgggcagaccttccagactgtgggtacgaagattgccgctgctcgtgcagcaactggcgaaatgccgcatttccgagtatatcatactaataatcatatttaaatttaaaaaaatttaaaagattgccctgttaacggatcgcgagttgaggagcgttccgcttcaaggccgcactgatgtcactgttattgagcgggcggatgcaccgactgccaagcaagttgcagtgatttgggtccaagaggatggacttcctcctcaaatcagcggtagaaattgcacagttaaaagacctttactatacgattcagctttctgggtgtccgacaaggccgggaagatgcgcgagctcaagagtggaatgccgcaaattgatccgtgctgcttcccactgctccatccccgcggtacgcttggatggcgatggtatatgaagaagcgtgggtccgaggtatata

SEQ ID NO: 58789 - DNA, 1116 bp, Heterodera glycines
  Genomic contig location: Contig_ID=SeqID_28137; Location=551..1666; Strand=+
  SCN-specific regions: Sequence locations=1-922,947-1116
atgattggaaaagcagagcgtgcatttgacgccgcgatgaaacatcggccgaaaaatttcaacaaaatttgccgcggaatggaaggaattttgagcgagtgggactgcaccgaaatgcgagctttcaatgaattgtgggaaggagtgaagcgaagaccggaagaaacgttggacgaattcgcggaacgaatttacggcattgttgaccgcgctcacccaggtttgccgccaaactttgtcagcgattttgcgataaagcacttaattcgtgctttggaaaacccggaaatttcgatcggtttggaattagctcgccgcccaggcatgagcttcgacagctttgtcgctcttgctgtgcgagcagaggcagtgcaaaaacccaccaaatcggccgaatctggaaaagagcaccgtctgaaatttcaacctaaaacgactgttgcgccacaaaaaattttcgcgccaaggacaacccgaatcgtctgctataactgcaacaaaatcggacacatttccagcaactgtaggctaattgaacggaagcatttcaactgtgtaccaaaagcgccgcagcatgaaaattttgcgacgaaaagtgccgattttcgaaaaaattaagaagctgagaagaaattgaatgatttgcggttgtcgaaccaaccaccggcacaacaaacaaacgtggaagctggaccaaaacggaaagcgtccaaccgacagcgcaattcgtcgtcttcaagttgcagcgtaaaagcagcaaaaattaaggaaaattcgccggaaattccaaaatggtttttgaatgctatgattgctgccttggctttgctcgccagcacattctcgaatgaaaagtcaaagattggacgaatttggaaaggcaaaagcccaacgaatggcagcgacgacgagaaacgacggaaagcagatggaaaattgaggacaattttttcgccgaaggccggggaggaaatggccaatgatattgcagacaacttagaaaatttgtcgatagcaaacaccgaactgaatacgcccctttcaacaccgaatgccctaccgatgagcccaaagcgcagaggacatcgcttcgtagagggcgaggatgtgatataa

SEQ ID NO: 58790 - DNA, 263 bp, Heterodera glycines
  Genomic contig location: Contig_ID=SeqID_5653; Location=3267..3529; Strand=+
  SCN-specific regions: Sequence locations=1-18,55-263
atggcattgtcaacgaagttgttgcctggcctttttcttcgctcttctgcattttttgcaccaatttcttgcagtcggatggcaaagtcggacgtgccggcgctgagcacgacgaatcagccctacccgtacaaggaacagactccgaagggtattttcgagaagatgggcttgcagaaaacgccggacggcgcttcaatcggcgaattcgcagtgatgcgtatggacgacatgatgaacttgatcgggcgtggctctctttg

SEQ ID NO: 58791 - DNA, 494 bp, Heterodera glycines
  Genomic contig location: Contig_ID=SeqID_5655; Location=216..709; Strand=+
  SCN-specific regions: Sequence locations=1-114,137-224,374-435,457-494
atgggaaggaagtggcccggggcaacagcagcggcgggggtgagggttgtgctgctggtacttcttcctcatcgtccgcttcgtccaacggcggtggtgctgctttctcgtactccgtgtcctcgtcgtcgtcgtccgtcaacaccaacagcagtgccgcttcaacaacggtgagacaattgagggccaacaggaagaagacggtacgatgggggtgccaggcggatgatgatgatgccaggtcatcggatgaggaggatgattatggcaaaaaatacaagtatgacgatgatgaggatgatggagaggaagaggaggagcccgtcatgatgacatgtgatgacgatgaagaggatgaggaagatggcgataacagttgggtgccatgggcggtcaccacttcacggcaccaaaaccgccacccgaaggcggcacccaaagagcacaaagcgcgctccaataatcataaacggcacaaaaaatcatccagatga

SEQ ID NO: 58792 - DNA, 116 bp, Heterodera glycines
  Genomic contig location: Contig_ID=SeqID_28142; Location=629..744; Strand=-
  SCN-specific regions: Sequence locations=1-59,83-116
agtatcagaagatcgcctttgcaactgcgattggattcgccattatgggcttcatcggattcttcgtcaaactcatccacattcccatcaacaatattatcgtcggcggaggataa

SEQ ID NO: 58793 - DNA, 678 bp, Heterodera glycines
  Genomic contig location: Contig_ID=SeqID_28145; Location=50..727; Strand=-
  SCN-specific regions: Sequence locations=1-211,233-301,358-558,580-678
atggatttgcttcttttccaacgcgataaatacgctttggcgtacaattgtacgaatttcgatgccaatttggtgccaattgggcaacgcattcacactgttcacggcatcatcttaatcattatgtttttcgtgttcgaagtaagtttcagcagaagattatttcaatggaaatatttaaaatgtttgccaattaaaatcttagctttttcataaaaaatttttattttatggtgaaaaaatctgaaaatgatataaaatttatggtaaaatcgttccaactttttttttgaattggatcaaaatctgaaacttaaatttcttaaaacagtcaaatttaattgttttcttattggttaaaaaccaagcacccttgtttttacttttttttccttgtctatcaaatccaacaatcttggtattattaccaagttgttttaaaacgaaaattgaaaaattcggaattcttaagttttttttcttccttttatatgcttgagcgaatagagcttgtaaagaatctccgagtcatgctaagattgttggatttagacaataaagaaaaaagttagaaaattttagctgccgccaaaacttcggcacaaaaacgacccttttcatttgtcacatgggcatgagtattttttttccattagttgttgtacattccctgcatga

SEQ ID NO: 58794 - DNA, 819 bp, Heterodera glycines
  Genomic contig location: Contig_ID=SeqID_28147; Location=45..863; Strand=+
  SCN-specific regions: Sequence locations=1-332,355-819
gactcaatccaccgcattcaatcactgggactcaacccaccaacattccaatcactgggactcaacccaccaacattccaatcaacaggactcaaccctccagcatttcaatcactgggactcaacccaccaacattccaatcactgggactcaatccaccaacattccaatcagtgggactcaacccaccaacattccaatcaacaggactcaaccctccagcattcaatcactgggactcaacccaccaacattccaatcaacaggactcaaccctccagcattcaatcactgggactcaacccaccaacattccaatcaacaggactcaaccctccagcatttcaatcagtgggactcaatccaccaacattccaatcaacgggactcaatccaccaacattccaagcaacgggactcaacccaccaacatttcaatcagtgggactcaattcttctgcatttcaatcactgggactctattctcctgcgtttcaatcaaaaggactcaatccaccgcattcaatcactgggactcaacccaccaacattccaatcactgggactcaacccaccaacattccaatcaacaggactcaaccctccagcatttcaatcactgggactcaatccaccagaatttcaatcactgggactcaattctcccgaattcaaatcactggactcaatctcatcaatccttcagcaacacaattaccgggactcagttctccgacatttcaatcaccggaacttaacctcagcaacggaatacagaactatttaagaggaatccagaaattgaaatataacccata

SEQ ID NO: 58795 - DNA, 701 bp, Heterodera glycines
  Genomic contig location: Contig_ID=SeqID_28148; Location=45..745; Strand=-
  SCN-specific regions: Sequence locations=1-701
atggatgaaactcaaattggagacagcgctaaagagaatgaagcaattcgattgaaaattcagaaggaccaacaacagtcaaaagaatcgcaaagcacagtaagtgaaaaataattgatggtgttccatattgtttcaaagaacacgtttatttattgggagggttcggtgtggctgattaggaccagcatatatgagcaatttcgagcccataaactcgaataaacgaaaaaacggcgccagtgcgctttaggcgtccattttttttcttattttcctttttagtcttttcttttattcctgagactagttgataccaagaaattaaagattgacacagtaataagattggatggtacttgattggacgcctaaaagtcatgcctaaagaacatgagaaccaaaaaccgattattatttagcaacagaaactatcgcagagacgatcatctacttttggatcctctgctcgtcaacatcggatttactatcaaagcaaaaagcaatttgtataaatcttgtcattttcggcaatcctgaagaatgggtgtccctaatttaacttttttttattttgagctcaaaatcagtttccgggggttttcgagggtgctgattacgaatcaggactcagatttgcctaattccgaacctcggatccgaattcgaacaaaaagttgaaaaaaaattaccaaaataaa

SEQ ID NO: 58796 - DNA, 515 bp, Heterodera glycines
  Genomic contig location: Contig_ID=SeqID_28148; Location=942..1456; Strand=+
  SCN-specific regions: Sequence locations=1-15,39-81,113-172,212-515
atgaccagctacatcgaacaagaagctgatctttctgaaggtcatgattcagactcggaagtttctgaacctgttgcaaagaaagcaaagaaaaataaagaaaagaaaagaaggcatcaaattaggtttaaaaatttcttcttaaaccttatacaaaaggaattttagtagtgatgaagaagaggaggaagatgaaggagatgaggaagaaatgagggattttattgttaatgaaggtgacgaagaaggtggagatgagggcgttgaagcggaagcagacggcgaagttatcacagatttaatccaaaaaggccttaaaattacctatttagagcgaaaaggggtctgatgtcagtgatgatttgctggatgacgatttggacctactcaatgaaaattaccaaaacactcgtggcagagttgaaattagcgatgatgaggaggatgtcagagaacgaatcaaagacagaatttttggaccgagtaattcaccattttttatatttctatgttga

SEQ ID NO: 58797 - DNA, 772 bp, Heterodera glycines
  misc_feature (28)..(28): n is a, c, g, or t
  Genomic contig location: Contig_ID=SeqID_28149; Location=176..947; Strand=+
  SCN-specific regions: Sequence locations=1-675,718-772
atgggattgtggtcaacaacgacctgcnccttatgggattgtggtcaacaacgacctgccccttatgggattgtggtcaacaacgacctgccccttatgggattgtggtcaacaacgacctgccccttatgggattgtggtcaacaaagacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacaacgacctgccccttatgggattgtggtcaacatagagctgtccctcacgggatacatttaaatcgtctttttattatatatcaatgactgcattagggcacttccggtttccattatatttacaatgtaatgtgtcagcttctcaatgaagtgaaaccaagtgcatgtcgggcgacgcaaagaccctaaagaaaataaggacctgcccttcttgggattgtggttcgaggcctgccctttgaggattttgggccacaacggtttacaatgatgatttccttattgttaccggccaacatccggtgcgaagctggtcccgcactttgccaagaccagtggactggtgagaggtaacataggatattggagttaaccaaaatttatcgtcaaaatttgatgaca

SEQ ID NO: 58798 - DNA, 304 bp, Heterodera glycines
  Genomic contig location: Contig_ID=SeqID_28150; Location=75..378; Strand=+
  SCN-specific regions: Sequence locations=1-31,54-250,274-304
tttctctttgattgtgccgccctcatttagcaataatagcaacaataataatgattcgggcacaacaaaagcttctacaactaatgatgatgatgatgatgcgaataatttgttgattttgcaccaaaactgtgcgacaaatgtgggagaaaaagaatgctttttcgagcctaccgtatcaccactgtcattcctactgtacatggatttatctgaaatatacggtgaatgactccatgattattggcactattaaatatttattaaaatgaattttctacatcgtatttttttttgttttgaa

SEQ ID NO: 58799 - DNA, 492 bp, Heterodera glycines
  misc_feature (473)..(473): n is a, c, g, or t
  Genomic contig location: Contig_ID=SeqID_28150; Location=512..1003; Strand=+
  SCN-specific regions: Sequence locations=1-372,438-492
atgccaaaatatgtgcttcacccaatccaactgttcacatcactgaacaacaccgaaaatgtcgaaaatgcacagaactcgccgcgctttgcacgcgcccgctttcacgttcagtttaacgctaccgcgcgcgcgttcgcaccaccgcttgtactgctcgcgcatgtcgtgtacgcgtcgccaccaacggcacagcgcgacaacgacagcgacgttgagtttggattggcacaggacgctgcgggagctgccgaacttgtggaaatggcaccagccacgggcataattgtgccaagggtgaaggaaaaaaacaattttgaaacttaaaatttttttaatgctttaaagtaaaacttaaaaaatactttcaacattaaattaatttttaaatattaattttcatataaatgttaaaatttgtttatttttaattttttgcataattatcggtaagaattatttgtttcgattanatcttttcaattttttata

SEQ ID NO: 58800 - DNA, 2165 bp, Heterodera glycines
  Genomic contig location: Contig_ID=SeqID_5656; Location=1227..3391; Strand=+
  SCN-specific regions: Sequence locations=1-474,497-1254,1286 -1597,1628-1645,1670-2165
  Gene Ontology: Mol. function=protein kinase C inhibitor activity; Biological process=protein kinase C activation
atgactgacagggaaaagcatttgcattttgttcgtcttgcggaggaagcggcgcgttacgacgaaatggtccaggggatgaagcaggtgaaggaaggaaggaggagaccaattcagaagaaccattaattaaactttgcatgcttaaggtgattgaattggatgccaaactgaacgaaaatgaacgcaaattgttgggcgtcgcgtacagaaagtcagtcactgggcaacgcttcgcttggcgtgtcattgcgtccgtcttggcacgagggaaaggcacgaagagacagctggagatggtcaagcagttgctgaacaagctggagcgcgaggtggaagagaggtgccgtgaaatattggtcagtggtgggtgggcgcattcttgtgccgcgaaattccgcactaatttgcgttacttttcaggatttgttggaccgggttctgatcaaggaggctgcagatgatgaagcgaaagtgttctacttgaaactgaaggctgaccacttccgctatttggctgagacacgggcggtgaaaaacggtaaaaggacagacggacggaccatacatgcacaaggcgtgtctcgacaccccccccccccccccatcgttcgtcgtaaggggggcggctgtaaaagaggggggtcgtcgtggagggaggcgttaacgaagggagaaaataaaaaaattttggaccttcgtatgaaaatcggtcccgagacacccccctgtcccaatcatccgtcgtatggcccttgggctgagacaccccttgtgaatgtatgggacggaccgaagcattgaacaaacggtggatcaacaattggtcaattttcaggtgttgcggagaaggcaaagcaagcgtaccaagaagcgttcgacctcgccaagaacaaactccggccaatgcatccgattcgtctcaccgtggcgctgaactttgccattctccaattcgaagtgcagaaatcaccagccgatgcttgccaaactgcccaacgggtgatgaacagaaaatttgtttttcaagtttaaccgctccaattttttttacaggcttatgacgacgcgacttccgatgcgcagacaacgggcgagagtatttgcgcggagtccgtcacgatcatgggactgttgcaggacaacatctcgtactggagtggcaacacctctaagacggagtgaaaaacgatcgctgtatattatacgacataatttgtccttgtccattgtgttgttctaatgagccttttaaattatatgtatgtacaatttgtatataaaacagaataaatgttaaacgctgatataaaagtaataggggtcgaaagatgaaagcaaaggtttgggggccttagggcagacttatagtttagagtccctcaaaaatggtcagacaataaaaaaggactgtgagctgtttgggtcacagatcttttcatgaatttgatattcattttaagcacccgaaatcaccatggacggtaaaaaacgaaaaaaattgccaaaaaataatttacttgtcagttttactaaatttatttccgcgattcggtgataattaatcttccatcatatactattagctttggcaccaaaagtgccatatttgtttgtattttcttttctccttttggccatcccttcccttttattcgtttttcatatcagctgaccgaagaatgagtcaaaaaagctcgagaaatttctcattcgggattttcagcagtatttgtttcgggatcattaatggacaaatcgcacattttgacaatggcattaatgccgtcgtccacctgctgctgaatatctctggtgagtggcgctgttcctcccccccccggcgccatcaaataaatatttgcaatgcaattaagtttgccccattaatttctgtcctttttataacacttttccccggctttgctgaattcaattttccgttatcagtgtatatagaagttcaagcagtacagcaaattttgatgggaaaggagatgaagatggacaacagcaaaaatggagaaacaaggcaagaggaggaaaatagcattaggttaggaggagagacggaagagaaagagagaaaaaggaaaaattcggcggaaggaagaggagagaatgaagctgaaaagagaaaagaacagcagcaaatcggcacttaa

SEQ ID NO: 58801 - DNA, 1948 bp, Heterodera glycines
  Genomic contig location: Contig_ID=SeqID_5656; Location=3777..5724; Strand=-
  SCN-specific regions: Sequence locations=1-1184,1207-1313,1340 -1401,1426-1948
ttggatttgcaacgacgtttggatggacattttcccatcctttgaccgtgctcaactcggcctcaaattggcacttctttcgccacgtttcgatgcgttggtggacaaacatttcgatggcaaaagcgaattgacaatttggagaactatcgaaattcgtcgcaaggacaaaggaccagaaccgaagctgtctgtacaaatgggtgacaaatttgtgccatttccattgccggaccgtccgttgcccagcaaaatccgttttaagcgccttcggatttagtaattaaaaatcagagagctatgacaataaaagcattccttccattttcagttacatcgatcattccgtgatcgcttttcttcgttcaaatcaccaaattttcgacaaaagaggcaccaatttacatttgtggattccattatcatacaccatggatgtttttgttcgtgaaatttggccaattttttcggcaaacattcgccacttgggctttccccatggtgatcatttggacaatttgcttcgtcgcatttcgccgacaattctcaccgatctcaaccaattgacttcaatccattccggtgctttgttgcccgctgcgtttggtgatgattttgatgggccaaattcaacaatttcttctggccaagcattgtccaaatggttgcactctccgagaaaagatggccaacccaaacgattgcattgcgcaaattacaacaaacaaacgaacttcgattgggtcaacagtttcaaggaggtgtggtgcggagggaggggggagcaggaacaaatactgctgaaaatccccgaatgagaaatttctcgagcttttttgaactcatgagttgggttcaaggggtaaaccaaaaatacgtttaatggtcttaaatggcgttaattaaaaggtatatcattttttggcgtaaaaccaacgatttcagagtgaaatacaattttttgtttaccgaaaaaatggacaaaattggacaatttagccttttaaaaaggtcaaattcagacaaatttagggtaatactaccgatggtaccacttcagaatgtttccatgtgattacccatttttagacgaaaaatgcaaaatttgaacttacgaaattttgttcgagttcgggtccggggttcgaaattagtcgaaatggatgtcatattgatgatcagcaaccccaaaaaccccagggaacatgttttcacggcttttgaaaacaaaattttttttttcaaaaaagttgtggtaccatcgggtagtattaccaaatttagtatcattcgaaagctcttggtgagttaagtctaaaaatcaaagaaaaatgtcaaaacgggagccacctaagcacagggacaactgagtcccattgaatatagacagttctgtaccaaaaaataatgaaagaaattaacaattaaaagtagggttgtacggaccggggcgggaattcccggtcctccgaggtctcagcccgttttacgccaaaaaatgatcataccttttaattatacgccatttaagaaccattaaacgtatttttggtttaccccttgaacccaactctagccttcgaaaaaaatattctataaaattcgaaaaaatgaggcccaaaatttcggaaattggaattccgaccccactcaaattgtttagcattttctccgtgccaatgccatttcttccgtcagttacgaaattcatttttatgttcgtgcgacgtcaatgcaaattgtgccatttgaattggtgaacgaatgcacaaaggaaaagctgacattggccaaagaagacgaaaatgaatttgaggacaacagttggataatgaaacgctgcaaaattggggaaaccgcggcggtttattggaaagacggaaattgggacaacaattataacactgtgctcatttggctttatgatggcactaattgcattgggtga

SEQ ID NO: 58802 - DNA, 391 bp, Heterodera glycines
  Genomic contig location: Contig_ID=SeqID_5657; Location=162..552; Strand=-
  SCN-specific regions: Sequence locations=1-9,63-391
atgaaccgacggtaagcaatttgaaaagtcacacaaattcatcatttatttaactaaactgttttccataatttcagttggatttgcaacgacgtttggatggacattttgcccagttttgaccatcctcaactcggcctcaaattggcaattctttcgccacgtttcaatgcgttggtggacaaacatttcgatgccaaaagcgaattgacaatttggagaatgatcgtaattcgtcgcaaggacaaaggacctgaaccgaagctgtttgtacagatggatgacaaatttgtgccatttccattgcccgacgatcgtccgttgcccatcaaaatccgttttaagcatcttcagattgagtaattcggaatcagagatttatggcaataaa

SEQ ID NO: 58803 - DNA, 149 bp, Heterodera glycines
  Genomic contig location: Contig_ID=SeqID_5657; Location=1215..1363; Strand=-
  SCN-specific regions: Sequence locations=1-149
gcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaa

SEQ ID NO: 58804 - DNA, 347 bp, Heterodera glycines
  Genomic contig location: Contig_ID=SeqID_28153; Location=475..821; Strand=+
  SCN-specific regions: Sequence locations=1-220,256-295,320-347
atgagtccagcagtgattagaagaggtgcaacagtgatgagaagaggtacaactgtgattagaagaggtacaacagtgattagaagaggtgcaacagtgattagaagaggtccaacagtgattagatgagtccagcagtgattagaagaggtacaactgtgattagaagaggtacaactgtgattagaagaggtacaatcagttaaaaaaatccttttacttattaaaaataaagttagaaatttataatatattgtagaatatttattgaaattgaaaggaattaatttctcgaaaattcaaattaaataaaacatttattcatcagaaataatttaaaataatta

SEQ ID NO: 58805 - DNA, 986 bp, Heterodera glycines
  Genomic contig location: Contig_ID=SeqID_28154; Location=118..1103; Strand=+
  SCN-specific regions: Sequence locations=1-187,220-986
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaa

SEQ ID NO: 58806 - DNA, 388 bp, Heterodera glycines
  Genomic contig location: Contig_ID=SeqID_28155; Location=306..693; Strand=+
  SCN-specific regions: Sequence locations=1-19,41-388
atgaaccgacggtaaaaggattttaaaagtcacacaaattcgtcatttatttagctaacaataaactgttttccataatttcagttggatttgcaacgacgtttggatggacattttcccatcctttgaccgtcctcaactcggcctcaaattggcacttctttcgccacgtttcaatgcgttggtggacaaacatttcaatggcaaaagcgaattgactatttggagaacgatcaaaattcatcgcaaggacaaaggaccagaaacgaaactatctgtgcggatggatgacaaatttgtggaatttccgttgccggaccgtccgttgcccagcaaaatccgttttaagcaccttcggattatgtaattgaaaatcatagctatggca

SEQ ID NO: 58807 - DNA, 491 bp, Heterodera glycines
  misc_feature (17)..(17): n is a, c, g, or t
  Genomic contig location: Contig_ID=SeqID_28157; Location=746..1236; Strand=-
  SCN-specific regions: Sequence locations=1-35,71-491
atgagaaataatggagnaatgatgtaagtataatctttaaaaatgtttatttttttaaaaaacaaaataagtgtaaggcgtaaatagtttcagccaaaagcgggaagggaccgccccaaacataccgagagaagtcatcttcaggaaaatgattaatattcttttcgccagttttacaaaaataaaattgcaaaacaaattaaatgaatgtaagctttttaattattgataaagattcgaataaaaatagacactttaaaattaataaacattttttattcagttaacaccagaagaaaaaattaaaaattatttctcaaaaaattgttttttttagaattacgaaagttgtcattcgacaagaatgtatcagtttccttaaccagatcaaagcatgatttgctattgcaggcgcaaaaagatttaaatcattatattttcaggaaatttgacaaatacttgttaaaaattagattaaaaccaaaaataaa

SEQ ID NO: 58808 - DNA, 499 bp, Heterodera glycines
  Genomic contig location: Contig_ID=SeqID_28159; Location=25..523; Strand=-
  SCN-specific regions: Sequence locations=1-499
  Gene Ontology: Cellular component=cytoplasm; Biological process =regulation of translational termination
cgaacaaacttccaacgtcctaatttctgaaacgaccaccattccccaaatggctgctgctccgtccattcgtatcatcgcgacgtccaaggcgcctgctgcgacgggctacaggtggagcaaacaatggatgacaattgagaaagcacaactttatttgcttttctgcagtcaggcagtgctcgtcaacaaccagacgctgtacgtgagcggccagaccgggatgatgccaggaaagacggatgtggtgtcgggaggagcgcgagccgaggcgaagcaggcgatgaccaacatcggagagcttctgacatacgccggctcatccttcaaacacggtgtgtgagcaaaattcggcataaccatcatcgttgatttccgcccctttccagttatcaactgcaacatcatggtggccaacatgagcgacttccaggacgtcaacgaaacgttcaagaacttcttcaccgcggacacgtaccctgcacgcagcttcttccag

SEQ ID NO: 58809 - DNA, 364 bp, Heterodera glycines
  Genomic contig location: Contig_ID=SeqID_28160; Location=245..608; Strand=-
  SCN-specific regions: Sequence locations=1-209,231-243,307-364
atgacggatcaaatctgccaatatttgaacatctcattgttcacaaaatatgagaccgctaatttggcatcaaaatctgccgcattatacttggacaaaaatatgacaacagttggtgaatggattttcagcccaattattcatcaatttgttgtggcaaagtgcacattccaacatcaatacaaactaattgaggtaatctcaattaaaatttcataaatttaaaagtaatgtctaaataggaaaaaaattattattatatgttttatgtaattttaaaaattttataaagcttttaatttttttctatagaaataattgaaaccgatgcagaaaacattaatacataaattatttaaataaa

SEQ ID NO: 58810 - DNA, 248 bp, Heterodera glycines
  Genomic contig location: Contig_ID=SeqID_28161; Location=176..423; Strand=-
  SCN-specific regions: Sequence locations=1-173,195-248
atgaagcgaaccaacgcaacaaacatcactccgcctcgcgccaaacgctcaatggcaccggcattggacccaatcactgccgcactcgcagagcaagaacgccaacgtacactggtgttcattggcctcccagaaagcaatgccgttcgcccatcggagcgtgttcaggaagacagggaagccaccaccaaaatcttggaccatcttgaagttgaggccgaaccaaccgccgtctttcgactcggccg

SEQ ID NO: 58811 - DNA, 1577 bp, Heterodera glycines
  Genomic contig location: Contig_ID=SeqID_5658; Location=1221..2797; Strand=-
  SCN-specific regions: Sequence locations=1-87,109-119,143-506,597 -1476,1501-1577
atggacgaattcgacgaggacgcggcggcgatggcacagcgaccgatgcccaaatgggaaaaggccggacttcgaattgagcgcaactgtgccgaaaaccaaattttcctgaacattgtccaagaggtatttctcaaatcagacgggcattaattaatttttaattgtccgccggtaacaaattaattgtccctcaaattgacagattgtcgacaaatttggctgggacaattccgcccacgactacgacatgtggaagaaggcatttgggcccaacttcagcatgttctttgtcctcgaccaaaaccgagtgccgatgggctgcattagcatggcactgtacccgcaagtggcacattggagcatgttctacgtgagggacccctatcatggccaccaactcggccgtgcgctcgctcgcagagcgctggaatttgcaggggacagacccgtatttggttatgcaggtcagaaaacatatggcagttttgcaaatgcttttttgccgattgattgctccgtagaatgattaatcgattgatggcccatcgatcgctttgccgactgatcgattgattgatggccaatcgattgattttgtcagtatccctgttcttttcaagttcctgaaatgtggcacaaatacgaggaagagtacgcattccatcactatttggactggcgactgtggtcattcggtgcgaaatgtgctgacgtgcgacccgaacggttggatcacgactcgagcgtggagctgaaggactggcgtgaagcttcgttcgacaaactgttgctttttgaccgtcagcagacggtgggcattgacagatcgtcgtatttgcgggaggcacttcgccttccccaaagtgccgcaaaggtcagcagcgactagtttttggcattcgctgctattttaatgacttaaggtagccgtgtgcagggagacgggcgacgtggtcggcttatgtcaagcgcggcatttgctcggcgatcggctcggcatcagtctgttctatgcaaacagtgaggtcagtcggtctttgcccccgctttacgctcctccgttttgcttaagtccgtcgcctcggctcttctccgtgccgttctgctccaatttgcgggccccgatccctccgccaagttcgactcgttcatctacaaaactccgtccaccaacacggagtccatccgtctcttccgccaactcgtccaaaatgggccggtcgaacgtcggcttttctacccgcaattctcgcgttattcgctgccttttcccggcaatcgcattttttcgatcggcgatgagcacgtgtcactgatctgaacaaagagcgacggcggaagtgaaagggacaaaacggaggcaaaaaagaaaacattgccgaaatgggcacacatttaaaagtcaaaagatggcagcaaattcacaaaattttgtgtataaattaaccaatttacatttacagagattttgtctaaaattattaaaaaaaaaattttgcgcagaggaaattcccttttggtacagattcaattggcaacttttgatttgaataacaaaattctctttaaataaa

SEQ ID NO: 58812 - DNA, 875 bp, Heterodera glycines
  Genomic contig location: Contig_ID=SeqID_28163; Location=388..1262; Strand=-
  SCN-specific regions: Sequence locations=1-68,90-338,386-404,440 -454,478-479,513-548,592-677,716-875
atggtggaaaagaaaaatgttagaaaaatcactggacgaaatagcacagcaaacaaagagagtggtagtggaggaaaaggagagggaaatagtgtgggaaatgcacaacagaagggaaaaagacaaaatgaatttgaaggaggatcaggagcaaatgggaataacagcagtaatattggcaatggcaacaatgaaattaacactaatagtaataatagcggtggtggcggctggggaattgttggagaagacgaaggcgaaccgccaccaccacaaacgccgcagcaattagagataattagcaataacagcagcggtgtgaggtgtgccgaaaagagaaaaaattttaaaaaacttttaaaaaatcaaaaattatttaaatattgtatccgaaatctcgtcacaaaaaaattcattataaaataaataaaaatttaaaggaattttctagaaaaataaatttggaaaatttaaaaacgcaaatcactaagatttttccatttttaccaaattatttaattacaacagatccgaaatctcgtctcaaaaaattcagtaaaataaatttaatttaatttaaattaaattaaagaaattttcaagaaaaataaatttacaaaaaaaacaacattaaactttttacatttttcccatgttcagaataaatcgttgagtcctaaaatatagtataatattgtttttagcaattttttaataattaattcagggcacaaaatgatgcgctcgcaattgcttctcaattggaaaagtcggcctccgctggtgccaccggcggcgcaacggcccaacaattgctgcaacaattcggatttggcggagccggagcacaaaatgcgttgcaaatgaatcaattg

SEQ ID NO: 58813 - DNA, 928 bp, Heterodera glycines
  Genomic contig location: Contig_ID=SeqID_28164; Location=131..1058; Strand=-
  SCN-specific regions: Sequence locations=1-566,588-847,879-928
atggccaaggcgacacacgcccgatgggccaagaattttcaggcaatggtcagcgcgttattgacgccatttgttcggaagcggatgctcgtggaaagggggacgttgttcggaaacgactgtctgatgtcggagtgcgacggcaccctcggacaaaacaattcacgggtagaatgatggggatgaggtgggggttattgaggcggccaacttttgacaggtggcgacatctacaaaatccttgaccacgaaaacttcgcttcattcacggcaccaattccacccgggccattgaaattttggctgatggacgccatgaatgacctccgccacatttaccgcctatcgcgtgccaaaattcttcacccagaggatctcgattcgcttgaacattggaccaaaatgttctactgccactggcagcaactccgatcacttgacgcctcgcgtaccccgtccgtccgaagcttcaccttctcagtgcccatgtcgtcccttttgcgcgctctcatctttggtgggggctgatcagtgaacaaggaatggaacacatgcacagaatgtgcaacaatttggtgtttcaatttttctttatcattgaatttttaattttaggtaggccgctactctcatctcggcacacaagagaagatcgttgagaaactggtgaagcacacgacgatgttgaatgcactgcacgaccgaggcgttgagaacaacaaagaaaacgacaaatacccagatttttgaccacattttcacctcaatttttttcacattaatatttcgaaaaatttgatgttttgaaacgagttaaattgcttagcattcgcttagaaaaagactctccttttcaaaaacaatttttagatacaaattttattcaatttagttggaaatgaagaaagttacggctgatcaaaataaa

SEQ ID NO: 58814 - DNA, 87 bp, Heterodera glycines
  Genomic contig location: Contig_ID=SeqID_28166; Location=307..393; Strand=+
  SCN-specific regions: Sequence locations=1-3,43-87
atgcccccctccctttcgcttcttttggccctttcgatggccttttgcctaatcactttggtactgaaatgccccgatgaagaatgc

SEQ ID NO: 58815 - DNA, 49 bp, Heterodera glycines; identical to SEQ ID NO: 51181
  Genomic contig location: Contig_ID=SeqID_28167; Location=440..488; Strand=-
  SCN-specific regions: Sequence locations=1-49

SEQ ID NO: 58816 - DNA, 289 bp, Heterodera glycines
  Genomic contig location: Contig_ID=SeqID_28168; Location=1324..1612; Strand=-
  SCN-specific regions: Sequence locations=1-56,152-289
atgccattgaatcagcaaatgaaaaattacaacagtaatcatttgacgaaatatttggagaaaaatgggaagaaaaagaagaagaaaaacaaaatgaagagaaaatcaagcaaaaaggaagaaaatattcaagaaaagaatgggagaaaaattatgccgaaatttgtaagaaaatttgagttggctattatgacacaattaagaaatggaagaaacaatttggcattaacatagaaaaaagaactaagaaagaaaaaattgaaaaaatgaaaatttattggcaaataaa

SEQ ID NO: 58817 - DNA, 703 bp, Heterodera glycines
  misc_feature (677)..(677): n is a, c, g, or t
  Genomic contig location: Contig_ID=SeqID_28168; Location=6..708; Strand=-
  SCN-specific regions: Sequence locations=1-24,53-703
tttggtgcgctttagagcactttctaaaaaaatatttatgaaataaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgtcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcnggttcggggggactgcccccgaaaac

SEQ ID NO: 58818 - DNA, 575 bp, Heterodera glycines
  Genomic contig location: Contig_ID=SeqID_28169; Location=1..575; Strand=-
  SCN-specific regions: Sequence locations=1-49,71-575
atgcgaaggaagcgccaattggagcggggcggcgccaaaggcgaaaagacgcggaaaagcccgcaggggaaaaaatttgtgcggaaggaataccgaatgatgaacgacagcgaacgagcgcatctgcacaacgcactgaacatgctgaaggagaagcgcgtggacaacatttccatttgggatttgcatattctgtgagtacagtaacaacttacagtaggatgaagcctaccgtccattttcagcctccactacccaaacagtgcccccgcggcccattggggtccgtttttctttcgtttggccctctgtccgctgtgttattgtcaccactcagacaggtcccgcatttctgccctggcatcgcgagtttctgcggcaatttgaagcagcgatgcacagcgaagtgccgggtcggtcggtcggtgcttcgatggcacttccgtcccatccctcattttaatgaactaattaagtaattcatcttaagagttaggcgtcattccctactgggactccactctcgaccccgggggggtgctcatgtcaactgttttttgatatgacttttttta

SEQ ID NO: 58819 - DNA, 430 bp, Heterodera glycines
  Genomic contig location: Contig_ID=SeqID_5659; Location=1..430; Strand=-
  SCN-specific regions: Sequence locations=1-110,159-161,183-430
ctaaacatttcaatgatttttaaatatgtacataggtaagtaaaatcatattacctatgccaatgaaataccaaatttttgtatgcttaaaagctaaaactgactttggcaaaattaaaaaaaaatctttttaaaagttttatttaattttattttttgctgtttaattcaaaacaaaaacaatttctttttgattaaagatgctaatgcctcaacggcagctgcgtttggttagcaaaagtttgctgttggtccatggggcgggtgccaaacaatttttgcaaggattgacaaccaaagacatggagcaagtgtaaaagccgtctttcttttcttcaacagtaatttcagctccctcaacaatgttccgttggtttattcctttctaatacaatgttaggggacgcattttggcggattttttcattta

SEQ ID NO: 58820 - DNA, 419 bp, Heterodera glycines
  Genomic contig location: Contig_ID=SeqID_5660; Location=994..1412; Strand=+
  SCN-specific regions: Sequence locations=1-419
atgacacgcaattttgaggccgccgagcgatttttgtactttttcctcaaaattatttctgtaaatgccacaatgcgcgacgcatttcgcgaactgctcattttggagacatttctgcacattatgcaacagcacagctcgggtaaaagccacttggaagagcacaaaatcctttttctgatcaatttacggacttttatcacggcattgataattattaataaatatcgcacattaaccccaccccattcgttgttctcacgccaatttgattttccgattcaaaatgtgccaatgttttacgtcgttcagaagcaactgttcagccgcatgtccgtcgtgtggttcaactctctttggatttgctgatcaatgcgactaagggaaatgtgttgaacgcccaattcatcaccggttga

SEQ ID NO: 58821 - DNA, 2897 bp, Heterodera glycines
  Genomic contig location: Contig_ID=SeqID_5661; Location=1..2897; Strand=+
  SCN-specific regions: Sequence locations=1-373,399-1284,1322 -1872,1894-2897
gggaataaatgattgatcagacagaaattagggacggaggggagggaatgatagcactgatcaaagaggcacagagatgcaaagtcaaagtgtatgatcgatcaatggtcaaactcttcacgcgtttaattttttgccccttcaaattcattctcaaaaatccaactgtttgataaggttcgtcccgccattatcaactcggttctgctcaatttcggctgtttcggcaaatgcacaaaagtggactcggaagcacccgtctgggccacagtcactttggccaattgcgggcccaaattggctgccatccaccaatgctttcggatgggcacggatttgtacagagcggacaacaaatggttaaaaatcggacgaattcaaatgaattttgagggaaaccgaaacttaagcaatggcgggcaaaacggcgcattagccgaagtgccaaagggaactttcaacgcacttttcctaatgcgacttctgttcgatttggcgtttgacaactttgacaagtatttatttaatagtctttcgcagtttaaattgttcattaccaaaaaatgaaggctttcaaatgaattgtgctgggcaaatgccgaagaatggcttcagaatgccgagaattttgaaacagtgccggttctgacctggtccaactcgaccgtgttgacccatccgagtgcccttctttccattgtcgatttgctcccggccatttgctttccgtccaatttgcaaccagcaggggacaatgagaaacacagggattataccgtagagggggagctgtcattagcggtgcgtacggtggcacaattagacgaatggtgcgcactggcccaactttacatcgcattggtcctaaaagtatttattttgcttttttgaccaaattcatctgggattcgctttatgctgttcttcgctctgaacgcaatcagcagacgatgtgccaattcgacttgcccgccaaacttttggcggtaggcgaaaatctgttcaaaacggaacggcacccgctgctttcgtcgttccattatttgttcgaaagactcgcttatcagtcacttcgaccatcggaactcaggcaagaaaaaaaccaaagagtgatcaaaaaggcaaaaacaaacagcaaacagttaagacgatttcttcggctggacatgccactttgctgcacaaatttagacgacgaaaacgaaaagggacggagcgacgcggcgatgaagccgggaggaccaattccgacccatcggttagcttaaccggcgaatcattgaaatttgattgactttttaattatttattgcacttaattgtcgatcgtttttgggtactgtactgtaaccttccaagggttattggtttcgcattggtcaccccttccctcccccatcccctcccctaaaggatcaaagcgttcgtgtcgatgctcaccccgcgtaaccattcgcttctgctggcgccgtccttcgtggaattcgatttggccatcgaagggttcgccgctttggtcattccctcaattgtgcgcagtgttcaacaactctcgcagctgccgccttcgctcggcagcgccggaggagcggcgactctgccggcgacgggcgccggcgattcgtcggacggcggcggcgcgaattttccatcgtccgccggattcactttggcaatgtccgcaatttttggggacaaagtatggaaaattggccgttcaggtggataaacattgtcgatttcgtggacaaaaaagagccgaccgtcgccccttcacaattcgccggcactttgccctccccgtcggcccaacccaccacaatttgcttgttcagcatcgttagggtgtttgacggcagcccatcaacaacaatgcttccggacgagaacacttcgaactcatctcgagactctcggccggtcaatcccgcgtattatggccatcaactggcggcaaacattgagaaccaccagaactgtctgcaagtgctgcttcagcgagtggacagctgcggttggtcgctggtggtcagtggggcggagcattccgtggcggacgaactgcgcaaggacttcagccgaggggcggagcagtgtctgcaagtgccgttgtccgagcagtacttcccacccaaacagtgggctcatttggccatcggttggtccgttcattcgccattcattcattaatttatcaatttctgcagtggtcagtcggccctctctgctgctcaagtccagcaatgtgtacaactgcgaagtgttcgtcaacggacactctttggccagtcaaaagttgcaactttggtggcattctgccgacagcggtggtcagcagcccgggctcaacgcgtacatcggcacattgccattctttcgccggggaagcatccaattgcgctggcgattagcctcgctgtgtttggtggaggaggcactcggggcagatgttttgcgcaaaatggtcgcacttggagtcgcctacacgggcaattaccaggtgccgtgccttttcggcactttccgccacctttgctctttttcagactgatgcttttccctcccccgcggcatcgtcccgttctgcgctaatctctgaagagagggtgctgctctcgctaaatgcttctgcgagtgcggagaccaccgctctttcgctgcgttcgatgtttccgtgccggacggacgccgaaatgattgctgcgctggtcggcatttcgccaaatgatcaaagcactccgttgtgtatcctctggaacatcacttcctgcccaaccccgtgccgtgcgcttccgctcggtgccgttctgatcggttacctcggtatccgtaccttctgcccgtgtccggtcagttcgctgctcgattctgtcggcggaatagctccgctgctcggc

SEQ ID NO: 58822 - DNA, 652 bp, Heterodera glycines
  Genomic contig location: Contig_ID=SeqID_28173; Location=79..730; Strand=-
  SCN-specific regions: Sequence locations=1-20,42-275,297-552,574-652
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagattttga

SEQ ID NO: 58823 - DNA, 1341 bp, Heterodera glycines
  Genomic contig location: Contig_ID=SeqID_28176; Location=79..1419; Strand=-
  SCN-specific regions: Sequence locations=1-1151,1173-1341
atgccgaacggaaagacgctaggacaattaagagagagggaagtgaggaaacacgatatactgagccgttacgtcgacttggaggtggtatgggagcatgaaataaatgagcaactaaagaatgacactgcaatgagggagtttttcgacaactggaaggaccgctcaccaataaaaatcagagacgcttttcatggaggacggactgggcaaatgaagctactgcacacagcgaaaccaggccaaaaaatcagctacaaggacttcaccagcctctacccgtttaccaactttacgacagactatcccctcggccaccctaagatcatcagttttccagtgaatgagcagacggtcaactggcgttctccatccgacaacccctacaaaggccttctcaaagtgctacttctacctccaaacaacaacatcaaagtcactgttatgcccataaaatttgatcaacgccttctcttccctctctgtgagaagtgcgccaaacacatcaccgcaaaatatcccaatggcctcaaagtcaacgactattcctgtccccactttaaccccatttaccgcgcctttgtatcaacctgtacccatcttgaattaaatgcatcactagaagccggttacactgctcgcaaactttttcatgtcctccaatacgaccaatggagtaacaatgtcttcaagtcctacgtaagtgaaatgatggccctgaagatccacgccacaggattcccatcatggtgcgagagcgaagagcagaagagtgaatacattgaggagtgctggaaaaaatttgcaattaaactcgacaaagaaaagatgaattcggagcctgggaagcgctacatcgccaaactttgcctcaattcactctggggccgcttctccatgcggaaccttctctccaaatcaataattgacaacgacgaaagcctaattcatcagtatgcagaagataaaaagattgatctaatcgacttggaaatgatggatgaggacaacgacgtattcatgctcacctacaaaccaaaggaggagtttgtcgatgaaaataaatactcaaatgtcgtcatttccctcttcactacatcaatggcgcgactctacctctacgaagctcttaaaaaagtggccgacacccccggatgtgaaattctctacttttacacggacagcatcatctacgttcatcccgtggacaatgacccactcccgacaggaaaggggcacctcggagagctgacagatgaaaagccggaccactatattttgggattcatcagcgctggctgcaaaactacgggcttaaactttcacggaagacaatggtga

SEQ ID NO: 58824 - DNA, 369 bp, Heterodera glycines
  Genomic contig location: Contig_ID=SeqID_28180; Location=700..1068; Strand=-
  SCN-specific regions: Sequence locations=1-369
atgccctacggggtggcatcggcaccagcgatattccagcaggtgatggaagaaattctctgtggaattgacggagtggcagtgtatttggacgacattgtcgtcactgctgcaaacgatgctgaacatttgaagagattggatgccgttctccaaagacttcaaaaggcaggactacgagtaaaaaaggaaaaatgctcgttcatgcaagaaagcattgtttatttgggacacattatcgaccggcaaggaattcggacttcgccagagaaggtggaagcgattcaaaaaatgccggcgccggaaaatttgaaggaacttcaagtttttagctctgaactgagcactcagtcacaaacgaattcataa

SEQ ID NO: 58825 - DNA, 129 bp, Heterodera glycines
  Genomic contig location: Contig_ID=SeqID_5662; Location=348..476; Strand=-
  SCN-specific regions: Sequence locations=1-129
atggcgaatgtttggcgcaaaaatgggccaagtctgcctgacaaagacatcccaaatcgctgtttcagtggacacttgcaatgtcaatttggtgccccttcggtcaaagagcaattccatggattaatt

SEQ ID NO: 58826 - DNA, 1666 bp, Heterodera glycines
  misc_feature (1662)..(1662): n is a, c, g, or t
  Genomic contig location: Contig_ID=SeqID_5662; Location=970..2635; Strand=+
  SCN-specific regions: Sequence locations=1-76,100-109,132-448,471 -612,650-927,949-1329,1351-1666
atggaccaatttgaattggtgaacgaaacgacccaagaaaagttgacattgcaaaaagaagtcggttgtggaaagaacaaatgtaaagaatgtgagaaaatgaatggttggctgttgaagaagcgatgtttatcgtcgaatgttgttgtttttggggaggcggttcagcaccagcagcagcggaaccacaacattttgaacaattcacaaaatgtccgaattgaattgcgtggtccaatttgcattgggtgggtgagcagcagacgacctttttttggtgtcatagcaactcgtacaaaatgcaacagctcatacaatttcttaggctatgcctaggcttaggcctaagctataggctagtccttaactttggcctgctctggcctaggttaggctttattttcctaatacatatttgttgattttcgtacgagttgccattgactccttttttattaattaaatttattggtaattgtttagcggtggggtgaatcaaaatcttcacccaaaaatgcgagattcgaaaattttaattttgagtttttgctcaaatccgggttcgggattcgacgtggctcaaaattaatatcagattcgggttctccgctctttaatttttattcaaaaatttatttaactaattattcttcgaattcaaattttaggccattgtctccgcccgccgaccaaaacaacgaaaaaggcgccaatttgtgaacgtatggccattgagaaaagaagaaaggaccgaccatttgattacctctgctggacttgatttgatgatattttctctttgaatgtgcttactttttcttttgtttaatggattttcattcaaaatcaaaattagatttttcgcggctaaatgttgatatttaataaaatcaacaaacattatgccatcaaaacaaataccaacgcaaatttttaaaatttatttaagtggcttataattttatgtagagcgataacgcaaaaatgagttctgctatctctatccccattttatttttgcgccaaaagtcatttgaaaaaaattgctttaaaatttcaaaaattatcgaaattttaaaaatgatgttgagcctttctctaccctcgagcccattggcaacaatttaaggcgaacagatttgaaaattgttttgatagaaaatgcgattctcgtgtttttctcatcaagtattatccgtaaaaaataggaaaatcctaaaaatccaggctttatccaacgcattaattcttctgctatatattgtgtgacatcattcgaatttggccaaattgtgcttatttctgccaaaaaatgaacaggcggtaaggcattttttaaaagccacaaattcctcacttatttagcctaattgtttcccatttcagttggatttgcaacgacgtttggatggacattttcccatcctttgaccatgctcaactcggcctcaaattggcacttctttcgccacgtttcgatgcgttggtggacaaacatttcaatggcaaaagcgaattgacaatttggagaccaatcgaaattcgtcgcaaggacaaaggaccagaaccgaagctgtctgtacaaatggatgacgaatttgtgccatttccattgcccgaccgtccgttgcccagcaaaatccgttttaagaatcttcgganttag

SEQ ID NO: 58827 - DNA, 1006 bp, Heterodera glycines
  Genomic contig location: Contig_ID=SeqID_5663; Location=61..1066; Strand=+
  SCN-specific regions: Sequence locations=1-92,118-733,756-867,889-1006
atgacaaaaggaaaagctgacattgccaaaacaaagggatgggacaaccgatggataatgaaacgatgcaaaattattggggagaccgcgacggttcagcagcaaaagaaaaatgaaaatttggacaacagttgtaacaatgtgtccatttggctttataatagcgccaataattgcattgggtgagcaattaaaaaaaagtgtttagataattcaaattgcgcttaattaaggccattgtctccgccaccggcagaagaagcggcacaaaacatcacaaaggggccgtcttctgacaatgaatgagtggtgggcccagcaaaaacagtggtcaacagaagaagaaatgattaattaagaatgatcgatcgatcataattcaaatcagtgatcaaatgaaattttatgaagaaaaacctctcaattttgtaaataaatcggacgtataaaaatggcaaaaaagttgactctattgcggttcacacgaccataagcttttttttgcaactttgatgcaccatagctttttcttattaaaaaattcttacacggaaatgaactaaaagtcatcactgcttcagtaaaatggtaatttgaaccatttttagactaacaagtgattccaaaaaattgaattttcgactttttgttcgaattcgggtccggggttcggaatagggcgaaatggatactggattcctgaacagcgacctcgaaaaccacaggaaacctgttttcatgtcttttgaaaacaaaaaatatttttttcaaaaaagggggggcaccagctttactattaccgaaaaacattttccttcgctaattttagagacaggcactatacatttttgattcagtctttttcgattaactgatcaaaaatagaaaaatttttgtatttcgaatttttaatataaatttcagaaattctttaacaaaagcaacaattttttttattgacgcgtgacatttttgggacaccttcaaaatttcaaagtttcgttaa

SEQ ID NO: 58828 - DNA, 329 bp, Heterodera glycines
  Genomic contig location: Contig_ID=SeqID_28184; Location=1..329; Strand=-
  SCN-specific regions: Sequence locations=66-66,98-104,133-295,326-329
atggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacaccccaatgacttgcgcatacgctaaactccttggtccgtgtttcaagacgggtcgaaca

SEQ ID NO: 58829 - DNA, 333 bp, Heterodera glycines
  Genomic contig location: Contig_ID=SeqID_28188; Location=1..333; Strand=-
  SCN-specific regions: Sequence locations=1-333
tatacatcccattatgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaaaattttagcgcttccaattccttctacaatcgcctttatacctcccattatgaacgctaaaatt

SEQ ID NO: 58830 - DNA, 155 bp, Heterodera glycines
  Genomic contig location: Contig_ID=SeqID_28189; Location=1002..1156; Strand=-
  SCN-specific regions: Sequence locations=1-32,58-155
taagcctaaactttttggcctgtttaaaaaggaattaaaaatttttaaaaatttattcatctcccttttgatagaaaaagcatcagagagccttatttaacttttaattaaaatttggtgcgtttcagagcactttctgaaaaaatacttaagaa

SEQ ID NO: 58831 - DNA, 578 bp, Heterodera glycines
  Genomic contig location: Contig_ID=SeqID_28191; Location=504..1081; Strand=+
  SCN-specific regions: Sequence locations=1-109,163-501,551-578
atgggtccgacaataaaaaaatccattaaagactcacgccgtattattgatttttcacgtaatcgatttgaacctttttggtctctttttcgagacgatttcttgtaagattattttttataaaatgaatttttttctatttttatttaaagaaaatatatacatttgtttaaattcttatttctttagcaatttaaaaatgtccatctgcattggagacacaacaaaaagccgaagttgaagtgaatgaatatttacgggaccaaaaaatcaaatccagggccgatccatcattatactgggaagttaattcacaaaaatggccaatgattggtgccgttgtacggaaatttctttccccgcctgcaacaagttcagaaagtgagaggcttttctcaacggccggcctgatttcagatgacttgagaaagagtttacaggcggaaaatctggcaaagcttttgtttcttcaccataacttgcttctaaccggattttcaattgaatgattttgcttttataaatttgctttttaatatgctttaaaatgctttaaaagatttataggattttttaaa

SEQ ID NO: 58832 - DNA, 1056 bp, Heterodera glycines
  Genomic contig location: Contig_ID=SeqID_5664; Location=24..1079; Strand=+
  SCN-specific regions: Sequence locations=1-29,51-72,109-198,220 -241,278-305,331-416,453-536,558-579,616-699,721-742,779-1056
  Gene Ontology: Mol. function=transporter activity; Cellular component= Cajal body; Biological process=nucleolus organization and biogenesis
accattcctgtgaccaaggccaaacctccgacggtgtccgagtcgagcagttcgggagacgacgacgaagtgccggccaaaaaaccggcccagaaggcacagccggccaaagtgcctccgaaggcaccgaattttcttttaaattttttttatttgtgtttttctttagaccattcctgtgaccaaggccaaacctccgacggtgtccgagtcgagcagttcgggagacgacgacgaagtgccggccaaaaaaccggcccagaaggcacagccggccaaagtgcctccgaaggcaccgatttttcttttttttttttaattttttaatttgtgtttttatttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttcttttttttaatttgtgtttttctttagaccattcctgtgaccaagggcaaacctccgacggtgtccgagtcgagcagttcgggagacgacgacgaagtgccggccaaaaaaccggcccagaaggcacagccggccaaagtgactccgaaggcaccgatttttcttttttttaatttgtgtttttctttagaccattcctgtgaccaagggcaaacctccgacggtgtccgagtcgagcagttcgggagacgacgacgaagtgccggccaaaaaaccggcccagaaggcacagccggccaaagtgcctccgaaggcaccgaattttcttttaaatttttttaatttgtgtttttctttagaccattcctgtgaccaaggccaaaccaccggtggagtccgagtcgagcagttcgggagacgacgacgaagtgccggccaaaaaaccggcgcccaaagcacagccggccaaagtgcctccgaaggcaccgaattttcttttaaatttttttatttgtgtttttctttagaccattcctgtgaccaaggccaaacctccgacggagtccgagtcgagca

SEQ ID NO: 58833 - DNA, 141 bp, Heterodera glycines
  Genomic contig location: Contig_ID=SeqID_5664; Location=167..307; Strand=-
  SCN-specific regions: Sequence locations=1-7,44-65,87-141
gcactttggccggctgtgccttctgggccggttttttggccggcacttcgtcgtcgtctcccgaactgctcgactcggacaccgtcggaggtttggccttggtcacaggaatggtctaaagaaaaacacaaataaaaaaaa

SEQ ID NO: 58834 - DNA, 148 bp, Heterodera glycines
  Genomic contig location: Contig_ID=SeqID_5664; Location=667..814; Strand=-
  SCN-specific regions: Sequence locations=1-13,50-71,93-148
tcggaggcactttggccggctgtgccttctgggccggttttttggccggcacttcgtcgtcgtctcccgaactgctcgactcggacaccgtcggaggtttgcccttggtcacaggaatggtctaaagaaaaacacaaattaaaaaaaa

SEQ ID NO: 58835 - DNA, 86 bp, Heterodera glycines
  Genomic contig location: Contig_ID=SeqID_5664; Location=1006..1091; Strand=-
  SCN-specific regions: Sequence locations=1-86
cgtctcccgaactgctcgactcggactccgtcggaggtttggccttggtcacaggaatggtctaaagaaaaacacaaataaaaaaa

SEQ ID NO: 58836 - DNA, 1145 bp, Heterodera glycines
  Genomic contig location: Contig_ID=SeqID_5665; Location=95..1239; Strand=+
  SCN-specific regions: Sequence locations=1-72,109-235,272-404,441 -468,490-575,612-738,775-948,970-1073,1095-1104,1126-1145
  Gene Ontology: Mol. function=chaperone activity; Cellular component =Cajal body; Biological process=nucleolus organization and biogenesis
accattcctgtgaccaaggccaaaccaccggtggagtccgagtcgagcagttcgggagacgacgacgaagtgccggccaaaaaaccggcccagaaggcacagccggccaaagtgcctccgaaggcaccgatttttcttttttttaatttgtgtttttctttagaccattcctgtgaccaaggccaaaccaccggcggagtccgagtcgagcagttcgggagacgacgacgaagtgccggccaaaaaaccggcccagaaggcacagccggccaaagtgcctccgaaggcaccgaattttcttttaaatttttttaatttgtgtttttctttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttctttttttttaatttttaatttgtgtttttatttagaccattcctgtgaccaaggccaaaccaccggtggagtccgagtcgagcagttcgggagacgacgacgaagtgccggccaaaaaaccggcccagaaggcacagccggccaaagtgcctccgaaggcaccgatttttcttttttttaatttgtgtttttctttagaccattcctgtgaccaaggccatacctccgacggagtccgagtcgagctgttcgggagacgacgatgaagtgccggccaaaaaaccggcccagaaggcacagccggccaaagcgtccgctaatgtacggacatgctatcgttaattattacctatttgctgtttaaatttaagcccgtttcgattcaaaatggcaaggcaaatcccgtgaatggaaatgaaacggagtcaaacagttcggatggagcgcctccggctaaggcgcctcgaatggtccttcataattattattattattattattcgtaaaataggattatgtttttcaaggatctcgattcatggggtaaaaaggccgctgccgattttaatggggtcaagggaaagcgttttcgccacgagaaaacgaagaagaaacgtggcagttacaatggtgggaaaatcaacacttcggctaattcgatgaaatttgatcactga

SEQ ID NO: 58837 - DNA, 141 bp, Heterodera glycines
  Genomic contig location: Contig_ID=SeqID_5665; Location=401..541; Strand=-
  SCN-specific regions: Sequence locations=1-7,44-141
gcactttggccggctgtgccttctgggccggttttttggccggcacttcgtcgtcgtctcccgaactgctcgactcggactccaccggtggtttggccttggtcacaggaatggtctaaagaaaaacacaaattaaaaaaa

SEQ ID NO: 58838 - DNA, 260 bp, Heterodera glycines
  Genomic contig location: Contig_ID=SeqID_5665; Location=734..993; Strand=-
  SCN-specific regions: Sequence locations=1-125,162-260
gtttgactccgtttcatttccattcacgggatttgccttgccattttgaatcgaaacgggcttaaatttaaacagcaaataggtaataattaacgatagcatgtccgtacattagcggacgctttggccggctgtgccttctgggccggttttttggccggcacttcatcgtcgtctcccgaacagctcgactcggactccgtcggaggtatggccttggtcacaggaatggtctaaagaaaaacacaaattaaaaaaaa

SEQ ID NO: 58839 - DNA, 1262 bp, Heterodera glycines
  Genomic contig location: Contig_ID=SeqID_5667; Location=859..2120; Strand=-
  SCN-specific regions: Sequence locations=1-231,276-294,316-624,646 -1262
atgcgatcggaggtgggcaaaatcgcactggacacggtgttcaaggagcgcgagcagctgaacgtggcaattgtgggtcagagtttcggtttagttgttgtggaatttttgtagctttacgggaattacacaagagtttttattttcggaaaataccatcccgtaaaccttcaaaaaggtcaatggactgttgggttgtccaatatttcctctgtatttttacgttccgtcaaaaaatataatatttttaacttttttatttgatttttttaaatcttattgcagagggtgcggcccgcccccctccaccgccctttttccccgtatcgttcccccaaaaattaaaaaatttcaatgcttatacttttttctgaaaaggggtgagtaaaatgcatcccatttccgtaaagcctatattcatacagcttatccgtagaatgctgattagcttttggttatttcgtgattcttttttctttctcagaatccattaacaaagcggctgagccctggggcatggtttgcttgcgctacgaaattcgcaatatgaatatgccggcgaaggtgcaggaggccatgcaggtaatcatgttgactatttttgcaattatctaattaaattaagtaaataaacaattttagccaaactagcgaacttctttcagatgcaagttgaggcggaacgcaaaaaacgggccgcaattttggagtcggagggcaaaagagacgcggcgattaatgtggcggagggcgagaaaagggcgaaaattctcggttttaattcatgcaaaaatagtagattaaatctgttccgctcgtccgtttagcctccgaagcggaacaacaggagcgcatcaatttggccaagggacaggcggaggcgatttttcgggaggccgaggcacgtcaaaaggcactacacgcggtggccgaggcgttgaacaaggtccgaaccaaacactcaatcagttagcatggcgcattacgtaatccgacattttgcaccttggcgattgatggacttgtcgaaatactagtactcgtaaaacgggacgaaatgctcgttttgagctctattcagtcacttgggaatgactatgaagcttttttaccttttctccccagtttaggctggtggatcggatgccgcttctttgctggtggctgaaaagtatgtgaaagcgtttggcgagctggccaaggagaacaacactgtgctgctcccgactgacatgggctcagtgggctctttcgtctctcag

SEQ ID NO: 58840 - DNA, 583 bp, Heterodera glycines
  Genomic contig location: Contig_ID=SeqID_28195; Location=890..1472; Strand=-
  SCN-specific regions: Sequence locations=1-139,161-505,530-583
atggccgacctcgcctttctgttcggcttgtacggttttgcttaccaaacgtatcaatcgctgaagaaggaattcgctaacgaccaggcttgggtatgttatcgaaatgttcgaccagtgcttctcctttcgggttgcagctgcaccatgccggtgctttggaaatggccgcgttgtccagctttatgagcgattggaaactgttttcggatcagcctgacagttccacctcaaaatcaattgtctggctgaggaagcagtacccgcaacggtacgcagacaacgcaattcattactacgcaaatgtctgcaggtacaaattaaaaagtgaattccaattttgacggataaactttcaaatgttaatttgctgcattagggaactgattttaatacttgtggcccttttgttgcttaaaaactgggattatgaacagttcgtatccagaaaaaaaaattcggggaaggcacccaaagagccttttttttgttgttcttcgcaacgaaaaaaaataaatttaaattttaagcagaaaggcgaaagcgcaggatttatagcgattattcgttaaattgaaataaa

SEQ ID NO: 58841 - DNA, 478 bp, Heterodera glycines
  Genomic contig location: Contig_ID=SeqID_28197; Location=904..1381; Strand=-
  SCN-specific regions: Sequence locations=1-3,25-45,86-211,249-369,410- 478
atgggactggaggtatgtaaatttgaatttttaaatgcttaacgcaataattttaattaataaaatttcattttgtaatttttaagaatggacggacaattttgaaacgcaaggcgaaatgaatgaattgagaagaaagattaagcaaatggagaaccaaattgagcagctgaaggaaaactcctcaaaatgcgaaaatgtgttttattcgttttttaattttttatttaattttcatttttaaaattggggacttttccaattctaagaaccattggaaccccgaagattgtcaccacgaacttttccttttgatgcccaaattggtgaagattgtttgccgtggaaaggacgaatgtaaattacatgaatattatttttaattattttatttattttttgattttttcagtttatcgctctgtccgtgccaaatttgctcagtccgaaaaactcggaatcatttattttgaagtga

SEQ ID NO: 58842 - DNA, 415 bp, Heterodera glycines
  Genomic contig location: Contig_ID=SeqID_28199; Location=87..501; Strand=-
  SCN-specific regions: Sequence locations=1-200,222-415
atgaattattttggcttatttcccgctggcatttttgctgttcaaacaatgctgatgctgagcattctgttgtcattcactaatggcatggaaattaaagtgattagtgatatgcatcgtcatgcaaaattattgaccatagaggtgcaaaaaacggacactgtggcaacactgaaggcaaatattacggaaaaattgaaggaaattttcaaaaataaggacggcattcctcaggaagaattatctctgcgttactcggaagaattgaaggaaattctcaaaaatcagaccgatcccaaaaagcagaccgaccacaaacagcaaaaaacccccaaaaagcagaccgacatttcttcgcccgaagaacaatctctggcttactacaaaaaaggaaatgggcatattcttgaggaca

SEQ ID NO: 58843 - DNA, 1631 bp, Heterodera glycines
  misc_feature (14)..(14): n is a, c, g, or t
  misc_feature (1513)..(1513): n is a, c, g, or t
  misc_feature (1573)..(1573): n is a, c, g, or t
  Genomic contig location: Contig_ID=SeqID_28200; Location=1..1631; Strand=-
  SCN-specific regions: Sequence locations=1-175,204-497,676-771,814 -985,1015-1154,1186-1257,1309-1631
  Gene Ontology: Cellular component=mitochondrion
ttttttgcggaatntagaattaatacacacacaacacgctgaatttgcatggcttcacgagatggaattgggtccgatggttgcgcattgattggcaatacgccaatggtttatttgaacaaagtgtcaaaagggtgcgccgctaaaattggtgaacaaatttatgaaaaattttaccaattgtaaatttttgtttttaaaccgaaatttaaattcggcatcacttattactaaaaattataaaaaaaacatttttcatattgaagtggccaaagcgcattaaatcagaaaaagtgaaatttgtccaaaaaatggatatccaattcaatccgaatgtttagcagtaaaattggaatggctaaacccctcgggctcagtgaaggacagaattggcgtcgctatgatcgacgcagcggaaaaagaaggccgaattaagccggggatcagcacaataattgaacaaacggcaggaaacacgggcattggtcaatcaataataattaattaattaataatcgagcaattgttataatgactaattaattaattatcaaaatcattaattgatcagccatcaatttgtgctaatgattaattaatcatcaacgtaattattctataatcttcccaatcattaattgatcattaaccaatttatgctaacaattaattaatccgattaattgaagcactcgcctcagtggcggccattcgcggctatcgtttcattgctgtgatatcctcgtcacaaacaattgaacgtgtgagaagataaaatatttaaatttttaatacatttttatttaattaaaactattttcgataaaaatgggttaattattatgaaaacagagaacagtgttacgtgcgcttggtgccgaattggtactgctagacccaaaattgggcttcaacggcgccgtagagcgaacgaaacaattggcacgagcaattcccaattctttcaatcccatgcaggcacaagttttaaaaattcaaataattaaataaattcattactcaattaaatttattcaagttttgcaatgaggcgaaccccgaaattcactatcggacaacggggcctgaaatttggcatcaaacgcagggaaaagtggacatttgcgtatttggaattggcaccggaggaacggtaataaatgaaaatattttaataaattatttgttgttttttcattattaagatgacaggcgttgggcgttatttgcgtgaaaagaatccaaacataacggttcttaaataaattataaatgaatttattaaatttaaatattaaaaaatttaaagtgctatcttcgttcaaaactcaaatatttttactcagcaaaaatttgcaagttttaaaatttagtgactgtgaccgcctaatttgaaaatagtttttttgcaaaaaaatataaatctatgaaaattcagaaaattttgaataaagaagctcctattcttttttttatctctttggattttctaagcctaaagactatttattanttttagtgtgtttgataaattccagagactttaagcttccgagtgacacaatataagctntttctcgccatttggacacataaaaatcaagaaacaaataataaacttactatcgaaa

SEQ ID NO: 58844 - DNA, 1249 bp, Heterodera glycines
  Genomic contig location: Contig_ID=SeqID_5668; Location=663..1911; Strand=-
  SCN-specific regions: Sequence locations=1-218,241-337,359-422,444 -465,487-539,561-717,739-878,902-928,950-1014,1055-1090,1112 -1191,1226-1249
atggttggcgtttctgtcggcttggcaagaagcggaagcgctggcggcatgatgtacttcgaggtggccgaagccgaccctttgaacagccactcagagaggggaacttgcttcttcacgggcggtggcggctctctcgacacttatgcattgtgttcgcagcagaatgcatacggcgccggtcagagtcgcgggggcggggtgagaaatttctcgcccccgggaacgggggcgggggtttgtttttaattagctccaaaaaatctcacaaaaaattattttttttttgaatgatgtgtttggctccacattcctttattcgatgtatcgcctcgattcaattcttttttggtataattgcacagatattgtctaaaaatgaccaaatttaaggattataaattatgccagaatagtcaatttttatgggtgtttttgtctaaatccagggtttctatttcaaaattttcaaaataagaataaaggctaaaaaaataagattttagggtcaaaaataagaacattttgcaaaattgcttcaaatatttttacattttattcgatcaaaaatgtattctattattattagggcttcgatttttaggtgctaaaaactgccaaaataagtaggttttaggttctaaaaaacccccaaaataggtgctaaaaatgggaaaatagaagccaaaaagttccgaatttggggtgtaaaatcgaaaattttctcaaaaagcaaaaatattatgccaaatcattaatgagatagcatttttgttaacaaattttgggcaaaacgccaaaataggtgaaaataagtttttaaaatttttaccacggggagctcaggaaaataggtaaaaacctaaaaatcgtatcactaattataattaattaaaattaacaaaacgccacacaaattcaaacacggacacatacatacacacactcagctttattatataggaaaattgattgtatcagcttcattaaatggtgttttttttctcatttttgtatttttgaattaaaatatatttttataatttattaaatagtgcgttttgcattttctgatttagcttcttattcttttaaatattgttataaatatatgaatgtttaaaaatttgaaaatcgtcattcgagattttgttacattaattaaatgtaattttcttcgtgtcataaaccaaattattatgaattttttttattaaatttttatcattaatgcatttttgttaataaa

SEQ ID NO: 58845 - DNA, 991 bp, Heterodera glycines
  Genomic contig location: Contig_ID=SeqID_5668; Location=2731..3721; Strand=-
  SCN-specific regions: Sequence locations=1-78,115-444,468-479,503 -573,604-776,798-991
atgtcgcacaacccgaaagaagctgagagtgaaatggaaaaagcgatgtaatattctaagttggatgcccatggcttatcattttgcttttccgttttcagcttcatctctgccgattgttggctcggtgttttcgatttgcttgagcctttacaacttggcctcggaattgcactgatcagccaccgttttgactattacgtgaacgtaaattcaccgatttcaattttttcgtcgacgaagcgctggggaaaaaatgcatgaaaatgtaagttgaataaccaatttaaatgaaatataagatacgtaatactggagaatctggattccacccaaaattttttttgttatgaagactaacccggggtttttggggcttctgatcacaaaatgatatcagatttgcaaaaacaatgatttacaaaaagggtacaacattcgatcatattaataatttttttttaaatctgattttcaaaatcaaataaaatgatttttgtttaattttgtcggcgagtttatgccccggcaaagtttccgcaggcaaagtttgaggtgaaaaggcggagtactccccccccccccccccccccccccccctccaagacgagactaaaatacccctaatttaaaagactcttgttgaaaattttgtctttttgtgttgcttagagcactaaaatattagaaactttttcgggaattagagcccggaaattttgaaatgtcatggcctgaaagtcaacttgggcgcgactcccaaaatgagagatgtattttctctgcactctctttttatttcgggacctgaaaatcgaccaaggcgggactcccggttgctcgggattttgtcaaaataaaagcccggcaccagactaatcggcaacaatcccgtcggcagaaaatttaaattttatttcagggtggaagggaatacaacctcctcccccttctcccgaccctcgcttgtctttacgtatcattctcctag

SEQ ID NO: 58846 - DNA, 888 bp, Heterodera glycines
  Genomic contig location: Contig_ID=SeqID_5669; Location=846..1733; Strand=+
  SCN-specific regions: Sequence locations=1-182,208-655,677-830,852-888
atgcttccaatggttttcggggtcgctgatcacgaatcttgcatccagttcgaccaattccgacagctctacgtatcctctattatttatgtaatttctaaaaaattagtaaaaatttactaaaagttgtaactaaaaaagcgggaaaaatttagactcaacaattttgaccctaacttttttgaaattcaatataattttttgaaatttaactgaataatagagaaatctttgggctatcttttcatatcaattgcgggtgtaaattaattgatgtttgaacaattttcatacatttaaatttgaggatttccttgaattagaaattaatttaggcccgatactgtcccatgctttttatggtcaattaattaatgaattagtcccttgctcaattaattaacggtgggggtcgattgggcgccgaccagttgggcgccaccctgctttttgaggcacaactcctttcatagttgaccgaactgaatgtatttaatatcattcaataggtctaaatgttctctattagcatgctaaattccgaaaattttggtcaagtttcaaaaaagttatgcacaaaaatattcggaaaaccgcttttttgaagttttttgtccataatatttttgaaacttgacgaaaattttcgaatagagaacatttaggcctattgaatgatattaattaaaggctcgcggtcttttggacagtggacatttggacagtggacattacgacagtggacatttggacagtggacatttggacagtgaagtcatttggacagaagtggacatttggacagtggacattacgacagtgaatgcaaattttttactgataacaaacttttgcaaacatatgctaattccaataactgaccattaa

SEQ ID NO: 58847 - DNA, 302 bp, Heterodera glycines
  Genomic contig location: Contig_ID=SeqID_5669; Location=2124..2425; Strand=-
  SCN-specific regions: Sequence locations=1-78,144-302
atgtgcaaaattagcactagtgctgactttcagttcgtttccgtgtattcaaatcgtggtgagccgaagtgacaaatgaatttaattaagttattttaattttaataacttatttaattttttataaaattagtaaaaatttacaaaagttgtaactaaaaaagctcaaaaaatttagactaaacaattttgatcctaacttttttgaaattcaataaaaatttttttgaaatttagctaataatagagaaatctttgggctatctagttatataaacaagattaaatttggttctttctga

SEQ ID NO: 58848 - DNA, 788 bp, Heterodera glycines
  Genomic contig location: Contig_ID=SeqID_28202; Location=207..994; Strand=-
  SCN-specific regions: Sequence locations=1-105,128-605,627-788
atggcagcaaccgatgctcaaaaagctggaggatgttacgggaatggaccgtgtgaaggcacgaagaaaacatttaatgcattcttttttgtaattcgccatgcttttcagcttttctacgttttctgcgctttcgtgatctgctggttggtcatgggtcctggcaaccaattcctctgcaatttgatcggtcagtcactaactgcttgagcaacgatcatcagcagatgctaattcgcttgtccttttttaggtatcgtttacccagcctatcagagtgtgttggctgttcgtacgcagacaaaagttgagacattccctcgccaatacgcaattttcattttgcgatgcaatttcagatgatgacacccaatggctgatctactggtgctctttcgctctgttcatcttgttcgacttcgttgtgaacaccttattgatatccaacatgataccactttatctgcttctgaagactgctgctctgctgtatttggcacttccgcagacgtacggggcacacaatgtgtacgtcagctatgtggacccgctcgtggattggattgacgaaaatggtacgaaactctatcgtgcggagacaaccgctcaatgaatgaggaaaatgttcccatgtgtttatggacaaagtcaagcccagtgttgtattgtatatttgtttaggcatttgtcccaatggtctatgtatccccattattattctttgacgtcgttatatgatattcatatacatgcagtcaaatatcgttataattctgttgagaattaaa

SEQ ID NO: 58849 - DNA, 602 bp, Heterodera glycines
  Genomic contig location: Contig_ID=SeqID_28203; Location=439..1040; Strand=+
  SCN-specific regions: Sequence locations=1-60,83-473,502-602
atggctctcattattacgccattatttttagttttagtcgagtacgatttaattttagaaaacacaataacattaaataagatgcgttctcatcagtttaatttacgccaactccgtaagcctttccgaaatgtcgcctcaactaacagtgaaggccttcgtcatcggaacagcatcgtcgggccaccggtagttccatggacatcgttggccttgttggcaacagcacctccaattgttgcgcctgaagatgacatcctgaacagtctttttgctcaggttggaggaatgccaactttgaaatccaccggcaccactgttgaacttgtgcggcgccgttccttttcttgtggttcaaattgtgcaaaatgcggttggtcctcttttatgagtgcatttgaacaaggcatttgtaattcatccaacttcaggcaaaccattgcgaaggactccgaccaccaacggttggtttcattttttgtaaattttaattattattttgtttgcagacaactcaaagttgctctactgcaaagactgcaacattatcttcagcagttcttcttcgaatgacgcgtcgtccaagaaattcaacattttga

SEQ ID NO: 58850 - DNA, 381 bp, Heterodera glycines
  Genomic contig location: Contig_ID=SeqID_28205; Location=147..527; Strand=+
  SCN-specific regions: Sequence locations=1-283,306-323,346-381
gtccaggcctggatccaggtcccgaggagcctggatttttcctggacctggatttttgtccaggaaatcaaggtccaggtccaacatggaatctaggtccaggtccaggcttttttcaaaatgtcgatctctaataattttcatgcaaacaaaaatggttttttggtacttttccattttgctggcataaatgccacagtctgaatctaaatttcagcaaaggtttatgaccaaaatgaaaagggtaatatgtaaattgccgatggtccccactttttggaagaatttattattattatttttatgggatgttttcagagttctgacatttattttgccaatttcgagtctctgaccctaattccaacaaacaatctaaaa

SEQ ID NO: 58851 - DNA, 474 bp, Heterodera glycines
  Genomic contig location: Contig_ID=SeqID_28210; Location=1429..1902; Strand=-
  SCN-specific regions: Sequence locations=1-73,95-149,181-404,427-474
atgacgaggagaaggggaacagacggcccgacgggagaagacgcaaagtgccaaaagtggtgagaaaccagcaaaacaattttcttccaaaaaatttatcaaaaaatatatttttcccattcgttcgtcgtgagggggggggtcgaagcgggaaagaaaaaattttaaaatttgagcaaaaccccttagcaaaattcatttaaaatttcaaaaaaaatttccccagcggtgcgtaaaaatcctaatttttcttttaaaaaaatacgcccaaaaatcgcaaaaattggtcagttattggacaaaaactattaataaatcgcaataaaattacgtcccgagaaaattttcattgtttttcagccccaccgttgtgacaaatgcccgatggaatttccgaaattgtggaatttcaaacggcattaccgtacacattctgacttcaaagcattcgaggtaaaagtagctaacaataaa

SEQ ID NO: 58852 - DNA, 5220 bp, Heterodera glycines
  Genomic contig location: Contig_ID=SeqID_5670; Location=945..6164; Strand=-
  SCN-specific regions: Sequence locations=1-371,403-404,447-490,513 -1086,1108-1239,1265-1487,1510-1872,1896-2675,2697-2780,2802 -2980,3003-3612,3634-3756,3778-3992,4014-4071,4093-4428,4460 -4624,4663-5088,5110-5220
  Gene Ontology: Mol. function=phosphatidylinositol 3-kinase activity; Biological process=hermaphrodite genital morphogenesis
cagatgagacgaaacaacagcaaaaagttgagacggatgcagaagaagggagggaaattcaatcgccttctcctgcaaaaccaaaatattaccgaccattggatgcaactgatttagaccaattgcaaaatgtctatccaaaaattgtcagcgaaatatgtggttagtttttcattaaataatagtgtaaatctgcaataaatggcattattttttaagaacttatttcacaattgaagcattcaaaaattgaatggagcaaatttaaaagtgaggaaaagcggattatggttatgttgtgctcagtaaagcaattgattaaagtcaaaaactcgattttcttggtgagtcagtgatgttttttagggaagaaaatatgtaaaaaaaaatattaaattaaaaccaaaaaaagaaaaaaaacttaaaaaaaagaaaaagtaaaaaaacaataaacttaagctacatggtcttcaaccaagccttttttcgctgtttttcggtcttcttccctttgccgaccgatgggttctgacatttttgccgaattttcattatctgttgcttcaaatggccaaggaatttgcattgacgtaagctttttcacactaacattttttactgtttttagtcattttggtttttaggcatgaccattttttccacaattgtgaaatttttcaatccggcttttccgataaacaaaagtcaaatgtcggtacgacagctccgctgtctttctcaagcagcgtcagtggcaaatactttgccaaaatcctcgattcactcgccgaattattccgtttctttaatatattacaaaaccacgcgcaagcgacactaatcgattggctttccaaaatttcgaatttggttgttgagcaattcaaagtagtctctgaggtttcctttaattttttgtgtttagttaatttaaattttctttttgttcagcttcgtgaaatgtttgctttgcgttcttcgcttttgctcgttccattcttttcgctttattccataaaatcgttcgaaatgcgaaagagtctcgtcaagtgtttgtacaggtcggtcttcgttgactgatttttctttaatttgtttatttattttagaattcatgtgttcaatgtcctcctttctgatgagccatcgtgtaaaatactttcccaccaatttattgccaaattgcgtgagtgtgctgaacatctcgaagttgaacagttccgtactctgtggaatcgcattccgatcacatatttaatacggtttgtatatctacatacttttttcattttttttgtttagaatttctgaaatatcaacgattaaatgtctctctttcttggaaattgcgaagagaactcaaaagttgcttggaaaaatgtgcatggaaccgaatgaatttcgatttgtgactgatttcctcttcggacgcaagcgcatttccatgttacaagacaagtaaattggtcaattttcatgaaaaaaacaaattattgttttgttattgcagttgttcgcctcaaaattggcttttcatttctggacaatacctttttgaaagtttgtcgtgcactgctaatgacaagtcacagaaagcctcgacaactttcaacgaaaatgccaagcaaaataaccgaatcggtgacagcgcatctctcctacaaaaatggttgtttattgttggccaatttgcacattattgtgccgttaatcgaatgaagacgccaattgggaagacaccacttgaaacatttactaaattcgaaggtccgtttgacaaattcccctaactcctcgaaattatgcattttccagctcaattgcgagcattggcttcctcttctacttcacaactgattgcttcgcgttcaaaaaatttggcttcaaatgaaaagggaatcatttcatattccaattctaatgatgatgaccacttatcaatgaatcaatcgagtaagtaacggaataaattacagtaatgaagcttttgaaggcggtaactgcggaaaggaacaacggaatttgtacccggaggaggaatggttccgcgttcggatgctcctccattgcattgacatggtcgagaaaatgatgtgttatgcggtgcgcgggtcgatgcttaaaatttacgacgaacttccattggtaatgctgaaacatcaatgattattgttcgataattgcctcttatttcagaatgcacgtcaattcttttccgtcaacttcaaaacttgcatggattggctgttccgaactgcacttccactaatgagcactgcctatgccaacggtcattatgctcaaattgtccgatttggtggttttcttttcgccgaactcgagcggaaacacccttcaaatgcttcgaacggtctttctttttttgtgggttttaaaatactatcatttgcagatacgaaaatccggcttgatccttccattcaatttgccattacttgggtcattcgtgctttggtcaggttaggcgcaccacaagcaatccgcggggttcaaaggttttccgagacaatgtttggacctgcggttgatttttcgtggtgccattatgccgaattacttgcatcggcacggtatattaacaataaaaggtgtatatggaaaaatgtttttttttagagttgaggaagcactcgatggatgtttaaactttttgaattgtgcaaagcaatccaaagagaatgttccgaaggttcgtgaccacgtgttaaatgccattgacgaattggcactgatggccgctgggattttacgtctcccacaagctgaaacaaagttaattgttttgcgaattctattgtattgtttaattaaagaattcgcgaagcaatcatcgacagagaagaagttaaagacgacgaaagcggagagagcggtgccaaaatgactgcgcttttttcacttcaaagctgggagaggtgggaataaaaccttttttataccgatgtagtaataagtccatgccttttttctcccctttttgccagtgttttgaaactctcttcctgggaccaattggccaattcggctccgtacacttcgcccactcagttgaccacggagaccaaaaatgaaagttgggctctgaacaaccatttattagagacagaggcgaaaataatgcgcattttcgaaatacggcagaaaaattcaatcggtcgccaaaataccggggaaatacttttttcacaacaggtaaataccatcttgttataatgcggtgactttggtaatcgtttaggatgagctgagtgatttggcacaatttctgctgtgtggtggccacgaaaacagcgacggacttgcacattcgaagttggccattcttcacgcaatttgcactgggattcagcatttgaatgtaccgaaccaacagtaccacgtacaaccagctcaaattcagcagcactttccaccaaagggccaacaaagcgccaagcaaatgatgagaagcccaccaaaatactccgtttcaacgccggtatttttgcagcattaatcatggactctgattaatatggttttagaattactaaattttatggtactatttagattttgctagaagttgactttgctgatctgttgcacaattgcaactccaatgctttgcatagtttggaaattggtcaaatgtattgcggatggatgcacagattgtacggagcgcagaaggagcacagttttgtgctgaagagaatgcatggacaaattgctcaattagttaatttggaaaagttttatataaaaaaattttttgaattgatattcaggcccaaaaacttggaaatccaaacttggccaacacgcattttcgactctcagttcaaaacggagggacccaaaattcgtggccaattgatgatttgtatggaaatcaaatgcaccggcagctagacattttgccagaatatcaattgccaatgggaatttcaaatttgtacatccaacaacaaacccagccgcagtttcaggtggaacacatgagaaatgcaacgaaaattatcttttagtcaattccgcctggcttcgagtcattactcggcaatcaaccttttcaaactgaagatgctcacaatcatttcaccgtcaacaatatttccttcacggctcctgcgacccctcaagcgacgaagagtctcctttctgaggactttgacggtgattctcttcgtttgttgcccaacgaattagccatcatgcaacaggtacagtttatttattcactttgtttatggctttcctttctgtgaccaaccaacttttccttttagtttggcattgacatttcctctccgcaaggacgtcactttgaggagttaattggaagttgctcaacttttgaagagttccgttctcaaatagtcgaacattttcctcttacggatgtttccatgaattcgacggcaattttaatgtatttatttgttttattaattttcattagggcttaaaagggaaatttcgaatattaactttttaagcaatttatacattcttttaagggtacttgaccagtcaaacttcactcaattttggctgtccatcaaacaccgtcaataccgtctctatgaattggcattgaactctcacctgcgtttccttgaaaatttggtaattatttttataaattttcattttcaattagtattgtttattgtttgtattaatttgtttagtcctcagaaaaaagttacgtacaaactgcggaagtgattctgcgattcctgaaaatgctttctcgtcaacctgaatggtttcaacgaattgtgacttttccggatgataaaaccgccacttctgccggcaataattctgggaaaaaattggcatggatggaccgaattcctgtcaacgtttggactggttattctaatttcgcctcattatttaagtgaattcttttctcttcaaattaaatgtctaggaatgatcccacaactttttgcctgtctcaaccattcaaattccattgtggtcgatgccattcacatgcttttggagcaaattggtcaaaatttgcctcacgtcgtttgctacccggccattgtcattgctggggcagcggatgaaaaaggtggaaaataaacacataaaaattcggtaaatttattttgctgtttagccaacacaatgccattgctatcggagttctcaaaagaaaacagcgaaagattaattgtaatttcaatacatccatag

SEQ ID NO: 58853 - DNA, 434 bp, Heterodera glycines
  Genomic contig location: Contig_ID=SeqID_5671; Location=4..437; Strand=+
  SCN-specific regions: Sequence locations=1-434
gtctctcatgattcgtccattgctgtgattgacaagtccaattctcaacctcaggaaaggccaattcagcacaaaactgcctttttgccgttcacttctgtccgatgggtcaatgagacgcatattgtgacggctgtcagatattccgcttttcctccaacacattgtctctgtctgttgtttagggtcacgactgttccccaatgcttttcactttcgacgggacggcgttgaatttgaaatgcaaattggtcaaaaacttatatttgatgcttaaacaaaatgccattttaggatgtgccgccagaaagtaaaaacggttccaacgtgagctccgctttcgccatgtttcgcagcatcgacaaaaaggcgttgtccgccgactctccgttgggttccaccgcactgaaaacgttgcatcaaaattcgattat

SEQ ID NO: 58854 - DNA, 695 bp, Heterodera glycines
  Genomic contig location: Contig_ID=SeqID_28212; Location=583..1277; Strand=+
  SCN-specific regions: Sequence locations=1-168,303-329,379-394,456 -486,508-695
atggacaaaaatgtcgcttggtggtgctgcaattgttgggacagtggaaaaagtgttgacgaagatgttgttggtgtacagcaacaacatctacaactaccacagcagcagatgttgctaagcggggcaaaacttggacaaaagcgctcattacaaatacaaattgagtttaaaaaattaattttaataagagtaaataattcataaattttaattaatgatacttcaaattataaaaataattttaaaatttaaaaaaatattttgacaatgttaaattaattattattatttttaaatttgataactcattacgaatagaaattgagtttttaaaaattaaactttaaaaatataatgaattcaaaaattttaattggtgatccgccaaacgaaaaaaaaatattttaaaatgcataaaaaatatagtgttaaaattattattatcatttaatcgaataaaattatgcctagattagcgaaaaataaatttcaaaattaaatttcagagccaaatttattccaaagggacaacagaatttacgcgcttcaagacaatgccatatttgatgaccaagaccaacaacagttgtataacagcagaatgtaagaatttttagtaaaaaatgtggcgaaaaataattttaaaaaactttcacttattctaatatttataacctaaatataattaatta

SEQ ID NO: 58855 - DNA, 111 bp, Heterodera glycines
  Genomic contig location: Contig_ID=SeqID_28215; Location=1..111; Strand=+
  SCN-specific regions: Sequence locations=1-111
gatcactcccaacgaaatgtgcctggcacggacagtgtgatttctatgcccggattgaccggctcacacaaacaatgaaaatgagtcaatgagatcatttggagttcattt

SEQ ID NO: 58856 - DNA, 45 bp, Heterodera glycines
  Genomic contig location: Contig_ID=SeqID_28216; Location=272..316; Strand=-
  SCN-specific regions: Sequence locations=1-45
atgaccgtttacgagtataaactttgcccggataaggagattaat

SEQ ID NO: 58857 - DNA, 112 bp, Heterodera glycines
  Genomic contig location: Contig_ID=SeqID_28216; Location=34..145; Strand=+
  SCN-specific regions: Sequence locations=1-112
cctgcatattttggaaaatacaggatttacaggatttgcaggattaatcctgccggatcctgtcctgtaaaaaattttgaattccaatcctgcaacaggacccgcaaatttg

SEQ ID NO: 58858 - DNA, 207 bp, Heterodera glycines
  Genomic contig location: Contig_ID=SeqID_28216; Location=382..588; Strand=+
  SCN-specific regions: Sequence locations=1-207
atgaataaagcgtttgtcaaagcagcactctgctccaaatcgacgaatgtttgcctcttcaaacgcctcgtcagacccgtcgtccaaattggctcccgtccaatcaccggcgccggttttggccatccgatgaccaggcaaaagatgcaaatgtacagcccggaaatgagggcagtcaattaccaacagaagcgcacccacatgcat

SEQ ID NO: 58859 - DNA, 512 bp, Heterodera glycines
  Genomic contig location: Contig_ID=SeqID_28219; Location=762..1273; Strand=+
  SCN-specific regions: Sequence locations=1-425,448-512
  Gene Ontology: Mol. function=adhesive extracellular matrix constituent activity; Cellular component=collagen type XI; Biological process=morphogenesis of an epithelium
gtggcctttggtttttctgccaatttaaaattgttcactgtgacggccaaaggagaaaagttttgaggcgaaggcggcaaaggggcgaatgctttcagctgctggtcgactttggaattgggcagaagaaaggaagcgattggcttaagaaggcattcttttgttggtcagatgtgagtgattgtcttaatggtcgtttgtttgcctttgcctctcctccgactgaattcaattcggacggacaaggacagaatttggcgtcggcgccgtcctcgcccggggggcccttctctccgcgctgccccggctttccctccaatccgtctaatccttgcttgccgacccttccgtccggtccgggcattccgatgacaaagtttcgttttcctctctcgccttgtttacccgtctgaccgggcggtcccttcaccccgggtaatcctgcaaattcagccctttattttatttaggcgtttttttcagagggttatctttgcactggtggacctgca

SEQ ID NO: 58860 - DNA, 984 bp, Heterodera glycines
  Genomic contig location: Contig_ID=SeqID_28219; Location=290..1273; Strand=-
  SCN-specific regions: Sequence locations=1-65,88-711,734-740,762-900
  Gene Ontology: Mol. function=adhesive extracellular matrix constituent activity; Cellular component=collagen type XI; Biological process=morphogenesis of an epithelium
tgcaggtccaccagtgcaaagataaccctctgaaaaaaacgcctaaataaaataaagggctgaatttgcaggattacccggggtgaagggaccgcccggtcagacgggtaaacaaggcgagagaggaaaacgaaactttgtcatcggaatgcccggaccggacggaagggtcggcaagcaaggattagacggattggagggaaagccggggcagcgcggagagaagggccccccgggcgaggacggcgccgacgccaaattctgtccttgtccgtccgaattgaattcagtcggaggagaggcaaaggcaaacaaacgaccattaagacaatcactcacatctgaccaacaaaagaatgccttcttaagccaatcgcttcctttcttctgcccaattccaaagtcgaccagcagctgaaagcattcgcccctttgccgccttcgcctcaaaacttttctcctttggccgtcacagtgaacaattttaaattggcagaaaaaccaaaggccacagagaaagaaaacgcaccgacgacgcaaaagggggcaaagacaacgacagtttatgagacaacagcgaaaaggacgacaaattacgcactcggagaagggacgacgaacggcacaacttcagaagacatagtgacaacgaaaacgacgacgacgccaaagacaattcaaaacacaaagccaaacgaaggaaatggacagcaaaattcaaatttgaaaattggccatttaaaggcgggggaaaggccaaacggacgagaaaataggagagagaaaggacaaagtgagcaaatcacagcaaaaaagggaaagacaaagcacaccaattaagacgaggaggacatttacccaaattacgaaagtccgaacgaagaaagggcaaagaacggagggaaagaggcgggagaatacgacgaggaaacgacgaatggggaggaggaggaacgggagagggaaggtgagagagagagagag

SEQ ID NO: 58861 - DNA, 1017 bp, Heterodera glycines
  Genomic contig location: Contig_ID=SeqID_28221; Location=176..1192; Strand=+
  SCN-specific regions: Sequence locations=1-324,346-699,722-1017
atggcaattccccagtacaaggaccttcccttcggaggaaagacggtcattttcagcggtgacttcaaacagtcactgccggtcgtgcctcatgaaggcataaccgcacaagttacggcctgctttcaaacttctccgttgtttcgtcaattcaccacaatgaaactgaccatcaaccagagattaggccaaggccagcaagcgtacttgcaaatgtgccgccaaattgggctcggagagaccggagaacacttctggattcctccgcagttcatcgtaaagagcagggaagagctgataaactttgtttatccaaactttcaacaactccttggcaatgaaaaggagctgctcaaccgtttgatactcgccccgcacattgatacgtgcgacgaagtcaacgaaatgatgatggcgaatgtgccaggtcaagtgcgggaatatttgtccacggacaaacctcttgacgatcgcccattggacatcgatgagatcgagtccgaagtggcagcattgaacggacgcacagactctgggatgcctccacactgtctgcgactaaaggtcggaagcgttgttgtcctccttatcaacaaaagtgatagggaagggctgatcaatggcacacgcattgtcctcgaagaacttggcgatgatcgccttgtcggtcgtgtaatcaatagcaatgctattggtggccaagtgaggtttttccttgaaagatctcgcaatgtcttcgaggacaaaacgcctggtgggctgaaatacgagcgtttgcagttcccaattaagcctgcattcgctatgaccattcaaaaaggtcagggccaaacaatccgcactgtcggcattgacctggaaagggaagtatttacccatggtcaattatatactgccttttcaagggcaacggacggcaacaatgtccgtgtgcatgctccaaaaagggagatcgatgcccaaggtcaagcgaaagtgctgaacattgtggccaaaaacatgctcaaattgcaataa

SEQ ID NO: 58862 - DNA, 621 bp, Heterodera glycines
  misc_feature (593)..(593): n is a, c, g, or t
  Genomic contig location: Contig_ID=SeqID_679; Location=4211..4831; Strand=-
  SCN-specific regions: Sequence locations=1-621
atggagcctacggacgacgagcaggaccacggcaacgacggaaatgagcgaatcggtggctcacccacaacacaaatcggagcaggtcagaagagtgcaaaaaggggaaaggacaaacagaaaggagtggaagcatcgacaactcaaagctgttcgggcactcagcccggagggacgcgaaaccttcggagcaatggcattgccatacgcgccattcgggaccagttggaaagggcatcgggccctctcgccgatcggatcgcggaagcacgggatttgctcgatccggatctcaacggagacaggccacagacagcagtctgtctctcggccatggagaggggactgcgggaattggtcgacattttcaagggccatttcgatcggggcctagcgacgatcggggacgaagcgccagagctgcacgactacctgtacgacgcgttcacccggccactcccggccgcaacgagatgtttggggctccgatcgcacccgcccccagctgaactgcttcaaatcgcgatggagcaccttggtgatctgcggacggtccgacgaacgctcgaggacgggaaaagttatcccagctntcatccgggacccgatcgggaaccgtag

SEQ ID NO: 58863 - DNA, 2427 bp, Heterodera glycines
  Genomic contig location: Contig_ID=SeqID_679; Location=1614..4040; Strand=-
  SCN-specific regions: Sequence locations=1-925,947-2427
atgcgaagcgtcgccaaggtcgcccagtacccggtcttaaacgcaggaggaaacggagccaacacttgggtcaatcaggccagcgataggagggaacggactccctccccgcacatccgacaagcgggcaatcaaccgcgcccgctgattccagaacttccaattgcggggaatccaaatccctgcggtcattttcggatacccgaacaggtcaggggcagagacccctcagttctgcgaaccactcgacgtgacgaagagacgacagtattcgaaaccgtgcgcctccagccaccgacattctcgggacaaccggaggattggacgacattttggtcgtatttcaagcgggcagttgacgacaagcccatcccgggcttcgaaaagcagcttcttctccttcgctgcttaaaggagggatccccagccaggagggctgtcgaggtctaccctccttcggacggtaactatcccgtggtcattcaattgctgaaagaacgattcggagacacggatgatctgcagcgggcaatccgggcccagcttctccaccttccaccggccacagacaatgctcaaagcctgaccaccgtcgtggacgagttcgaacgcggagtgtgccaattggagcaactcggggcgaatgtggaggacgcttccttcatgccactgctcgagtccaagctgccggttcggatcctgacggaattgaggatccgggaaagcacgagtggaacgaaatggtcagttcgggaatttcggagggcggtgggcgcccaagtcaggtgcatgcgcgcggcagagtcagctttggcggcaatgcgcgagccggagcgccgaaccgaatcaagaccggaacaaagccgacacgccgaagggacacagaatcgggatcagttcccgagggtgttcatggtcagaagcaacccctcatcccaacgacccataacacctggggcatccgcccttcggaccggaactcacgcgccacaccggaaagtggctgatcggaaccggaatcgacttgcccaatctcgtgggccggccccaactgacaacggctgttctctatgccaaaattggggccaccgtccaagcaattgcccgacttatcccacgttccaagaacgacgacaacgtttcttcgagcaacggcggtgtatccgatgcctttcttctgatcatattgccagttgctgtccccgcccaaaagcatgccggtggtgcctgcgcaacgaccatcactctttggtctgttgggtcggaccagggaaaccaatcgcaattcgtgagccagcgggaccggaaacccgcgaacacattgggtcgaaaccagtggaaagtgtggtcgagccgagaacccattccggcctgctcaagccgacggacgcgacggttcagcctcaaatcgtgatcggaattcgcaagttttgggacttggtgatcggattcaaaatatcggccgagggggcctttcttgtcgacacagtgttcgggaccgtactttgcggagagcatttcggggcgcccttggggcaatcagtgccccgcgacaccatcctcatggcaataagcggagaagaaaacagatggaaccgcatgccagcctcatcgggagtggaagcagcggacaaatcgaaaccgtccatttacgagaacgatcgtctggggattggtcccctcaacccaacgccaaagaacccgcgcgatcggaaggaccctccgcatgtccagcccgagaagcgatgtagggtggagcagcaacggaccaaatgtgagttaccggaatcggaccaagacggaacaacagaaccgtgcgaaagaggcctcagccagtgcttgctcggggcgtctctgctgtggaaggtgatgacatgggtgactcggcacccaattcgagtttttaatcgtttgacgggtggggacattcccgagccgaccgccgatcaggtcaaaagtcaagaacgagtgcaattggccagacgagcccgcgcagccgctagagcttggagaaatgcagaacgaggacgggcatccaggcccggggccgccatggcactgcttccgctgctttgttttgtcgcccttttttcttcatcggagcccatgtcggtgatgctccgctcggaggactgcgcaagcacgccatcgggattcaaatgttccggatccgcggccatgatcatcggcccggaagtcggtgaactcagggactcagtgaacggcatcactccaaaggggattggtcccctgtgcctcttccttcaatgggatggtggcatttcgactgtggctcgtccttggcccgcctcgccgccgcccccaatgtcgcgaaagcgacgagagaaaaaggatgggctttggatggccgggattgttcccggcggactgaaggaagcagggggcccgatgccaaacagtgattaa

SEQ ID NO: 58864 - DNA, 1247 bp, Heterodera glycines
  Genomic contig location: Contig_ID=SeqID_681; Location=2711..3957; Strand=-
  SCN-specific regions: Sequence locations=1-399,422-676,699-792,814 -1247
atgattcgtaataaacttgaatgtctacaaaaaagtcggaagaagctttatttgttagacatttcaaacccaactgaggatgccgtgaattttggagtgtagattgacgaaccgcatgccgtgataacttccgacaatgttgaacaacagagtttgaacgaggctgaactttcagcaatgacctttgagcacggaaaaaccaatttcgggggagattgtctatggttgaacggtaagtttgaagtaatgcaaaaaatttaatttccaatctattcaggacttgtttcacacatctctcagaaaatcgctggagtcaaggcgacagaaaatcaaagaaagtgttggtctcgagcatttatatggcgagaagacagaatatgttgaggcagttcgcaacatattcaggtaaaaaataagatttagatgtaaatcataattatttttccagagcggttctctctttgccgcttttgccgtccgcaatatcagaagagctttctcaattatcttggccgtcttctcctcttggaatgccagtgttcttcctttacttctctcgaacatacatcggcttgacacagcgcccgttgttggatggtgttaacgcatttggagatggtaacccactcgatttttcacccatcggcaatcattgtttgtttaaatttatgcatttggtttccaaatatttaatttttagctgcactctggacaacaatttcgaccacaattcggaacacagctatgcggctaccctaatacagttcggcatcggctcaccggcaccatcaactcttacatggccaaccactgtgagtccacaggagcagcttgttcaatattcgttgagcccgctatcgacttcgacagcgccaggcagaattctttcatcaatcatccgtttaaatttaataaaaaattcagttccagcgtgggaggacaaaatcattcgggcgccacatggcctctgtcaccaccccgacctctcagatttcattggtggggttaatgaaagtatcgacagacaggcggacgctgcctgatctgctcgccatttcattcacaagcgacacaaatgatacatcctgcaggacgcggttattatgcgaattttggcggacgcgtcgtacaacagcaacggtgaaattagtgatctgatgtcggcgctcggtctccaagttgaaggatatgcaggaaaattgagagattttgaaatttacgaccattcaattgtccatgttccgtaa

SEQ ID NO: 58865 - DNA, 5715 bp, Heterodera glycines
  misc_feature (5621)..(5621): n is a, c, g, or t
  Genomic contig location: Contig_ID=SeqID_5672; Location=1..5715; Strand=-
  SCN-specific regions: Sequence locations=1-79,101-460,482-554,585 -879,902-980,1002-3610,3632-4755,4777-5071,5095-5715
ccctttgttgaccatgcagactgggaattggtgcaaacttttgggacccgttcggctgcggtgcaattttgcgttgacgaaggcgcgccgcgccaccatccaaatggaatcagattcatttacgcattctgcacatatcctgctgggtgcggcgggcagtttcggatgtgagttaatgtggactcaaagtatataatgtacaagggttaggctgggggtggggggaggtcatgccgccacccgcatggggtcagcgggcgtcgataagcaataagagaagtgtttggaattttgacccaaaaaggcgaaaatatcgcgtccctttgctcaattacctttggtgattttggatccacatgttggttatttattatttgtctagttttgatttagtaaaaatcattgcaacatcaaaaatccctggaaacgtgttttcacgactttttagaacagaaaaaaattttaaccaaaaaaggggcgaggggaggcaaactttactattatcattggattctgcgaccattaaaaccccaggatggtataaatcgaataaaaaacaaaattttccttgaaaaaatggggagcaccgtctatgaataaatgttggtttttgtggagccaagacaagtcagcacttattaagggcacccatcaattgggaccttgttgaacatgttggccaccgcgtgaccggattgccatttgtcgccgctggcgactgaacgcgtggaaattgggggacagcccggaggatcgctcggaggaccgtttggaggaccgcccggaggaaagaaatgaggaagtcctgtggaggacggaagaagattctcgaatgttcccttgtgatctttgtgattaatattcccgaagtttccccatttttcatttcctttcaggtgtgttttagaattttccctccctgtccaaatctcatatataaacccgaatatttccctttagaatccctctcgaaaaatcattattccatcctttgattgtgcgctattccgacaaataaactacttcttgtctaagaagttttttgttccgaaggtgttcctttttctctacggtttcgacattcccggaactcagagttccgtgtttgcatttgtctaagctcgattgtcccgaagtccaccaggacagtccaactaagtctaaaggggctgtccatcccacaagtccattccaagagcggaaaccccgtcccattcgctaagttcaataacattgtcgcggagcgtgtgcaaaccgacagccgaagcgcaaccgaccagtccagcaaacctgcacctcacccgcctcctcgacaagtggcgctcctgggaacgcgataactggcgctcctgtaaaacgaccacacaacaagtggacctcccgaaaagaccatcatgagcaacctaatccggatggtactgggcccacaagtggcaattcttcgtcaacgagtaaacacggcacggacacatgtcgaccgtgaggaagatgaagaagttaacaacgctgcgctgatggaagcaaaagtattgctgttaaaagtattgcagcgtgtggaagctgaactagcgaaatgggaaaacgtgatttctggacttcaaggacaagaaaaacagacagagcaagaacgactcgagacattcatcaacgaaagagaagtagcgaatttgctagccgacgcacatgctacgatggatgaaatacaagtggcacttgcaggagagtcagaatacgatggttcccaaaacggggacaatgccgtgcgagaaaatgcccaaaggcaacggcaatcacctgctcgagaggaaaggcaactcccttttcgagtacaaaggcaatcacccgtcagagaagtcctgcatcaaccaaggatcagacttccagaattacggatgccgatattctccggcgatccgttagagtggccgacattttggcaatccttcgagaatgcggtccacaatcaggctcacctgcagccaatcgacaaaatgaattatttgatgggatgccttaaagggaaagcctctcgtgcagtgataggctacagaggtggccaaaattacgaaaatatggtggaaacactccgccgattgtttggcaatccgcaagttatcgtcgaagccttgcaagccgaacttttcaatcttccaaatgtagaacatagcccggactccctccagatgttctccgagaacttggaacgaatatgtcgccaattaaatgctttgggacatcccgagaattcgctcatgtgcatggcagtcaaggcaaaactgcccaagcaaattctcaccgaattgattaaaatggagcgagaagaggggttccattggcagatgtcagatctgagacgtggactagcagaagtcgtatcacttcgagaggaggtccagcgttgctctcgatcactaagaagagatgtgaatcgaggtccgacacaaaacagacaggtgttccagcgcgagcaacgaaggcaatcagcggagagagccagagcctttgtagccacacaagataaacgaggaatggagtcagcgcctcgtgggaagccaaaacttccatgtttcttctgcgacggaccgcattgggtcaacgattgcagaaaagtggtcagcgttcagcaacgaacgaaaatgctcgccgaacaaaataggtgttctctgtgcctacgcagagggcacagagctccggattgtcgggcaaataggagttgtgcgagatgcaaaggagcgcataacaaagttatttgtccgaatacaaagaaatccggccgtgaatggcagacaaagccgaaagcacaattcaagagaacccatgcagaagtcaatatgacgacaattggttcaacagaaaatggaacagtagccacgatggtttctgatccaaaaagagtgcttctgatggcgaaatacgtcacaattttctccagaagaaatcctacaaagagaattaggattttagtcttctttgacacaggttcgcaagtaaccatgatcaaaagtgctgtagtgcgagccttaagcttatataaattgaaagatggccagctagaagttagcggtttccacagcgattcaccggtcaggctggatgccccgcagtatgagctacatgtcgcattggaaaacggcaaatccgaaaaaatagtagcttatcgggcagattggatagtcaaatctatccgtcgagccgaatggaagaccggaaacgtggaaataaccgatgaagaacccgatttactcattggtatggccgaattctggcgattcttccagcggcgcgaacagataaatcggaacttattccgcatttacacttcagtgggacctatcgtatgtggaaaagatatcccacaggagatcggagaaacgagacaaatttgcgcagtcatgtcagcaaaagctgattgtgaatttgcagaaacaggcatcgacactgcaaaaaacttttgggacctacaactgataggaataaaagataacccaaaagaaaatgatgacgacacagcgatggaaatcttcgaaaagaaagccaagagactcgctgatggacgttatagttcgggatggccatggaaagagttcccgtccgatttgccatcgaattacaatatggcatataggagattggtcaacctccttgaaaaactgcgcaagactcccgagttattggacaaataccacgagtcaatctcgagagagttcaatctcggattctttgaacttggcgaaagaagggagggttttcctgaacacttcctgccacatcatggagtagtaactcataaacttcgaattgtttttgatgcttcagcacacccacggggagagaaatctttgaacgagtgtatgttcagaggacccgtgatgattcccgatctcgtgggaatccttctaagattccgtctcccaataattgcattatgggcggacttagaaaaggccttcaatgccatatctttggacaatgaagacagggaatttgtgaaattcctttgggtgaaagaccctaagaagaaattgtcgacagacaatttacagatcttccgttgggctcggattcccttcggagtaatttcttcgccatttattttggctgcagttgtccagaagcatctgaaggagaaagcttcccccttggcgttggaattcgctgggaatgcctttgtagacaatctaatgacttcatgcaaagacgctggagaagtcttaaagaagtatcgagaagggaaagcattgtttgctgaagcacaaatgaacctgagggaatttatttgcaactcaatgaaagcgatggagcaaattcccgaagaggaccggcttaataaaccagggactaaagtacctggcatcccttgggacattcaaaaggacgaattgagcattggattcccaccgacgaatgaagccgggaagatttcaaaacgcattgttttgaaaacattagcaagcatatttgacccattgggaatggtcgcaccttgccttctccaagcaaaattgttcctacaacgattgtgggacagaacccttggatgggacgaaatcttaccagctgatgaaacagcagaatggtttgctgtcatcagattatgcagcggcacttttcataaggtctcagaaaggagaagaaaccaatgtacagttactctatgcaaagagtagactcaagccccggaaagctgaagtaacaattccaagaatggaactcttggcaatgctaattggggcgaggatgctgaaatttgcggaaaatcagctgagaatcccaataaatgaaaaatttatttggggagattcaaaacccgtcttgagctggattgagtcaaaagattcccagcccagatttgtggagaatcggttgagagaaatccggaggatatcagaaaatgccagatttctgcatatcagaacgcacgaaaatccagcggatgtagcatcaagaggatgcactccagaagagctgagatcccatcatctttggtggaatggaccaacatggctccgagaaccaatgaaaagttggccgatcgacttcgaggtcaccccaacaggagccatgaatgatggacaagaaagttcagaattggacaatgtagttgcagtgccagcaacaacgagtgaagacaatccatggattgacccttgtcgatttagcagttggactaaactacgccgcactgtggtttggtttctccgtgcaataaacaagatgaggaagactcgaatattcgagatttcagagggtgttcctatgagcagtgaagattaccagtacgccgagatcttactcgtaaaaatggcacaaaaatgttggccaatgtgtaaaaagcaaccacaagaacttgtaaagacatcgaggaaagatggtcttgtccgactgtcaacacggctcgcaatgagcaatgcatcagaagatatggttaatcccattatccttcctgagaattgtccaataacccgactaattgcacagtcggtacatgagtcccttgcccattctggagttgaatccactctgacagaatttatgggaaaatattggacacccagagcgagactgacaataaagaaggtcattcgagcatgcggtcgttgtcgccggatccaatgccccgncatataaattgccgacgatgcctcctcttttctgagaccgcgtgaggcggacggcaccatttgaaagcattgggatcgattatcttggaccaac

SEQ ID NO: 58866 - DNA, 97 bp, Heterodera glycines
  Genomic contig location: Contig_ID=SeqID_28222; Location=298..394; Strand=+
  SCN-specific regions: Sequence locations=1-97
gtcagatgcgttcattggtccgtacgcgcaataattttgaggttgaacgcatcaaactcacttgtgagcaaccacttgcccaatcagtcgccgatgc

SEQ ID NO: 58867 - DNA, 806 bp, Heterodera glycines
  Genomic contig location: Contig_ID=SeqID_28226; Location=522..1327; Strand=+
  SCN-specific regions: Sequence locations=1-177,199-395,417-806
atggcagaactcatcaccaaattgtgtacgacaaaactggccattttgaaatggcttcaaatggtgcgtttttcgcactccctaagttcggaaacccttccctttttgtttggtcttttgaattttcgcccattccatgccaaaatttgtccgtccctttgggggtgcttttgtcagatgaatgaatgaatgacttttcgtcccccgcagctttgtgccgtcatcaccgtcctttttctgattgacggtcagcgccagtcgtggttctacactttggtaggcaaaacaaacgcatttttggaattctttaccatgccctccctaattacctaattagcaattaattaatccctttctctccctttttctctcgtggttcaaaattctcaattgctctttcatttggtcaggtttttgtcgtttccattgtgttcggcctcatctcgttgctcactctgatcgccaactttttcctccactcgcgcaatcagtcggtccctctgcccgcctttgtccgttttccgtcctatcgcttccaaatttccaaaatcatttatttctccaggaaattggcttcaatgcgttggctgcctttgtctgtttggcatttgccgttttgctcaccatcgattcagtccgaatgttcggcgacgacttcagccaccaccgctttttggtgggcaatttggaaaaatggcaacaaaatgatttgcccaaaattaaaggatttaacaaaaaaagaaatgctttagccaccagcgaacattggcaaggacgggtggcgcaatcggactttggtggtggcg

SEQ ID NO: 58868 - DNA, 559 bp, Heterodera glycines
  Genomic contig location: Contig_ID=SeqID_28227; Location=349..907; Strand=+
  SCN-specific regions: Sequence locations=1-559
atgtctgctgacaacggatggtacgacgaggcggacgacacggtgacggtggaagtcgaagtgattgtggacgagccgtacctcagagagtcgcggtggcgcgccgtccccgtagatgatgccattgacgcggaaggctttgggaacggcggttttgcccagcccgttggatttggcgatggttgggcggcataagctgatcaatgcttcaaaatgccttttcttacctttgatcattcctttgtttaatcctgttattttaattaacatcaacatttcggctcttatatggcttcgcctgctactctttgctgtcctcattttgaactgcttcgactgttgccatgggtaagctttcggatttggaagcattttgcctcacttttttgcttatttctcggtcaattattttcccatttttcagcagatttcatcctaagtccagcacagttccaacgactacgacgaagtcgcctccacctccaaaaaaagaaaaagaaactggtgtcttcaaactcctcccaatgtgggccaccattgtcatcgccgttttaattgg

SEQ ID NO: 58869 - DNA, 1122 bp, Heterodera glycines
  Genomic contig location: Contig_ID=SeqID_28229; Location=325..1446; Strand=+
  SCN-specific regions: Sequence locations=1-702,724-827,864-991,1017 -1122
aaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaaatcgattttttcaagtgttcgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcagggtactgccccgaaatccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaat

SEQ ID NO: 58870 - DNA, 290 bp, Heterodera glycines
  Genomic contig location: Contig_ID=SeqID_28229; Location=1446..1735; Strand=-
  SCN-specific regions: Sequence locations=1-79,113-253,280-290
atttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaatgaaaaaaataattttaaaaaaataatacttgtgtggta

SEQ ID NO: 58871 - DNA, 658 bp, Heterodera glycines
  Genomic contig location: Contig_ID=SeqID_28230; Location=345..1002; Strand=+
  SCN-specific regions: Sequence locations=1-658
aaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaac

SEQ ID NO: 58872 - DNA, 717 bp, Heterodera glycines
  Genomic contig location: Contig_ID=SeqID_28231; Location=921..1637; Strand=+
  SCN-specific regions: Sequence locations=1-278,300-717
atggcgaagaacccattgcctgagggatgcactgcacggccacttgatcaacggaacatgaccagctggacggtaaccatccgaggccgggccggcacaccgtacgcaaacggcaacttccaactgagcatggcatttccgagggactacccgttcaaagcgccgcaagtcacgttcaccacgcgcatcttccacccgaacatcgacacacggggcaaaggtgtctggacattctgcaaacgcactgggcaccgacgttgaccatcgaaaaaggtggcgtggatttggtggtggatttgatcatgttttaaatggattgatcactttaatgctcttaactttttcaggggaattaaaatccgctaagtgtgtttgattagcaaattcaaaagatttcattgcgtttcatcagagttagcgaaaaagcgagcgaatttttggaatttatggtcttaatcgggcatgaatttgatggcgttggttttgtgtggtatttgtgaagtttgagtgatcaattttttcacatacaatttttggctgcagaaatcgttaatttgtttctctgtctttacagttgtgctctccatcatcgttctgctgaatgacccgaacccggacaactcgcctgtcaatgcgcaagctgccagtttgtaccggactgaccgtgcggagttcaacagacgcgcccgtgagatgacgctcgcctatgcacgatga

SEQ ID NO: 58873 - DNA, 669 bp, Heterodera glycines
  Genomic contig location: Contig_ID=SeqID_5673; Location=318..986; Strand=+
  SCN-specific regions: Sequence locations=1-56,82-108,130-250,273 -332,355-547,569-602,644-669
gcaaatattatttgcgacggagataagctcggatgtactaatgtccctccaagaagaattttttcaaagaaagagctttttgctcgattgttgggcctcagcggtaatctctaattttaaatggttttagcgtaaaacaaaaatttataggcgctggcgttttcgagcagtttttcctcagaaagccggcagtattaaatgtcacggacaaaatagtagcaagaaaagtggcatttaaactggtttgttgcttaggaaagaagggattgcccgcccattaatgaaagagttcaattaccaatttttttggggggggggtgaaaattttatccaactctaaatcaatttattaaggccgaaatggagtgcaccagggtggcatctgactattttaaccccatgcatgatattaaagaaaagcctgagttgaaacgaagggaagaactcattgaattagcaagaagggaagtttttcaaagaaacggctgagacaaaaggcgcggaagaaaggagccaagaggaagaaggtgaactgaacggaatggaaggggcaaaaaggaaacgaaaattaagggaggaggtgactcatcgtccaattcatcggaaggagaggaggaggaggcgaacgaagaagaagagaagggacaaagtcgggagggagacgaatga

SEQ ID NO: 58874 - DNA, 756 bp, Heterodera glycines
  Genomic contig location: Contig_ID=SeqID_5673; Location=1165..1920; Strand=+
  SCN-specific regions: Sequence locations=1-756
atgccaaatttgctccaagttctgttcggaccggttgtttaccgcccatatcaacccaacctattggaatcgggcggtaacaagctgttcagcatcggtgctggtgcctacaacacttgtgttgtgctgtcgcccattctcgtgccgtacattgccttttcttggacccactcccatcacttttcttttgtcggtttgcatgtttccaattcagtcctctcacttttgtccctttttcagttgcgcttcgttttggtgttttatgccattgccttttccttccgaacgattggtcggctgacaaagtgagccaaccaaaattctcactgattgctcattttcgttgactgttcctcacttttgtccgtatttcagtgttgactacgtccgttttatcaaattgctcggaaccgtgcgcaaatctccgcagaatgtcactttgctcgacacactcaaagactacgattttcaagtgaatgtcccaccgttgctcttttctcatccctttccttattttcggtgtacgctgcgcccgctgattttaaagcatcgccaggccgaacggccaaatggcaccctccgcgtgaacgccttccggacttgaatcctccgctgaattttctgcgtcaggctatcgcgtggacggccgctaacacttttggacgtcgaatgcttttccctggttcgatggcacttttcaattcaatgttgaacagccaactggtcgatggacggcgcaaattgttgacagaaatg

SEQ ID NO: 58875 - DNA, 1617 bp, Heterodera glycines
  Genomic contig location: Contig_ID=SeqID_5674; Location=1..1617; Strand=+
  SCN-specific regions: Sequence locations=1-179,208-1496,1518 -1553,1575-1617
tcttctgtcttcaagcctcctatttctttacttttagggttggaaacggaaagtcattgagacggaggatgggggcaaggtcgattcggtgttcatcgacaaacgcgggaagggcaagcatggcaacattttgatgtgagtctttgtatgtttttgcattttcttagcgtcgcgtttttcagcatttgctgtgaagggaatgctgggtattacgagatgggcatcatggtaagcgggcagcacgtctttccccccccccccccacggtcgtttgttgcatcgtttagctcaaattaacttttctatttcgtcatagcatatgcttccgtttacatatttttgcagtgataacaaacagacaaaacttttccgtatttttgcacatgtttatcgtttggtgaataaccttttgatgtcctccctttagtaaaatttttgtggaatgacggattggggggggggggggagaaacgtgcccttggaaagaaattcctcgcttaaatcctagtaaaccttcacttttcattcagtcaacacctgtgaacttaggctattctgcgttgggttggaatttgcctggtacgttttcccgccattttgtccgattcttttacccgtccgttcgtaggctttgccgaaagtaccggcactccattgcctcatacaattctcaattccatggaggcggtcatgcagttcgctgtaaagaatcttggcttccaaccgcaacagattgtgttgttcggctggtccatcggcggtaataatttgaaggccttttacccgagactttaaaaagcattccctcgtccaccgcttaaggatttgctgccacgtgggcagctgccaattatccacagatcaaagcgctgattctcgacgccagttttgacgacgtggtacctttggccagtgcccgcatgccagcggtgttagaagggttggtccgcttcgctgtgcggacccacttggatctgccggtcgccaaacaggtggtccaatgcttctgtcggttgcttttcctgaattacaactcacaaccagttacaacgctacgaaggtccggtgctgctcattcgacgttggaacgatgaaatcatcgccacggataccctcgctaaagacgatgccaccagacgcgcttcaaatcgaatcaatcatttgttggtcagtcttttgcgcagccgccacccgggccttctgaagacgaaggcggacgaaaagtgtgtgttcgaatggtaaaagttatgctcatgaacgcttcaattccatattttcttattgggtttaaaggctttcccacgaaccgcaagaacgtctttttgtctatccgccggaggattcgctggaaccgcaaactttgaacgacagtgaaatgaaaagtgaacaaagccgacacaggtgagttaaaatgggccattgggtatgaaatggggggacgattccgccgattggaacattgggcaactcatcaacacaaatttcattttgtttctttattaattaaaactttaaaggtttatccgacaactttgcaccaaatatttcttcgactttatgggcgccactcacaatgttgcgcttgacccgcagcactttaaaattccgacggctctc

SEQ ID NO: 58876 - DNA, 85 bp, Heterodera glycines
  Genomic contig location: Contig_ID=SeqID_28232; Location=1078..1162; Strand=+
  SCN-specific regions: Sequence locations=1-46,68-85
aacccatgggtgctctatgcacccaccaaatttcattccgaaactccacggacacctccagaccttcctttgttagtatcatcga

SEQ ID NO: 58877 - DNA, 892 bp, Heterodera glycines
  Genomic contig location: Contig_ID=SeqID_28236; Location=618..1509; Strand=+
  SCN-specific regions: Sequence locations=1-580,609-630,652-892
atggccaaccgcggaccggtggctgccgcctttacgcccgcccaaatgatgcaggtgggagaagaagctgccttccagcattttcgttcttatcaatcaatgccatggcatttttgatagcactagctgatcatttgctcgtagaacatttatcccactgatcactgaccagggctcatttccttgacatttataaaatgcttaatattatattaacaaaactacaattcttaaattgatcaatcaattaattgggttgatcagtagctctgaacattgcttttcaaaatgttgatcagtgatttgtatcagggatgttacgaaatttttttcctgttcttagtactgagtcgacaatttatctgtaagtcaacaaattcccaaggaaaaaatctgaaaaaatactaaaaatttcctttcttacaataatgaactgagataaaaacaaaatgccgattttcgattgctgacatggccctcaaatggaataattagtaaaaaaacaaagtcgaaatgatgtatgtatgctattgctcgtcggtgttcaatcccaatttagttatttagccaaaaagcgctgaaaattaataaattttgatttttttataccgatcaattaattaattaatcgagttgatcactgctgatattgctttacaaaacatcgatcagttgtgatttatttattcattaaataaccaattggttccttgaataatcgtttcttgagtaatcagcagctgattagcttatgtgtaactctattatttctctttttcagggtgcccatttcggctcgcccttttaccattcgtccgccgctgctcagaattcgtccgccaataacactccgccccaatcgcaacgtgtgccaaccatcgcagtacagcag

SEQ ID NO: 58878 - DNA, 731 bp, Heterodera glycines
  Genomic contig location: Contig_ID=SeqID_28238; Location=2..732; Strand=-
  SCN-specific regions: Sequence locations=1-143,165-177,210-254,276 -644,666-731
  Gene Ontology: Mol. function=structural constituent of cuticle; Cellular component=extracellular; Biological process=cuticle biosynthesis (sensu Nematoda)
atgcaagagactcacattgtcctgggcattggcacggtgtgctctctgttggcgatcatcgccaccgtcgtcactttgccatcgctgtactcggagatgaacgaaatgagcaccaaagtgcacgctggagttgaggtaacaacaattaaaatttaaaaatatatgctttgccaggctttccgcgtcaacaccgactcggcctggactgatctgatggacgtgcaagtggccgtgtcaccgccgtcgaagccccgtgccaaccccttcagctccatcttccgtgccaagcgtcaactgcccggccattgccaatgcggtccgctgcaacagccaagctgccccccgggcccacctggtccggccggagcgccaggtcaacccggtcagcccggaggcgcaggacagcccggacagccgggagcacctggacaacctggtaggattgaatgattgattggtaattgcttcacactcctacattgattgcagctgctccatgcgcgccccagcacatcccatgcccgcgctgcccggctggcccgcctggccgtcccggaggacagggaccgcccggacaacaaggagcccccggccaacctggttcacccgctccaggcggaggacagggaccgcctggcgcgcccggaccccaaggaccttctggacagcccggacgttctggagcaccaggccaacccggacagcctggagcaaatggagttgtctcgtaa

SEQ ID NO: 58879 - DNA, 451 bp, Heterodera glycines
  Genomic contig location: Contig_ID=SeqID_28239; Location=607..1057; Strand=-
  SCN-specific regions: Sequence locations=1-181,215-429
atgaaggattggtacatgaatcccgtgggatttaagtttttggatcagggacgatccgctgatatgaaggggaggtataatcatacggtcacgcttggtcaaatcactccgtggtatggaactcggactcaacaccgcgaaatatatccaaatctaaacttcagtcgtttggacgcgaaacattaaatttataattattaaactaatttttaaactttcaaattttggcaaattttatcagtctcatatttcgaaaatcagtaaccaatttaattcaaattaaatttaatcagaatttcagaaacatggtcaaaaaaaaagaaggttaaaaaagaggtggatttgttttggtagctcaatggtagagctgccgtgggttggttggaggaatgagttcgttccaatcaggggcacggcattttccatttctaattttaaataattaaataaa

SEQ ID NO: 58880 - DNA, 930 bp, Heterodera glycines
  Genomic contig location: Contig_ID=SeqID_28240; Location=267..1196; Strand=+
  SCN-specific regions: Sequence locations=1-286,308-311,333-372,394 -572,603-637,659-930
atgaaaacagaaaaccggaagcacaaggttaacgaaaatacaacggaaccgggaccgttttacaaaccagaatcatgtgaactttccgtaaatacaaaccgctacatataaacttcggaaaatataacccgccaaggaatgtaaaccaaaaagcatatgactttccggaaaacaaaaacctctacgaatttataataaactagaaataaataatttaccgaaaaacccattaatggaatataaaatttttttgagaaaattttcttcatatattcaactatttttaattattattcccattttgtagccatatttagtgtttatatatatatccgatcaaattcagaatttatattcatcgaatttctgaagataattttttttaaaaaatttcaagccatagataataatgaaaaaagaaaaaatttttttgaaattatgcaacaatttttagaaaaaaataaaaattcatccaattaaaatttcaagttcagccaagcagtccatcatccaactgctcaatttttgttttgacaaatttgttcaacacttcccatgccacaatcactgatttgttatcatcatcattatcattttcatcggtcgcgtggttcacgcccaatttaaaaaattccgccaaatttttgaagaacaatttgtacattttggcatccgaaagcaatttgagttcatctggttggcgttgtgccacaacaaaattaatcaacgcattaattcgtgggacaattggtaatctgtgattttaaaaaatggaattaaaaaggtaggaaaaatggaaaaaacggtacaaaaagtaagaaaaagtcttaaataattgataaaacaggttaggctaattaaaacttttagagaaaaaaattaattgttaaaactttgataaaaaacagtaaaagtaagaaaatgggaaaa

SEQ ID NO: 58881 - DNA, 704 bp, Heterodera glycines
  Genomic contig location: Contig_ID=SeqID_5676; Location=395..1098; Strand=+
  SCN-specific regions: Sequence locations=1-704
atggcgtttactgtaattttagcatgtttgttccctcttcccgttaaggggggaacagaaacaaatgcttatccaaccaatcaatgcaatgagtgcaaacttctttgctttaacaaaggcgttaaagcaaagattccaaaagaaatcaataaagttgagctctgctgtgcagagaactgttacattcatgagaatgtaaagcagctcacttacgagctaccaaaggaaatcctcctaaatgacttccaatgtgaaggtcatttttggatggattcgaaacacatgttcaaaaaggacattttatgtccagcagttgatgagtgcgaactcatcgaatgctatttttgcattgaacagttagcgaatccaacctgttacccattgatttcatcaatgttagcagggggactttgcttatcactcactcataagcattagctttatggctttttccatattaaaagtcctgttttcaggattttatatggtcatttggctgataattcaatttatcaggccaataatttacttagctggcccaaatcggcttccgaaagagaggaggccaagggcaacagcttctcaaaattggacatcacgccgtgtttacagaacaatggcgtttgttgtccttatggctaactctctccagaatttgactggagcagagaccatagcagtcatggccaaatcggaaaaatgca

SEQ ID NO: 58882 - DNA, 1096 bp, Heterodera glycines
  Genomic contig location: Contig_ID=SeqID_5677; Location=1198..2293; Strand=+
  SCN-specific regions: Sequence locations=1-7,29-68,90-430,452-872,894- 905,927-1096
gtataaaagggtggcggatttgccacccaaccacactcttcaaatcatccttccacggaatgcctattcccatacgagaagggccttatttctcggctcgccgggtggtcatacccgaaaattccgaggtcttcaatgatcgcctttacggacttggcgatccacgatctgaagaggaggagagagttcctcgctggcaggaacctcctattcctcgccaaattgagtcattgagctcatggattgagcggtcttatggaccgcattggtatgaaacagcacgggagcgccgtgctgtcgaagcccgccttcgcggagaacttcgcgaaggggccaatctcttaggagaacattttggcagaattgccgagatccattttgatggattcacctgttatggtccggagggtctcttcatctctccgggcataacacttttcgatcattttgtacggttgggtcttcaagtagacccagtaaaaccgtgcatacaagaatatatagggtttagccctcgcgagcaagggatgctgcttgtcgacatttatccgatcgaactggtcaacatccgaaccagaatcggagttgcttggagagcgccagcagttttggaggaacctcgccctcctccacgtgaccaagcacagctaccagatggacgtttggagaatcgtcctcctagggtggctcgtcgacttccaaaccgacgatgaaaagaattttggcaacgggacggcaacagttgccgccatcctcgaggcccggagaatgtcgccaaaagcgacacaaatttcttggaaattttcatttattttttgatacttttcgtcgatcaattttcccattcgctcgctccttttttatgactcagctctttttctcttcatttttcactatgagtcaccatttttaatggatttttgtccatctgtttgtgcacatttttcacgtgcctggccccgcccccatcgattgtgagggtataaaagcccggcccattctccattttcttcactgatcactttttgattaagtcagtcgggacagttttctgtccaagcatttgcattaaattgtaattgtgcaattgaattga

SEQ ID NO: 58883 - DNA, 566 bp, Heterodera glycines
  Genomic contig location: Contig_ID=SeqID_5677; Location=1..566; Strand=-
  SCN-specific regions: Sequence locations=1-24,46-344,366-374,396-566
gtaacacccagatatgttcaacggcaaaattgtgcaaaggctttggtgaagttccaaagccatttggagaccttcgatttgaaggtttaattggacaggactaaatcctgtcaaggcaattacctttctcccagtatttctgagttggtaatttttgatgtttaatggaagtctcctctctggactttccattaacttttcaaggttatgtgaacggcaattgcagttcactaaacctgatgaatggtcaggtatgcaatcagtgcatgcctgaactccaagactgcaattgaaatcaattgcttcttgccgacttttacagttaaagtcaattgttaatggctctctggttagagccatgttgctcccgtcataaacaaaatctgagtttaagacgggggcgggcggaaaggttactccgatcggagtaaggctgatgttgttccatctcagggttcttcctggataaagaaacacctgagttgacttgggtttttcgccctaaagtttcctaggcgtaattattgtatagacaataaattccctaggaattacagccccatgat

SEQ ID NO: 58884 - DNA, 1059 bp, Heterodera glycines
  Genomic contig location: Contig_ID=SeqID_5678; Location=479..1537; Strand=+
  SCN-specific regions: Sequence locations=1-247,272-423,447-448,486 -516,539-724,749-1059
ctcttgggtcgtcccattgcctattttgtgtgcgaatcgaatggaaacgcggagaattttcaaatttcactgcttaaacatttcctacttcaaattgagccgccccttccgaaggaggaggagaatgtttactttgttgaggtgcaatgccacggcttcaaaccgcacacattcaaaacaatcaccagggccaagacggacgtggtgctgcaccaactcagctgcaaaacctacgacatttcggtgcgcaaagtgccgttggaatggatccggcgactgaaataccatggggtaagcagaaggccgttagggaagcgacgtggggcgatcagagaacggaatttctaaaaattcctggaccaggatcctgggaaaaccctgccaagacccggcactgttcagattaatgggtaaataaggcaaatttttcagtttttgctccatttgttatgaaatttaaatgaaattttttggggaaagattttggttatgaaaatgtttcttcagcgaattacctattttaatatacatttaaaaaagagcaatttttcgtgtattaattgtagttattgtatttcctcaattatatgccccccctcgattatatttttattggttgtgctccaaacactgggtcattaatttcattgaaaatcctttaaatcttttggaattttccttggaaagcattttagttataaaagtatttcttgaacgaattacgtattttaatttttatttaatatttcatgtattaattgtacatgcgaatattaatatgctttacaaattaagtataacggaatgatccattcaacaaaaccgtttcatcaattggatattaatattacgatgggcgcgacttatgtgttggaatttccggcaagatttcagcggccgaaacaagtcaattatagggtaaaaaaaaattttactttttggcactttctcattagtgacgaggcgagggaccggcacggagttacccccccccccccgcttttccccgggaattttttttaaattaggagaaaggtgaaaaaatgcaataattaaaaa

SEQ ID NO: 58885 - DNA, 527 bp, Heterodera glycines
  Genomic contig location: Contig_ID=SeqID_28242; Location=215..741; Strand=-
  SCN-specific regions: Sequence locations=1-92,130-130,209-266,307 -376,431-431
atgcatttgcgaccaaaacgggtcgcacttcaaattggatttgcttccacttttaagcaatggtcggattcgcttactgtacacaaacaaattgcccgtgacgagtttgtcgtcctccgttgtgatttcacatcggtatttgccaatgacggaaatgggcacgaggccaaagtcgagaaaagcgcgattcccttcgggactgagtctgaaagggagaggcgaggatgggtgatcaccactgatcggttggggatgagaagacggacctggcctggtggtgtcggagcggcggagggtgcaattggacttaatggaagcattacaaactttgaaaagcaaccgattaattgttaaagagttcagttttgatgcttactgaatcgggcacttttgatcggaagctgatcacttccgtcggaagtggcctgactccaaagagcgctcaaatttgctatctgtgcgctgttttccgagctccttccggatttggcatcgaataccaatgccaaattgccctgagcaaaagg

SEQ ID NO: 58886 - DNA, 987 bp, Heterodera glycines
  Genomic contig location: Contig_ID=SeqID_28243; Location=191..1177; Strand=-
  SCN-specific regions: Sequence locations=1-267,294-406,431-573,599 -684,706-784,818-874,896-987
atgagtttcgatgtgatcgcccgtgtggcgttggggcagcgcgagtcgcgacagtttgagactgaaatggcacacctggcgattgagtcgatgcaaaaatacaataacactccgttcgattacgtcggcttcgctttcccgtggttcggcattcattttttggaaccgttcatcagttggagcggaatattgcgcaaagacccgctaattatactgaggaagcagctaatggacgaattaaaggcacgcaaaaagctgagggaaagcggagaacaacagcagcagcagagagcgaaagtcgacttcattgacctgtttttggagacggaacagaacgaacagcagcagctgacggagcaatgccaaaacgagggcgaagcaatgctaagcaaaacggcacttcaggtggggagagagaggaagggggaaggggttggcgctagtagtcaagttcgagagtcttggtctcgaaccttctcgactcgagcaaaatacttttcgggatgagcgtttcaattctaaattcgatacagaaaagttcggctctattgcactttatgagtccaatcgaccaaacaacaattaattaattaatcaaatctttttggcaattgcctaaacgctgagattttatatatttttgcttctttcctttgtgctttcgaatgataccaaaaacatagggtttgttcgaacatcaacaaagttattgtataaaaagaaggtattaatgccaaaacgagggtgaagcaatgccaagtaaaacggcacttcagcaggtgggaaaagagaggaagggggaaggggttggtggcggtagtgaagtcgagagtcttggtctcgaaccttctcgactcgagcaaaatactggggcttccaaggatccgggtttcaactctctaatttgatacagaaaaatataaatgaatgatttagtctttaatatgtataatgttctagatggaaattcacgagaaaaagacttga

SEQ ID NO: 58887 - DNA, 1010 bp, Heterodera glycines
  Genomic contig location: Contig_ID=SeqID_28244; Location=152..1161; Strand=+
  SCN-specific regions: Sequence locations=1-141,193-196,218-349,409 -430,454-557,589-705,744-795,817-1010
atgcttgagttgcgtgtcgtcatatcggtaataagcaatgtgcaaattctggtttttgtggttcatcttgcgcatggagtgacgctgccaatgcttgttgttgcgtggggcgaactgtaaacaaccaaccaaccattaaacaaaaatattttgaaaattatattattaattaaacattattatttattaatagggttgtaaattatatggactaaaaacgctaaatttggacataaaatatggactataaaaaagcccaaaatatggactaaaaatctcaaaaatggccaaatatggaccaaaatatgggctaaaaacttctaaaatttacattttaaaacctcatccaaaaatgtgtatatttcaatatttgctttaaaaaataccctataaactaccaaaactcagaaaatgcccaattttggaatgcattttttaaaaatttcgaaaaaagtctatccttagggctttatttttcacttttttgcatttttcttgtaaaaattttccagaatggccgaaatatggacgaaaaacgcaaaaatggcgaaatatggatttttcccaaaacccccaaaatatggatttattatgtactaaaaacctgcattaaatcaaaaattttaacgtagaaagaaaatttttgaggccctttctttatagcatatgcgcagaaaaatatgttaatccatacaatttactaccatatttatttatataaattatttaatttcaataattttgttaaagagcgattatcaatcctactaattacatctaattaattagatcttttaaaaaatttttagccaactgcatgagaagcaggacacgtacaaacgggacgaatgaagcgatttcaatcgtactaagacaaaccgaaaaaaactcattgtggccgacccggaataacccaatgtaaattccgcttgttaggccttaagcaagccgtataaccatgatttattcaattctctaatttttctggttcacgcataacattgaagtaa

SEQ ID NO: 58888 - DNA, 739 bp, Heterodera glycines
  Genomic contig location: Contig_ID=SeqID_28248; Location=60..798; Strand=-
  SCN-specific regions: Sequence locations=1-59,81-298,353-739
atgtacctattccctattggaccgacagtattctgttcaatgtacaataattattttaattatttcttcccattctttttagaatttttatccgttttggaaaatgaggaagatatgcccgagctcacaacaacctttattgaaaatgagctgaaaaatgcaattaccaaattcttgaaacaaatgatcggaattgaacaattggaaacgatggaaaaagaaattccaaaagcatttcgtgtaattttccaaaaaaataattttttttactgtacaaaatattttgggggtttggcacataaaaattattttagaaaattttttttaataaataaacaatatttaaaattaagcattctgaaaaaaatgggctgttttaaacaacttttttcttccaattttttagcacatattaggcacttttaaggtttaaaccatattttgggatcttttaataaataaatcaaatcggggccctgctgtttgatattcacaattttcagattcgccgcgaagatacatcattaatcaagaagcctgaaaatatggcatcatcagctgagaatgtttgaaaacaatagatgtttatatgtgctgaagaatttttgggatttcaaatatattctcatttctttgtctttttaaagtctttccattttgatttggtggattttaatatctcatatttatccggagagactaaacgagaagtagcctaggcgacaaccaaaaaaataaa

SEQ ID NO: 58889 - DNA, 280 bp, Heterodera glycines
  Genomic contig location: Contig_ID=SeqID_28250; Location=656..935; Strand=+
  SCN-specific regions: Sequence locations=1-190,218-280
atgaccaaggacaattattgcgcttttgcggatctgctgctgttgcaccaatctgagtcaactttccgtcgatggattggacaaagttcgcccgcttcacaccgaaatttgtcgctgagaattgagcttaagtgggaaaattgggggaggataaaacggagacttgaaaaagcagcggagggaatgagacacataagaaggagaaaagaaaggggcgaaggacatggaaaagtcagcaaaaacgggacgaaatatttgaggcaaaaatgggttgggggga

SEQ ID NO: 58890 - DNA, 66 bp, Heterodera glycines
  Genomic contig location: Contig_ID=SeqID_28251; Location=712..777; Strand=+
  SCN-specific regions: Sequence locations=1-66
cataaacatttatttgatttattttaccatattcacaatttgatcaaaatataggtgatcaaaagt

SEQ ID NO: 58891 - DNA, 4403 bp, Heterodera glycines; identical to SEQ ID NO: 5680
  misc_feature (12)..(12): n is a, c, g, or t
  Genomic contig location: Contig_ID=SeqID_5680; Location=1..4403; Strand=+
  SCN-specific regions: Sequence locations=1-496,518-991,1013-1408,1430- 1598,1621-2665,2687-2917,2939-2955,2977-3077,3099-3586,3608-4112,4134- 4169,4193-4403

SEQ ID NO: 58892 - DNA, 1142 bp, Heterodera glycines
  Genomic contig location: Contig_ID=SeqID_5680; Location=3014..4155; Strand=-
  SCN-specific regions: Sequence locations=1-22,44-548,570-1057,1079 -1142
atgagcagcgactcagaaatgctggaattcttcaaaaaattttgggccaaatgcgaaaatgaggaagagagtaaagctgagacttcaacaatcgggaaaattgtcgccattattgttgaaatttttggccaaacaaccccttcgatgttggacagcggggcccaagtttcgcttattaaggccgaatttctaagggaaattttaaagcgcctaggcctaaagggtaaaagtattaacatttgccccaaatcacggaatgtggtggacgtaaatggaaaactcgtcgaatgttatggaactgtctcacttcctgtcctcagaaaaggttgcgaagaaatggaaatcgatttccatatcacgtatgcccctattggcctacccattttattcggaaccaatgctttagggcctcttggtttcaaacttttcggtgccccaaatggtgaattgattgaatttgaatgttcaaacaataaatcggattcggttcgtgtcgtttacaacacagtggttgaaccgttttcaaccaagtttgttgaactttctgttccacccatttttaatgatacaaatgtgctcatcattgcaaatgacgaagacaacagcgtaagagtcgaacctgcactgagtacgggcagaaacgcaaaaattatggcagcaatcacaaatttttcggaaaaagcggtaattttgaaggaaaactaagaaattgcagtggcagaagagccaagtaaaattgccgacgcggagaactgtttggaagagtcctggtcaacacgagataaattgagaatttccaaatttaaagcagcacgagctttttacaaaaaaaattcaatttggcgaagcacaacacgagtgcttttggcgagaagaaagttgtaagctcggacaaaaatccgaatggagtcaacccaacacgagggttgtcaaaaattttttgtttggatttttcacaacaaattttacgaccgatgtttcccttcaattgaaaatgccataaagccagacctttgtcgtccaggagcgccatgttggaaagtcaaaccaattcttcttcttttggtattaattttaacacaatgcgagaagaccaaattggaaaatgtctgagaatcggagaatacctgctttagaataaa

SEQ ID NO: 58893 - DNA, 1168 bp, Heterodera glycines
  Genomic contig location: Contig_ID=SeqID_28259; Location=9..1176; Strand=-
  SCN-specific regions: Sequence locations=1-232,306-504,526-575,597 -828,850-1168
atgactaagatttttgcaaggaacattttgcaaataaaaattaaagatcagaatttaaaaaattattcaaggcttattaaggcacatttcaagtcatatgaactgactaaattatgtcgacatttgaacaagcaatgcttatggcacaagaaatgtgttcaaataaacaagatgagaaataaattaaagaatatggaacaaagattacgaatatttatgtataaaagcaaagataaaataaaatttaaacacattaaaaacaaaataattttaaaattaattttaaattcaatatttttaattaagcctttcaaaatgatcgaaccacgaaccagtctgatcaaatttgccgccgagttgttaacatcaagaccgaatttgtgcagtgcattgtactgacccgtgccgaaaaacgcgagaaattgatcatggaactgaggaaggctgacttcaatggtgtaaagatttggagcaaaatggacacaaaaccaaaagtaaatttgaaccaaaattggtgggaatttgttttagacatgccctttgacaccgaatttggaggcaccaattcggtggtcgaattaaacaaacaaataaatgatgactttcgaccaaatttgtcaaaattcggaccaggtttagtcgtaaaccgaaaattttacccgatttcgggaataatgctcgaaggagtactcgatatttacgataaatatcgagaattttggtggaacattgaaaaggaaaacaccaaattcaaaattctaaaaattgccaaaaggatgaaacaaaaataataaaagcaaatgaagaaaaagaaaaaaccatcgaatttttcatggaaactgatggtgattcaattgaatttgaaaccgaatcagaattttttcaggaagagcaagagaaaaattcggccaagagggctgacgggcgtctaaaactgacggtaaaagcaaatgccaatcaaaaccgtgttttggcaattaagggcgttgtcaaattttcggcattcattgccatttttttgttatgccaaaatttggtttgtggaatggaagaacaaaagaaaatgttaaatgaaagcattttggatgagagtgatgacgacgtttgtgtaaagtcaacgaaaaggcgaaaaagtgagcaacgccaaaaggcgaaaaatcgtttatga

SEQ ID NO: 58894 - DNA, 941 bp, Heterodera glycines
  Genomic contig location: Contig_ID=SeqID_5681; Location=227..1167; Strand=+
  SCN-specific regions: Sequence locations=1-27,52-97,130-158,264 -539,561-714,748-941
atgcaagatcctatgttaagagaatgcaaaaaatttaaagaatatttgcttgttttatatgaatttttgttcaggaaataccttgaaggtaagtaagaaatttttcttaaatgccaaaaaatccaaaatttcgctatttttttcatacataatttgtgtattttttataaattataattttgatatttttgagatttatagaaatttcttatgagatttaaaaaaaatttttcaaaaaatataattttttatttacatattttggtacatattgggagatttacgtatatattcctatttttttacatttttacttaatattttatggtttttcttaattataaaatttacatccctaattattagttaattgtccatcgttccaattcgccaccacagtacaaccaatttttgtacttggaaacagcaaaacaaatgcgacaataattgacgttttggacagtcttggcattatttgggcattcttttttgattatgcgtatggccaaaaatatgagaattacttggaaaagttattcaaagaaaaggcagcagcagaaccaaaatggttgaacgaagaaacaattgggcataaaattgtgaacaatttacaacaaattaccaaatatggcgcagattttaagcaaatctttgggagagaaaaaccagataaaattgacgatgagcttaagcaaagtttattaattgatgatgctacaaatcagcattcttcaaaggcaaattcagacaaagcaattcagtcattccgtgaagcatttgatggcataatcaaatcgatggcggaaacggcaaaaaccatggaggaatcggaggaaggatttggcaaaactaaaaaaatttgcgttatctattcctttgagatcatttcgagaattatttctttctctatgctttccaatcgtgagtggaaaacctgctga

SEQ ID NO: 58895 - DNA, 1698 bp, Heterodera glycines
  Genomic contig location: Contig_ID=SeqID_5681; Location=2253..3950; Strand=-
  SCN-specific regions: Sequence locations=1-193,215-1538,1562 -1571,1600-1698
gttataaaacgtgttcgccatgacgaagatgtaccacctgctgcaccactcagtttggaagcattggaattgccgcccgcgtacagaatgtacaatcgaacagagattgacgaggagaatttcttattggcggacaccggcgtttttcaaattcagggacaggctggaccgcaaaggtaaaaataataaacccattaatttttaaaaaattccatgttaagaattttgatatttgctcgcgcttcgacttcggaatgggccggtattatgaaaaatgtatacgcagatggcactttcagtttggcgccgcctttgttcagtcaaatttatgttctccttgcaaagtaaaaccttaattttttaccacttttttttggtctttttaggcgtgataaatggggttttccgattgcgtactgccttctcacttcaaaatgtgaagtgatatacacacggatgcttcaactgattgtccaaagatggccaaattttgcacctgacaccatatcgttggacttcgagcaagcgatggtcgctactgtccgcacagtctttccactttgtcgtgtgcaattctgcttttttcacttggtgagaagtatgaagaagcgaattgcttcagagggtttaacacaggtattgcattgttacaattttccccaataaaatttttcatattaagacgtacaacaacgacgccgtatttgctgaaaagagcaaaatgatcacatctatggcttttcttcctgtccaccatcttcctgctgtcctcaatgctttggaggcacaactccctcaacagcttattggcgtcttcgattggtgaatttttaggaatggaaaatcaacaatattttttaaaggttcacggacaattacaccggaaggccgcggttcaatggtggtttgacagcgcctcggttcgcaccggatgaatggagtgtgcatcaacggacgttggatggaggagacagaaccaacaattacgcagaagcataccatagaaaacttcaacgggcatttgattgtacacatccaactgtcttccgcttcatcaacacaattcgatgtgagcaaaaatcaattgatgcagacatcgcccgatgcatcgctggtgaactccctcctcaaaaggcgcccaaatatcgtgccgccgatgcgagaattcttcgactcttgcagagctacaatgccatcaacaataaccaggctcaccaaaatgatcacaattaccatgcccttatcaatgttaacccctataacatcatcaattttctccttggtatttctcggaattatgagatgcgcccgtaatattttcaatgttttgttatttttttgttgttaacacattgataaatctgttatggtgttaattttaaagaattttcgagaaacaaatcagaattggatcaatgtaggacaaaaacagcttgccagactaaaacgaccctctgactaaaccggccagactaaaccgaccctctgactaaaccggccagactaaaacggccagactaaaccgacccccaccgtcgtttaaataattttaaatataaaacaatcgcttcaatatatttttctttttaaaaattttatccaaaattgccacggattcaaaaattccgcggatcgcgcatcgcggattcaataagggagagtcaatgacaatggggaaagaaacgagagtaaaataaa

SEQ ID NO: 58896 - DNA, 796 bp, Heterodera glycines
  Genomic contig location: Contig_ID=SeqID_5682; Location=693..1488; Strand=+
  SCN-specific regions: Sequence locations=1-796
atggcacgtcacatttggcccctgctgaagaacggactcatcattctggtcaacatgaagcggacgcacctcgccaggatgcacaaatacgtgtcgccgatcgtcctgttcgattgcccagaacttgtccaaatcagcagcactgttttgcccgagagtccgaccacttacagcacgtcgcctgacttctcaacccgttgcctgtacaattggctgtacacgccgcgcccagatggtcgtccgctggtgttcaaattgaccaaatgggaagcgggatgggagaacttcgtcaacgatttgttcgcggtgggtgtggggtgggtgatgatcgacggatggattttttcgttctgatcaaattttccgcttttagtccttcagtcgtgcgatcgtcccggtcaagtacatggtgctcgcttcgttcgacgtcaactacacccggagtgaacaaatggttaacactctgacggaggaaaagctgacgctgtcgagcgatgtgcatccaacgccggatggtggttttgtgtcatctgtgaagattctacgttgtccagcggagttcacggaagcgaacgtgatgtcctggttgcgtctgccgcgtgtggccggcgaatggcacccgaatttggtgaccattggcttctcagatgacgaaattgggtatggacgagttgaacaaatttaagattcagtgttcttatttccttcattttcagaccgatgccttcgaacagaggaaccgatcgggctgagaactgagaaggataactgcggatcaacaacagatgagccctaa

SEQ ID NO: 58897 - DNA, 1238 bp, Heterodera glycines
  Genomic contig location: Contig_ID=SeqID_5683; Location=902..2139; Strand=+
  SCN-specific regions: Sequence locations=1-28,68-106,163-260,282 -776,798-875,916-1147,1178-1200,1230-1238
atgctggtccagggttcgaaaaatggccaggtgcaaatgccatcctgggaaaacaacatctcaaaatcgcaaattataaaatggtggttattcgtaaaaaaatcacttaaaattaatatcagaaatttaattttaaaaacaattgaatttttctttataaatgttgagcgtttcaaccgcacaagacctttccaaacaatttcattgtttattgctttaaaataaaaaaagaaatttctattttagcaaaaatgggtacgttccaaaattaaaaattttaagattgcttaattgctgatacatttttcaaatgtcaacgaataacgaggtaaaaggtgaaatatttaattttaaggacaattcaggggaaagggtcatttcggcgccaacccaaaaataaaaacacacaataaagggttttaaaggacggtgaatcagattatgacacccatttcgaaccccgaacccggactcgtacgaaaactcgaaaattcaattttcaaaaaatccacatttatgcaacaaaaacggttagacctagttcgacccaaaaactcaaaaatttaactattcgaccttttgttcgaatccaggttcgggattagaaattggtcgaaatgaatgctatatccgtgatcagtgacctcgaaaacccctgcatacttgttttcaggacttttaaaccaaaaaaaaaagtttgaaaaaaatttgacaaaaaatatggacccaaataggcatagtacccaattttcgttaaaaaaaatttctagctggtttgattttttaaaattttggcttagcgccgaaacgtgggcgccgaatcgtgggcgccagaacgaccccgaccaaattcggcagaggaaaaaaattattggaaaaattaattaaaatataatatttttttatttaaattttccagctcattatactttgggattaagaattattttcaattaaattcagctgtacgatctttacaaagatgctggattggtgccaatcgaaattgtcaccaatggcattattgctgtcatctgtttttccggcatcactctcaacatgttgcttgtctatgtcaccgtcaaatcaaagtgaaatgccctcagatttttgatgccataacttaacaaaattaattgaaaaatgcaaatatagaaattaaaaaatatatatatatgatcttaaggacgaaaaaatttgaaaaacacaatttttggggaattttctttataatatta

SEQ ID NO: 58898 - DNA, 527 bp, Heterodera glycines
  Genomic contig location: Contig_ID=SeqID_28264; Location=173..699; Strand=+
  SCN-specific regions: Sequence locations=1-151,180-504
atgccaatggaagttgacgacgtggaagaggaaaactttgtcagattgagagaaacgaatcaaatcaaaatggacactttaaacaaagaaattgccgaaacagtttcacaggaaaatataaccaaattaggtaaaatcacaaattacacagattaaaaaacaaataaaataaattaattccagaaaaagtcatttggcaaatttttgctctcacttttcaaattgtcggcattgaactcaatcccactgatcaaataacgcgaattcttcaacaaacattgaatttcgatcagttggcattggcactttgcaattccaattccgaattggttctcaatagcattaagactcatttggtcaacaatgagcatttgaaaaagaaagcaatatttgctaacatttttagccgaataaatagtcaggcaaaagacatttttggacaaccactcgggtagtgcttaatattttaattaatttacacaccaattctgtcgtatggggagcattttaggaattaaaataagaaa

SEQ ID NO: 58899 - DNA, 1457 bp, Heterodera glycines
  Genomic contig location: Contig_ID=SeqID_28265; Location=5..1461; Strand=-
  SCN-specific regions: Sequence locations=1-211,238-302,324-325,347 -376,398-1136,1165-1424,1446-1457
atgtcgaaaaaaatgaaaattgcaccttataaaaatattcgttgcgaacaaactggcaatggagcgaacgaagaactcgaaaattttatggacacaatttcggatatcgttgttggtgagaacatcacaatcgattcggtaagtcaactaccagtttttgtgaaagtgcaattcgattttttggcaaaatcaacaagggaaaattctacagtaatattaaaatattatttaaaaattggccttcaaaaaaggcgaattcttcaattttagcaaaattttatagaaaattagattttgggatggaaaaaatataatttgttaatagattgtcactaaaaatagttaaaaatttttgtgatttttaagtcaggcggtgatttttaattatttaaaaaatcatcttttgcgaaacattttttcacaaatctttatgaacagtgttgtgccgcagcgagaaaaactttaattctttacattaaactccatttttaggcaaataccaacggagaacaccaggaaagtgaaatggaccatgcctggaggccaaaccaaaacatcgttctgcacgacgaattccaaaatgctttggcattaaacatggacgtggaaaacaataaccttgaggaagaaaattcggaaaggtaacctcagttaaattaaaatatctggcgaatgattttttatttgggtctggattcaaaaatttttcaaatccaaaaattagattttgtggtcaaaaatttaacattttttgcgattttttctttgatcaaaaaacgatcaattgttattttttcacatgcaaaagtaatagtaattcttatttacacgccgccattttttacttaaaaatgatattaatcaccaattttagcatgggtgatcatcactcattcgccaattctgtccaaaatggtcagcaaggtgcatttcgattgccaccaattgaaatatttgttgacggatcacttccggaaaaaacggtaaagatgcgcgaaaacatttcaagtcttgtggcttaagtttttgcttttcggatgaaaataagggttattttaatcaaagtgccgtttttaagccgcgcattggcagcattcaaggcatcaataatccggccattcgcagtttggatcattgtgggggcgtcaagcgcatttccggcctgatctacgaagagaattgcacagtgccaattgtcagggagaatgagccgacatttaatgaagaaatagggccacaagatggcaatgtgtccgagttatccgtatgtgcgacggacaaaagcagccacgggagggcacctcggttagaactgattggttctgacgtttaaaattatccttgtgttaaagggcacgttcaaacagtaatgtcagtgtgccgttaaacaaaagtcagcgaaaaagggccaatcgatctgaccggaagaaatccggaggccgggtgaatcaaataaa

SEQ ID NO: 58900 - DNA, 1068 bp, Heterodera glycines
  Genomic contig location: Contig_ID=SeqID_28267; Location=1..1068; Strand=-
  SCN-specific regions: Sequence locations=1-778,800-931,956-1068
ttattcatctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaatttattcatctccctttttgatagaaaaagcatcagagtgcctaaactagcatgtaaataaaatttggtgcgtttcagagcattttctgaaaaaaatatttatgaataattttgcaaaa

SEQ ID NO: 58901 - DNA, 288 bp, Heterodera glycines
  Genomic contig location: Contig_ID=SeqID_28269; Location=412..699; Strand=+
  SCN-specific regions: Sequence locations=1-66,90-189,219-288
atgaaggaaaatacacgacaaatgaaggaaaacgccaaaaaattgaaattggaggaaaagggtgaaagattggaggaaaatgccaagaaattggaggaagacggtgaaagattagtggaaaatgccaacaaaatagaggaaaacggtgaaagattggtggaaaatgccaacaaaatagaggaagacggcaaaagattgattgaaataaaaataacagaaaaattcaaagaaaccgctgaaagattgatagaaaacaataagaaattgttggaaattcgtgaaaaatag

SEQ ID NO: 58902 - DNA, 62 bp, Heterodera glycines
  Genomic contig location: Contig_ID=SeqID_28269; Location=63..124; Strand=+
  SCN-specific regions: Sequence locations=1-62
aaagtcatagcgcacccgctccgtatctaggcaacgttagagcaacagatgtagctgactag

SEQ ID NO: 58903 - DNA, 1264 bp, Heterodera glycines
  Genomic contig location: Contig_ID=SeqID_5685; Location=729..1992; Strand=-
  SCN-specific regions: Sequence locations=1-17,39-106,131-142,201 -357,387-413,435-452,475-544,585-599,621-693,732-933,1242-1264
atgcgcgaacggacggaaagaaatgagaaaaacacagaggaaatgcaacagaaacaaagcggaagaaatgagaaaaagcggaagtggaaaaagcagcgaatgaattggtaaggaagaaaagaaaggagcacgtgtaattcccagacatttttcattcaaaaatcaattttgcctatcaattaataaaggattgaatgtgataaatagaattgattaagaaatgattcaaaatggacccgccggtcgtaaatgatgaataaatgaagaatgagtgatcaatggaatttttgggtccatttttcaccggatatgtccgtttttttgttaatggtcaattgatttgacgacgtattaatgggtttgttctgtgtgtgtgtttttggggatcgccgccgccgctcaatcgcatcgcattgttttgctttttgctccttccgccgccgccgtttgcttttgattggctgtcggcggcgcagctgcccacataaaaactgccgggggcgaatgaatgcgagcgaaataagcgagtggtggtcgccggccgcacacgccaccaccaacaacaaaatcacatcacatcacacgcagcacaagcacacgccttcccctttcatcatcaacagcattcaattcattctcaatcattagagagcggcgaggactgaaaacgacggcggcaagggaatcccagcacatcattagcatcataattatcatcataattatcaacaaaacaatcatggaaaatatgtctaatagacagcaggaaaagaccgaaaagatcggcgaggatgagagagggaggaaatgatggaatgatattgagaagggatttatatttggacaagtgggaaaaagagagaatggcattcactcggagggatacgggggaaaataaagggacagtcagaggaaaaacaattcacactgatgagacaaatgatgggaaggaaaaaatgaagagaaggtggggaagagataggcaaaagcaaaaagggagggaagagaagagaagtgttggatggatgagtaaaagcagagggcgagagggaagagaaaaacgaacgaaagtgaagagaatgggtgcctaaaaggagagaggacatagaaaaaggggagaaagtgaatgtggtaaggggagagaggatcagggtgaaggaaataaggacaaagagagagagagaaaatggaggataggaaatgctgatcaacgaagggatagagggagagaaagagagaaaatgaagttaatagcaaaaataaa

SEQ ID NO: 58904 - DNA, 77 bp, Heterodera glycines
  Genomic contig location: Contig_ID=SeqID_28272; Location=493..569; Strand=+
  SCN-specific regions: Sequence locations=1-77
atggtcacagccggtcagcttcaagacttgtgttcccggattcccaggctcgccgacaagcatcaaaatcacaaaat

SEQ ID NO: 58905 - DNA, 318 bp, Heterodera glycines
  Genomic contig location: Contig_ID=SeqID_28273; Location=19..336; Strand=+
  SCN-specific regions: Sequence locations=1-153,176-318
atgccaaaagcaatgccaaaagcatgccaaggcaatgccaaaagcaatgccaaaggcactgccaaaagcaatgccaaaagcaatgccaaaggcaatgcatgccgactttgtatcttagcaggtgccgtccacttcgctttcgtcccttcctcccgcgtccgctccctctccctccgctcgtgccgtcgtcgacttggcacgttccgcgcttctcttcggcactgccggttacatggtctacagatttgttcgttcgtggctgctcccgcagcttctcaatgtgccggacccggccgaggagcgtatgcaacgacttga

SEQ ID NO: 58906 - DNA, 547 bp, Heterodera glycines
  Genomic contig location: Contig_ID=SeqID_28274; Location=174..720; Strand=-
  SCN-specific regions: Sequence locations=1-547
atggccctctattctgtcttttgctggtgttgctctgcttgggcctcatcgtatttgctgctctattggacaccttattggtcttgcatgaacttccgtgcggatgacacaaatgtgccgttggtcacttttgtgagttttgccgcccatttgattctgcattttccaatttctggatttttcaggtgttcgacatcgtcatggtgtgttcgttcgtcttcgagatgttcttcaacaattcgctggtgaaaaaacggcccgagaatgcttcagtcgctgccgctaatcgcaaattgcgcaacgatgtcgccacggaatgtgccaatgtcgccattcatcgccagcagcagcagaagaacggaagtgccatcatcatgcaaacttaagcagaggacggacgagtgggatgaagaatgatggtgctggtgccaacaaacattcaatgcgatgaaatgatataaagcataatatgtatttctcagctgtattccattgtattgtatattccattatatcgcctatatgcgtatgcatggtctcaaataaa

SEQ ID NO: 58907 - DNA, 1474 bp, Heterodera glycines
  Genomic contig location: Contig_ID=SeqID_28278; Location=55..1528; Strand=+
  SCN-specific regions: Sequence locations=1-75,135-285,307-674,705 -732,754-841,864-882,905-1474
atggatttgtttggcgaaccaatttggaactatgcgcgaatgattggcattgactctaacaaatgcattggtgtgttattattttttaaatttaagtataaattattcaaattattaattttatttatttataactgtttgactttttaaacaatgttaagcagtgaaagaattcggagaagcattgagaaaaataattcatgcgaaattaaactcagttgaaatgaacaaacgccaacaaaaacgaattgaaagcccaatccaaatgaatgaattccaaattttgaaaaagattttagagaaaattaaggacaacgaaaattatgggaaaatggaaaattatggacaaaaattcaatagcattctcttagataaacagggaattgctgcgttaaaggaacttttggccattttgaaccaaatcattggccattactccggcactgatgagtcatgcccgatggaaaagagaagaagcatttatttagaaagttttagagagaaaataaaattcagcaaaattttatttgaaactctcagcaaatattcggaaaatgtgaattatgacgaaaagcgtcaattgcttacgtttcccctgtcaacgggcgaacacattatcgcgcgactcagtgcattaattgaactaattggccaacaacggttggttaacgtacaataaatatttaaaaataaatacaaattaagtgtttgaattttgtattatttttgattaatttgctatgaaaaaatttctaaatctgttgatcaaataaatttgaattgcaaattttagtcgcacagttcgaaatgatcatattagtagtcaaattgatgttgtgaaaacaattcaaaacattgcttcaatggagccaattcaattttatgagcgaaaattcactttgtattggcgtgaatgggtacatttcgacttgtttttctccatggcaattcgtttgagtgcacaaattgagcggaacgatcatttgaacgcattattattatccgccagcccaaattatcactcctattgtatgtaagtaaaatagattaattaattggtactttctgctggcttttagggtctaatccgtggcgcagatcccatttgaaaaattcttagctcaaattgtggcatttatctttgcgaaataatttgtaattggcgcgtagttagggctacctaccgccacaccggcgggatgcgctaacggaaaaacttacaaaaaatgttcatttcctgaaattactccagcgaattgttttcgcttatcaccagaattattttagctttttcgattataaaattcaaatcaaaaatggcaatttggtggagataaacaccccgacttggcatgcgccttattatgtgtattggggaaacgacaaagatcagatggtgacacaatctcagcataggaggagcaaagaagcattggtacaacgagaagctatgggtaaaaaaacaattaattaa

SEQ ID NO: 58908 - DNA, 1914 bp, Heterodera glycines
  Genomic contig location: Contig_ID=SeqID_5687; Location=361..2274; Strand=+
  SCN-specific regions: Sequence locations=1-331,364-539,590-991,1016 -1550,1572-1708,1730-1914
atgccatctcaaaatggggcaggtaatgttgccattgggtgtccattagctaataaaaaaaaatcctatttttagtaattaataatgctaaaattagggtcagattacattttagtgccaataacatttaagcagagccaattaatttaaaatttcttttgaataatttctgagaaacaaaatgctttcggtaattgtgattttaaaaaaatcattgaaaacgcaagcaaaaagcaaattatcgttttcaaatcaaatttttttgaaatttaacaaaatagtaaaattctcggatgataactagaatgtttcttttaactggggatatgagaaaaattatcatttaaataaaattaaataaaactccaatgcacaaaaattgccactcccaaagcgcaattggtcataaaaagcaattaattaagtaattagcaaaacaaaattgttccccattcccaccagcagaaaatagtgccgtcgttgatgcgccacagcttgaagaagagttgttgctcaccggctcatccccatccgttgaggaggagcagcaacagcaactgcagcaggaggaggaggagaaggaggtcgaaatgctgcacatccacggcatggaacagccaccacatcagcagcaaattgttgctggcactgcttcaacttttgctgctcatgctgctggtgccgcttctgtggatgatatggggccggccgccgcttcaaatcggcaaaaccgtcccgcgagtggcagcacgctgccgcgcagccgggcacagtcgcaggacgccgacgcgggcccgccctacgcgtcaacgccgacactgtgcccaacggacgaaaacccgacatttttgcgtcatttatggcttccagaagagcccgagggcacggagcggactgcgaattttgtgcgcaaaatggactcacttgaggtgcctacaacaagcaggattatcattagtaaacttagcaacaaaaaattagcaaagctcgagccctttttaacccaaaaaggaaatttgtctctcaagtcgagactcgtgactttcgagagcactaatgtcagggtattcgagggaattgggtgttactttcccattattatagttggtccctcttccctgtcttatttgttaggcatgtgctcggctatgtcgtgacaacgttgagccgtttgggggacggcattttgcgtgccacggcttcacttacattggccaacgaaacgcgcgcaatgcatgcgaattctttgacgaccatttggcggcggcacttgagaagaagccaccgctgggcgccttccaccaacagggccaactgctgagggccgacatggcaccgcaattcccaaaaaattgtaattagccgcaaaataatggaaaatttttcaggggatttaaaaaaaattgttgcaaagattttgagcgcatttgccttggccttccgtcccgttgcgcgcgtttgccgttcgcttttgacgtgcatccccgcaaggcattgcacgtcccaacggaggcgaagccgttgggtgttgagcaggtggacgaccggaagcaatgcctgcagcaatgtctgaacacaaagggatgccgatcgttggactttgacacggccaatttgtaagcaaaggcaacctaaatcatatcggcttaatcaaattggagtttttaaattggctattttttcttgtgcctttttaggatttaacgagttttaattatatatatataaagtaaatcaattgattccgctgattctgagctaaagccccgcttatgactagcaattaccgcatcccatttttaaaaatatggtttcactaattgccaaattttatgatgtcttttccgtcatgtccgtatgaacggagtttgccattctgtccaaaatgcaccaagaagtttggcattttggtca

SEQ ID NO: 58909 - DNA, 521 bp, Heterodera glycines
  Genomic contig location: Contig_ID=SeqID_5687; Location=3027..3547; Strand=+
  SCN-specific regions: Sequence locations=1-156,179-521
atggaattgcgcatggacgaggctgaagacggtccaattgttggtggtgttggtggcatggaacaacaacagcaaagcgaaccgggattacaatatggaacaggtaaaattcaatgaatatatttttagaattgagaattatcttcgacaattcaaaaacttgatttaataaaaatgacttggactgagtccaaaatgccgcttctttgcttaaaaaacttgaggctcggggtctagatcatggcaaatcccaatcgagatcatacgcaatttgagactggtaccattcccatttagacatgtcgggactgacattggagcgctgcttggatgcgtgcattcttggtcaactacattctgtccgtcactcggcacattttccctgttttcagatgagtcatgtgtgtcgctcatttttcgtccattttccggggatgacaacgaacaacggaacggcacaggcgcagtccccggcgccacttccatgtgccgactgttcccatttggcaaaatggacaatc

SEQ ID NO: 58910 - DNA, 1702 bp, Heterodera glycines
  misc_feature (13)..(13): n is a, c, g, or t
  Genomic contig location: Contig_ID=SeqID_5688; Location=83..1784; Strand=+
  SCN-specific regions: Sequence locations=1-43,66-321,358-701,736 -775,797-897,944-1052,1078-1297,1320-1492,1514-1702
atgacgacgacanaagccaaggaaaagcagcagcaacaggtggacactgctgctggagagaaaggcaaaaccgaacagggacaaatggacacggtggtggccaatgacagtaagtgatcaaaccattggtgatcggggtcaatggcaactcgtacaaaggcaactcgtacaataaaaattttcacaaaattaagcctaagcctgagcatatacctagcctaaagcttaggcctaatcctaagtctaaagcttagggctaagcctaagcaattgtgttgtcatcacagcacatcggtgatcgaatgttaagccaagcggaaggcattttggagatttaaaaaagtaataagcaacaaattgtcaagaattgtccccacaattttaattaattgttgaagcaaaagttggagaaccgaaaaacaaaagcagcacaatgagagaggcagaagagggagaagaagcacaaacaccaaatattgtcacttcgaattggccaactttggcatcgtttggccaaacaacagcttctttcgcttttggcagttcgacaaccgcactagcatctgttgttttatcggaacaattgtatcatgccacgggtggttccgctgatcatccaaactcaacactgtcaccattgtctaccgtatgcattttggaattgaaaagaaaattaaatttacgatttattattaaaatctatttcttggactggaaaaaagggttttcaaaaaagaagtaagtaccttgaaccgttttcacgtgtagtgatatcggtttttgtaaaactgataattcccttccgggaaagcgtttttaaagagagaagtaccgaaaccgttttcttgtgccggtggtatcggtaaaaataccgtatgcatttttggattggaaagcaaaattaaatttacttatttattttgtatttttttaaacaaaatttgagcttttgtggccaattatttttttgtagttttccattggacaatttctttgttaaattttattaaaagtcccaaatatttccttcgctgggcctttcgctatttgccggcccccaaacccttttaaattttatacacttgaactttccataaattatgacgcaaagatacataaatgcaggaatcagacagcaaatgttctgcaaaaatgttgcacagtttgctgttggagcggggccgcacgctgaagttggagcagcgtcagcaacaccaccgcaacgtgacggacgcgttgcactgcgagcggttgtgcgccgacgcggacgatgtgccgccatcgttggccaccagcgcgtcgtcgtcgtcgttcacatgtctagcattcgcgtacagcggccggtcgcacgaatgtctgctctcgtccacacgaatcaaaggcggagcagcgggagccgccgagttggagctgttcagccaggcggacccggactttgacctatactcattcgttgatagtcaaatggatgaaaattgcggggacaaatggtcgacgacgacggcgagcagtacagcgagcgtagcagaagtgaatggtcagtcttgttattcaaattgataaatttgaggtgaggggtggttcaattcccagccgcagcctttcaagtaatccagtcgaaatgacaaatgccgatcactcggcaatggatagtattgtcggtcatgtcagtggccgcatttcgagtgttaaatatgaggca

SEQ ID NO: 58911 - DNA, 1173 bp, Heterodera glycines
  Genomic contig location: Contig_ID=SeqID_28286; Location=345..1517; Strand=+
  SCN-specific regions: Sequence locations=1-71,93-285,307-445,467 -1032,1055-1173
ttacattgaccattccgtcctcgcgtttctccgtgccaataaccaaatttgggacaaaggcaccaatttgtatttgtatgtgtgcacacatggcaatgccattcatatttggaatgtttttgtcggagaaatttggcccatttttgcaacaaatatttgccgtttggcctttatggatggtgatcaactggacaatttgattcgtttcatttcgccaacaattctctttgacctcaacattgattctgtccattccggtgaactgcttcccgatggaattgctgattttgatgggccaaatgcaactccaactgctggccaagcgttgtccaaatggttgcacactccgagaaaagatggccaacccaagcgattgagttgtgatcttatgtcaggaaccattgaatgggtcaacaatttcaaggaggtcagtccccaatttttcgtaaaatatttggattaattggcatttgcttttcgtttcccattgtttaggcatttctccgtgccaccacttcttctgccagctacaaaattcgacttgaactttttgagccaacagaaattgtgccatttgaattggtgaacgaacggaccagcgaaattctaaaattggagaaaggagaagttgatggatgggttttcccatggataatgaaacgatgccaaattggagggccggcggttcaatgggaggacgaaaatttggataatttgaacgatgtccattttatgcttcaagcagattgcattgggtgatttgcttttattggtgccgtcacattaaatttcatttcatttatgccattgtctgcgcaaaaggcgggtcaaatgaacgcaaaatattctctgaaaatgagtgccggaaaaagtgaatgaattattaggaaatgagaaattctgatcattgaatggaaattgatctgataattgctcctcatatttatttgttgcttctttcatttgatcagaaaactacaaaaaactggttttgctttttggatattgataatttatccaaaaaaaatttaaaaatggtttataaactggaaaagcttgacaaatgcgcgaccgcgatacgcgattggcggcattttttttgcgcgatccgcgaccgcaggatttttctgtgcgcgctccagccctgcttcgaccaatagctttcagttttca

SEQ ID NO: 58912 - DNA, 976 bp, Heterodera glycines
  Genomic contig location: Contig_ID=SeqID_28287; Location=337..1312; Strand=-
  SCN-specific regions: Sequence locations=1-976
  Gene Ontology: Mol. function=acyl-CoA dehydrogenase activity; Cellular component=mitochondrial matrix; Biological process=energy pathways
atgctttcgaagaaactaattgccttttgttccgatactttttccggaaaaggtttgtcgtctcgaagactgatcagttttgacctatctgaccagtgagtggttagcattttgtcacattgtttatcatatcacattcacaatttaagacataaagccatccgggatggagctcttaaattcgcgaaggaagtggttgcgcctaaagccgcggaatatgacaaaacaatggcatttccttgggacattatcaaacaggcgcatcaattgggattgatgaatccgacaattcccgaaaaatatggtgagtgtgtcgaggcggtttttaatttaaaaaaatgtcaatgtaaaaattaatattttctggaagtagtgttcctgaatgaaacagtactaagtaatttatggatttgccgtccttttcatgtgggcctggttgttccaatttggagactgctctgatcgttgaggcgttatcttatggctgttcggctattcaattggccattatgggcccatcgcttgcgttagctccgcttcttttggccggcaacgaaactcaaaaacagaagtacgccggcatgttggcagcggaaccactgattgccgcgtattgtgtgaccgagccgggggcaggctcggacgtgagcggagtgaagacaaccgccgttctgaaaggtaactcatttaaagagggagagggatttgaaaataaatatttcaggagataaatgggtgctcaatgggagcaaggcctggattaccggtggcggatacgcaaaatggttttttgtcttggcgagatcggactcggaccccaagacacccgctggcaaggtgattgctttccttaatcgtttctcatttgtttaaatcttaggcattcactgcctttgttgttgacggagacacgcctggaataacccgcgggaaaaaggtaatgggaagcaattggatcaattgggattcaccatga

SEQ ID NO: 58913 - DNA, 447 bp, Heterodera glycines
  Genomic contig location: Contig_ID=SeqID_28287; Location=1553..1999; Strand=-
  SCN-specific regions: Sequence locations=1-447
  Gene Ontology: Mol. function=acyl-CoA dehydrogenase activity; Cellular component=mitochondrial matrix; Biological process=fatty acid beta-oxidation
atggctatcaatgtggagttggcacgattaatgaccttcaaaagtgctcaggaagtcgactcgggtcgaccgggggcatattgggcatcaatcgccaaatgtttcgctgctgacactgcgaatcagacggcgtcaaatgctgtccaggtatatttttaatggttgaaaaaggcattaaaaacttatagatattcggaggcaatggcttcaacaccgaatttcctgctgaaaaattgatgcgcgatgccaaaatatttcaaatttatgaaggtggttttgctggacgaatatgctttacaaaataatgacaacttttataggcacttctcaaattcaaagacttgttatttctcgtcagttgctgcaacggtggatttatttatcaaaaaaataaattacctatacttttttagagttgctcaaactgggacatcttatgttacttaa

SEQ ID NO: 58914 - DNA, 376 bp, Heterodera glycines
  Genomic contig location: Contig_ID=SeqID_28290; Location=535..910; Strand=+
  SCN-specific regions: Sequence locations=1-376
atgctggattgggcaatggacaaaatggcatgcgggtacaaacaggcaatcttaatccctaaccagaatcgccccattttgaagtacggtttttttgctggctcgcaacagtcggatccgtcaagttttcttttgcaacagacaacagtcgaagaaggtgttagcaacggcgacatttgccataatgcgcagcgacatcagctgcaattttctacgatgaacggccaaaatggcggaatgtgttttccatcgaatttgccatcagcaatgtcgatgttagcaaatgctcctcaaagacgaacatttttattcaattcggacatggcaaacaccgctgctaaatctatgcagcagcatttaaccgaagacatggccg

SEQ ID NO: 58915 - DNA, 562 bp, Heterodera glycines
  Genomic contig location: Contig_ID=SeqID_28291; Location=358..919; Strand=+
  SCN-specific regions: Sequence locations=1-64,104-242,298-562
atgaatgcattgaccgctgcgatttttttccttcgttttatctgcgcattcggtaaagaataacaaaaataattattaaattattttaaagattaaaattttaggcttgaagtgctttcttgaatttgaagggaatggaaaattagccaaaaaccaattggatgatttcgagtgcccgcttgaggggcagctctgtttgttcgctcaatgcgtggacgtttacggaggtagtaaaagcgaacaaaaataaaataaaataattatttttttttaaattattattatttaaaaattaaaggtggcattatgccaacttttgtcggctgtcgtcaacgggcgaatgacaactgcacggaatttcttgcgaaatgcaaatcgctgcaagccgatggatgctgctacacttgcagcacagataggtgcaacagtggctggacttgtggcaacgtgtactgtacaaataccgtattggaaaggcggcatttttgtcactatattttttcaaattccaggagtacaatcacttccaccaccacgagtacttcgacgacaagtacgttga

SEQ ID NO: 58916 - DNA, 246 bp, Heterodera glycines
  Genomic contig location: Contig_ID=SeqID_5690; Location=968..1213; Strand=-
  SCN-specific regions: Sequence locations=1-130,183-246
atgtcaacagatgccgaaaaaagtcgggaatttccgataacaataaattattggaagttggtataccgaactctaaaaatctgcttaaatgaaagggataggcagacattctgatacacaagagctttagaaaatatttttttttataaataattatttcaacaaaaataataataattttagagcttgccctatcagaatgatctcctttaacctaaattatatgctaacaataattcaaataaa

SEQ ID NO: 58917 - DNA, 642 bp, Heterodera glycines
  Genomic contig location: Contig_ID=SeqID_5690; Location=276..917; Strand=+
  SCN-specific regions: Sequence locations=1-35,123-150,184-417,440 -500,523-642
atttaatattattttgcatttttttatacatttccattttttattttataatttttccaatgttacaaaatttgaaaatataaattttacttttactaaacataaaattatttttattttttcggccggagaaaagataagtattcaaggtaattaaaaaataataaatatatttttttaaatgttaaatggccaatttaggaaaacttcatattcaaaaatatcttttggatttggcatcagatgtctatttaaatttgaataaacattcatatgaaaaatttcaaacacaagctcttcaagctttctgtagtgaaaattttttgaatgaaaatgaaatacaaaatttgataaatcagaatttttataaaaatggcaaaaaatgatagacattttttgtatgcagatgagtcaaggaaaaaacatagaaaattttgaaggaacgattcagaaattgggcattgaataaagggcaatccaattataattaatcaaaacctaatgttttcaaaaacaataaaattataccaaaattggatgaatccgaaattacttcaccgaagaaaatgtcaattgaaaacaaaaataaacttttacaacatttttatttgggagtcaacgaattttttagagcatttagcg

SEQ ID NO: 58918 - DNA, 438 bp, Heterodera glycines
  Genomic contig location: Contig_ID=SeqID_5690; Location=1451..1888; Strand=+
  SCN-specific regions: Sequence locations=1-282,305-438
atgtccacgggaccgagtgacgtcaatgtttggtgttttttggccattagcattgaaaatttttccctttatgcgcctacccatttgtgcaaaaattcaggagaaacttgacatgccggtcttaatcctacaaagggtctgcatcaatgtttaaagcgtaatttttcagtattttaggacacagaagtacgatggaattcgatgtttcaaatgcttaatcgtttcttacaatgcaaagctgccgttcaagtatttatgacatcggatgaagcaaagagaaacaacaaaggaaaaggcattccaatcattagcaatatcgaatggaaccaaattgagcaaatagtggatgttttaaaaataattaacgatgcgtcaaatgaattacagtcaagaacagccacaattggaatgataatgccatattatttcggaatttaa

SEQ ID NO: 58919 - DNA, 727 bp, Heterodera glycines
  Genomic contig location: Contig_ID=SeqID_5690; Location=1939..2665; Strand=+
  SCN-specific regions: Sequence locations=1-4,26-347,370-727
atggtatttattttcaatttagacacatttgacattcgaatcgcaattattgggaagttggaccaaataatggacaaggaaaaaaccgaaaacaacaagttgcttaagaagtaaaaaatttcaaaaaaagttttttttagatctttgatcattgcaactgtccttgacccccgttttaaattgaagttgtttgaacaaatgaaggaacaaattcgggaatggatgagagcggatttacaaaaaatgttttccgggtttttaaacacgacgttggttcgccaatcaagtacatcgagtagttgttccacggaaaaacctgttttttctggtcttttagaagttttaattttaatattttccataaagattttaatgattttagtcatccagtgggtcatccaatctctcaattaccgatgatcaatcgaaatcacaaaatgaattttacgatgcgcttcaccaaatggacaaatatttgagagagccgcgagtaaaatacaatgttgatccttttcaatggtggaaaaagaatgaagcggaatttccaagcttgggacggcttatgagaaagtatcatagtgcgccgccgggaagtgttgagtcggaacgcctgttcagctgcgcaggatttattttgaatgacctccgaaaaagtctctcgcatgaaaatctcgaacggcttatttttcttcatcataatattatcctttacaattttgattattga

SEQ ID NO: 58920 - DNA, 383 bp, Heterodera glycines
  Genomic contig location: Contig_ID=SeqID_5691; Location=42..424; Strand=-
  SCN-specific regions: Sequence locations=1-383
atgccaactgtacgcgaaatacttgagagtctgcaaaagccaattaaaaggccccgaattccaacaaatgaagacagcgtactgaatgctgagaggacagacgcagaacaacaaatggaagacacttcaaccaggaatgatttggacgtcgctgcaagcgatgatgaagaaaactgtgagcctgttcatgcagcttattctcacgctgggaacgaagacatcgtactgtcctcgcacgtttcccagatctcggttttggaatgtctactccagggctcaaatggcaattgagtgaatgagcaacggcatggaagggggcgcatggacaatttgcagtaaaaaattgccgtcggaaagcattatttttggtattttcagcgtga

SEQ ID NO: 58921 - DNA, 540 bp, Heterodera glycines
  Genomic contig location: Contig_ID=SeqID_28294; Location=607..1146; Strand=+
  SCN-specific regions: Sequence locations=1-148,171-190,213-232,255-540
atgcttcttcgcgacctcgtcgtacgacctccaatgcttcttcatctccaaatcatcgtacgacctccggtgctgctgctccgcgaacttatggttgtgggaccaccattaactccgatgctgctgctcgacgaaatggcgctggttgtgggactgccaaagccatgggtgctttgccaactgccggttgtgggactgccaaagccatgggtgctttgccaactgccggttgtgggactgccaaagccatgggtgctttgccaactgccggttgtgggactgccaaagctgcttctcgaactcgtcatgcgacctccagtgctgcttcaactgctgctgctgctgctggccgtagtcacagcggttcaagcaaatgcgtcttttgcaacaacaaataattttgctccatttttcaaggtgctgcaacgaacggagcggcgggcgcggaagtggcaccggcgaagaatgccaacaacaacaatacgacccgacatgggaatgcggccagcagctcctcaagcagcgacagtgactgaatga

SEQ ID NO: 58922 - DNA, 432 bp, Heterodera glycines
  Genomic contig location: Contig_ID=SeqID_28296; Location=535..966; Strand=+
  SCN-specific regions: Sequence locations=1-432
atgtacgttaaagtcaataagttattcaataaatcatggagtactccttttcatcaaaaaaaaggtaaatagacaaaaatcaatattctgcctttaatgtgaatagttagaaatgggtgcaggattagtgatcgccgaccccgaaaacccttttaaacatgttttcatgacttttgaatcataaaaaaattttcgaaaaagggggggggacaaagcacagtattacccccaaaaaataaggcatttgctgactttcaggaaaagcgagattttgtgaaaaatggctaccaattaaatccccggatatcaaccatattactagtaataggcggaatttggccatatccgaaaagaagcgaacaaaaccgagaaaccgttttattttgtagaacagtgtgtgggttggttaatggtacgagaatgcgacagaaa

SEQ ID NO: 58923 - DNA, 249 bp, Heterodera glycines
  Genomic contig location: Contig_ID=SeqID_28296; Location=921..1169; Strand=-
  SCN-specific regions: Sequence locations=1-249
ggactgaccctgacgaatcggcgagcagcaaatcgccctgacttttgacgtgttgaatgtgtgacttttgctgacccttgcgcggatggatctctgtgtaatgatgataatttcaccacccccattttttgtttgtttgttttttcttttgatttcttccgtttattttgacaccctttttttgtctcccttcccccttttattttctgtcgcattctcgtaccattaaccaacccacacactgttcta

SEQ ID NO: 58924 - DNA, 1440 bp, Heterodera glycines
  Genomic contig location: Contig_ID=SeqID_28297; Location=444..1883; Strand=+
  SCN-specific regions: Sequence locations=1-183,205-228,254-364,386 -408,431-1224,1298-1338,1400-1400,1433-1440
aattaatgatgaaaaagtgaagagactaatcattcaattgaatgtggacattgcaatggctgaccttttcgtggaagtgaatgatccggcaaaaaaacgtgccaatctttgcctaatggacagtttgttgactcatctggtggcaaatggcacattgtacacagaagtccaagaatggcaaacccacatgctttatgaacattttattaatcatgtaaaattacaaagataatttatttattttttaaattaaggttctttggttaatgtttaatcatgaaacttgttctcgaggggtttttgacgacctctgatcatgaaaatgacatctattttggccaacttctaactaacccgaactcggacaaaagtttaaaattccaattgtccatttatgattttttgttcaaatttaagccatttttaaagtagcgcaacaaattccattgatttaaagatgaatttaaaatctttaaataattccaaaaaaaaaacaaatgcaatttctttttttgctaagaatttcatacagtccatgattagaatcaatcaatatagccgcattgattgatcagcttcaatcaataatgattgttggttgaccaaaaccaatcaatcctcattattcagaacgaaattccgcgttcatcggatgccgatttgcgctgggccaaaccggagtgccataaggcggaggtggcccaagcggcagtgagcaaattattgagccaaatgcatttggtggtacaatcgcacagttttgtgctgtgccaagttgcacaggattgtgccgaattcgtatcatttgtcaaccaatatgcgattaggaatttcgaaaaattatattgctgtaatcaatgtgccataggtcgtcgtatcgtaatagtgccagtttgcaaaattttcaagcaaaactcttcccacttttgatgatatggatgggctattaaaattataccagttttctccaaaatctgtaaaatggtttttaccaaggatccacccgtccgggtcattaacccgggcaccctcgttttacaagggtttgaaaatttgaaacaaaacacctcaaaaaaacttaagttggcccttgttttgggggggccaaagaaatttcttttttttttgaaaatttttttttggcacgggggttttttcccccaaatttccccctttttttttcccccccgtataacaaaaaacccccccccaaaaaaaaaaaaatttttttttttttttttttttttttaaaaaaaaatttttttttgaagaaaaaatattataaaaaaaaaaatttggcccccccccccccgggagaaaaaaaaaaaagaaagaaaattttttgttttttttttttttttttttttttttttttttttaaaaaaaaaaaaaaaaaaaacttttttttttttttttttttttttttttttttataaaaaa

SEQ ID NO: 58925 - DNA, 304 bp, Heterodera glycines; identical to SEQ ID NO: 51570
  Genomic contig location: Contig_ID=SeqID_28299; Location=584..887; Strand=-
  SCN-specific regions: Sequence locations=1-304

SEQ ID NO: 58926 - DNA, 1729 bp, Heterodera glycines
  Genomic contig location: Contig_ID=SeqID_5693; Location=289..2017; Strand=+
  SCN-specific regions: Sequence locations=1-621,643-732,781-1729
atgatcattgcctttgatcgtatattcaaaagatcaaaatatatcccgtggaaggtgttaacagatcagggaaaggaattcactgcccgggcagtacagcagttcttccgcacaaaagacgttgaacacttttgtatgctcacttctccccaatttcatgccggaatggcagaacgtgcgaatcgtagcatcaaagagcgcctttaccgctacttcacggagcgcaacacgtacaaatggattgatgttgtgcaagacattgtttgcgcaattaaccactcgacaaattcgtgcattggaatgcgcccagtagacgtgaactttaaaaacgcagaagcattgcgacaaaaattacatgatgcagctgaaaatgttgtacgacgcaagccaaaataccgtgtgggagatcgcgtgcgcattgaaaagtacaagcacgtgttccaaaagggtcacctcccacgcttcaccaatgaacttttcacggtggcagaggtacactctgagcgttcgccagttgtttatcggttacgtgatgacaataatgaaattattagtggttggttttacgcaaatgatttatgcaaaacgctagaagacaaacaacaaaaaatgtttgacattgaaaatattttgaagaaaaagaggcagaacggtgtggaatatgtacttgtgaaatggaaagggtacagcgctcgctccaatagttggattcctgcaaattcaattagcgagaaaaatatataaaaagcattatttaataaaatttatttttaaaaaaatgccttcaaattctttttatgttgttcttccgtcaaacaccaatattgaaggaaataggacaaattctttccgagtgcgtttaccgcgcaaactacaattcaattcggaatgggaggtgggtcttgccgttattgtatatccccactcttggccctcgataggcaccgtggagcaacaatttgtacagattgagtggcagacagggaatacggtacgtatcgaagttccgccatcaaatgtcaccaacccccatgagcttagcaaaaatttatacaggctactgggtgagggaagtgatccgttggcaaaaaaggtacgatcaacacagaattctttcatgcttacgataaacaaggctcgccgctgggccagagaagaatacattaagcgaaagactaaagaaaaacggggcgtccgtgacgaagagctgctcctacaggccatgttggcagatactggaacattggttgacctcaacaacgtggcccaaggccttctgtcacgcgaaaagagtgctgcaacgagcaatctacagttgagaacgtcagctgacgataatgattcgtatcagaaaaaattggatgactacttttcaaaattaagtgacaaaaatttgaccgttcttgatgaattgggcatgacaaaattgaccgccgaaatcaaaaatttgacagaagaggaacgtacgatcctcgaagccacaaaggaaatgggaacggaagcatggattcaggcgtaccgtgagatacgtcttgtttgccaatttaactatgacgtccatagaaatcgctttgttctgaacaccgacccacggtacgttaaaaaggtcgaagtctcgcctcaacttgcctacattctcggtttcaacaacacggagtttatgcagcccgcaaaggaggcaaggttttcgccggacatcattccacgtttacacgccggatcttattga

SEQ ID NO: 58927 - DNA, 317 bp, Heterodera glycines
  Genomic contig location: Contig_ID=SeqID_5693; Location=4977..5293; Strand=+
  SCN-specific regions: Sequence locations=1-56,78-317
atgtctccaaatgaatgttctgaccgtccctttcaacaacccgacaatgtacaacagccgcatcaacaaccagatgaagacgccgagttgcgcgcacaaattgaagacgcggaagaggatttgctcttgaattggtggcgtgaagatccgacaattgtaagcttgtttttcaatttagcatttttaatttcttcacgtttcagattcgttttctttttggacatggacgagcccctgccatagaagccgcgcttcttcaacgcgccgaacgtgaggcagaaattttgcgcgaatatgccgagaatcaacaacaatga

SEQ ID NO: 58928 - DNA, 478 bp, Heterodera glycines
  Genomic contig location: Contig_ID=SeqID_28302; Location=534..1011; Strand=-
  SCN-specific regions: Sequence locations=1-89,122-130,174-478
agcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaa

SEQ ID NO: 58929 - DNA, 831 bp, Heterodera glycines
  Genomic contig location: Contig_ID=SeqID_28303; Location=1..831; Strand=-
  SCN-specific regions: Sequence locations=1-8,67-98,140-186,208 -231,253-393,446-514,539-556,578-831
ttttgtacaatttattgaataatgaaatattttctaatatttttcatttcttttttaatatttaatgactgtcgccctttccccggtgatgaaaatggtaaattatacaaatatgaaaatttaaatttttttaaattaagaaaacgaagaaaataatcgccaggaatctggcgagtgttctcgtacaaacacggggcgaggcaaaagtaataattgggcacttttgcatttgtcataacttttgttttccttattgaattatgcaaaatatttacgcgcattttatttgttaaaaaattctctataataatttcggaattgctaagttaagccaatgaaaaaaattatgcaaaattttcaacctcattaaaattcgaaaatttttagtgcaccaaattttattatagttttttatattttaatgcatttttcttaaaaaaaatatctgctaaaattccgaaatatgttttttatctgccaaattctttgtgtgtttttttaaattttttctacaaaaaaggtaaacataaaaatcccagccctattcataatgaataatttattaaaatcaggaaagctacccgaagaagaaaaagcaaaaatactcaaaaaatttgaagatgagcgaaattcgtttaatactaggcaacaaaatctcagagaacatgccaaaaatgaattgctgggaaaaattctaaaggcaaaaaatgaatttatggaaaagatcgaaaacgaaagggcccaaattgcggaaaaacttttttgcgaatttggaagacgaagcgatggcggagcaaagcgcagaatcgccgggggtcgaccaaaccgcgg

SEQ ID NO: 58930 - DNA, 776 bp, Heterodera glycines
  Genomic contig location: Contig_ID=SeqID_28304; Location=465..1240; Strand=+
  SCN-specific regions: Sequence locations=1-216,239-453,475-776
atggagccaatgccaccgtacacggtcatttgtccgggggtatattgttagtgaaatcatttatttgtagattttgacaagagaagaatttttgaaagagatgcagaaacttacgcaatcgacagcagaaaatttggggatttcggaagcattgacaaaactcatgttgaacatttataattgggacgagaagacattgacagcagagtaatatttcatttttattcttattttatttccaaatttaggcataaccgagcagcagataaggaggcattttttgaagaaaaaaaaattgccactgggaacccaaaggcgccggcggagggtgaaaagtgccaaacgtgtgacagtgaaaaattttgcaaaatgtcgccatgtgggtgtttcttttgtgtcggatgctggagtcgctatttttggaaagaggcgagtattgaaaattcacgttattaaattattacaaagtttttagataaatcttaaacagacagtccttttgacttgcattggctgttcccattttgctgatgaacaattcatcagtcaaacgtttgaagaatttaacaaaatcaatgatgtggaatacattggagaattgctgaattgaatgcgaatcaaaaaaaacttgtgctgagatttttggagttggctctgaaaaccattgtcaaagtatagttgtttaggcattatcaatgtattaaattaatctttttagcgtaatccgtttgtggaatcatgcccccaaagtacgtgctcgaaaattatcaaagtca

SEQ ID NO: 58931 - DNA, 250 bp, Heterodera glycines
  Genomic contig location: Contig_ID=SeqID_28306; Location=1240..1489; Strand=+
  SCN-specific regions: Sequence locations=1-72,95-250
atgttcgtctacgtgcccatttcccacgtgttcggccccatgttggtgcgcattcggctgatgatcacccgcgacctggtcaacttcctgctgctgattctgctcgtattggtcggaaatgcccttgccatcaaagcggtgcttttccccgacctctccgccaaccgcgaaaccgtcgccacttccgtgcactggacattccaacagctgttcaccaccgacctcagcgttcttgcgcagtccgatgaat

SEQ ID NO: 58932 - DNA, 599 bp, Heterodera glycines
  Genomic contig location: Contig_ID=SeqID_28308; Location=23..621; Strand=+
  SCN-specific regions: Sequence locations=1-304,326-599
atgacaataatgccgcttccatcactttccctgcccttaaagtgttgtacaaatgcttcgacacatttgactcaaaacagtcagtgtttttgcctttgagtgttttttacgaaatttttttcccttttcagagaccccagggcaaatggctgtgattccagcgttggcattctcgagttaccgactgactcgtgtcttcgtcttaccgaaatgctgctgtccagctctttggcccttccgccgcctcttagagcccttgggcaattctacgtaattatataactaacaaatatttaattgtatacaacaacaatttattgtacatatgtccgtttgagtatttgttatcggttaaggtcgggttcattcgtatgaaagatagagttgattaatgggctgtgattattgatgttcgactgtttccgtttgcgatttgatttttttgccaatgatgtacattccgcatttgttgcaattgaacccaaaaaatgtttctggcctttatccccgcaggcaatcgcattttgtataatctgttccatttttaatcacataatttaacttcgttacgttatcggttttaaaaaacattttataga

SEQ ID NO: 58933 - DNA, 75 bp, Heterodera glycines
  Genomic contig location: Contig_ID=SeqID_28308; Location=668..742; Strand=-
  SCN-specific regions: Sequence locations=1-75
tagagaaaaaagataatgtttttctctggcactctctatttattggtacacatctcgttttttcggacggtgtgt

SEQ ID NO: 58934 - DNA, 87 bp, Heterodera glycines
  Genomic contig location: Contig_ID=SeqID_28309; Location=318..404; Strand=-
  SCN-specific regions: Sequence locations=1-87
atgcaattggcatcggtcatggcacgagcgcttctcgtgtcggcgtttttcgcaatggatacttcgcatcgatcaacaatgaccaag

SEQ ID NO: 58935 - DNA, 663 bp, Heterodera glycines
  Genomic contig location: Contig_ID=SeqID_5694; Location=3..665; Strand=-
  SCN-specific regions: Sequence locations=1-384,410-637,659-663
atgaaactgtgcctaatattcttttcaattgtattatttttaattgctcaaattgaaattggagcggaaaagaaaaaattgcaacaaaaaacatttaaagaaatatttggagaaaaatgggaagaaaaagaaaatgaacagaaaaagagagaaattgttgaaaaattcaacaaaattaaagcgaaaatcaaacaaaaaggaagaaaatattcaacaaaagaatggaataaaattaatgataaaatagcgaaaacattggggacaaatcgaaaatacatttacaaatggatcaaagaattgggaatatataaatggcacaacaaatcaaaaacggatgaacaaaaaattgaaattgtgcaaaaatttaatgcaatgaaaaatgagtataaacaaaaaggaagaaaatattcgacaaaagaatgggacaaaaattatgcagaaatttgtaagaaaattggagttggccaaggagtaattggacaatggaagaaacaatttggaatgggtgaaagaatgacggagaaagaaaaaatggaaaaaatgaaaatgtattggcaaatgaaaggagaaaatccaaaaatgagtgacgagaaaatttcaaaaatattgaaaattagtcaatggaccattttcaattggaagaaacaatttgagaagaattaa

SEQ ID NO: 58936 - DNA, 500 bp, Heterodera glycines
  Genomic contig location: Contig_ID=SeqID_5695; Location=1030..1529; Strand=+
  SCN-specific regions: Sequence locations=1-27,49-126,149-500
atggcggaacagggcgattcattgtctccgtttcggtgccgccctttcattgccagccgtttcattgcagttgtcgtttcattgccaagatgggtctcactgccaatatgtttaactactgcctacttttctctttttctcattattttcattaattttgttattgtaattttcctatttcaaagcagatcattcgttttttgtcaacgattatggctactgaaattctaacaagcgtggaagaaaaacattgttacacgatggttttctgtatatcttcgaaaaaataaacaaacggggtgacgtcaggttttgtaaatgtgaatttttcggaacccaggacatcatatgcaaatgtcgtttgcacacagatatgaatgacaatattttggaggttcaaatattcaattattaatgttagatatgaaaatttttaggcaagagccgaaaaacatcaaagttcaaacacttacgacatcgctgaagaagcgtgcgcatga

SEQ ID NO: 58937 - DNA, 1031 bp, Heterodera glycines
  Genomic contig location: Contig_ID=SeqID_5695; Location=1935..2965; Strand=+
  SCN-specific regions: Sequence locations=1-337,371-1031
atgactgatgttttcgtagatggcacgttcatcattgctccaccgttgttttaccaagtttacgctgtgttggcaaggtggagttagtattattccaacagacttaataaattctcacacttatttaggcgtcgagatcgatgagtctttcctgttgcatatgcactacttacgaacaaaagtgaggggacatataccaggatgtgggccttactaaaagaagcctggcctgaattttcacaccggacgttttcagtggactttgagatggcagcaatcaattcaattcgtaacaattttccggaagccaaaactcgtggatgtttatttcatctagtgaaaaatatgaagaaaaaacacagaaaataaactttcgcaggtctatcgaggatgtgtatttaataatcaatgtgtttttagcgttatcaaattgatccaattttcgcatcccagtcaagctggatcacatcaatggcatttatgtcaattggagacttaacgcacgctctatctcattggaaatgcatctgttacctgagcttcgaccaattttttgttatagatttaagtaaacagatttacaggttcgccacaaactacactggacgtgttcggcgtgctgaagggactcgaaccgtaccaatgtttcccccccccccccccaattatggagtgtctactctaggacgattaatggagaagatcgcacgaacaatttcgcagaagctgcacacaggcgactgcaaagggattttaactgctctcatccatcaatatggcgtttcattgagacattgcagaaacaacaaaagttacgagattccgaaatgtccaaatgcgttgctggattcgacccaccacaaaaggcaaaaagatatcgcgaagcagaccgtcgaattctcacattgacacgcaattaccatccagtgaatattggtgatcctgctcatgtcaacgttgataattttaacccacaaactatcattgattttcttgctggtgtctcatacaattgttcgatggacccctga

SEQ ID NO: 58938 - DNA, 90 bp, Heterodera glycines
  Genomic contig location: Contig_ID=SeqID_5696; Location=25..114; Strand=-
  SCN-specific regions: Sequence locations=1-90
atggcggaacaggcgattcattgtcgccgtttcattgcccgcattttcattgccagccgtttaattgcaggggtcgtttcattgccaaag

SEQ ID NO: 58939 - DNA, 1287 bp, Heterodera glycines
  Genomic contig location: Contig_ID=SeqID_5697; Location=384..1670; Strand=-
  SCN-specific regions: Sequence locations=1-345,370-645,666-1287
atggtcaatgtccgattccaaatcggagctgatcggagggtggccgagccccctcgtcctccccgaataagagcgtatttggcattggaggaggctccaaatgaccaagaggggcccaacaggggaccgccgtctcggcgtctcttcgaggccattggcttccgaagagacaatccgaacattggcgatagggcggaaaacaatgcccgccaagcgcctattcaacgcggagagcgagccattgacaatggccgcccaaattcaccggacggaagctttgagaaccgcccacgaagggcggtccccaaccgtccaatgcgccgttggcagaacggcctattcattgtggccttggctttgtgcctcggcagtttggcggagggaaaggaattcccttcgacaaggacttgccatcagccgcttgaagcggcggacatggcacgtgaaaatcaatggggattttcacgaatacttttcccatggccattttcccacgatcagaaagcaaatctgatccgaggactccgccccttcaatggtagcggaacctatataagggcagggataaggcatatcccaccatcacttgcccttcccaaaatgccgaaacccatcaaaatgccctcctcgtcatcgtccgcctattcatcatcatcatcatcatcgccggatcgccagtcgccgccaccgccccgcaaaaaggcggtggaactgttcaacattgccgcagcaacgcctgagcgggacgcgaaaagcggacggaaattttccgtccgcgacttcatcgacgcggaggcaaaggaggagccttcctcaaaacgtctgccgacgtgttcggcgtgccaactctccgggcatcgccgcggggcaaaggcctgccccctctatgtagctccacaaagggagcggtcagcggcagccagccgccccgggacttcaaatgcacggcgcgactcccccgaggaaggggagatcaccgccgataaggcggaccgtaatcgcccaccggtaatttcttaaatgcatggggccaattgtcgcaatcaaaaaaattcccgcccaggacgacgcgggaattgtggccaaagcgcaaccgccaccaaggcagccgtggacctcgtggctgttcacggagaactcaccgctcgccgtcggtggatggaaagcacaaggcgaagaaagagcgccgacaccaccgcgaagaaattcgatgattgccgcgggggggagttctgtcgccaacagcgacagattttatcgatcgcccgctgttttttcccacgcctt

SEQ ID NO: 58940 - DNA, 582 bp, Heterodera glycines
  Genomic contig location: Contig_ID=SeqID_28313; Location=86..667; Strand=-
  SCN-specific regions: Sequence locations=1-336,358-519,541-582
atggcctcgttgcaaaacttggagaggtaagtaaccaaaccaaacttggatgattacggacagagcgagttgctagtgaagagggtgcactttatcctcaccccatcccctcccgaaaattcatcaaaacctaagaattaaaaaatttgaaaaattaagaaaattcttagaattgttataccaaaaaattcttgaaggccgaagtcttgaagaattaaaaaaattctcttggagacctactccgcaatgacggtggccaaaaaaatttctatcaaaaaattggacaattctatggcggagtggaatggagtgcgtgcactccgactaatttgaatttttattgttttattaaattgttctttttttaggtgcaaattgtgcaactttgccgttgagatggaagtggacaaaaccgtgaacaaagtgttcgactgtttgaactgcggtgccaaattttgtcgtctctgtgaacgccgttgggacgaagaccatttcgggataagctgtgatgagttgggcacgaagacgaagaaggacaaaaaggagcgagaattgtgggcatttgataagcaaacggagtag

SEQ ID NO: 58941 - DNA, 357 bp, Heterodera glycines
  Genomic contig location: Contig_ID=SeqID_28314; Location=465..821; Strand=+
  SCN-specific regions: Sequence locations=1-199,221-238,261-357
atgccgattacaaaaccttatatcaaaactctcgagtgagctgtttaaagaaaggacccaacaggtggaaatttatttttagtatgataattgtcaccgttattagatgcggacgcacattttggaaaaaagacgccagtcaaataatggagatgtaactttgagtgggggagatttgaaaaagtaatagttttacataaaaatgtaaataattattataatagcgttgtaaatatctatcattatatataaaattaaattctttttagtttccttgaagggatcgacattacgaaaggaaaggatgaggagaatgatatgtttcaagtaattaaatttaaactctaatatctaaaa

SEQ ID NO: 58942 - DNA, 624 bp, Heterodera glycines
  Genomic contig location: Contig_ID=SeqID_28317; Location=677..1300; Strand=-
  SCN-specific regions: Sequence locations=1-82,113-547,570-570
atgaaaaccgaacccattgaaaattatgatgagaaaacatccggacgcggagcagctaaagccgagaattttgtgctaaaacaggagccatatgaagtgaaaattggagaaataatagaggagcggtgccaaattaatgggtcggcgtcgttttcgcgtggggaagtgttttctattagcctacaaaatttggaaaaatttcgttaaggttcaaaaaagttatggtcagaagagtcaacaaaccaaatttttcaagtttttttggctcgaactttttttatactgaacgaaattttttggaattttgcaggctaatagtgctactgaagggctttcgaatgatgccaagaatgttggatttggttagcaaagaaaaaaagttatagtccaaaaactccgcctcacgcgaaaacggcctggcccgcaaattaatggtgccgaatttgatggtcaacaaagtgccgagtggcctatcaaaaggggccaatcaaattttgggaaaatggaggacgaaagtcaattatcattttcatcattatcaggccagtaataatgtccccaatgcaaaagaaataatattatgtttttaattttttttaactttcaaataattgaaaaaataaa

SEQ ID NO: 58943 - DNA, 230 bp, Heterodera glycines
  Genomic contig location: Contig_ID=SeqID_28319; Location=88..317; Strand=-
  SCN-specific regions: Sequence locations=1-47,69-165,187-230
atgccaccatcaaatgccgaagtcgtcgtcgaaccaaatgccacaacttcaacaacaacagtcaaagtcgccgcccgacagaaggccaagacttcatcgacaacaacagcagcaagtcgtcgccagccgaaatgccgtctgctttacatcatccaccgcattgacaatggtcacgcgcagtgcacaacgacgtgcagcggaggaggaagcggttccggcacttgcaattc

SEQ ID NO: 58944 - DNA, 1219 bp, Heterodera glycines
  Genomic contig location: Contig_ID=SeqID_682; Location=204..1422; Strand=-
  SCN-specific regions: Sequence locations=1-160,182-1134,1156-1219
  Gene Ontology: Mol. function=protein serine/threonine kinase activity; Cellular component=nucleus; Biological process=cell cycle
atgccattcgcgatcaagcaggagcagtgttcgaagctcgtcaatggagtcgacctgaagacagcaaaattcatcttcaacgagctgttcatcaccaaacagcttacagaactatccgaggacaccggcagtgactttgtcacgccatcattcacacaattgcgtatgaggaagatcgtcaaaggtatttttaatggagagtcccttcaaatttcattcctaattagggcttgtggggtgttatgctaaatcaaaatgttttgtagtgctaaaacataactcatctttccgtttaggatgttttcctccgaaattgctcaaggcttgggatgccttcaagaaggcaaagcccgaattgtcggagaacgaacggccagacatttatgccgacgaagatctccatttcgttatcattggcctttcctatgggggaaaagatctggaggcgtttaaggttagccttcaaaaagaaaaaaattaaaattgtttttttcgcagataaaaaatggccccgaatgttactccatcttccatcaggtcgccttgtccctggcaattgccgaagccgttctcgaattcgagcaccgggatctgcatgccggaaacattctcgtggagcggtgcccggacaacgaaaaaattcggtaagcagcacaagaaaaaaactggaaactaatgttaatgttaaagatacatctaccaaggaaaacaaatcaatgtcgtctcaaatggggtgcgcgcctccataatcgacttttcaatttcgcgtatgaaaaaaagtaagctcaaatttttctcaagcgcttaaagtttactcattaatttctgtttcccaaaaccagaaggtgttccgttcttcgttgatctcagccaagatacgggccttttcgcgcaaaatggtgttagcgatggtggcgactaccaatacgacgtctacaggatgatgaagacggtggccaggtcgagagaaactaatttttgtcacattaaaaattctttttttagcgaaaattggtcctcattctggccccaaacaaatgtgtactggatgggctacgcggcaaagaagctctttaacaagaaccgcttcatcagggcgaagagaaaagaaaccatcgacaacctcttttcaaactttgaaaagaaatttggatcgattagcgatttcattgaccatcctgattttttgtcagtgtttgctgaatttacttccgggtaa

SEQ ID NO: 58945 - DNA, 1788 bp, Heterodera glycines
  Genomic contig location: Contig_ID=SeqID_683; Location=16..1803; Strand=-
  SCN-specific regions: Sequence locations=1-452,515-557,579-894,936 -1136,1159-1262,1331-1453,1477-1524,1560-1590,1662-1788
atgccaattcaagtccacgcgcaatccattggtagagacggaacgccaaaaataatatttttgattttttacaaaaactcaggtcctaattgtgtgacgctcacttggcaaccgccagctgaggacggtggctgcaaactggagggctaccttgtgcagaagcgagaatggggtcacgaacaatgggagatggcaacaccggatatggtacggtatttccatatacaatagtcacaaagaatattttaatgggtcccaataaaaagatttttttattttaattacaatttcgttaaaattttagtgtccattgaccgagtttttggtgcccgggttgcgcgagttccaggcctacggtaattgtttttaaatgtgtacttcactttctcccgcgtcgtccccccccccttcaaaaattttcatgcgatttttctaaaattttatgatgaatcattaaatttttttattatttaatttgttagtaggtaaaaaaaaaaatttttttcaaaaatttctttttgaagaattccgtgtcattgcgctcaactcgcacggacgcagtccaccgtcgttgcacacgttgcccatcaacatcgaggagacggctggcgcttgcccgaccattgtgataaagtcagcagagaaatttcaaaaaaaaaaattagtgcctcttctttttttgatggtgacacaaatttaaagacatggcaaaagaaaattattgacaattcaatttttttcgattaaataaaaatcgtgaaaggaaaatgcgtcagtgaatcagtgcaatttcgaccttttgtaatgcaatacttaatgctacagtagtaactttattataaaaatactgtattactggcaccttttccactgacgcattttccaggagccctcaaaatattactattttttaaaattaattttcatttaaatatggcataaaaatttccagcaaagaagtgtctgtgcagaagcccagtgttgtgccgttgaaatcgcagcgtgccaacgaaaaggaaaaggacgccacgcaaatccgaactcctaaaacggcacaaccttcgtctgtacatggcatcggaccatccttgggtaagatatgagtttggatggaaaatcttagataaaaaactttctttaccagttcggcatttagttcaaaaacgattatccgcttgtctctttttcaattttaatttaaaccgtttcattttttgtaatttttaattagttcaaaaaacagttaaacattttccacggacatttttaatttaatgataatttaattttaaaatttatttttaattcaaatatattattttaaaataatgcattgtttcagactcatcagaccaaccattgtcctccaccgcccgtcgtcgccagccgcgcagaagtgccagaaaggatgccactgacattcagtggttggtttaacaaaaaaaaaagtttaattcattttattttttagttgtagcaagaatttgacaccgccacgctccaaaaacacggtgagcaaattcggatgttttaaaattatttcttgggaattttgagaaattgaaactttttaatttttaacgtgaaccgaaaaataattttaaaaaatgatgcatatttttgaatattttataaaattttttacaaatatatatatttttgttttttctcaagtgcaccgccaaagacgacaaaacaatggcccaactctttgaattggtggtcaagggaaagccgaaaacgcccaagaggctgctggacacaatgaacgcaacgtcggacagttgc

SEQ ID NO: 58946 - DNA, 7655 bp, Heterodera glycines
  Genomic contig location: Contig_ID=SeqID_684; Location=395..8049; Strand=-
  SCN-specific regions: Sequence locations=1-140,170-266,325-493,577 -1250,1273-1563,1585-1664,1688-1690,1723-1913,1940-2034,2056 -2123,2146-2199,2229-2309,2331-2415,2476-2532,2554-2564,2586 -2736,2763-3298,3331-3674,...
  SCN-specific regions: Sequence locations=...3714-3719,3742-3774,3926 -3974,3996-4013,4036-4395,4417-4444,4559-5087,5110-5170,5192 -5265,5310-5871,5893-5978,6012-6089,6111-6113,6179-6264,6286 -6319,6347-6463,6485-6596,...
  SCN-specific regions: Sequence locations=...6619-6619,6669-6818,6843 -7547,7569-7655
  Gene Ontology: Mol. function=structural constituent of muscle; Cellular component=cytoskeleton; Biological process=regulation of striated muscle contraction
atgggcacttcagttttgatgctgataatttctactataaaatgcgatatcttcagaagaaatacagtactttttgtagacactgaaatcgaagtgcccatacctcatcgggtataaatcgtatagactttcatctttagtatattattaaatttaaaatattatttatccatcccttatcccctgaccaggagacggaggagaaaaggcgggagtggcgacgaacaaaaagcctaaatcaggcaggcttccgtagctttgaggtgtttttttgattaaataattataattaaaaattcaccaaaaaaataaatataataattagacaataaattaaggatgaagaccacacgcttcttcagctgcttgagcagcgcgggcacaaaagaggcacatcggacagcagtgcacaacgttacctaagaaggcaacagctcaaggaggagaagcaggccgaattggacaagccggccgaattggtaagctgtggaacaaaaaaaaaatcattagatatttaaaaaaattaaaagattttactttttttattttcaaaaatagaaaataaaattaatttttgtcacaaaattttaagcaatgactttaaacaattgattattgatgcattttttcatttaactttttagattttagaatgaaaattattttttgtaatagaaatatccattatttttgaattttaggttcttgcacttttttgaattggtgtccaatttactggagtccaaattttccgattggtgtcctcccaaataactgcttcctttttttgcttcacccgcccgccccccccccgaaaaaaatatcatgatacgaacaaaggaaagctttttcaatggtagttttgggtgctgatcaggagtctaactcaaaattgcaaaatctatactgttatctatgattttcttcatatgattttgttgatgatttaaaaaaaaattattctcaccctcatcagtgctttttgtggattttgtaataacatcaacaaattcatagatttgtacggctttaacttcagattattgattaacacctaaaattaccatacaaatgtgttttctttctcgggattatgacatttttatggggggggggtatggcataacgaaaaagtacccttttctattatttatttaaagccatacaagtgcaaagaatgcccagatgcatttgctcgtcctttgtacctggcaagccattctcgcaatcatgggtacaatgggagatacaaatggtaaaaatattttgattctttttatctttttttatttgtataaatattcagccaacattgcaattatggctgtgacttgaaggacacatttgacaaacaccggtaataaattttccttgttttgctcagttaattctaaaatcactttttactgtgtatagcaatttgatttcagtggtaaattccatattcataaaaattccaaattaataaaggaaaaataaaaaataattcattagctgttgagatgatccaaaccaatgacaatgggcattaaaatattagttgaaaaatctcataaaattaacgtatttttgcaagattctcatttgatcgattatttctgatcagttaggaggtcaagattaaaaatagctgaaaatttaggaatagcaaatccaattgctcttcatgataaaaaagggtttaaagtgatctgaacagttaacatttttggctgtttcctttaaaaacaaattctttatttgtttagtgcctgtcatgtcaatgtgacgccgatcagaattgactttgacgacgaggtgtttgctggctcgccggacccagacgaggtgggtgaaaaacgaggcgcaaattttgttttgttttgtacttatttcaaaagggaaaaatatcaaacgaaaaaataaacaaaattttatcttttttgtaaatgtccttatttttgaatattttcacaaaataaaacgattttcagtaatgaaaacattgtcgttcgtctttttaagcaaaaccttatcggttgtttggaattatcaccggctcccatgaccatgactatacgtgcataaacgaataattttttaatggacaaaaaaacacaaaaatttaataaaattgaattcggaattaatttttataaaaaatatccgacactaaaattttcaaacggtaccgacaaaaaactggtaatttctgtgttctaatattttttaaagttttttaattaattgacaaacctaaataataatatttattgcgcctctgatatttgcgcctatgcttaaaagcagtctcaaaacttttttttaatagaaaaataaagcaattgttattattaaataaattgtttgaataaatggtatatttacctttttgaaaattttcttaagctttttttaatttccgtgtcaaagcggtaaaataattttttttaatgttaatttttaaataatatttttttaatttatacaatttttgcacttgttgcatttttggccaaaaattgctcatcgccaaatgcttgacactcctcctatttatgagaaatttcagaaaaagccatggagcagattatttgaaagaaaaatatttgctaaaatgtggcatgccatcgaaaacaaaaaattaatttggcgcattatttttttaattctaccgagttttggctttatttaaattcaaaattgtctagaaaccgaatgtcggctatgttttcctgaaaaagccttaaaatttcgaaatttttaattaatttattattttacagttccgcgtgtgtgccgaaaatgcgtttggccgttccgacccattgaacaccgacgtggaccggcccggccccccagagggcccgatcacttatccggccacaacaaagtgagaaattttcaaaaatataagatatttttgaaaattttgcactaaattttggaatggtgccaaaaaatcgttgccaaattttgcatttcactaattttctttttaatttgactgaaatttcaattcaatttttcgattaaataaaaatcatgaacggaaattggggcagtggaaaatgcgtcagtgaatcagtatttctttaaattgagatacggtagtaatattacttgaaatcattacttattttttagggattttggaaagtttcaattattttgacatttaaaaacttaattgaaaaaaacaacaaaattattagacaattttcaccttttgtaatacaatactttaatgttacagtaactttattttattactgacaccttttccactgacgcatttgccacgagccaaaaatagtacaaatttttaaaattaattttcatttaaattatggtacaaaattttccagcaaatgccaagtgtctgtggtggaggagccccgtgactttgttgagacgttgaaatcgcagagtgccaatgaaaacgaaaatgccacttctgaatgcgaagtggacgacaatgacatcgatgtggaagatgatgagcagctgcgtgacgagatagcggcaaatgtggtaggaataaatttgaagggggggggggggtcaaacgataattttggggggaggggttcgaccatgttaaattttctaaaaaaatttttaacaaaaaatgtcttatcaagattaaaaataatatgctacttatgaattaattcaaaattaaaaaaatttcgcagaatttaaatgcgaatatttatttatgttattttttactagtaaataaaagaattatgtttttaatgctttaattaacttcaaaattcaagagaaatcttttttaattattaaattaatattttttattaataaatatattgcagaattaaattgcaaatatttttatatttatattttttaaataatgattttttaatatatttgtcataaattaaataaaaacacattataatttaattgttttattgatttgtacaaaaaaatttaagtcaaaccgggcttgagtcagataaattacattttttctaattaaattagaaaaacaaactttttcgaaaaaaataaaatataaattttggtcaaaatatcactaatttaataaatccataaaattaaggcacttctgcgcgccaatgcggagcagttcgaactcgaagcatcggacgtggaggaagacgaatgggtggacagcagtgaggaggagcaggagaataagcagctgcgtgacgaaatagcggcgaatgtggtgggtataaatttgagggggagcggggggaggggtcaaacgaaaattttgcaatgggggggggtgggttcgaccatgtttattgacttttttaatttactttttaagtctatttttgtgtttttcttcaaaaacttttttggacgagggggacgggggcgaggtccgatggtgccaataggcaggcgtccttggggaaattttgaaaatttgagtgcaatttgctattcattttattggattaattcaaatttatttaatttttataattaaaatgtttggatttttttttgttttaaaatttattaaataacatttaattaataaactattaattcatttaatattaataaacattttctccagcatcagcaatgccgtccgtttgtcagcccgccgggcgcgccggagaagccgcgcgttggcaacgtcaccaagcacacggtggacctgagctggattcgtccgctgcatgacggcggtgcgcgaattgatggctatgtagttgaacaacgcaaaatgggcgacaatcactggtctcgtgccaacatcggcatcccgcgtgccaaaacagtgcgcgacacacactgcacggtcgaatgtctgccggagaaggaacagttcgagttccgcgtccgtgccgtcaacaaggcgggcgagggcgaaccgtccaagtcgtccgacctcgtgttcaccactgaccagccaggccgtcccgtgttcgacctgtccaacctgaaagacatcacaggtggcgcatgcattgcttataattaataattagtgttaaaagttgaactgaatttttaaagtggtaatttgtccaattcggtgtttgtaattgtgcttaatgcttatttcttacttgtttcttttgagtctccgattcttaaaaattaaaaattcgcttacttctaagatttttgcttaattttagatttagagaatttttttttgcaaatatcccatttcaaaatttttgaaaaagcgcaacgcattaaaacatggactaattagtaattaccatttcggttcctaatttacattcctttatttttgtcattttattttttatataaaattaaaaattgtcaatttaaaaaatctgccaaaattacagtgcgtgccgacgaaaccatcaccttcacgttgccgtacagctcgggagggctgaagccgaatgtggacgtgttgaacaacggcaagacaatttttgatgaacgcaccaccattgaagtggaggacgacaaaattgtgttcaccatgcgtgacacaaaacacagcgatgccggaccgtacaaagtggtggcacagaatcggcacggcaaagacagtgccaagctgaacgtgaacgtgctggacgtgcccggcaagccgggcgggcccatccggttctccgagcttgccgcggacgcgtgcacactgcactggagtcagcccaaggatgacggcggttcgccactgaccaattatgtggtggagcgcaagtcagcacgtggcggtgactgggagcgcgtcggtgcaccagctggcatgtcgctgcgagtgcgcaggctgaccagcggcgagcgctacaaattccgtgtgcgtgccgagaaccagtttggcgtgggcgagccgctcgacgtggacgaaccgctgctggccaaagcgcccaacgcgccgtgggagaagaccccatttggcaatgtgccggacacacgattcaaggtggggaaaaacagagccgttcgtccccctccccctcgtttcattccctcccccccccccgccgtaaattttttttaaatttttaaacttaaaattagaaagggacatatttgcaaaacaattaggaatgaactttgaatttttttcagaaagcaattttaacggagtatttttcgtctttactgtattttgttcttacaaaatatttttataaaaaattgattaaaataaggttaaaaatattgttctaaatattttatttaagaaagctccaaatttatattgaagttgttaaacgaaacatttgtcggctaaaaattatgtttttcgtgcttttcttaaggaaaaacataaataaataaataaaaaatccccgccctatttataaattttccaaaaatagacattttaaaaataaaaaattataatttactcgcttaaaacacaggtgttgcctgagccggttgtcaagtactcggtgccaagccagccggacaaacccgtggtgcgcaactttggccgaacatgggccgaattggagtgggagctgccggcatccaacggcggggcaaaaattcgtggctacgaactacagcacaaggaccaacattcgaacgaatgggtgagtttatggagtatttggtgtgtattgtaattattgttgagttttttttctcgaagtgagcagctcgcttcccacacccgaaattaaaaaaaaaaatttagaaaaaaacgaaaatttttataaaaaatacaaagaaaattttcatagccttttaatcaaaacatatgaaaattcgattagaaaattccagttattattggatattgattgtatcactgctgatcattaggattatgcgttgaatatcctaaaaaaattgccccgtttttgtgaaaattcaaaatttaatttttttttttttttctttaggttacatgcaaaaaatccgcgacctggtcaacaaatttcaaagtgcaaaatctgagcgaccggggcgagtacgtgttccgcgttgcggcaaagaatgcggcgggttggagcaaaccgtcaccccaatccgaccgaatcaaattgcgacaacgctatggtccgccgggaatgccaattcaagtccacgcgcaatccattggtagaggcggaacgccaaaaataatatttttgattttttacaaaaactcaggtcccaattgtgtgacgctcacttggcaaccgccagctgaggacggtggctgcaaactggagggctaccttgtgcagaagcgagaatggggtcacgaacaatgggagatggcaacaccggatatggtacggtatttccatatacaatagtcacaaagaatattttaatgggtcgcaataaaaagatttttctattttaattacagtttcgttatagttacagggtccgaattcagaatcattgatgccgaaatccccatagaaaagggtttttatgtacttttgaaaacataaaaaaaaaattttgaaaaaaagggggggggacaaactgcactatctgagttcagattatgcatgaaccttcatttagtctatgatttttcatcaatgtcataaaaaataatccgcagccaagcggattcgaacctcagatccccgcctcatacgatcaataattaaatttaaaaaaatcatatacgaaaaagtccaagcactcaatagctcattcaaaaaaaaaaattggttatgaatcataactcgtttttgcatggcaataaa

SEQ ID NO: 58947 - DNA, 292 bp, Heterodera glycines
  Genomic contig location: Contig_ID=SeqID_685; Location=1408..1699; Strand=+
  SCN-specific regions: Sequence locations=1-148,186-292
atggcattcattttggaaaaatgcgcatcgattctttgctgtgcagttttgctcgctgttatcatttgtttttccaacaaaaatttgtacaacatttgtataaatgcgatgattttaccgtataaacacagtaatttttcgtgtgaagatattaaaattaaataaaaaattattatattatttatgaatgaatttttgtaacatgatgttcatttactattttaggactaaagcacagtttggagatgtgcccaataaaataggagtcgaaagatcgccatattaccgaatg

SEQ ID NO: 58948 - DNA, 894 bp, Heterodera glycines
  Genomic contig location: Contig_ID=SeqID_686; Location=16..909; Strand=+
  SCN-specific regions: Sequence locations=1-387,409-484,521-603,625 -663,704-771,818-844,886-894
atggacccggacgcagcaataccggacgtgggctcaagagtaccggacgtggccaatgacccggacgtggaacgagataatggacacgcagcgggtacgaaccatcaagaaccaaatgatcttgatagttcttttgattatttttctgattgattattttttaatttgttttactgatttttgctttttggcttttctattaataaatttttgtctgaaaaattttatgtgtaattcttagtttactttagttttaagtgcggcacctttttaacaattcgttccttgctcatccattaatttaacgtgatagaaaattgccaaataattagttgatagatatttatctaaaagttttgaagttaattgcattacctcggcgccgccggggggaattttgaaaattttagtgtaatttgctaacagattttcaaaaaaaaaggctggtttttgggattactaggctcaatttgtacggattttctttaaaaaaatgataaaatacaattaaaaaaattaagaatcatattctgtcgataggaaagccatgagtatacaaaaagaaaattcaaaataatttaattcctgcagaggattgaaccaggggaaagaagaagggaaagacaaggcgactagccgctaagccatccgcacaattgcctgaatttttaaagaatatattaatatatttttaaaattttttccttttaactccaattttcttcactaatttttcactcagacccccattcttaccagtgcttgtttttcccggttcccggttgccctaccgggaccgggacctgagcttttcaaattccgggaacctggaccgggacctcgaatgaccgggaattcccggcccggtcccggtcccggtcccgtggcactcta

SEQ ID NO: 58949 - DNA, 1467 bp, Heterodera glycines
  misc_feature (21)..(21): n is a, c, g, or t
  Genomic contig location: Contig_ID=SeqID_5698; Location=58..1524; Strand=-
  SCN-specific regions: Sequence locations=1-120,142-169,191-223,249 -365,387-667,689-827,857-875,899-1176,1198-1232,1255-1467
atgttcgccgtgcggaagtcncaaaagcacatcgagaccgccttcactgccgagatgattgcttatcacccaacagatggcaccgattcggaatatgtcgagaaaggccaaataatgttcggttgggttgggggcacggaataaagcgatcagagcacggcgagggcttaccaactgaagaagcatttgcaacaggcgataaccgaaaatggcatcaaaatgtgccttactttttcccttttgtattttctcctttttctctaccatgggatttaggaaaaaatggactgtatcttaccggggccagaaaagcctagatcgggaccttgattttcaaccgaaactaaaaacttaaaaaaatacagtttaaaaaatttgttaaataattaactttgggtaatgcgctgatcacgaatctgagctcaagttttgaaaatcattgatttttatctaagattttttgtcaactacttgattttttcgatttttaaagttatttttttaaaacgtttagcaatgaatttgggttaaaaaatactctgatcacgaatctaagctctgattatgcatgaaccttcattttgtctatgattttcatcaagtgtcataaaaaaataaaccgcagccaagcggactcgaaccccaggcccccgtctcatacgacccctagggattaataatatatttcaaaaaatcgtaaaaaattgaaaatattgaaaacttgacttctccatacatttaatagctcatttgaaagctctttttagtatcagttttatgtccgactaattttcttaaaattttggaaaaaatcatgtagttgatgaaaaatcatagataaaaatcaaagattttcaaaacttgagctcagattcgtgatcagcacattttttagcctagaaaaaatacccgacaaatttttaatattttttttggtcgggacaccaattcttaatgattgccaaaatattaatgtcgcagaggggaacagacctaaccatataataataacgatattttagtaaaaatctgtaaaaaaaggaacaaaaattccaaaatttgcaggcagccaaaagttttttgaagaaaactagccaaaaaatagtataaaaagaaagaaaagtctcaatttaaggctggtcccccttcgcaaattttctctaccgatattttcatctaaaaatcaataaataaatattgaccaataaatcgatcgttaatttttctctccaaattaattaatttatttacatcaattaaaacacctgaagagataaattggctgaaaaggaaggaaacagctccaaaagaagaaaaaggagaagaagccaagcgaagagagccgaaaaaagccacggaaagtgctgaaaatggtcatcgaaagcagcagcaaagccaagaagcataagggaaaaatggaaaaagagaagaaatgagagaaatgaaagagaaatcagcaaaaataaa

SEQ ID NO: 58950 - DNA, 1500 bp, Heterodera glycines
  misc_feature (1390)..(1390): n is a, c, g, or t
  Genomic contig location: Contig_ID=SeqID_5698; Location=115..1614; Strand=+
  SCN-specific regions: Sequence locations=1-156,179-213,235-512,536 -554,584-722,744-1162,1188-1220,1242-1269,1291-1500
ccttatgcttcttggctttgctgctgctttcgatgaccattttcagcactttccgtggcttttttcggctctcttcgcttggcttcttctcctttttcttcttttggagctgtttccttccttttcagccaatttatctcttcaggtgttttaattgatgtaaataaattaattaatttggagagaaaaattaacgatcgatttattggtcaatatttatttattgatttttagatgaaaatatcggtagagaaaatttgcgaagggggaccagccttaaattgagacttttctttctttttatactattttttggctagttttcttcaaaaaacttttggctgcctgcaaattttggaatttttgttcctttttttacagatttttactaaaatatcgttattattatatggttaggtctgttcccctctgcgacattaatattttggcaatcattaagaattggtgtcccgaccaaaaaaaatattaaaaatttgtcgggtattttttctaggctaaaaaatgtgctgatcacgaatctgagctcaagttttgaaaatctttgatttttatctatgatttttcatcaactacatgattttttccaaaattttaagaaaattagtcggacataaaactgatactaaaaagagctttcaaatgagctattaaatgtatggagaagtcaagttttcaatattttcaattttttacgattttttgaaatatattattaatccctaggggtcgtatgagacgggggcctggggttcgagtccgcttggctgcggtttatttttttatgacacttgatgaaaatcatagacaaaatgaaggttcatgcataatcagagcttagattcgtgatcagagtattttttaacccaaattcattgctaaacgttttaaaaaaataactttaaaaatcgaaaaaatcaagtagttgacaaaaaatcttagataaaaatcaatgattttcaaaacttgagctcagattcgtgatcagcgcattacccaaagttaattatttaacaaattttttaaactgtatttttttaagtttttagtttcggttgaaaatcaaggtcccgatctaggcttttctggccccggtaagatacagtccattttttcctaaatcccatggtagagaaaaaggagaaaatacaaaagggaaaaagtaaggcacattttgatgccattttcggttatcgcctgttgcaaatgcttcttcagttggtaagccctcgccgtgctctgatcgctttattccgtgcccccaacccaaccgaacattatttggcctttctcgacatattccgaatcggtgccatctgttgggtgataagcaatcatctcggcagtgaaggcggtctcgatgtgcttttgngacttccgcacggcgaacatttcaattaattgcaacaattaattaaatcactgacttattaattgtttagacagtccgtccattcccttcccatctttggccccattttt

SEQ ID NO: 58951 - DNA, 2214 bp, Heterodera glycines
  Genomic contig location: Contig_ID=SeqID_5699; Location=759..2972; Strand=-
  SCN-specific regions: Sequence locations=1-184,206-513,535-870,892 -962,993-1380,1408-1637,1663-1715,1737-1771,1801-1820,1850-2214
gatatacaattctggacggatacgaagaacacgggggaaggaaagagaccaatggaggatttagaagatccatccgaaggcaatgaccaaggccaatttcctctcacaatcagccataaattcccaacttcgtcttccccaactgctgaagtcgttgtcaaagcggccaaagttttgaacaaattggacagaaacaaagaaaaagcgtcgtatttggtgttatggccggatgaagcgggagtgagaagcaatgaaagcccaaatagaagttgggaccagcgaatttcgttggtaggaaaagcggacgaagcagcggaagaaagaaagccattgcatttcagggaaacgtcgaagcaattttggagtttgaagaagccgtcagaaagcgaaaggcatgggccgaaaacgcggtaatgtacgaagtggaaaaagtgatgggacgaagaaagaattcggggaaggaagcgcctcaatatttgatcaaatggaagggatacgacgagataagttgggcgaccatggaaagtctgcaaattggcttcaaacatttgctggtggcttacgcattggaaaggccgagaacactggaaaaggtgggaaaagcggtttttttttttaaatcaacagcgggcgcgtagaattgtaataatcttcgtttccattgcataaattaacgaaagggcatttgctttcccaccatttttatgaataaatgtcctccccctcattcttcctccacgattgataatataattttataatcctcttcagaaaaaaaacaaatgaatttaccgcagtaaatttcctacaaaaaaatgattgtccagaggcgcgcattttgcatcaaactttggccgcaaaacggaaaagtaccataaaatttctccatatagaaataattaggcaattctaactgcatcaattttccgccttgaaaccccggtacttttccgttttgggcctacaactcaaaattttaaaaaagtcacattcaataatttatgagcaacgccgaagaggagaggtcctttatcgctactttaatttatgctatggaaattgtcaaaaaatgtacattaatcgcgcccattgctgatatttttttaaaattttgaggtgtaggcccaaaactgaaaagtaccgaaaccccttatacagttttactaataaattatatttattgtggcaattgcctttttataaggggaggcgagaagcgagtgaaatccgacgaaagaatgtcacagaaaagacgaaggccgaaattaagaagatcaacgaacgtttaaaagcaaaaatactttctgattttcacattttctgatgctttgaaattgaagttggttaaaaattaagagaattcgaaattctgcggcatggaaattttaaataatttatttaattattcgggaaataatttgtgaaattggccagtggataaaacaatagaaaattgtggcgaccgtaaaactcattaaaattgcggggggaagggcgatgattaagctaaaaggtgattctgtctcttggaaggcagtgatacgcgtgaagagaaaaacgatgggcatgtgagtgagagcgacggagaaagtcagacgggcgaacacagcgaaaattcgatggatgagacgaggccgaaaaaagctgaaaagaaagagaaaacggacatttggacagaagtggacaaatggacatcatgacagcggacattttactattaattattattaaaaatagctttagaatgaaataaaaaattttcgatgctacgtaaataaaaatgtaatattatatttataagaacataattcctccaaaataagcccaaaaagggaaaaaatgaacaaaagggaatttaattgctgtttgttgcatattttatcgtttcctcgtcccctcccttttgttttgctgtcatttgctcctcggtctgtacccaatgtcctaagtccacccaattaccctgaggggctgctagatctctgcgttgggtcagtctgcttttagattttgattgggtctgattgacctaatggctgggttaatgctaaacaatccgatgcctcttatagctcacagatttttataacaaaaataaaaaatggggcacgggaaactcgacgacatattaaagacctttttatggagaggagacagctgagcatcatcagtccgatgccacaagcgaacagtgttcggaaggatgccgtgtag

SEQ ID NO: 58952 - DNA, 165 bp, Heterodera glycines
  Genomic contig location: Contig_ID=SeqID_5700; Location=329..493; Strand=-
  SCN-specific regions: Sequence locations=1-165
atgaatgcgatttttggtccaaaaactccgcgtcatgcagtcaaaattctcaaaaaaattgactacgaagaccgtgcttcttgctatttggtgcaatggaattgcggaagtgcggaggaaaagggtccttcgacgacgtgggaatgggccaataagctgtcaccg

SEQ ID NO: 58953 - DNA, 739 bp, Heterodera glycines
  Genomic contig location: Contig_ID=SeqID_5701; Location=77..815; Strand=+
  SCN-specific regions: Sequence locations=1-50,72-411,433-739
  Gene Ontology: Cellular component=AP-1 adaptor complex; Biological process=ommochrome biosynthesis
atgatcaacagcattttcattgtaaattcttctcagtgagttcatcaatgttttattatttcagtcaaagggtgatccatcatttaatccgttttctttagtgatgttatattggaaaagcactacaaatcgtcatccatcgttcaatttgcgattatttttttgatgtccaaaaacaatcaccaaatgccgaaaacattcctccggtcattgcggcaccgcaccattacctttacattgtccaccacaacagcctgtatttcatagcaatttgcgtcacagaaagtatgaataagtctcattccaaaaaacaaaaacattcagctcctccattaatggttattgaggttctgcacaggataattgctattttcaccgaatattttgacgaatgttcggactctgcgattaaagaaaatattgtcattgtttttgaggtcagtgtggccatgcattatttgttgcttcatcttttacacttttgagttgctcgacgaaatcctcgattatggttacccattgtgcacagagttaaatgtgctgcaggatatgatcaaacctccgaattttttacgttccttaaaaaaccaagtcacaggacggacaaacatttcagaaatcctaccaacaggccaattatcagtgattctaacattgctataaaatttggatttggtatttttgcagaatgttccatggagaagagctgctgtaaaatatgcaaacaatgaaggcgagt

SEQ ID NO: 58954 - DNA, 771 bp, Heterodera glycines
  Genomic contig location: Contig_ID=SeqID_28324; Location=1..771; Strand=+
  SCN-specific regions: Sequence locations=1-771
atgtcttttgatgaatttgtagctttagcttctcgcgcagaagcaacacaaatggctgcaaaaaggcaaagttcggaacaccgaccaaaccaggaacgaaaatatatgcacccgaacaaccgtgaagttgaaacaagttccaaaaatcagttaagaccctatcaagttgtttgttacaattgtaacgaacctggtcatgtttcacggaattgcaataagacaatgtcccgccaaaaccgaaacgaattcccatcgtcttttcctcagcagaatcaacagcaaaccccaaatactgttgccactggggcaaaccgagttttcctaaactcgaaaaacggaataccctcagcaggtcgctcgcagaattttctaaagcaaaattgcattagaatggaggaagaagtgaaaaccgatgcaactgttgccggtgttaagctggaaagagaagtggttgaatttctaagaaacgaattggataaggcaaaaacgaagtcagacaaaacaggagaaagtccagtaatcggaaaaatggtcacggttgagctcaaagtttttgaaaccccggccaccgcaatgcttgacggtggagcacaaatctctttaatgggcggaaaatttttctacgaactgataacaaacggaaaattggaacttcataaaaacggatttaatcgcgtttcagctcgaatttctgatgtgaatgggaaagaattagaatgtttcggagtcatttcactccctgtcgaccgggatggttgtaaaacaactaat

SEQ ID NO: 58955 - DNA, 405 bp, Heterodera glycines
  Genomic contig location: Contig_ID=SeqID_28325; Location=193..597; Strand=-
  SCN-specific regions: Sequence locations=1-20,42-244,269-405
atgtcccagtcaccgtcttccatgtcatcgtcctcatcttctgcagagtcttcacactccgcagggaacaaagggggacaacccaatgtttgtgctttggttgcaaagacggggtttcaaaaaacgggggttaattcgcccagtttttcatttgtttgtgcattagtttaaattcccaagcttcagcatgtcgaaagccatggtgaccacgtgggcaaaatgcttggcaatgtgtccgacgattcggaggagggcgaggaggaagaagcagcacaacaacaacacgcggaagtagcggtggcggcgatggacgacgcctcttccgactcaccggcgacctcatcagacgaagaaatgccaatggaacagcgccagcaaaagcaaagggacgcggaggggacggaa

SEQ ID NO: 58956 - DNA, 161 bp, Heterodera glycines
  misc_feature (132)..(133): n is a, c, g, or t
  Genomic contig location: Contig_ID=SeqID_28325; Location=993..1153; Strand=+
  SCN-specific regions: Sequence locations=1-161
gataaactttgttttatgaaaataagccggtagactttttttgtaggccgggaatacctaaaaaagttgatttccgaacctgagtccgtggaaaacaaacaagaaccctgtttccgatcccgtaccactaanncacatagatatgaattcagcagaaatgg

SEQ ID NO: 58957 - DNA, 627 bp, Heterodera glycines
  Genomic contig location: Contig_ID=SeqID_28327; Location=395..1021; Strand=+
  SCN-specific regions: Sequence locations=1-545,567-627
gtactccgggcgtcttgtggccgcggtgttgcagcgactgttacacgcgcgcgccgcgcacatttacgggctcggctggttcgcgttgcgccatggcgagctgttgctggccaacggactgcacttggaggtgcgcgagttgcgcgtccattcgctgttcaattggtggtggacaacgacggcaccgacggtggacagcgcggccaacgacggcggtggtcaacgcatggcactgaacgtgcgtgtgtccgtcggcacaattcgtgttggcaaacaggtgtgtgaattgcgttttgtggcacggttttgaagacaaaacgggcgcattccatttactgtaaaatttaccacagatcatgagttgcttttccattaaaatttcatgtttttaatccatacccaaaaatcttgttattccttttttttgttttgttttttatttagaagaaaaaagatattgaactgacataattttcataaacaaaatgttggaaaaatgtcaattttttagttgggttacgagaaatagagagttgtttatttcgtaatttttttttaattttttagttggcggacgaagaaggcagcagaaatgctacgagtagcatttgtgatggtcagaaatga

SEQ ID NO: 58958 - DNA, 849 bp, Heterodera glycines
  Genomic contig location: Contig_ID=SeqID_28329; Location=51..899; Strand=+
  SCN-specific regions: Sequence locations=1-298,320-849
atggaagaagaagagattcgtcaaagaatagcgaattgttctgagttaatggcatattttgaattgaataagacaaatgttttggcaaagactttgttttatcatcagatacctgaaaagttttgttttaagaaaggaaaatggacagagagaaagacatattttaacacaattggtcgaatggtgaaggtatcaccggctgagccggaacgataccacctgaggctgttgctgttgaatgtgaagggagcatgctcctatgatgatttgaaaacagttattgatattaatggtaatgcaaaactttgtgaaactttttcagccgcatgtttagaaagaggtttgattagaaatgatgaagagtggaaaagagcattagaagaagcagagagttttgaaatgccatgtaaattgagagagttctttgcattgattttagtccattgcaatccggccaaaccggaagagctttggaatatgtttaaagactcattgtctgaagatttttgcaggagttttagaaaagaattggcttatgctaaagcatataaagagattgcacttagcattatgaaggctggaaagacgctgccgattttccaaccatggaacataaatgttgatgacgaagttgaacaactgtttgacctagccgaagaattggatttgggacaaagaaattatgctttgatgtatgatgaacagaggaatgtttgtgatgccattttgcatagaatatgtaatcctgtaaatgaacccgccttctactttcttagtggaccgggtggaacaggaaagacacatgtgaacaagacaattgtacatatgctgagaggtcaaaagaagaaa

SEQ ID NO: 58959 - DNA, 379 bp, Heterodera glycines
  Genomic contig location: Contig_ID=SeqID_28330; Location=337..715; Strand=+
  SCN-specific regions: Sequence locations=1-90,137-236,262-303,325-379
atgattttggaaattcgattgtacgaagaatggacgcaaaactttttctataaagaagaaaatcaaaataaaagcaaaaaaacaggtgagtatttattatttattaataaaaattaaaataaattaattttttaatgctttttaaggaaatgttagcgaagaaaaacattttgtaaaggataatttaagactaaaattttttcataatttgggagattattggatattttatgcaagcaatttttggaaaagagaaaaaattgtacgcaaagtaacgcatcaaatggccaaggatagtaaaaacaaagttgccaaaatgaaagaaatgataaccgaattaaaggaaggaaaagatttcttcttatttgtgagctaatta

SEQ ID NO: 58960 - DNA, 55 bp, Heterodera glycines
  Genomic contig location: Contig_ID=SeqID_28331; Location=142..196; Strand=-
  SCN-specific regions: Sequence locations=1-55
aaaatggacagggacttggtcccgagattcacgttttccgggactcccggtcccg

SEQ ID NO: 58961 - DNA, 484 bp, Heterodera glycines
  misc_feature (42)..(42): n is a, c, g, or t
  Genomic contig location: Contig_ID=SeqID_5702; Location=96..579; Strand=+
  SCN-specific regions: Sequence locations=1-232,259-484
attttttgcctatcaaatattcgcaataaatgcccatctatntaaaaaatattctattctattaaaatgttctgtattttgctatatattaagaatagccgtacatctaaaggcgtcagtaattgaacaaatttctcaaatttcaagaaaggttccggcagtcgccgtaaaaattgtctatataaaaacaatggcgatacgcatttctgcactaggtcctttttcaaaattgatgtgcttttattgaaaaaacatgtttaacgggccacaaattaatagacaaatttaggcacattcttaaaaaattctgcttttaattagttcatttaatagattatgcttttgctttgtttttttaaattctacgcccgcgattatctgataggacaatgatatcaataaattttcttctgaagaagcgaagagttagcccaaacgttttccttcctttctatttaatgatctatcatttcagatataacag

SEQ ID NO: 58962 - DNA, 484 bp, Heterodera glycines
  Genomic contig location: Contig_ID=SeqID_5702; Location=1151..1634; Strand=+
  SCN-specific regions: Sequence locations=1-232,259-484
attttttgcctatcaaatattcgcaataaatgcccatctatttaaaaaatattcaattctattaaaatgttctgtattttgctatatattaagaatagccctacatctaaaggcgtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaaacatgtttaacgggccacaaattaatagacaaattcaggcacattcttaaaaaattctgcttttaattagttcatttaatagattatgcttttgctttgtttttttaaattctacgcccgcgattatctgatatgacaatgatatcaataaattttcttctgaagaagcgaagagttagcccaaacgttttcgttcctttctatttaatgatctatcatttcagatataacag

SEQ ID NO: 58963 - DNA, 485 bp, Heterodera glycines
  Genomic contig location: Contig_ID=SeqID_5702; Location=2207..2691; Strand=+
  SCN-specific regions: Sequence locations=1-232,259-297,319-485
attttttacctatcaaatattcgcaataaatgcccatctatttaaaaaatattctattctattaaaatgttctgtattttgctatatattaagaatagccgtacatctaaaggcgtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaaacatgtttaacgggccacaaattaatagacaaattcatgcacattcttaaaaaattctgctttttaattagttcatttaatagattatgcttttgctttgtttttttaaattctacgcccgcgattatctgataggccaatgatatcaataaattttcttctgaagaagcgaagagttagcccaaacgttttccttcctttctatttaatgatctatcatttcagatataacag

SEQ ID NO: 58964 - DNA, 484 bp, Heterodera glycines
  Genomic contig location: Contig_ID=SeqID_5702; Location=3263..3746; Strand=+
  SCN-specific regions: Sequence locations=1-232,259-484
attttttgcctatcaaatattcgcaataaatgcccatctatttaaaaaatattctattctattaaaatgttctgtattttgctatatattaagaatagccgtacatctaaaggcgtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaaacatgtttaacgggccacaaattaatagacaaattcaggcacattcttaaaaaattctgcttttaattagttcatttaatagattatgcttttgctttgtttttttaaattctacgcccgcgattatctgataggacaatgatatcaataaattttcttctgaagaagcgaagagttagcccaaacgttttccttcctttctatttaatgatctatcatttcagatataacag

SEQ ID NO: 58965 - DNA, 483 bp, Heterodera glycines
  Genomic contig location: Contig_ID=SeqID_5702; Location=4319..4801; Strand=+
  SCN-specific regions: Sequence locations=1-231,258-483
ttttttgcctatcaaatattcgcaataaatgcccatctatttataaaaatattctattctattaaaatgttctgtattttgctatatattaagaatagccgtacatctaaaggcgtcagtaattgaacaaatttctcaaatttcaagaaaggttcaggcagtcgccgtaaaaattgtcatataaaaacaatggcgatacgcatttctgcactaggtcctttttcaaaattgatgtgcttttattgaaaaaacatgtttaacgggccacaaattaatagacaaattcaggcacattcttaaaaaattctgcttttaattagttcatttaatagattatgcctttgctttgtttttttaaattctacgcccgcgattatctgataggacaatgatatcaataaattttcttctgaagaagcgaagagttagcccaaacgttttccttgctttctatttaatgatctatcatttcagatataacag

SEQ ID NO: 58966 - DNA, 60 bp, Heterodera glycines; identical to SEQ ID NO: 52045
  Genomic contig location: Contig_ID=SeqID_28332; Location=694..753; Strand=+
  SCN-specific regions: Sequence locations=1-60

SEQ ID NO: 58967 - DNA, 1077 bp, Heterodera glycines
  misc_feature (923)..(923): n is a, c, g, or t
  Genomic contig location: Contig_ID=SeqID_28333; Location=217..1293; Strand=+
  SCN-specific regions: Sequence locations=1-18,41-127,149-715,750-1077
gtagagaaaattttatcgaaaatttattataatttaaaatctccggcaagtttcgctgggattcaaaaaattttaattgaggcgaaaaagattgacccgaaaattacgaccgatgacgtaaataaattcctagaaaaacagagaacatacacgattcacaagcccataaggaaaagattcccgagactgaagacaataccgagtggcttccacaccgattggcagtgtgatttatgcatttttgatcagttgaaaaagcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacattgggagccaaaccgtcttcaattaattttgaaaatgcccgtgcgctctgggaaaaattatataaggctagggaatttaaaattttaaaaaagaaaaaatttaaaatcggtgatatcgttcgtattaccaaggaaaagggaaaattttcaaagggatacctcccaaactttaccgaagaattgtttaaaatcgttgttgccaattcgacgacacccgattcatacaggatcgaagatttggaaggaaatttaataaaaggcatattttataaccaggaatnagtgaaaacacatggatgatttttacattgtactaccttcgaacacaccggggcaggagaacactacgtcaaaattcacagtacgactccccgagactttggaattgggcacaaattggtcagtagctctctcatcaattatttacccctactc

SEQ ID NO: 58968 - DNA, 1090 bp, Heterodera glycines
  Genomic contig location: Contig_ID=SeqID_28334; Location=879..1968; Strand=-
  SCN-specific regions: Sequence locations=1-174,196-390,413-440,462 -661,696-859,886-943,974-1090
atggcccagttcaaggcaaacactctgccgatgctcaaacatttggacgaccagggcaaactacgcgtggtacgcttggaaagagcggcacacattggggcggtgtctgaaatggcaccgatgggaaaggtcggtggtctgcggcccagcaaattagccaattaaaaacagcaatttttaattgtttttctttttggaaatcaaattacataaagttgaatttaaacgaaaaaaggactcttaaaattaaactctttttgataatcgtcaaaaattgccatttttagaaatattttatgattaggcatacggcagtgccagaaagtgccgttggaagatttttgggtttttgacgaatttcccagaagaattacgcataaatatcgccgtattaaattaaacaaattattttacgattaccaataatggccgcagatcaaaaactgaacttcaaattgtgtggtttgtgaaatgttcgcactcaaaaagaatgcacgagaaaattttctgttcaattacgacccgaaaacctttggttttggtaattcttaaaaacaaattataatgggattaaaaaccggagattccgggagtcttccatttattgttagttcattttgatttgacttgcaaattagtagttcattctttgtccctctccataattttatgtttatttaattttaaaaaataatgcccttttggacattacgttcaacatacaattatggtcatatgtttagcataatttgcgccttattgggtttttgattgacaaaaaaattttgagattttgggctaatttttttaagaaaagataggttttggtgggggccggcggtgccgataggcgccgcagtgggaaaattttaagaatttttaatgaattttgttaaaaaatggccaactgatttttcataaaagtcggtcggtggggcaattgaactttagaagaaggaaaaaataatggaagggataaccactgggccaccgacgctcacattggattaacattctttgtaaaggatattatatatcaaaaaggaaaagcttcatatctcggccagaagcttcatttagcaaaaataaa

SEQ ID NO: 58969 - DNA, 290 bp, Heterodera glycines
  Genomic contig location: Contig_ID=SeqID_28336; Location=495..784; Strand=+
  SCN-specific regions: Sequence locations=1-39,76-290
atgcaaactgattgtgagaattaatgtcaacaataagacaatattaaaatatttaattaattttttcatttttttcagccaatgaaaagttttttattttggattgcgccgaagagaacaatgaatatgacggcaagcaaaaaattattgaacatatccatcagatccagtctgacgtacattggacatgcgatatcaaattcggcgatcgcgaccaacctgtgccattcccattgcctgaaggtgcgattttgccaaaaaaataaataaaaaacgcaacctggcaatta

SEQ ID NO: 58970 - DNA, 618 bp, Heterodera glycines
  Genomic contig location: Contig_ID=SeqID_28337; Location=363..980; Strand=-
  SCN-specific regions: Sequence locations=1-44,66-106,153-156,187 -297,351-361,431-460,482-618
atggtcgttagaattacttgaattttgaaacttcattgttttgcgttaaattcaattttttgaaaaaatccgcattttcggcgttatcttaaaaatccgaaattagttttatattttttaaataaactttttggtaaaaaataaaaaataatccttaacaaattaattcattaattttcaaaggttcggagccgaaattctttgaaatgaaaaagtttcaaggctttaaatgcggctgtatatatgatgagacaaaggttaatctcaacttgccaattccaggtatagtattttggcaaaatatattataataataataattattattattaaattaattaattaattaagttactacgagcaccacgaccactactacgaccaagaccacaaccactaccaccacaaccaccacgacaaccactaccacgacattgccgccacatcagtgcaagcgagaaattgtttccacggacaaaaatgaaaaatttgctgacacctgtccttcgggggaaaatgcgtgctatttgtttaactgtacttcgggtaggttctatcattgaattaccgtagttaaattcactggtttccattaaaatttcaagttttgccaataaa

SEQ ID NO: 58971 - DNA, 81 bp, Heterodera glycines
  Genomic contig location: Contig_ID=SeqID_28340; Location=480..560; Strand=+
  SCN-specific regions: Sequence locations=1-13,47-81
atgcatagaattattgctgcggttaaaaagctcgtagttggatctgtgctagccgtccggtgcacactttgtgtgttactg

SEQ ID NO: 58972 - DNA, 1614 bp, Heterodera glycines
  Genomic contig location: Contig_ID=SeqID_5703; Location=50..1663; Strand=-
  SCN-specific regions: Sequence locations=1-3,32-245,267-775,807 -835,857-940,1004-1148,1178-1227,1263-1614
atgaaaatattattaatatttttattattatgcgcattaatattcaaaaaagcaattaaccaaattgaggctggcaaaataatccaagaaaaaagttttgctgaaatatttggccaaagatgggacgacggagcagaagaaaacatctgtcaaaatgatcaaataattcatggagaaattgctgatcagaataaccaatttggacaaaatgttcgacaatttgatcagatttttgatgaaaatgtggaagtgaaagaagaggagagtgaagaaatgtccacagattatgatgaattgggcgaccaattgccaatgccaacaaataatgaacaaatttatgatcaaattcgaattttaaatgacaaacagaagagaggaattgtggaaaaatttcataaaattaaggagaaaattaagcaaatgggaaagaaatatccaagaaaagaatgggtgaaaattgaaagaaaaattgcaaaaaaattgggcgtcagtcaagagaaaatttacaaatggaaaagagaatttggaatgatgaagaacaaaaattattcagttgaagaaaaaagaataatgttaaagcaatttgatcaaatatatggcaaattaaaaacgaaatttaatgaaaaattggaaggaaaaaggacaaaatgccaaaaaataatagcaaaacatttgggcacaaatatcagaagtatgaatagatggaagaaagaaataaaaaatgggaaaactatgaaaaatcaaagaatttttgagcaaaaaattgaaattgtggaaaaatattttaaattaaaaaaagaatttatgcaaaatggaaaacattcacgaaaagaatggaaagaatttagagcaaaaattaaacaaaagtttggtgtgatttttcagacaattgaaaaatgggacaagaaaattggcttaaatcaaattctttcaaagggtgaaatttttaaacaaattgttatttattaattaaatttaaaaatttttattatttaatatattacagggcagaagcattatacatttgcggaaaaaacggaaaaaataaaacaatattatcaattgaaaaaccaaaacccaaagctcaacgatcgccaaattgcggaaattttaaatattacaaaaagatctttagaaagatataaatctgaattcaagagaaaaagtgaaggtgtcacggattgactgggaatttaagctttcagggccattcattgttaggttttgataaatttaaatttcttaaaaatttatatattattcggcatttcattcattttccaatttgttgcttatgtaagagttaaaagtattatgcattaatgtttgaaggttgttttttttgttctattttttgttgtaattgccatggaacggatttatatgtgccaaaaaagctccaaaatatgcggaacgggccaactccgtctggccaactccgtctggccaactccgtctggccaactccgtctgagccaactttgagtcaatataactcttgaagttattgaccgaatcaaacaatcttgatatcattcgaaagttcttcacaggctctattagcctactaaaaattacagaaaatttcgaactataaaaaaagataaaaataaa

SEQ ID NO: 58973 - DNA, 189 bp, Heterodera glycines
  Genomic contig location: Contig_ID=SeqID_5703; Location=1..189; Strand=+
  SCN-specific regions: Sequence locations=1-189
aaaaagttgtcagtttaaaaccgcaaaaaaggcagaattttcaacgttttttatttttatctttttttatagttcgaaattttctgtaatttttagtaggctaatagagcctgtgaagaactttcgaatgatatcaagattgtttgattcggtcaataacttcaagagttatattgactcaaagttggc

SEQ ID NO: 58974 - DNA, 249 bp, Heterodera glycines
  Genomic contig location: Contig_ID=SeqID_5703; Location=2660..2908; Strand=+
  SCN-specific regions: Sequence locations=1-249
atggcgaatgttgatttggcattggatgaaattatctcgaagtctcgccctcctcctcctcctcccgcaccacaacagagaaactttggtggcaagcgaccatttcgaatgaatgctaccaatcgtcccgggttcggtcgacgcaattctttgggtggtggccaacgttttatgcgttccggaagtgacaatgctgtttggattaacatcgtcaaccttcacgacactgtgcttactcaagaccttcag

SEQ ID NO: 58975 - DNA, 1621 bp, Heterodera glycines
  Genomic contig location: Contig_ID=SeqID_5704; Location=778..2398; Strand=-
  SCN-specific regions: Sequence locations=1-3,32-121,143-248,270 -418,440-778,810-838,860-943,1007-1151,1181-1234,1266-1621
atgaaaatattattaatatttttattattatgcgcattaatattcaaaaaagcaattaaccaaattgaggctggcaaaataatccaagaaaaaagttttgctgaaatatttggccaaacatgggacgacggagcagaagaagaaaacatctgtcaaaatgatcaaataattcatggagaaattgctgatcagaataaccaatttggacaaaatgttcgacaatttgatcagatttttgatgaaaatgtggaagtgaaagaagaggagagtgaagaaatgtccacggattatgatgaattgggcgaccaattgccaatgccaacaaataatggacaaagttgtgatcgtttttcaaatgaaactaataaaaataaaagagaaactgtggaaaaatttcataaaattaaggagaaagttaagcaaatgggaaagaaatattcaacgaaagaatgggtgaaaattgaaacaaaaattgcaaaaaaattgggagtaaatcaaaggaaaatttacaaatggaaaagagaatttggaatgatgaagaacaaaaattattcagttgaagaaaaaagaataatgttaaagcaatttgatcaaatatatggcaaattaaaaatgaaattaaatggaaaattgcataaaaaaagtacaaaatgccaaaaaataatagcaaaacatttgggcataaatatcagaagtatgaatagatggaagaaagaaataaaaaatgggaaaactatgaaaaatcaaagaatttttgagcaaaaaattgaaattgtggaaaaatattttaaattaaaaaaagaatttatgcaaaatggaaaacattcacgaaaagaatggaaagaatttagagcaaaaattaaacaaaagtttggtgtgatttttcagacaattgaaaaatgggacaagaaaattggcttaaatcaaattctttcaaagggtgaaatttttaaacaaattgttatttattaattaaatttaaaaatttttattatttaatatattacagggcagaagcattatacatttgcggaaaaaacggaaaaaataaaacaatattatcaattgaaaaaccaaaacccaaagctcaacgatcgccaaattgcggaaattttaaatattacaaaaagatctttagaaagatataaatctgaattcaagagaaaaagtgaaggtgtcacggattgactgagaatatttttaagctttcagggccattcattgttaggttttgataaatttaaatttcttaaaaatttatatatcattcggcatttcattcattttccaatttgttgcttaagtaagagttaaaagtattatgcattaatgtttgaaggttgttttttttgttctattttttgttgtaattgccatggaacggatttatatgtgccaaaaaagctccaaaatatgcggaacgggccaactccgtctggccaactccgtctggccaactccgtctggccaactccgtctgagccaactttgagtcaatataactcttgaagttattgaccgaatcaaacaatcttgatatcattcgaaagttcttcacaggctctattagcctactaaaaattacagaaaatttcgaactataaaaaaagataaaaataaa

SEQ ID NO: 58976 - DNA, 371 bp, Heterodera glycines
  Genomic contig location: Contig_ID=SeqID_5704; Location=2730..3100; Strand=-
  SCN-specific regions: Sequence locations=1-75,99-371
atgaaatcttctttcctaatattatcattactattcctaataatatttgaaaacgtaattgagcaaattaactctgggaaaataaatcaagaacaaaattttgatgaaatatttggccaaggatgggacgaaagaacagaactccgaattgatcaattaattcatggacaaaatgctgatcagaatagccaatttggacaaaatgatcgaacttttgggtgaaaatgtggaagtgaaagaagaagagagtgaagaaaagtcattaaaaaaatatcaaaaagtgcaaaaagaaaaaaaagaaaatttttgatcatttttggatatcttgccaagaatttgagtgcaaaaaagctactttcgtaaaaaataaa

SEQ ID NO: 58977 - DNA, 1061 bp, Heterodera glycines
  Genomic contig location: Contig_ID=SeqID_5705; Location=57..1117; Strand=+
  SCN-specific regions: Sequence locations=1-354,377-967,1000-1061
catttcaatcactgggactcaacccaccagcatttcaatcactgtggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaaaccaccagcatttcaatcactgggactcaacccaccagcattccaatcactgggactcaacccaccagcatttcaatcactgggactcaacccaccagcatttcaatcactgggactcaacccaccagcatttcaatcactgggactcaacccaccagcatttcaatcactgggactcaacccaacagcatttcaatcactgggactcaacccaacagcatttcaatcactgggactcaacccaccagcatttcaatcactgggactcaacccaccagcatttcaatcactggcactcaacccaccaacatttcaatcactgggactcaacccaccagcatttcaatcactgggactcaacccaccagcatttcaatcactgggactcaacccaccagcatttcaatcactgggactcaacccatgggactcaacccacaagcatttcaatcactccagaattcaatctcaccaattcttcgaaacccaataaccggaaatgaatgataaaaccgaaagcggctcgaccgcttagcggcctcgcactcttcttttggcattttcttatggcataacagttcttccttgtttcttgacattttcttacgacacaacatttttcttctatacaaatttttcaaacaaaattctcattcattcatttaaaatttcattaccatttacataagcaaaacaaaacctttcatatcaaaatcaaatcaatttataacacaaaca

SEQ ID NO: 58978 - DNA, 92 bp, Heterodera glycines
  Genomic contig location: Contig_ID=SeqID_5705; Location=1313..1404; Strand=+
  SCN-specific regions: Sequence locations=1-92
atggcatataaaggtgctagcgcgtttgttaaaaactgccacccatacgcgtttgttaaaactgccagcgcgtttgttaaaactgccaatgg

SEQ ID NO: 58979 - DNA, 379 bp, Heterodera glycines
  Genomic contig location: Contig_ID=SeqID_28345; Location=467..845; Strand=-
  SCN-specific regions: Sequence locations=1-27,55-79,101-379
atgttttttcgtaaattggatcccggtaaagaatttttaaaaaattggaaaagtgagaattgcaccggagatgatgctgatatgcactgggtttaaatattgtctccaaaattattccgtccagcgctttgttgctaatcatctacgctttaaattttagtcattttgaataattcgagataaaaagattttttcagcaattaacggaattcattcaaataaaacaattatgatctatcattttgaggtactgtttttctatcttgatttaaatctaacttccattgctgatcgatccctaaaatctgttgttgttatggcagataaaatttggtggtcgcttcgatttcagtgcgacaatatgggcacaatttcgtaa

SEQ ID NO: 58980 - DNA, 464 bp, Heterodera glycines
  Genomic contig location: Contig_ID=SeqID_28346; Location=308..771; Strand=+
  SCN-specific regions: Sequence locations=1-194,216-369,442-464
atgaaacggcggttgtccccgcgcagcaattcaactcaaccggtgggccccatcagccgaacagcaattgtgagtaaattttgaatgaaatgtcaatttttaatttgtaatcttttcaagacaacactcacatgttgcaattgtttctgactcatggcggggccggcactgctcacagcggcgccggcggcgcccagcaacagcagcacccgcccgtaccgatcagtgccggcggttccgcgcccggcgtggcgccatcatccgccgcgttgagcgcggtcgcctccacgctgggccgaatgttcgaccaattgggtgccgcgactgcgggcagcggaacaaacaacaacaacggcaccagcaacaatgttttgcagcaacagcagcagcaatggggaggcgagaagcaacagcaggtggacagaaaagaagaagaagcagtactaattaataatagcacctaa

SEQ ID NO: 58981 - DNA, 1282 bp, Heterodera glycines
  misc_feature (32)..(32): n is a, c, g, or t
  misc_feature (1196)..(1196): n is a, c, g, or t
  misc_feature (1201)..(1201): n is a, c, g, or t
  Genomic contig location: Contig_ID=SeqID_28349; Location=1..1282; Strand=-
  SCN-specific regions: Sequence locations=1-230,253-1282
  Gene Ontology: Mol. function=structural constituent of muscle; Cellular component=striated muscle thick filament; Biological process=striated muscle contraction
aaagccaaattaactggaacattcggacccantcgagaagcccttccctagaaagtgaccaaattcaaatttagctgtttcgacttcgttgcagtaatggacgaagccaatgaacaagcagaggcactaaggcgagagaacaaaacgttgatgcaagagctaaaggaagtgacggagcagcttaacgacgggggaagagggacccacgaattgggcaaggcgaagcgaaagttggagcaggagaaggaggagttgcaattggcactggaagatgccgaatcggctttagaggcggaagagtccaaagtgctaagggcacaggtcggtaggcaaatgtggccgcggggcaaacacattttggcatacattgattttaaggttgaaatttcgcaaattcgttcggaaatagaaaaacgaatagcggagaaagaggaggagtttgagaacactcgcaaaatgcaccagcgagcgttggaatcgctgcaagtcactttagaatctgagagtcgggccaagactgagttggccaaaaccaggaagaagctcgagagtgacattggggtgggttggccaaagttcgggacttaacggaatcacaggaattggaactcgcgttggaccaagcgaacaaggccaatgttgaagcgcagaagcatttgaagcgatgccaggagcagattcgcgaattgcagcaccaagtggacgaggaacaacagcttcgggagcaggttcaggaacaatggcaagtgacggagaaaagagtccaagtgggacagcaagagaaggaagaagcattgatggaggcggagcaggtgaggcacttggcagggcaggcaaagccagggatgaagccgaaagagccaaattgaggcagaaagagcgcgccgtcacgcagagtcggaggcgcaggaaatgcgcgagacgatgggagggctggaaaatgccaatgcggcaatgaacactctcagacgccgactagagaacgaattgggccagaccaaaatggagttggcggaaacgacggcagaactgcgcgggatggaagagacggcacggagagcggcgacagacgcggcacggctggcggaagagttgcggcacgagcaggaacacgcgcaaggcgtggagagacagcgcaatgcgttggagcagcaagtgaaggtcagcagcagtggcaaattgaacagtcagcttanacggngacaaattgaaggagacgcaactgcgcatggacgagatggacactttgacactgaaaagcggaaagaaagcaatggcaaag

SEQ ID NO: 58982 - DNA, 615 bp, Heterodera glycines
  Genomic contig location: Contig_ID=SeqID_5707; Location=42..656; Strand=+
  SCN-specific regions: Sequence locations=1-593
atgattagaagaggtacaacagtgattaaaagaggtacaacagtgattaggagaggtacaacagtgattaggagaggtacaacagtgattaaaagaggtacaacagtgattagaagaggtacaacagtgattaaaagtggtacaacagtgattagaagaggtacaacagtgattaggagaggtacaaaagtgattagaagaggtacaacagtgattaggagaggtacaacagtgattaggagaggtacaacagtgattaggagaggtacaaaagtgattagaagaggtacaacagtgattaggagaggtacaacagtgattaggagaggtacaaaagtgattagaagaggtacaaaatgattagaagaggtacaaaatgattagaagaggtacaacagtgattaaaagaggtacaaaatgattagaagaggtacaacagtgattaaaagaggtacaacagtgattagaagaggtacaacagtgattaaaagaggtacaaaatgattagaagaggtacaacagtgattaaaagaggtacaacagtgattagaagaggtacaacagtgattaaaagtggtacaaaaattgaatgcaatttattataaatttaaaaaa

SEQ ID NO: 58983 - DNA, 453 bp, Heterodera glycines
  Genomic contig location: Contig_ID=SeqID_5708; Location=22..474; Strand=-
  SCN-specific regions: Sequence locations=1-271,293-453
atgattgtaccctttttaaccattgttgtacaattccaacaatttttgtacctctccaacaattattgtacattttcgacagtggttgtacctcttctaatcactgttgcacctcttctaatcactgttgtacctcttttgatcactgttgtacctcttttgatcactgttgtacctcttctgatcactgttgtacctcttctaatcactgttgcacctcttctaatcactgttgtacctcttttgatcactgttgtacctcttctgatcactgttgtacctcttcaaatcactgttgtgcctttcccttccgtggttgcacctcttctaatcactgttgtacctcttctaatcacttttgtatcacttttttactgttgtacctcttctaatcactggtgtacctcttctaatcacttttgtatcactttttcaatgtcgtacctcttctaa

SEQ ID NO: 58984 - DNA, 643 bp, Heterodera glycines
  Genomic contig location: Contig_ID=SeqID_5709; Location=1448..2090; Strand=+
  SCN-specific regions: Sequence locations=1-157,183-643
cgcccgcttcgcggcatagtacgggcgcttcgcgcccgtttttcaaatcttgttttgctctaacgggcgcttcgcgcccgttttttaaatttgttgagctcagacgggcgattcgcgcccgttttttaaacttgttgagatcggacgggcgcttcgcccccgttttttaaatttatttgggccttttcggccgcttcgcggcatagtacgggcgcttcgcgcccgtttttcaaatcttgttttgctctaacgggcgcttcgcgcccgttttttaaatttgttgagctcagacgggcgctttgcgcccgtttttaaatttatttgggccttttcggccgcttcgcggcctcagacgggcgctttgcgcccgtttttaaatttatttgggccttttcggccgcttcgcggcatagtacgggcgcttcgcgcccgtttttcaaatcttgttttgctctaacgggcgcttcgcgcccgttttttaaatttgttgagctcagacgggcgattcgcgcccgttttttaaacttgttgagatcggacgggcgcttcgcccccgttttttaaatttgttgagctcagacgggcgctttgcgcccgtttttaaatttatttgggccttttcggccgcttcgcggcctcagac

SEQ ID NO: 58985 - DNA, 1127 bp, Heterodera glycines
  Genomic contig location: Contig_ID=SeqID_28354; Location=170..1296; Strand=-
  SCN-specific regions: Sequence locations=1-94,116-741,763-938,960 -979,1001-1127
  Gene Ontology: Mol. function=intracellular transporter activity; Cellular component=intracellular; Biological process=Golgi to endosome transport
atgggcaaaggggtggcggcactgactttggacgaggactaccaacgacggcgaatgcaggcccggcagcagccgaccagcatcggtgaaggaatgtttcgcggggttcgcggcgttggcacaagcgttgtggaaggagtcaccggtcagccggcacttataattagcacatttggactcatttgctaattctatatcacactgacaattttgttttgttgtttctcaggtgtcgtgtccaaacctgtcgagggcgttaagcagggcggcctgctcggcgggatcaaaggcatcggtaggtcaaactcataggaacggggccttgtataaagcgttctggtcaactttatgtttaggaaagggaatggtcggtgcaattgctcgtcccgtgtcgggggtggtcgatttggtcacaacgacggcggacaatgtcagaaagtgagcgagggggagaagggacacgacgggtccattgttaatccacttgttttcagtgccattagcaatgttgaggacgtaaagccaattcgcccgccacgtgtcatttcccatgacaaaatcatccgaccatacgtttttgaggaggctgtcggatacaaaatattccgggttaaaattcagtctattaatttccttcagttaaacacatttttgtaggagacggaccgtggtcattttgctgacactgatcactacctgacttatgggggcatcacaaaacatttggtcatcattgtgacggacaagtgaataaatgatcatcaacccatccctacaaagtgtaccataataacccattcattcttaggcacgtaattgaggctcgacaacacgaactgacgggtaattggagtgcagattggaacccggaatatgccgaactcaaaaggccgactcgggtggactcaaatgggaaatttggttggcaattaaacttaagaatgcctaaatgaatttcaattttaggcattgagctcagactgaagaaggagaaaaagggattttcgtttttctcttcgaaagatgccaatgtcaaaggcaaaattgtgcaattcggtgctgaacacgtcgcgcaacgagtgttcgagcacattcttcgcgcctgggaatacggtgtcgcggattaa

SEQ ID NO: 58986 - DNA, 1189 bp, Heterodera glycines
  Genomic contig location: Contig_ID=SeqID_28356; Location=556..1744; Strand=-
  SCN-specific regions: Sequence locations=1-730,753-981,1003-1130,1153- 1189
agaaattacggcggtattagggtttccttaaaacatttttcggactcattaaaggttcgagaaaacttatcaagaccggaagtctgcgctcaaaaggattaatgaaagcctttttgaaatgttccttgaaaaaggcgaatcaaccttacaataaaggacatggatttacggagatgggctcataacaggaaattaaaatacccaattttaaagcaagccgtcgttggttgaaaaatttcaaatcagccaaaagaattgttgtcagaaggttttgatctacagtaatcctttttactcaattttttgagatcacaaaattcgtgaacaaaaaatatgccgtggaaaaggaaaaattgctggaaacatccaacaattttgttcaaggagtaataaacatggtcgaggagttgagcccggaccttgttctcaacagtgatcaatcaggatttgagcttgagcttcattcacaacatacattagaaatttcttggacaaaaagagtggaaagcagggcgcaaaatatttcagcaacaactcacagctatacaatctgtccaattgtttcagtacacggagtgttgtattcaccgctgcttataatcatagcagaaaaaaatggccaattccctcaaaaagggatttttaaggttactgtatattttctgtaatttgtctatttttcatcctctaggccccaaatataacggctattgctggccgttctcatatcatgacaaaagaaatggcaaaattctttgttgaaaattttttgcttaaagtcattggggacaaaaaagccattgtgttgcttgattcttggccacaatggaaaacggccattggtggaacctttggccaggaatgctcttcatcaaataaagagtgtggcagggacaatatttgcatccagacaatccaacctggttgtactggctttgttcagccatgcgatttgtatttatttcggttagttcaaaaaaagttattttaatttttaatggttgacagaacatggaaagaattagttcgaaaaatttctgatcgaattgtacttgatgaactccctgtaaacatttatcagcggatgaaatcatcaaacttcaaagtcttatccattatcaattatgcgcaccgaaatttaagcagtttttacgttatgcatggtataaagggggttatttgcgtaagc

SEQ ID NO: 58987 - DNA, 282 bp, Heterodera glycines
  Genomic contig location: Contig_ID=SeqID_28357; Location=708..989; Strand=+
  SCN-specific regions: Sequence locations=1-14,52-282
atgaacagacggtaagcaatttcttttaaaaaattgcaaattttcatttacccaattttcttatgtttcagttggatttgtggtgacgtttggatggacattctgccatcttttgaccatgctcaacttggactcaaaatggcattgctttccgaccgtttcgatgttttggtggacaaacatttcgatgcaaaaagcgaattgacaatttggagaagaaatcgaattcgcaaggacaaagggccaaaagcgaaactgtctgttctgatcgatgacaaatgg

SEQ ID NO: 58988 - DNA, 408 bp, Heterodera glycines
  Genomic contig location: Contig_ID=SeqID_28358; Location=890..1297; Strand=+
  SCN-specific regions: Sequence locations=1-100,124-201,224-408
atgctttttaaattttcaattttattttgcacaatttttttgtgcttttgcgtcgacgacggcccaaaaaatgacggaaaaaagcaaattttgacaaattgggaagaaaataatcaactaactgagttcgaacttgatgacgaatattcgcattatctttacgatttaatgggaaatgaaaacgacgaagacaaatgggccaaaatagaaacgaaaatagacaaagcaattggagggggacaatggccaaaggaggggcacaaaagcggaaacggggaaaatggggacgaaaatgggcaaaatgagtgccgaaatgggcaaaatgggggcaaaaatgcgcaaaataagtgccgaaatgggcaaaatggagacaaaaatgggcaaaatggggataaaaaagtaaaataa

SEQ ID NO: 58989 - DNA, 208 bp, Heterodera glycines
  Genomic contig location: Contig_ID=SeqID_28359; Location=282..489; Strand=-
  SCN-specific regions: Sequence locations=1-135,157-208
tgtggagcaaaatggtgacaactgctacattgtgatgtcctgcatgaagacagacaattattcgactaattggaaggattttttgtctgccaatggcactctggacatgacaaaggcataattcggttaaaagtgaacggattgattgattgatttgaccatcgttttaatttaagcctatgtgtgatttcattgatggtttaaaata

SEQ ID NO: 58990 - DNA, 507 bp, Heterodera glycines
  Genomic contig location: Contig_ID=SeqID_28361; Location=648..1154; Strand=+
  SCN-specific regions: Sequence locations=1-18,40-241,272-274,311 -376,399-507
atgcttttgtctccgacaaatttattatttttctcaattcttagtcaaatgtgttccgttatatgggcaacaacatgttggcctatcggtcatgtgacgaattggcggagcttaacttgcgcatgtggatgtcctgttgtgatgaaacttgctcagcacgtgcgtcgactggcattgacagtgccaatgatgggaatgagcaaagcagaaggtggaataataaaaaaattgaaaaattgccatagaaaatattataattaaaaaacattggcattttataacaaatatgcatattcaaatgcatgaaatttgaataactttctattaatgaacttttttttttgcacttttttgattatgtaaatatttaaatcgaaaaattaattaaacaaattttactttttaggcgtaagcgcgctgttcatctatatgcaaatgggaataattaattggaaaatatgcacaactaaaaagatcaattctaccataaattgttgctttaaatga

SEQ ID NO: 58991 - DNA, 630 bp, Heterodera glycines
  Genomic contig location: Contig_ID=SeqID_5711; Location=980..1609; Strand=-
  SCN-specific regions: Sequence locations=1-456,479-630
atggtccaattcattcgattgaagctgaacctgaccgaacttgtccgacgaatgaatctgatcggctatggacgggatgaaacaatgctcgtcactttgcattcggctgatcagcttaacgcgccgggcggatacacgcagacatgcttcaaccaaaaaaaggcagggcccacaaaatatttgacgaggttcgcattctcatttggatcactcacagtctctaaaaaatgccgaacataaccccattaccaagctttcagggagactttgtgggctccggatacttcctgtccctctggccattttcgtcatggcatttgcaattttggcgtcgaagatttggccagactcgccaaattcccgcactttttcttcaacaaattttggcccgccttcgattttggcgctttgttgtgtgtgtacgaacggttgttcaacatgacccatttgtacaccggcgcggaacaattggccaaaatgacaccggtggtgaacaaatcgtttgtccaacaactgcccaatgttcgttggtttggtgttggaaaaaaaataaaaagtgaaaaattggcaaaatattaaaggaaactcaaagagaataattcttttagtttttaaatccacaaaattaaa

SEQ ID NO: 58992 - DNA, 1250 bp, Heterodera glycines
  Genomic contig location: Contig_ID=SeqID_5711; Location=1952..3201; Strand=-
  SCN-specific regions: Sequence locations=1-144,166-1250
atgattaaacgacgcattcgtcgcgaggaggacccggctgaaaatgacctggatatgtcctgcacggcaattcaaagccgaaacagattttggcacggtgccaaagatgacgaacagggggagaaggatgagaaggagcatgccaattacccaatggcacaaattcgaacagtgtacaaggcaagaaatggtgaaattgggattaatattggatgtgaatattcaaatagtctgaaacccattcggccattggttcgaaaagaattcaattttcaatgggtgtaaatggatcaaaggtcaatttggtcttacatttccatgcttattctttatgttacgatttccggctcacaactcaaatttcgaaccaatccctttcgttttgaaaaatgcccggctaattattcgcgctactgtcagcaggacttgtacttcttagttggatttgattctctcagggttaaaattctctttactctcgggcttttcttgtctcaatttttctggtccaattctcagtcttaatctcggcaactgtcattattggccatcactaattattacccttccctattccattctctccccaggactatgtggtggttgagttggaattcgccgccacattttccccgctcaattggtactgtttcgtcgtcgatgccgcgtcccccgcgctgtttaagcgccgcgtgcgcgcgttggccaaatgctttccgaatgtaattatgggagacgagcgcccgatgaaaagtgacggggagggcatgatggaagcggtgttggactgttttgagcgattggacacgccaaaacgcaaatgggaatatgtcactctgttgcaagtgaataaattggccataacttatataatatatgtactacggtatatgtgcatgtacagtatgacaagacacattagcacagggtttcaacagatcacaaaaataatttttgattttaattatgtgttaattctctcgtctgatttttatgaaatctatgacccaaaaacagaaggtattatcatattaccaacccagaactcaattaatcattattttttattattttcttaatagaatcacgacacagcaatcaaaacgcgtgttcaaatggcacaaattttcgcttggatggacggagcaaacgatgttcaagttttagtgccaccgcctggacgagttgacaaaattacaggaatggactggagttttgaggcactgaatttgttcaaaaatggtacataa

SEQ ID NO: 58993 - DNA, 570 bp, Heterodera glycines
  Genomic contig location: Contig_ID=SeqID_5711; Location=4471..5040; Strand=+
  SCN-specific regions: Sequence locations=1-89,127-435,459-570
atgcacttttccactattaatttaatctatttcataattgctttaaatgtttcacatggcaatttgtcgccctgcctgccgtaagtttgaaatttaatatttattaaattttttctaaattttaaagtattcgtctgacaaatggcactgacggcggtgtgcgagtgatcaaattatgcacatctgctgagaaatgccccgaaaacaatggaacggatggagccacgaaaaaggcctatggaattgaatttcgactttcacaaaacagcggaaattgtgacgatgggtgggaagagaaattacaataacaaataaataagcatttttaaatgcctctttagacttttgatttgttatccggcattgcttcaacgaggcaatcacttggacattgcagccaatttcaaagtgaaaagaacattcacaattggtgatcaaaaggcaaattattcaaaaaatatgaacgcttaattatttattaatcaatcaaggacaatccgattacgaacgaatgcgcggaagtgatggccaagaatggccataaaaatagttcaactcattggcgtggca

SEQ ID NO: 58994 - DNA, 1207 bp, Heterodera glycines
  Genomic contig location: Contig_ID=SeqID_28362; Location=443..1649; Strand=-
  SCN-specific regions: Sequence locations=1-132,157-181,203-340,364 -388,419-448,640-680,702-846,924-924,1033-1103,1133-1140,1165 -1175,1197-1207
  Gene Ontology: Mol. function=long-chain-fatty-acid-CoA-ligase activity; Cellular component=peroxisome; Biological process=learning and/or memory
tctttggtcgcccgttcgagtcccttcaagcaatggcttttccgtttggcttatgcccagaaattggctctcctgcgcaaaggcattgtcacaaatcggtcaatttgggacagattggtattctccaagatacagcagcaattgggcggcaaagtcagactgatcggtgagcaaacgaagatcaaatgaacacacaaaaagtgatcaatcgattgattaatttgacttgtgcaaggaaatcacaaccgtcttgatttctctaaatgtccatttttttctttgctctctctttctctctgtttctctaactgatctgtctttttaatattccaaaatcacttctccctccctgcctccctcccctttctccgtttatttttccccaatgtctctctctctctcactctctctctttttcctgctattccccccccccccccattttcaagtcaccggctctgccccaattgcgccggaagtgctgcaggacttgcgcattgcattcggcaccacaatcatcgaaggctatggccaaacggaatgcactgcaatggtcaccgtcacttggccaggcgacgtcgacggcggccattgcggggcgccggccgcgtgttcactggtcaaattggccgatgtgccggaactgaattatttcacggtcagtcggagggaaagcgaatggcggaaaaagggcacaaaatagaccatgccaatcagggcttggcataattacggattacggaaactacgacatttttggatcccgtaattacggatataatttccgtaattaaatatctacccatccctgatgctaaatactcttttataaattggcatttttcagagtgatcggaagggcgaagtgctggtgaagggaccgtcggtgaccaaaggctattaccgcgacgcggaaaagaccgccgaattgttcgatgagaacggctttttgcacaccggagacattggccaattgttgccggatggacggttgaaaatcatcgaccggaagaagcacattttcaaattggctcaggtaaaagggggtcgaagaggacaaaggttaatttggagaccaattagcgaacaattaaccgtaattaagggcgaatatgtggcaccggagaaaatcgaaagtgtttatgtgcaatgcccacttgtccagcaagtttatgtggacggcgacagtttggaacgaaatttggtg

SEQ ID NO: 58995 - DNA, 839 bp, Heterodera glycines
  Genomic contig location: Contig_ID=SeqID_28363; Location=1..839; Strand=-
  SCN-specific regions: Sequence locations=1-180,202-492,514-631,664-839
  Gene Ontology: Mol. function=organic anion transporter activity; Cellular component=mitochondrion; Biological process=transport
atttaaaatgcgcaaaaggcaaaaaatgccgatggttcgcccaaactcaacgccagcttcttctctcgtcttttctattcgtggttcggtccaatccttcaaatcggtcgcaagcgtcccctaactgaacacgacctattcgagctggacactgacaacaaatgtcacttccttaccgcacaatgggaaaagctttggctgcctgccgccgaaagttgaataaataatgcaaaacgctttaaatttcgtcacatcaacagaataccaagagcggcgccgtcacaaatacttcatttggcggaccagcaaacgtggtttgatgccgaaacgcagcttcgacagcgaatgcgccgtgccaatgccttccattgtgttcactctgttcaaggtcagtcggtcatttgctgtcattcactgcccaaccaaccatccgtcgttcacagttgttcaaatacgatctgttggtggctgcctttgtcaaactgttctacgacattctcctttttgccaatcctttgcttctgaatttgctagtcaatttcatctccgacccgaacgcccatctttggcaagggatttgctactcgttggctatttttctctgctctgaaattcgatcgtaagaattggattaatataaaacaaatatttttgatttctttttcagtatttgcgtcaattaccactacaatgtgatgttccaaatgggcgccaaagttcaaagtttgctgacgatggccatctacaaaaaggcgtttaaactgtcaaatggcacgcggcgagacagaactgtcggtgaatagtcaatctgatggccattgatgttgaacgattccaaa

SEQ ID NO: 58996 - DNA, 231 bp, Heterodera glycines
  Genomic contig location: Contig_ID=SeqID_28364; Location=554..784; Strand=-
  SCN-specific regions: Sequence locations=1-231
tggattaaaacgttaaaagtaagtgaattgcgcggaaaaaagaaactgtattttccaaaaaatcgtcaatcatatgaaattactgtctttcacaatgaacaattcattgttcgaaaactagcaatttatgagcgatcgaaattgaagaattatttggagattgagccagagcaatgggaacaaaaacagtccggtgatgtgtttactttccaacgtagtgatgatggacag

SEQ ID NO: 58997 - DNA, 1080 bp, Heterodera glycines
  Genomic contig location: Contig_ID=SeqID_28365; Location=91..1170; Strand=+
  SCN-specific regions: Sequence locations=1-243,265-427,449-522,564 -674,698-1080
atgcatcaaattttcttgaaaaattgctttacccttcgcattcatccttcattatcgtcaaataacaccactaatgatgatggacatatttattttgtggccgttaaatgcaatggcattgagggaggtcaattgtatcggacaatcactgaggaaattgcgcaaattgtgctccatgagcaaaacgaatgtgaagcttatgacataaaagtgtacaaaattagcaacgaaatatcaaaaaaagacatggtaaaaataattcttatttttcaatttttggggtgtctttttccaatattatgggttttttaaagtgagcatatcacctattttctataaaaaaaaattggtggattgcataacaaaaaaataaaaattttcattaaccaattaatcttactatttgggtttgcttcattacttcgcacaatttcaatcaatttcatctattaaatcctttaaatgctcagtttataattaaatcataatcattttagaaggctttcactggcggattattggtattatattttgttattaaaattttgatttttaataatttacattaagccattaaatggtgatcaattcaaggatggacgacaaattttaggagtgcaaattcctaatggccacacttaccaattcagttttgttacatttgaagcgcaacaaccatcaacaccatcatcatcatggaacacaaaagcggtaacaattgaaagagcattcggaatttaaaattttaaaattgaataggaaatgaagcgcttatcctctgaaattgatatattgggaactgaagtaaagcagctgaagaacgatgttgagcaaatgcgggaatcaattaagacggggctgacagagatcaaaaattttctaagcaacaaattgaaaaattgaacaatttttcaactctttttgagtgattcatttatgttctatgacatactgtaatgtaacggtatataaaatctgtatcattatcttttttttattattataaagagcataactgacataaattggtggtagatgatgcttaaatctgatcctttaattgaaattttgaggcaatta

SEQ ID NO: 58998 - DNA, 351 bp, Heterodera glycines
  Genomic contig location: Contig_ID=SeqID_28366; Location=81..431; Strand=-
  SCN-specific regions: Sequence locations=1-6,31-351
taatagattattaattaattaaattaatttgttctgtactgaaatgacccgccccttctgatcaccactcattcgcacttttgtcacttcgattcaccacgtttgaaaatgtacagtcaggggcaaaagtatgttttgcttcagttgcttttctgatggaccctcccgatctatccgagactcagccgaccattccgaaaaggggccaccaccaccggcgtcgcgtggaaatctctgcctcgcgtttgccccgcgctgtgctcgtccgcatctttgggcatttgagtgtggctgagttgggtgctgtttctctcgtttgttgcagttggaaattcatcgtcgactcaaatg

SEQ ID NO: 58999 - DNA, 133 bp, Heterodera glycines
  Genomic contig location: Contig_ID=SeqID_28367; Location=80..212; Strand=-
  SCN-specific regions: Sequence locations=1-67,89-133
atgtttcatgctcaccagttcgttctcgtggtcattttggcattgtccattaacgaggtgaactgtatgccaaaaagaaaggagaaaactactgtaatcgtaaacgaaggtgaatcaccaataaagcatgtcg

SEQ ID NO: 59000 - DNA, 508 bp, Heterodera glycines
  Genomic contig location: Contig_ID=SeqID_28368; Location=333..840; Strand=-
  SCN-specific regions: Sequence locations=1-234,256-305,327-508
atggaaccattttatcgaataggttggatcagtgacccaccggacttagccctaacatttggggaagatctgacatttattacttcttgtttaagaagattggtagttagccaacaaggattcgcaatcgaagaaagagaatttgtaaaattcaaccgacaattggacagaactcgccgaaatgttaattttgatgaaccgttggacggtgaagttcgcaccgaatggatttcacagaacattttggaaatttggccatgttcaccagtttatgagtatggattcgcacaaaccaaggataaatgttacaagaaaatcccagtaaaggtgacattagttaggaaagacaagccaattctggcttatttggacccaaaaaccctcataataagtgcagaagctagaaaagttgattgtcagacagatcgctacaaacatatcgttcttgaaggtcgactttatgagattgatcaagttttaggtattaagagtcctgttaaggaaataa

SEQ ID NO: 59001 - DNA, 527 bp, Heterodera glycines
  misc_feature (3)..(3): n is a, c, g, or t
  Genomic contig location: Contig_ID=SeqID_28369; Location=584..1110; Strand=-
  SCN-specific regions: Sequence locations=1-106,160-200,222-271,305 -436,490-527
atnctgtaagtaaaatattttccaaaaagtgctaatttttccgtttctgttgaatccattatcaaatgcttttttttatcagagcattaataaatttcgatttatcatttatataactaaaatatttttaatgattaaaataatattaatttatttatagatcctgcactcgaattaacaccatttttttcaataaaccaccttttcattatccattttctattaagatcacatgaacttcactatttccttaatttttatcgcgtaaatcttataaaagatttaaataatattaattttttaagattctacaccgcgtctgaaaccttcaaatctgtaagtaaaatattttccaaaaagtgctaatttttccgttttgttgaatccattatcaaatgcttttttttatcagagcattaataaatttcgatttatcatttatataactaaaatatttttaatgattaaaataatattaatttatttatagattctgcacgcgaattaacaccatttttttcaataaa

SEQ ID NO: 59002 - DNA, 573 bp, Heterodera glycines
  Genomic contig location: Contig_ID=SeqID_28370; Location=81..653; Strand=+
  SCN-specific regions: Sequence locations=1-260,283-486,508-573
gagtcgttggggataaaggaagaccctaacgaagtcgatgatcaaacagcaatgcagctgtttgacaagtcaatccgtcgtgagaacgacggacgttattcagtgaaatggccgtggaaagaagatataccaaatcttccttccaattacagaatggctttctcaaggttgatgtcgaccttgaataagctcagacattctcctgaacttctacagcaatataacagcacaatccacgatcagctatcaaaaggcatcattgaagaggccagggaagcacatggcactcttgagcactacattccgcatcaaggagtgctggctaagggcaaaaaacttcgcgtcgtttatgatgcgagtgctcacacaaggggtacaaacagtttgaatgactgtttgtacagaggtccggtacttttacctgatctcatcggaatgcttttgcgattccgatgccctgcatttcctcttctcgcggatatccaagctgctttcttgcagatttccttggaaccagaggatagggaagtcacaaagtttttgtggctaaagacaccgaaaaggaggcattaa

SEQ ID NO: 59003 - DNA, 170 bp, Heterodera glycines
  Genomic contig location: Contig_ID=SeqID_5713; Location=135..304; Strand=-
  SCN-specific regions: Sequence locations=1-170
atgttgcgtcccgcccatgccaacaatgagcagcaacaatcgctctgtgcccaactgcccaccaatgtttggtgcactccgtccgccatcggtcgcatggccaccattttgcgccaaatgcacgcggtggtcagcgaggaaatgggccgggaattgatgggacggcaacg

SEQ ID NO: 59004 - DNA, 1974 bp, Heterodera glycines
  Genomic contig location: Contig_ID=SeqID_5714; Location=219..2192; Strand=+
  SCN-specific regions: Sequence locations=1-46,87-296,319-397,419 -1695,1717-1881,1903-1974
atggcgaatttcgaggaatacgaagccccaacatttggtgaggatgaagaaaagtgacgagaaaaatgcccaatcaaatcagcaccaattgaataactcgggattttttgcttaaaattttttgagcaaaaaataaggcgcaaaaaagtgggttttatataaccgtttaagaaaaaaacttttagaatttttttgttacattttgtatttcctgctgttgctggatttgaatttggctgcgataacgaggagtgtcgttcccttcgtcttttagtaaaatttcattccgaaaagacggaaatccaagaagaaaaaggtgccaccgttttttgatcaccccctttttcacaaatgaattcattccttttttagcccaaagccggagcagcggtgccaacgccacaaacatcggcagcggacggaccaccgggagcagcggaagcgccctcatcagtgaaatcgtcagagaaaagcggcggcacaaaaaaaaagtggacgaacgaacgactttttgaataaacaaatttgctggctttaaggaccagcaccgaaggactccaccatgtcgcgatcgctaacctacaaaacgcatgtggtatcgaaggacctcgccctccgtaagcaaacgaatccgaaatggcttagacaaatgattcattgctttttcccccatttcagaatccgagccgaactatggaacgcttgccggtttggacaaggaaattttcgcgaaggaacagcaggcgaaaggtgggggtcggaaacgaacggcacggcgcaatcgcaatccattgaaatttgtccacctcccatttcaggaggaatgccaccgccaccgatgggagctccacagccgcaacagcaggcgcccggaccggcaatgactccaagtgaaataaaaaaggcgcaaatctcaaatgtttgactttccatcccaatttcagcaactgatccgaactactggaccctcaacaacttggacgccgacatcttcacgaagaacgcgccagcaaaaccggcagcggcaccaaaggcgggaccagcgccacacggaggcggcggacaggcactgacaccaagtgaaaaaaatgccgaacattttcaaattttacgggcttttccttcccatttcagcgactgatccgaactacgggacgcttcagaacttggacgcggaaatttttgtgaagaaatagtgccatcgacagcgaacaccccggcaaggcgtaccgatgtgtgatattatgaggaaattggattgattgatgttaaatgtttgcctgtattgcttattgtaatctgttgttgccgtatattcgctgttgtacatatgtatgtatattgtgttgtacacactgtaatgttctcatcatactataaatgttttggtctgtaaaaatgttcaaaatttcgactttttgcaatttatgttatgacttttatgataattgtctaatcaccagacagtagcatagaattagcttctaaacatgttaagcctcagaatgataccaagatttaacatgttttttttcggaaaatgcccaaattggtcaaccgagttttcgaatatgtaagcactgtttttgataatcaaatgcagattatgacataattctcaattttctatttcccagccagcgaagccctataaaaggaggcattttccaccgaccgacccacacatttccctcatttgtcacaagtacatttattgtgcctaattttatttgtgacgtcggcatttgtacatattacgacagttcgtcgtcgactgctgcatattattatttgttgtcttcaccacacactcgtcaagctgctggttgagcgcaatgtccaagagacggcttcgacaggtgtcactcatttggggatgacgttgtttttcaatttgaaaaagtcattcttggcggcatctcatgaatccaatcaaaatttgcgaatccgatcaaatttttgggtcaacaatta

SEQ ID NO: 59005 - DNA, 1206 bp, Heterodera glycines
  Genomic contig location: Contig_ID=SeqID_28372; Location=798..2003; Strand=+
  SCN-specific regions: Sequence locations=1-35,61-122,226-483,534 -660,754-825,854-977,1047-1206
aatacaattgattccattcacaaggcggtgaaagatggtcaattggaattggtgaaggtgaaaaagcactaattcattaataaattttatgtcacttaactaattaccaataaaacaaactgattttattttttaatttaaaaaattatttaattaattttatttatttattgaaacatttttgtcaattaattataatatttaagttcaattaaatttaataatgttccaacaaaaatgaaaataattaatcaattagtaccttaataaataaaataaatggaaaaatttaataaaggccctaataatttgagggcatgatgaccggaaagcgtttggcatggcacgcgaccggcacgggtgcacgcccctgcacacggccatcattcacgaacggagcgatgtgagatcattattctgctgatcacaaggacaaaccgaactgatcagaactgctgaaaacagcagatagtggcggacaacaatttttgtttaattttgaaaaatcaaatatttaaattttcttaaataatgccaaaattataccgttcacaattttcaaaattctatattatgccgtacacaattttgaaaattttcacttgtgaaaaataaaaaataaatacgaaaataatcttgttgggcaaagatcgaaaaaacattttaaaaacaaaaatttaaattaaaaaaccgaaattttataaaatataaaaatctaaaaattttcaaaacaaaaatttatataatatttttgttcacagattatccgcttcattgctgcaacttatccgaatgttctcaatgcgcctgactatgtttgtatagaattttttttttaatttaaaatttttaagaataaacggaccgccatgcattacgcggccgctgcgcgtgacggcgggcattacctgaaaattttgggcaaagctggcgccgatccaatggcagtggacaatgtaaaaaatggggggaggggctaatttaattttaaatttataaataaaatatattttaaattaaaattttaattcaattaaaataattttgcaggaaggtcgagccccggactattatcgtagaaacaccgtttttgacttgaagctgttgaaggagcgcgacgtggaagagggtcagccagtgctaattatattttactctcttcgacactctcgaccagaacctggcccgggattttgcgagatccca

SEQ ID NO: 59006 - DNA, 56 bp, Heterodera glycines; identical to SEQ ID NO: 52733
  Genomic contig location: Contig_ID=SeqID_28374; Location=1173..1228; Strand=+
  SCN-specific regions: Sequence locations=1-56

SEQ ID NO: 59007 - DNA, 106 bp, Heterodera glycines
  Genomic contig location: Contig_ID=SeqID_28377; Location=295..400; Strand=-
  SCN-specific regions: Sequence locations=1-106
atggacggaggaaaagccaaatttaatggcggaggaaaagccaaatttaatggcggaggaaaagccaaatttaatggcggaggaaaagccaaatttaatggcggag

SEQ ID NO: 59008 - DNA, 822 bp, Heterodera glycines
  Genomic contig location: Contig_ID=SeqID_28379; Location=1..822; Strand=-
  SCN-specific regions: Sequence locations=1-509,531-662,689-771,814-822
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 59009 - DNA, 817 bp, Heterodera glycines
  Genomic contig location: Contig_ID=SeqID_5716; Location=1161..1977; Strand=-
  SCN-specific regions: Sequence locations=1-315,337-418,446-453,540 -548,617-632,655-666,742-817
atgtgcgccagtgggaatccatcagtaaaacaatccgtcggttatggacaatctgtcagtggacaatccgtcaacaaattttttttttttaattctctgacgaaatgtcctttgacggaacgtcagtctactgacgaattgttcttcactgatgaattgtccgtcactaatagaattgtcttccgaaagattatccactgacggattgtccggaatccggataccgtcaatggtgggaccgcattccgggagtttttgcgacggaattacacattccggcatttatggcttgccgaacacctccatggcatacacatttaaaaatggcattttaaggcgaaatcaaaacattcaactggctccactgctggtggtggactatcagtgccggcgccaaacaatcggaagaaaacaccaaatcaacaacaacagcaaaaaggaaacaacgaattgggaggagaaggaagagaaaatggggggaaaagagaggaaaagggaggagaaaaaggagcagcagcggaagcagaggaaaaggaaaattgcagctgaacaccatcagaaacaacaacaacaaaagcaagaagttcaagcagtacagcagcaacaacaaaagcaaattttggtgggaatggagatgaagatggataacagcaaaaatggagaaacaagggaagaggtggaaacggaaggaaatagcactggggaaggaggagagacggaagagaaagagaggaaaaggaaaaaatcccgcgtcaaaatcccgaaaattaatgtcacaattttcaagcagagagaaattcatacactcgatagatag

SEQ ID NO: 59010 - DNA, 386 bp, Heterodera glycines
  Genomic contig location: Contig_ID=SeqID_28383; Location=1..386; Strand=+
  SCN-specific regions: Sequence locations=1-207,232-386
attctgtgtcttccctgtacaccattcgttgtctcccccgccagggctttcatttttcggtctcctttttggcgaactcctgaagagagaatgggcgttcgttcgttctttgctttttgctttggtttccccattttctcatttcatttttccttttcccccaattcattcgttatttttgttatttttatggtaattcttgagcatttaatcaattaattaattaattctcgttttgccctctctttgcaattctacaaaactttgaaaacaaattttgttgacgtttttaaccaaaaattgacgaaggaaagggcagaaaaaggtggcagcggagacgaaagagtcagaataaatcgctgacgaagtttgaaacattaattatt

SEQ ID NO: 59011 - DNA, 129 bp, Heterodera glycines
  Genomic contig location: Contig_ID=SeqID_28384; Location=218..346; Strand=+
  SCN-specific regions: Sequence locations=1-79,101-129
tatggcacggaaagacttccgatttccgacatttttggggtcggaattccgacttccgaaatttttgatgaaaagtcggaaatttttttaatttttttttcaaaaaactagtaagttttgtacaatttc

SEQ ID NO: 59012 - DNA, 991 bp, Heterodera glycines
  misc_feature (963)..(963): n is a, c, g, or t
  Genomic contig location: Contig_ID=SeqID_28385; Location=22..1012; Strand=+
  SCN-specific regions: Sequence locations=1-271,306-346,429-574,604 -622,644-651,793-941,970-991
atgcaaaaacaaagaattcctttaagaaatttgcaaaaaatgcgatttctacggctgtatggacgaggtggggagtcaacgaagtgtttgttgccgtgccggtcactcgtttcgttgctgttataatgagccggttcgtggtgttccaaattttgtgatttttaatcataaaaaaaaattagacacctccctctaagaatggaaaagttttctaaaattttcgacaaaaaaaatgaaaaatgtttactgtatttggctcccatttttgacgttttttttttaataatttttaattaactttttttctacatttttttgtttgtttgtctaaaagcccgagccaaactttataaatttttttcttacaaaagaaaaaaaatatttataaaaattcaaaataatttttaaatatttttaatagattttttgactagcatatttttgcgaaaattttgaatgaataacatttgttttcacttttcagccacgcattacaactactaccacggtaaagagctggaaatgttaattctttaattattgaaatgaatgactatggctaattgatagtaaattgttaaacaaaataatttcattttttcagacaacgttgttctcaaaattgttttcaactaaagaaataattgatactttaaattaaataaaaaattaatatttatctcaaattattaaaaaaaaaattattattattatttttattattttcaaattattaataaaattcttatttatttaaaattattaagttttaagattattcttttttaaattgaaatatccaattttcagacacttttgtccacagagacaacacaaacgaccaccacaatgtaaagagtttcgaaacatatccattagggatggcacggaatttcaattccgacttccgaagttattgataaaaagtcagaaatttttggaattttttttaatttttttttntaaattggcatttttgtacaatttctta

SEQ ID NO: 59013 - DNA, 652 bp, Heterodera glycines
  Genomic contig location: Contig_ID=SeqID_28386; Location=317..968; Strand=+
  SCN-specific regions: Sequence locations=1-274,296-422,445-507,529 -530,567-652
atggtgttgatgatgctcggttttctgctcgtcctttggtcttccttcagctacagtcgccctttgtaagttcttaccgttcgctttctctgctcgaccattgccatcctttctttgtcaggcacattgtctacgcttgtctcggggctttgctctttatggtttacttggccatcgacattcaggcatttttgtattgaatttttgtggaacatttttgctttaaaagatgattatgggtggacgcaaatacgaaatttccccggaggaacacatttttgcggcgatcattcttttcatggacattgtccaaattttctggtttattttgtccatcttcggtgaccggtaacttttccacttttttcttatttaagagtttattaaggagctgagagaaaattgcgcaccgcgaatcgatgaaagaagggaaaatgagaagatattttgaacctgtgaaagtaaaactgtactgtaaatttcattattctcgatcttgatccatggattcttttttattaaaaaaccggtttattttagttttattttattctttaaattttataggctagcagaagagagactgtgcaaaagggtgtgaccagacaaatccctgggtggctgaatcccgttggccatgactttaattaaa

SEQ ID NO: 59014 - DNA, 744 bp, Heterodera glycines
  Genomic contig location: Contig_ID=SeqID_28388; Location=191..934; Strand=-
  SCN-specific regions: Sequence locations=1-194,217-273,296-482,504-744
  Gene Ontology: Mol. function=ubiquitin C-terminal hydrolase activity; Cellular component=cytoplasm; Biological process=protein deubiquitination
ctttaccaattattttttgattttcccccatttttgcctctttttacatccgaatccctcaatttcccctttttgcaggacatttgaattggtggtgtcaacatgacagcaaccaacggctgtggcccctggtgacaaccggcgatggcaattgtctgctccatgccgcgtcgcttggttggtggaccggcaccaaaaatggggagggaaaatagagtattcgacccagacctggatggattttccccgatttttttggttttttgcccaaaaatttggacccagttcaaacatgaaacctccagacctaagtctaggcttttttttcttaaacttaggttataaaattcagtaagtttcaaagattttcatggctattcctaaaaaggataaattttttgtcaaaactgggaaatttcctgttcaattttgcattatcaaatcacatttattgacaaaactgccaagaaattttccaaatattttaattccttttttaatttggcattggcattatgttcaaccaaattaaggcatttggggtgtccacgaccggcagctgaactggcgcaacacgctgcacgatgtgctgaaattcgggagccgaaaacatgccatctaccggcgttggcgttggcacgagtccaagaacaatttggcgtcgggtttggtgctgtcggaggaggaatggcgccgggaatggaacgccgtgttggagttggcatcgccgacaccgcgcccaaa

SEQ ID NO: 59015 - DNA, 574 bp, Heterodera glycines
  misc_feature (548)..(548): n is a, c, g, or t
  Genomic contig location: Contig_ID=SeqID_28389; Location=597..1170; Strand=+
  SCN-specific regions: Sequence locations=1-115,137-424,446-574
atggcttccactccgttgctcggctatttggtggtccacgagcagtatttgccgggttgcattctctttgtgctcatcgctttcaccgacattgtgcgttacattttttagggtttggtgggggtcggtcctaaggacggacgatcgtttttgagggaggcaggtctccgccgattgggcgacgccgtttgggcgccgccgattgggcgcgggtacgattgggcgccgccgtttgggcgccatgcggcagccaaatttttcgttttcatattatccaaaaactgaaattactacaaaaatttctagccattcacctgaattacgagaaacagcactcaaaaaacgtaatgtttatggggttaaaatctatttgagtcacaaaattccttcatgactctttttttaatggcatgggttctcgaaattatgccctgtaacttaaaatttgaagctgtccttgaatttaatgtccttgaaaaagaattcgagaaaaacaattattttatataatgtttttaatcatctacattcttttgaatagattttgngacaacaaaggttgatttgatgaaaa

SEQ ID NO: 59016 - DNA, 561 bp, Heterodera glycines
  Genomic contig location: Contig_ID=SeqID_28391; Location=731..1291; Strand=-
  SCN-specific regions: Sequence locations=1-561
atgacaaaattgaccgccgaaatcaaaaatttgacagaagaggaacgtacgatcttcgaagccacaaaggaaatggaaagggaagcatggattcaggcgtaccgtgagatacgtcttgtttgccaatttaactatgacgtccatagaaatcgctttgttctgaacaccgacccacggtacgttaaaaaggtcgaagtctcgcctcaacttgcctacattctcggtttcaacaacacggagtttatgcagcccgcaaaggaggcaaggttttcgccggacatgagtggtggtgtgtcatcattccacgtttacacgccggatcttattgaaccaatgatgattggagatgtgacggccccagtgttgcgcatagtgaccatacgcggaaacccagaccaagtagttgaagaacaattttttgccatacagtatcacaagctcttatcaaaagaggtttctgaaattctgattgagatccgtaccaatagcggcatcttgatgccattccaatacggaacatgtacattaacattacactttagaaaaatgtcctatttttaa

SEQ ID NO: 59017 - DNA, 6033 bp, Heterodera glycines
  misc_feature (56)..(56): n is a, c, g, or t
  misc_feature (113)..(114): n is a, c, g, or t
  Genomic contig location: Contig_ID=SeqID_5718; Location=1..6033; Strand=-
  SCN-specific regions: Sequence locations=1-180,202-243,334-907,932 -1083,1117-1498,1535-1667,1726-1746,1768-1873,1908-1953,1975 -2365,2414-2635,2661-2726,2754-2983,3087-3134,3188-3263,3287 -3301,3491-3495,3517-3522,...
  SCN-specific regions: Sequence locations=...3545-3547,3588-3610,3632 -3708,3751-3864,3887-3924,3950-4149,4178-4281,4355-4395,4428 -4677,4733-4851,4884-4927,4949-5156,5229-5403,5444-5551,5626 -5714,5825-5908,5932-5941,5963-6033
gcaaatggcatcatcagaatgattagttttgatttctttgtcgctctctgaatatntaattacctttgtccatttttgttttccttactaatttctgaaatttggtgaatttnnaattttttccccattaatttatttcagtaattaaatttttgccacaatttttttctgcatataaattgaaaagattgttttaaaagggttagttttggcataaaattttaatttagcttaaaattaggctaattaaataattattattcgcaaaaaattatttaaaaatattttttatgcaaaagactaaaatttaattttaaaattttagaaaaaaatgcctttcaaattattatttgtactcattttggcactattttcattgacaaatgctcaaaagaattgtgcaagtgcaccgaccagcgcgttcagaatactgtgtgaacagttgcatcggtgggacacaaatgcgcgggtaaaataaaaacgaaatgccaaattttgtgccaaatttaaaatggggtttccttgggttctttggattttaaatgtttttaaaaaacaaaaaatggtaaattaccaaatttgcgacaaaataaaaattgcccatttaaacggtaattactagggctgggaattttaagttatgagcttaaagtttcaatgtaaaggctatctgcctgcaaaatttcataaaatttcatacattagagtcttttttttacaaaaatctgcatgtttttaaaactggaaatttcacggcggtgtcacgaatttgatttttcaaattttacgaacatggagattttgtaaaaaatttacgtacgaaaaatctggaattttgcaggcagatagcttttacataaagtattaactgcaaaatttaaagtcattctgaccactacgaaatttgaataagaaaatcagcttttttaaatctcgtgaatttttttatgacttaaattcccagccctagtaattaccgtgctaatgttaccgtactccgctcattaaaagcacaaaaatttaggcagctccaccggttgacgacaaaattccgcttcctccagcaatccctgggcttccaggtaattttcaatttatttatttttaatttaaaaagctcaatttagccccaacattggctgccgaaatagcgccagtggccgcaacaccgtaccaatgcatggatttacagtgtctctcctcatatttgggcggtaaaaaaataaaattaaaatctcttaattggaatatataagtttatccaattagcgtatttcttgaattagaaccctccctgaattaaagcccccctttcgaggggggttgaaaaataaatcccgccccctgaattagaaccccccactaaaaaaattttttttcaaaaaagaagtcaaaaatttttgtgcctgcctagcttacatactaattacaaaaagtaattagagataatagatcaatgaccattaatttcgtaattaaattatttctaattgtcaacttattaaatttatttaatttctttcaaaaaaataatcgaaaaaacatttttaaatgccttatgtcaaaaataatgtgagaagctgttttacaggacgacagcttaacaaagcgatccgcaaagagtacagaatgttgtccgacatggaacgatcgagatttgtaaattcttatatttaattcaaaataattatttttaaataaattgtttaaaatatttaatattttcaaccaaatttagcatgctgcaatgaaaacgataaaacagaacggggaatacgacaaaattgccagaattcatgctgatccgaccattggcggtggggcacacggagggccggcatttttgccatggcatcgggaatatataaaacggtaaaaaatttaaaataaaatatttaatattttttcggtccaaaatgtgatgtttttactgaatcgaaccattttcacaacgatattttgattattcttttggacgggtttcatcattggagatccacaatactcacaacaaaaatcagttacattatatcttgttttctgatatcttgatcagtttatgctgcgctcgagatcgagtttttcccggagttcgagaccgagaatctcgagcagtacaactgatcagcgtcataagcttacaattagtggggggggggggggttagttactcaaaatacaatcaatcatccggtgccggtgctgatcaatttcatcaatcacccgtcaccgttcatttgtgccaggttggaaattgcgcttcgccaggtggacccgagcgtggcgctgccctattgggactcgacgattgaggaccgactgccgacgcccaaagattcgcacatgttcacaacagatgcaagcgaaaaatatttatttattttatcattttataacataattatttattttagtttatgggcgaaacggacgcggctggcaatttggtgaagggcgattttgcgggatggcgaacaacgacggtaaggaagcaccacaaatcttattatccagatccctaaaatcggattgatcccgccggataaattacggcgggagataaggaaaatgccatccagtatttctggaaaatgcccgcaaaaagtgtttccgggaaaatgcttgagaaagtgtctaatttttttaaattaattattttagggaaaagcaaatgtgctccgcaaattaggcgctgatgggcatggctttagggacacggagtaagcaagcaaaaatatttttaaatgaatttgtataaatatttcattttgaatttttgcattaaaaatttggatgattcaattaagaattaattggtttctgcaacagaccagtcctgaaatgatctttggctattccgcccctcaacaggtaatgtcgtcattttcgattacctaatttccatttgcaattcgttttttaattgattgcctaattggtttcaagggttgcacagtgacaacaaactacaacctgatcgaagtatatttttatgaaaaattacaaaatattaaatatgtattattagtaagagaaaatttggtaattttttttttgaaatttttctctaaaataaaaaaaaatttccccggcggtgccgccttttgtcatcgtctgatatcattaattaacagttttataaagaatttatttaattatggttgaatttatttttaattatttaaatcagtacacccatggcaacattcatctgtttatcggtggcgatatggctgaacaatcgacggcagcaaatgacccaatcttttttcttctccattctttcgtggactttgttagcaaattaattacatttaaaaattcaattataattattaaagtaccttattttatgtaaataaaaaatttgcttatttcgtacatttaaaaatttaaaaaatatttaaattttcactatttttgtaaaaattttatcacaaaaaagcaaaatatacttaacaaaaattgaaaatttattaaaataaattaacacccggaaaattgtattttcttaccgaaaaattgtttttacaaaataataaatccgaaaaatatttaatttttgaaataaatttacttaaattatacccatataatctaagatttcatttaaaatcagcaaaaataatttctcacagatttgggagatgaaacggcaacagcaagcgccatttgagcgcgaacaaatgtaccccatggacaatacggtaaaaaataatttatttaaaattaataaataatttattatttgacatttaagcaatgtgcaagtgcgtctcacttcggttctgccagtatgcgaccattccaggtacggtaattgcctactgtaaagcccatggaaattttggaatttattataaattttcatgtttcttataataaactgaatgcgaatcttagaaatccaaaaatgatttgtaagaaatttttgaaagaaaatttaaatgagacaaaacgcgaaagctttcccattggctttcaaaaaaatcaaatccggcatttccatgcaaaaaaatggcacttttttgacagccttggacaaatcgggacgggctgagcaaccggtacttggatttgtatgaatatgcgccacgaccgaactgcatgatggggcctaactgtggatcaaagttgcaaaattttgggataaattttaatatattttataaaatttcccaggtatttgttttgcgatcgttcccatggcgcgccccattgcgcggcacaggtgaaacctggcggaaattgcactggattccgtagcggtaagactatttgtaattaatttataattctaattttacaaaaaaatgaaatataaatatatatttaaaatattaaaaataaattagcatccactaattacataaaaaactaatccgttccatatactttaattattaaattatttatattttttaattgtataacgcaattaactcagaatagattattcacggttccttattaattaattcatcgaattaactattaattgatgaataattaaggagaggatgtgtgcctgaacggtgaatgtcgtgccggaaaatgtgttcaaacggagaaagtaaaaaaaaacgcaaatatttttcccaatttcaacaaattaggccacgcctacgccaaaaccaccaaaatcgacgactggctccccgataacgccagtccatgtaaaaataatttaattaactaaaaatatataatttaatttaaattaatttaattttgggtgtcatgctacaatgaacacgagtgttgtggcacatgggccacaaaaggtgaatgccgccgaaatccgacctacatgaacctgtggtgtaaagccagctgtgcacaggtgccaaaaacataattattggaaattaatttaattaccatggactggatttatatactttttttaaatgttattcgaaatctcaaaaaatggcatttttacttgtttttttttcaataagagagcgagtttttaagcaaataaaaaacatatttcggacttttggctgataaaaaaagaatgagagatttttttgagaaattcacttatttttttgcagattacatacatatttggcttttatttgttcccgttaattatttatttaattgtaatttagactttctctttttttcaaatcgatttttgcacctaattttatgaaaatatattaaaattccaaattgaaataaaaatttttctattttaaacaaatttatttttacagtgtcagcccaactataatttggccgcaggtgaattaagaaaatttcatccacagtatggcgaattggtgtgtaaattcaaattcactttttttgcagaatgccaagatcggcacaaaaactgtggccaatggtcacggcaaggcgaatgtaacaaaaaccaattttttatggtaaaaaatattattaatttaaaaaaaataattaatttaaagacagaaaattgtcgaaaatcttgttcaaaatgcggtgtgtcacgagcccaggtgtgtggcggaggagctggcagtaaagcaaatcacagtaagaaactttaaatgccatttttattttattgaaataaattaataatttcaaaaataattttatttacctaaaattaattatcaaaaaattgaagaattttttgtcttgtaataactttgttgaaatctgctgaagaaattttctgaaaatttgtaagataatcaagaatgcatagtacaaattaattttaattttaatcttttcaaatctgtatttcctttattttgatttttcaattagtaatttaattaaaaatttttttataaatttaattaatttattgtaatttttaagatcgtgtcacccaagcgccacccaaacaagccaaatgcacttcgccaatgtgcttcaacgaaaacctgtgttgccaggcaaattttttaaataaaaatatatggctgatcaaattagcaaatctctaacaaaatattagtacctatcaataaaacactgttccttcataaaatgtaaaaacccgccattttcagagactccaaa

SEQ ID NO: 59018 - DNA, 299 bp, Heterodera glycines
  Genomic contig location: Contig_ID=SeqID_5718; Location=1358..1656; Strand=+
  SCN-specific regions: Sequence locations=1-249,282-299
atggactggcgttatcggggagccagtcgtcgattttggtggttttggcgtaggcgtggcctaatttgttgaaattgggaaaaatatttgcgtttttttttactttctccgtttgaacacattttccggcacgacattcaccgttcaggcacacatcctctccttaattattcatcaattaatagttaattcgatgaattaattaataaggaaccgtgaataatctattctgagttaattgcgttatacaattaaaaaatataaataatttaataattaaagtatatggaacggattag

SEQ ID NO: 59019 - DNA, 1182 bp, Heterodera glycines
  misc_feature (393)..(393): n is a, c, g, or t
  Genomic contig location: Contig_ID=SeqID_28394; Location=305..1486; Strand=+
  SCN-specific regions: Sequence locations=1-93,156-254,288-328,631 -1008,1032-1117,1139-1182
atggagaacacggaacaggccaaggtggcggcactccgaatattggagatgggcccacgggtggcaattgtcacgttggggccacggggtgacaaaaatacatataaatattttaatttttaatataattaaaatatttttataaattttaaataggcgcaattgtggcacgacgcgaacacaacaatgggcatgtaaaaattggtgaagtttcggcgccgaaagtcactgctgtggacacaacggtagaaaaaattattatttttattattattattattaatattttaatgcgaattattttcatttacaaatttaaataatgttcaatttaataaattaaagaaaattagcatttttaaattgaataaaatttgcttataaatttactanataatttgttaaattttctaaattggtttaaatatacaacatacaaataaaataattagaaatttattattgaaaagaaataatttttatttaaaaattaattctaacttttgcatatttaaattagattaagaataaagaataaataatttacaaatatatttaaatagattttttaataaataaaaaataataataatttttaaataaatttaattctaaaataaatttaattttccaaagggtgccggcgactgtttctgtggtgcgttggcccactttttggtggcccaaccgtccgctgaactgcttgaagaccacgtgcgtcgggctgtccaaattgcggcactttctgtccagaaaaagggcacccaggccagctaccccacacgggacgagttgatcacaatgggaatactgcaggattagagaaagagagaaaagcaaaaaacaaaaacaatcgatcatgacaattctaccgtattaaatttgtgtgtttctaccgtattcattcattttcctgtgtttctaccttattcaatttgtgtaacctaaggcctcgtgtacatagcccgagggcatggcaacccgagggtggcactgaaatgttttgaaaatttttaaaaccaaatttatttgaattttcctgacggcaacgatggacacacccaattaaatcaacaatttttgctaaactcatttcaaaaatgcaccgatttgatccaattttgttatcatatttttggttgataaatcgaaatttcaaaaaatttatcccaacgattttca

SEQ ID NO: 59020 - DNA, 95 bp, Heterodera glycines
  Genomic contig location: Contig_ID=SeqID_28394; Location=51..145; Strand=+
  SCN-specific regions: Sequence locations=1-95
ggattatttttcaaaacacctcgtagactgtgggataattggagactgcgggattaatagagactgggctataattagagcatatacggtaattt

SEQ ID NO: 59021 - DNA, 56 bp, Heterodera glycines; identical to SEQ ID NO: 52733
  Genomic contig location: Contig_ID=SeqID_28398; Location=581..636; Strand=+
  SCN-specific regions: Sequence locations=1-56

SEQ ID NO: 59022 - DNA, 163 bp, Heterodera glycines
  Genomic contig location: Contig_ID=SeqID_28398; Location=723..885; Strand=+
  SCN-specific regions: Sequence locations=1-163
ccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatgggtgcaaaaat

SEQ ID NO: 59023 - DNA, 1057 bp, Heterodera glycines
  Genomic contig location: Contig_ID=SeqID_28399; Location=32..1088; Strand=-
  SCN-specific regions: Sequence locations=1-9,109-128,406-426,608 -666,800-840,1021-1057
  Gene Ontology: Mol. function=translation factor activity, nucleic acid binding; Cellular component=eukaryotic translation initiation factor 3 complex; Biological process=regulation of transcription, DNA-dependent
agaaagtgtaagaggaacagaaagtggaagaggaaaagaaagtggaagaggaacagaacgtggaagagaaacagaacgtggaagagaaagtgtaagaggaacagaaagtgtaagtggaacagaaagtggaagaggaacagaaagcggaagagaagaagaggaacagaaagtggaagaggaacagaaagtggaagagaaagtgaaaaggaacagaaagcggaagagaagaagaggaacagaaagtggaagagaaacagaaagtggaagagaaacagaaagtggaagagaaacagaaagtggaagaggaacagaaagcggaagagaaagtggaagaggaacagaaagtggaagagaaagtggaagaggaacagaacgtggaagagaaacagaacgtggaagagaaagtgtaagaggaacagaaagtgtgagaggaacagaaagtggaagagaaagtggaagaggaacagaaagcggaagagaaacagaacgtggaagagaaagtgtaagaggaacagaaagtgtgagaggaacagaaagtggaagagaaagtggaagaggaaccgaaagtgtgagaggaacagaaagtggaagagaaagtggaagaggaacagaacgtggaagagaaacagaacgtggaagagaaactgtaagaggaaccgaaagtgtgagaggaacagaaagtggaagagaaagtggaagagaaacagaacgtggaagaggaacagaaagcggaagagaaagtggaagaggaacagaaagtggaagagaaagtggaagaggaacagaacgtggaagagaaacagaacgtggaagagaaagtgtaagaggaaccgaaagtgtgagaggaacagaaagtggaagagaaagtggaagaggaacagaaagtgaagagaaagtggaagaggaacagaacgtggaagaggaacagaaagcggaagagaaagtggaagaggaacagaacgtggaagaggaacagaaagcggaagagaaagtggaagaggaacagaaagcggaagagaaagtggaagaggaacagaaagtggaagagaaagtgtaa

SEQ ID NO: 59024 - DNA, 617 bp, Heterodera glycines
  Genomic contig location: Contig_ID=SeqID_28400; Location=177..793; Strand=-
  SCN-specific regions: Sequence locations=1-537,559-617
atggccgatggcactccgtccgccaaacggccgtacatccgactgaccgttccgccgagcaatgccactcgccccatcggcggcgaagttcgcatgcgttgcgaagtcgccgcttcgccactgcccgtccaattcacgtcctgctgacttttcatggaaaatgcgaaattaacatttcactctttcagatggttaaagaattatgcgccggtggaaaagagtcggcggattcgaattcggcacagggaaatgtcatcgaaattggtaatggtcgagttggacgcgctcgaccaaggctattaccaatgcaccgctaccaacgcggctggcagtgtcaacggcactgcggtgcttaaggcaaggaaacgattgcttattcaaactccatttaatgactagggcttcgatttttaggtgctaaaaactgccaaaataagtaggttttaggttctaaaaaacccccaaaataggtgctaaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaaataaa

SEQ ID NO: 59025 - DNA, 286 bp, Heterodera glycines
  Genomic contig location: Contig_ID=SeqID_5721; Location=145..430; Strand=+
  SCN-specific regions: Sequence locations=1-286
atggaatggcccgcattttggcagagtttcgagagtgccgtcgaccgtgccgcccttgagcccgtcgacaaactcaactatcttcacggttgcttacgcggaaagtctgctcgtgccgtaaccgcctaccgtggaggggagaattatgcccatgccgttgccgcactcaggcgactcttcggggatccacgaaaaattgccgaggcacttcagtccgaactgatcaatcttcggtcggtggacgataacgttggatcactgcaacacttcctcgagactttggagc

SEQ ID NO: 59026 - DNA, 310 bp, Heterodera glycines
  Genomic contig location: Contig_ID=SeqID_5722; Location=1354..1663; Strand=+
  SCN-specific regions: Sequence locations=1-2,296-310
  Gene Ontology: Mol. function=protein binding; Cellular component =axoneme; Biological process=N-linked glycosylation
atggaagaggaacagaaagaggagaagaaacaggaagagaaagaggaagaaacagagaaacagaaagagcaacaaaggcaaagaggaagagaaaggaaatgggaaatggaagagaaagataaagaggaacagaaagaggaagagaaggtgaaagtggaagaggaagagaaaaagcaacaaagggaaagaggaaggaacaaaaaaagaagagagcaagagaaagcgagagtgatgtagtgaaatgggaaggtagaaaggagggagaaaggggatgagaaagaggaaaagtaagagattttaagtgatcata

SEQ ID NO: 59027 - DNA, 1312 bp, Heterodera glycines
  Genomic contig location: Contig_ID=SeqID_5723; Location=1290..2601; Strand=+
  SCN-specific regions: Sequence locations=1-668,691-843,865-1115,1157 -1157,1179-1224,1246-1291
atgagcttcgacagtttcgtcgctctcgcagtacgcgcagaagaagtgcaaaaggccacgaaatcggctgagtctggaaacaagcaccgaccaaaatttcaacagaaatcgacatttcaaccacaaaaaattttcgcgccaaagacaaaccgaattgtgtgctacaactgcaacaaaacgggacacatttctcgccattgtaggttgccctttgcgcggaagcaatccaactgtgcacgaaaaccgccacaacaaaattttgcgacgaaaagtgccgattttcgaaaaaattcagaaactgagaagaaattgattgatttgcggttgtcgaaccaaccaccggcacaaccaacgaacgtggaagctggaccaaaacggaaagcgtccaaccgacagcgcaattcgtcgtcaagttgcagcgtaaaagcaacaaaaattaaggaaaattcgccggaaattccaaaatggtttttgaatgctatggttgctgccttggctttgctcgccagcacattctcgaatgaaaagtcaaagattggacgaatttggaaaggcaaaagctcaacgagtggcagtaacgacgagaaaaaacggaaagcagatggaaaattggggacaattttttcgccgaaggccgaggagaaattggcggatgtcgcagcaaccaattttgaaaatttgttgaaaattggcactgctctgaactttccaagtgatgatcggaagtgtgcgcaagaagctgctgctgatgaatttatcaggccatgtcaaaagtcggagacccgttttgtccgttgtttttacaggtctgaccttgcaacgcgactccatgccgaaccgatccactgctgacacccttgccgcccctttcaacgccgaatgcactaccgatgagcccaaagcgctgagtacatcgcttcttagagggcgaggatgtgatataattgtgatttaaaatatgtttgccgttttgttatttgattttgtgtcatttttgtttgtgattttgagttagttagtggttagtttttttatgctttcgtcagttctattgattgtcgtcgactatttaatttggaattaaacgataattgtatcttcggcattgggctgtattgttttgtgtttgctttgggctgttgtcttttgttgtgtgcaacaacaacaaccatatttgttttttacgactttaggaaaagcttctacttactcatcaagagctttcgaaagataccaagattatccaatttggttggcaaaaaccttcaaaaataattcccaaatatcgtcattttttaatattttggacaaa

SEQ ID NO: 59028 - DNA, 203 bp, Heterodera glycines
  Genomic contig location: Contig_ID=SeqID_28404; Location=1072..1274; Strand=-
  SCN-specific regions: Sequence locations=22-123,146-203
catagaacaaacactaatgttttatcaaagacatgacacacataattgtgtcacactaaactcaaacaacaaacactaatgttttttcaaaaacatgacacacataattgtgtcacactaaagtcatagaacaaacactaatgttttatcaaagacatgacacacataattgtgtcacactaaactcaaacaacaaacactaa

SEQ ID NO: 59029 - DNA, 527 bp, Heterodera glycines
  Genomic contig location: Contig_ID=SeqID_28408; Location=905..1431; Strand=+
  SCN-specific regions: Sequence locations=1-23,69-314,355-469,492-527
atgaaagggaatccaagtaaaggttaattaaagttaaatatttttatttaataaataattaaaatattctttaatgacacgatagaattgtcgcagtccgttcagcaaatgttggaagtgccgtagacgaactgcttgcgaaggttggtgttgtgttgccacagtgccaccaccgccaccgccgttcactgaccctccgccagccgaggacaccccggagctcagactttcgctacgttccaccacatttttggccgattgattgtgttggtgcagtaacacaaggccaaccgtgtcattgcttgtccttaatgaaaatttaagaaaattaatttaaaaattaaaaaataatttcgctaaaaatttcagaaatttacacgaaaagcatttattttccttatcgttttggtggctgctcgagagtcaatattgttcaagtcgaggactaacagtaagaagaattaattagaaactcaaaaattaaagaaaaattttacccttcatttttgataaaaaatttcgcaaaa

SEQ ID NO: 59030 - DNA, 407 bp, Heterodera glycines
  Genomic contig location: Contig_ID=SeqID_28410; Location=454..860; Strand=-
  SCN-specific regions: Sequence locations=1-122,144-275,297-301,323-407
atgataccaacaatgttggatttggttggaaaaaaagttatagaaagttatagtggaaaaacatattggggccgaaccgtggggggccgaactgacgtagaccgaatcagcatagagttaagtaatttttaaaatcataaattcttgtcaagaaataaataaattaattttggaaatgaattcttgagaaaatctttcatttttcacagggatgtatttttttaagtcctagagactatgggagcttaaataatggccataatgatttgtaaattaaaatcaaatgatttctatttcagaacatgttggaagagagcaatctcaaggaaggccaacggacggccaatcaccaagcgggatatgccgccggatgcgcgatgaatccgcactgcacgcggataacattt

SEQ ID NO: 59031 - DNA, 3110 bp, Heterodera glycines
  misc_feature (770)..(770): n is a, c, g, or t
  Genomic contig location: Contig_ID=SeqID_5724; Location=106..3215; Strand=-
  SCN-specific regions: Sequence locations=1-351,379-954,982-1110,1132 -1587,1620-2258,2280-2922,2945-3110
  Gene Ontology: Mol. function=lysosomal cysteine-type endopeptidase; Cellular component=lysosome; Biological process=proteolysis and peptidolysis
gggaaatggttggccaccaaacattctgttggtgtgtaccgttgaccggcttggccctgtgtttcaacaattcacggttgtcgccccctctgcactcaatgttctcaatttgccgatcttttgggcccatatttcaccttcagaagtgccgtcattccgtgcacttctttgttccacagaaaacggcacacgcatttgttggcattgccttcttcgctaatgaatttgttggcattgtcttcttcgccattgtttttttcttcgatgattgaatcggtgatcaaagtcttttctccgattaaaattttattggcaccctttcgtttaatcattgagcaaagaatgaatgacaagaaaaagaaaccaaaagaaatgaagtgggaaagcagcaactatttgtttttaattaatccaaaatatttggtcaattatttattttcactgagtgcgccaaaaaatgcccaatttggaccgaccagtgaattaatgagggggggggggggaagaatgccaacggtgtcattttctctgacggaataacaacttcgtaaatggcattcatttcttggaatgaatgccaaaatgccaaatgacaattccaatttattacacaaaaaaatgtcaaaaaggggaaaaaatgatgtgcatggtttaaacaggttgttttggaaatgcaaaaaatgatattaattaattaatgggcgagatacggacggacggaagtctgtcagcggacattggccgtgccgttcggtggacagttgtgccgnggggcgggggtggcggctgtgttcggataccgcccaagggttttctttcccccccccccacctttccccccgtccgtcccctcgggcgctcttttgctttatcgatccccaaagtgtcatcatttgaccgcccttcccgttgcctccctcccatttccccctaatcatttattatttcctaatcaccccaaatgtttccccatttatttttgttgctccgtttctccttcttccttttatctgctgtcaccttcgtttcttccacttcacttcatcaccgggccattcgcgcagttaatgcactgaatgccgaaattggggacagccatttttggaagttggggaaaataattggggaaactgagacggaggaattggaaaatggggcacggaagaaaagcatggagataagcttaatgcggacggggtgtctgaagcaggtaggcttaatgaatgaagtggcaaatgaaagcaaacactttgcatgcgaaggaggaccacctgcgaatactgctcggactttgtgcggtggatgagaaagggccgagaaaggtactaatcaatacgtattgtgatcagagtgatcaggccggttgatcggactgatttggccgactatctcgtactcatctgtcaaattgatatgatcggacttgatttaatcggttatttgatcgaactcattttttttgttccttttaagaaatgtctggtggacgttgtcgaaaatgcggacggaggggaggaatttgtgcaaaggaaatgcgaaagagacaaagggcgagaagaatggcagaaggaagtcgaaaacaatgaagagggggaagaggagcagcagagaagaagcgaagaggggcaaaaggacgacgacggcactttgtggagaatgatggcacaactgaaccgaacgatcaaagccaacgacctattcgaatgggaccgatttggccaatttgtgcgcaggttggccacccaaatcaatcgattggaagacaaatcaacgaaaaacaaaaaacaaatcaaacagatacggacccaaatacagcacgaagagggaaattgcaaagcgattccgcattttcaagaagaatttggccattgccaggcgaattcaatcggcggagaagggaacggcggaatttggagaaacgaaatattctgatttgagtgtcacagagttccaaaaggtgtgaaatcaactcaatcgaattgataatttaaaaatgccaattttggcacccttcggacattgttcgcctaactcaaaatgacaacagcaaaaatggctgttcttttatttttgctttttcagatttatctcccttacaaatggcctttgaattcccatggcaaaatgatcgatggtggcaaaatcgccgaagggattcttcccgaaagttttgattggagacaaaaaggcgcagtgacaacggtcaaaaaccaagggacgtgtggaagttgctgggcattcagtgtgacggggaatatcgaagggcaatggaagctgaaaaagggcgaattggtggagttatcggagcaggaactgctggtgaggcgggagtttgaaaaatggaaatgaaaaaaaagaaagaaaattgaaacgattgaaaggactgcgacaaattggacatggcatgccaagggggcctcccactgcaggcgtacaagtgaggagaatggtcggaaataggggggaatgccattcatgagcccttttcaaaaggaaaggccgacttttgggtgaaaataatcaattagggaaatcgaacgcatcggcggtttggagcgcgagaatgactatccgtacgacgcgcacaaagaaaaatgccatttgaaaagcgaccgcatcagtgcgtacataaacgactcgctgcaactgccaaaagacgaggcgaaaatggcacaatggctggtgcaaaacggacccatttccatcggtcatattcatttgtcatctttttgctatttttgagcttttgaaggtctaaacgcaatgccaatgcaattttaccgccgtggcatttcccacccccctaaatggctgtgcaatccatcgtggctgaaccacggtgttctgatcgtcggatttggcgaggaagcgagaaagcccttttggatcagtgagttgggcttggccaccttcgacggattgatgctttttctgaattaaatttgcccctttcagttaaaaacagttggggaacgaattggggtgagaaaatggcaaagaaagcacggcatttacactgtttatgttcaggcgagaaaggctattatcgaatgtacagaggagggaacacttgcggagtgagggaaatggcgacgagtgccatcatcgaa

SEQ ID NO: 59032 - DNA, 1698 bp, Heterodera glycines
  Genomic contig location: Contig_ID=SeqID_5725; Location=200..1897; Strand=+
  SCN-specific regions: Sequence locations=1-46,93-155,359-394,555 -566,899-914,1087-1231,1403-1698
  Gene Ontology: Mol. function=translation initiation factor activity; Cellular component=neurofilament; Biological process=regulation of translational initiation
atgaatggcacagcaataacaacaacaattaacagcagcactagcaagagaaccaaaacgacactggcattttttaaagaaaaagggacaaaaagggatacggtacaaccaaatgggcatacggtaacaccgagaggtacagtagagccggttatggaaagacaaaggaacgaaacacaacaaaagggaagagaaacaacggcagaaaaagcaggcgaattggtaatgccactgaaagaagatggaaatggagagaaggaaacggaagaatatggaaaaggaaaagcgaagggaaaggaggaggcgatgggaggagaaagaagaagaggaagcgaaagggaagagaaacaggataaaggcacaatagcaaatggaagcgaaaacggggcagagaaagagacagaaaaaagaaaagaggaagagaaagagacggatgggaaagatggaaaagaagagaggaagagagaagaacaaagagaaaagacagaaaaaagaaaagaggaagagaaggagacggatgggaaagatggaaaagaagagaggaagagagaagaacaacgggtaacggagaagcagaacagagagaaaaaggagcccgaaaatgagggggaagaaaggaatgaaggacagagggaagagcaaaatacagtgaagaaagtgggaaaggaggagaaaaaggaagaaaaagggaaggaggaaaagaaagtgggaaaagaggagaaaaaggaagaaaaagggaaggaggaaaagaaagtgggaaaggaggagaaaaaggaagaaaaagggaaggaggaaaagaaagtggaaaaagaggagaaaaaggaagaaaaagggaaggaggaaaagaaagtgggaaaggaggagaaaaaggaagaaaaagggaaggaggaaaagaaagtggaaaaagaggagatagaggaagaagaagggaaggaggaaaagaaagtgggaaaggaggagaaaaaggaagaaaaagggaaggaggaaaagaaagtggaaaaagaggagatagaggaagaagaagaacaagaagaagaagaagacgaagaagacgaagaagacgaagaagaagaaggaaaggaggaaacaaatttaacaagtgtagagaaattttttgcaacatcagcaaaagcagaagaaacaacggagaggaacgacgggggagagaagacgacgacaattttagtaacagaaagagacggagagggaagcggaacggaagaggaaggaaaggaggaggaagaggagagaaaagaggagggggaggaagcggaagtggaaggaaaggaggaggaagaggagagaaaagaggagggggaggaagcggaagtggaaggaaaggaggaggaagaggagagaaaagaggagggggaggaagcggaagtggaaggaaaggaggagggcacggacgaaattggcattcccacaacgtccaaaagtgtggtgactctgccaacgattgcattgccaacggaatcagttgaaagaaaatgcgcggacacacatgattagtaagtacagtgacagaagggaacactactgtagctgatcaaacagtccgccccaattaattaattgctttcatttattgaacagttgtcgcttttgggctcggaatggcttttgctccaacgctttttacgcaaaagagcaaattgcccaattttgtcgtaagacatgcgcactttgctgaggaca

SEQ ID NO: 59033 - DNA, 1266 bp, Heterodera glycines
  Genomic contig location: Contig_ID=SeqID_28412; Location=176..1441; Strand=+
  SCN-specific regions: Sequence locations=1-233,258-529,551-727,749 -811,833-1266
  Gene Ontology: Mol. function=aspartate carbamoyltransferase activity; Cellular component=mitochondrion; Biological process=arginine metabolism
atgcagcaactcgttgaaaaactgcatgacaatccgcgacgaatttttggcctacccgagcagcccgacacttacattgaggtgattgtggatgaactctaacaagggaacatcccgaattgtaaatgtgttcgactcaacttttaaaccatttttatcgaacttttttttttttgctccggcgccagaagtgatcagtcagaaaaagtcgatcaaagttttgaagaatcaacaaaattattaaatttttaaaaattcatagccatcaactttaaaaaaagaatgatcagcgaaactttctgaattttggcaccaaaattaaacttttttttgagtaaattctaaaaaacccaaaaacactaaatttcaacaaaaaaaacaatcgaaatgcgttttgaaacccttcatctttttttccttggttttctaaaagtctaacgaaagatttttttaaacaaacttttggaagagctgattttttttaaacaagaaggctggaaaaaatgtgttgacttcacgaataaaaaataaattcccaggtggaaatgaacgaagtgtggacaatccctgagagcggtggctggagcaaagcagggtggacaccgtttgctgggcttcaagcgcgtggccgcgtgtgcaccgtggtcatccgtggccagcgcgtgtatgacgagggccaattcctggttgggcccggctttggccacaacgtgcgattgttgcccggcgccatggcggccaccgcctcaaatttgccatcgccgtcgccagcagctgaattgacggcagcagcaaagaaaactgacggcgccggcggaggcggcaagaaaagaggggtggcggcggtgacagccggcaccggtggtggcaccacaaaacggcacgacacgttgcgacagcaccaacagcaacgcatttcgcccgagctgagccccgaccggaccagcgttgtggggccaagccgtctgtacggccagaacattttgtgcgtggaacagtttgacaaggagacggtggagcaggtgttgaagctggccaagcactttgaggaggtggcggtcaaaatggcgggcgcggacggcgttgaacgcctccatccgtccgcgtttggtttcccgttgcgcgacttcagcgtcagtttgctgttctttgagccgtccacgcgcacaatgtgttcctttgacgatgcaatgcgtttgctgggcggcacggtgtccgtgttcaacgcggaacactcatccgtgaagaagggcgaaacgttggagg

SEQ ID NO: 59034 - DNA, 263 bp, Heterodera glycines
  Genomic contig location: Contig_ID=SeqID_28414; Location=714..976; Strand=+
  SCN-specific regions: Sequence locations=1-75,122-173,196-263
atgcccgacccggtaggtaagggtccaaccgggtccaaaatagggtcaaattgttgaccaaagtttagtgtgaacaaaaaaaaattaatttaatttacaaaaattaaatttaataattatagtaaaagggaatcatttatctgctgggcgccggacttttcgacagtaaaaagtaattaagtttaaaatttaggggtgtaaaatcgtaaaattttatcgaaaaagcaaaaaaattaagcctaatcatatgttatcgaaaagaa

SEQ ID NO: 59035 - DNA, 53 bp, Heterodera glycines
  Genomic contig location: Contig_ID=SeqID_28414; Location=361..413; Strand=-
  SCN-specific regions: Sequence locations=1-53
gagtacaaaggcctcacttatatggcagccatgagtcctcaagcgaattatga

SEQ ID NO: 59036 - DNA, 216 bp, Heterodera glycines
  Genomic contig location: Contig_ID=SeqID_28416; Location=304..519; Strand=-
  SCN-specific regions: Sequence locations=1-55,78-216
atggatatgaagctgaggtcggctcgacaaaatgttgagagaacagtcgctggcgtggaattggcctgggaacaaaagcgcgacgcggacgccgaactcgcggctgcggatgcggcatttaaactggcacaacagcgactgaacgcggcaaaaaacgcggcggcgaatgctaacacggcactggacgcggctgacgcggagcgcatccgtgtgatt

SEQ ID NO: 59037 - DNA, 934 bp, Heterodera glycines
  Genomic contig location: Contig_ID=SeqID_28417; Location=189..1122; Strand=+
  SCN-specific regions: Sequence locations=1-141,164-197,242-257,280 -337,378-448,479-631,672-777,815-883,919-934
atgcgcacattccgggtgagtgaaattattgaaactccgacatagccagggggggcctaacctaaaaaatccaattttaagggaaaattgattaattttcaaaatttaaaaaaaggccgtgatcaagagggcacctctcacttttttccccagaaaatttaaagtaaaagattttcagtcaccgattgaaacaacaatttaaaattttgaaaggaaagtttaattaattttaaaaattttaccgtcaattgcaattcattaaaatttaaaaaaaaatttccctgcttttcccctgtcaacaccgctggacacccaactttcattttgtttatatgtcaaaatttttaaaaataataatttaaaattttttaattaaacaagcacgaaaagtgctaattttatggatttttgggaaatttaacgaaatttcaatgttatttttctcgtcaaaatttaaaaaataataaaaataattaatgccaattttaagcgcacgcaacgcgcgactacgccagacgccatctgatcaccgattttccctcacttcacggcaaacgttccttcatcgaccttgaagcgattgaacagcgtaaacttcgtcaacaacgaaaattgccggaggcaaaattcgaaaaaaaaatttttttttttaataaaaaaataataaaattccatccaatgataggccggtgatcgtgatcgggatttggacaaattcttgaaggttcgagaagataaggagcaatggaaaacgccgtggcccgcgccgaaggtaggaaaattatatttaaaaaaataaaattttttaaatttagcccgaagacgaatcattgcgcgagttggaccgtcttcgtcaggtataaattaaatatcattttcgatcaaaaaatttttgaattttttagaatttataaaattgcaaatatgttctaaa

SEQ ID NO: 59038 - DNA, 147 bp, Heterodera glycines
  Genomic contig location: Contig_ID=SeqID_28417; Location=1593..1739; Strand=+
  SCN-specific regions: Sequence locations=1-147
atgtgtccttttgggccaaaaattccacaggcatcgatgcgcagaagcaaatcgttgaacgaattgcgcccggtgaaagcatccgcaacaaaacctgaacaatttacattaccgccactgttgccctcgaggcacaaaattttggag

SEQ ID NO: 59039 - DNA, 675 bp, Heterodera glycines
  Genomic contig location: Contig_ID=SeqID_687; Location=66..740; Strand=-
  SCN-specific regions: Sequence locations=1-467,493-516,538-590,646-675
atgcacgctgaaaatatcgtttggctcgaaaaatacccgcgttactttcgcataaactggaacggatggtttgacaatccaagaattgcccgttatgaggcatttgttaagcaactgtccggggtggacgattgggcacgaattggaagtcttcctgttgtaagtttcaaaattctaagcttcaaaggcgtagagccagccatgggaaggattgagttgggtatgaaagtggtgcttttggatacaaagaagtgaaaaatacgcaaaaatcagcgaaaactttgttttttaactttttattccaattcgggtccgggattcggaattggtcgaaatgggtgacgtcgaggtcagcgaccccgaaaaccactggaaacatgttttcatgacttggaagataaaaaattctcggaaaatgggcggcggtaaataaacgttactattagagatcgacattttgaaaaaagcctggacctggatctggacctggattccatgttggacctggatttcctggacaaaaatccaggaaaatccaggtccaggaaaaatccaggctcatcgagacctggatccaggcctggacctggattttttgaaatttattttaaaaatcaaaaaaatgtttgaaaaaattaattatttgcgtagaagcatctaaaaatatctaataaa

SEQ ID NO: 59040 - DNA, 166 bp, Heterodera glycines
  Genomic contig location: Contig_ID=SeqID_687; Location=582..747; Strand=-
  SCN-specific regions: Sequence locations=1-166
gataaaaatgcacgctgaaaatatcgtttggctcgaaaaatacccgcgttactttcgcataaactggaacggatggtttgacaatccaagaattgcccgttatgaggcatttgttaagcaactgtccggggtggacgattgggcacgaattggaagtcttcctgtt

SEQ ID NO: 59041 - DNA, 318 bp, Heterodera glycines
  Genomic contig location: Contig_ID=SeqID_688; Location=4415..4732; Strand=-
  SCN-specific regions: Sequence locations=1-15,69-72,94-165,187-318
atgtcaaaatcttgttctctctctctcttctctctctctcttttctctctctctcctctctttctctccccaatccggctaattttgcattttgcgaagatccgccgtctgccggccgtcctctacgctgactcgcgcaaatccgactctcgccagctggaggtgctgctccgcgacggctacggcctcccgctggtcactttttatgccgacaaaatcggtcggttggccgcggtggaggcaaatttggccaaactgaccgcccatcgggaaatgccattcctgttcatctgcggaacgttcattggaagtcagtaa

SEQ ID NO: 59042 - DNA, 287 bp, Heterodera glycines
  Genomic contig location: Contig_ID=SeqID_688; Location=1177..1463; Strand=-
  SCN-specific regions: Sequence locations=1-80,132-153,177-181,240 -240,273-287
ttctgctgctgctactgttactggcgagacgaaacgggccaaaccaagttcaaagtgccaatgtgacgacggcggtttttgttcaatgctaatcagctaattgctcactaattaccccaaataacaaaactatgcttctcccaacaatggcccccaaatgccttccgctcgaacttttgttcgaaattgtgcctctcatccctgccgaaaatgccacaccgaatgcgctctcgtcctgttggctgctgcacaaacttttgctgccacgtgtcttaaaatggcaagag

SEQ ID NO: 59043 - DNA, 547 bp, Heterodera glycines
  Genomic contig location: Contig_ID=SeqID_688; Location=5139..5685; Strand=-
  SCN-specific regions: Sequence locations=1-547
ccttaatccaccttaatgacccctgcccctccatcgcatttcacttaagcttcaatggtgccgtctccggttatgacggtggtcccttttctgtcggtggtggcacttctgctgcagctgacggtggtcgaccatggcggcaacatcaaaagccaacaccaccactaatggtggcacaacaaaatgccgtagtgcagcagcagggcaatgctgatcattggcaaatgccgacaacaaatggaggggaggagaagcggcggcgaacagtgacgggtgggtgacggacgagcagcggggaccctagttttggccaggatttcggattttttaatgaaaattcaggaaaatccttttaatagttcaaaaatccttcaattttggcaaaaaacctgttcagaaggatggacaacaacaacctgcagcagcagttgctggagcagtcgctgcttctcgcgctattagccactcagcaacaaacgacggcggcgacacccatcaacagaatgccaacacagccaatgccaatgatgacgacggaaacaattga

SEQ ID NO: 59044 - DNA, 1057 bp, Heterodera glycines
  Genomic contig location: Contig_ID=SeqID_5726; Location=1264..2320; Strand=-
  SCN-specific regions: Sequence locations=1-223,245-302,324-1057
atgaagcccgagttgaaacagttattctgtccaccggtcaaccttttcaaggagtttagtatgcaattgaagaaggtggtggactttcaacaaaacaatcgcatgcgccttaaggaacgacaaaccatggaaaaggtgatggaagttttgcttttacgcctccaaattgttgctctattgccatccaccccttcgttgatttttttaaatttatgtggttgcacaaaactaaaaagtcagaattttaagtgacataaggaaaagtacaataattaaatggatgcattgtcggaagtttgccaatagtagtaataataagaaaaggctaaagtaatcaaagtttcaaatgatttagtcttgttattttataaagtaacagatgcaaagtgctgcaagatacatccaaatactgaaagtggaactgcgcaaatcatcggacaacgagcgcatagctttgaaagaacgtaaccaaatgaaagcggagatggaacgatacaaagagcaggcccaaaacttgaagacgaagtgaggaatttgtaatggattattggaagagcgcaaggtggcgcaatagagaggccttacaattagatgaccactcaaaagcagtctagacaaacttcgtcgactttagagcttagattttgaatcattccttgtatgaccctgaatttgctcaaggattgaaaaggcttgatattgttttgaagactggctgaccgtgagaagcaactccatctccatgcgtgcaaattgcagctgcagccaagaaacccgaaccgggcctttgcaagtctaaatgggaacactccgttgttgggcctttcctttgattgtgtcaaaagtacgccgaatctcaacgatgtaagtaataataattgaaaatttcaagttttttcccagattttttcaagtaatatttacttttttagacaacgatgttccaagcgaataggaaggatgttggcaataatgtgctggagacgccggttttcaacgagagtgaaatcgctggaccgcttcgaatgcctgacacgcccgcaatgcttcgtaatcg

SEQ ID NO: 59045 - DNA, 118 bp, Heterodera glycines
  Genomic contig location: Contig_ID=SeqID_5726; Location=357..474; Strand=+
  SCN-specific regions: Sequence locations=1-27,49-118
cacggcgattcaattttgggctccaagtacaattaagttggttttttcgtcttagtggtctgtgagttagtcaccaaaaagggggtctcaagttcaattcctccttgtgtttgtgtat

SEQ ID NO: 59046 - DNA, 375 bp, Heterodera glycines
  misc_feature (319)..(319): n is a, c, g, or t
  misc_feature (355)..(355): n is a, c, g, or t
  Genomic contig location: Contig_ID=SeqID_5727; Location=6..380; Strand=-
  SCN-specific regions: Sequence locations=23-23,134-162,319-375
atgtcaaccattggtagtcttgctcgttctgtcactggaacacaatctggttctggaagcgagcctcgtgaacgtactctttacgaaagagaagcggagaaggctctaaaactcagaaatgtttgtgtttgtttaatggtttcttcttagttcctggtctaggtggaagttggtcgtgctgtcatggcggaaaaaccaagtgcaggccacgaaggcgatttggaagttcataccaacgtttacgccatcagcatgggtccgctggatatctaccgttacgatgtgtccattgtcggcgaacgtggtggcgaacgatcgngagtcttgttcaccaagaatataagggatgagtcangtgtcttcatcgtacattaa

SEQ ID NO: 59047 - DNA, 304 bp, Heterodera glycines; identical to SEQ ID NO: 53844
  Genomic contig location: Contig_ID=SeqID_5727; Location=1687..1990; Strand=+
  SCN-specific regions: Sequence locations=1-304

SEQ ID NO: 59048 - DNA, 175 bp, Heterodera glycines
  Genomic contig location: Contig_ID=SeqID_5728; Location=457..631; Strand=+
  SCN-specific regions: Sequence locations=1-175
atggcattccctgccttggcagaacattcgcgacgccgccggaaaaactccgttggacctttgcgttttggtgccgaagtccgactggcgaggggtcgcctttttgctgaagcagaaacagccggcgaaactgaccaaagtggaagtgcagttaatcggtgcaccatcgctgcaa

SEQ ID NO: 59049 - DNA, 118 bp, Heterodera glycines
  Genomic contig location: Contig_ID=SeqID_28422; Location=193..310; Strand=-
  SCN-specific regions: Sequence locations=1-118
atgtccgagtcggaaaacagttgggacaaaaaggcatgtcacgctgatctcgcgctaatcgggccggacaatttggtggtaaaaaccaaagagaccaaaaatcgcagtagcagcaatg

SEQ ID NO: 59050 - DNA, 399 bp, Heterodera glycines
  misc_feature (3)..(3): n is a, c, g, or t
  Genomic contig location: Contig_ID=SeqID_28422; Location=597..995; Strand=-
  SCN-specific regions: Sequence locations=1-30,52-130,163-271,322-399
atncgtttccagcaaaaccacattgccgctaaagttcaaattggacaattagaaaacgaagtgcatgacttgaaacatcgaattgatcaacttgaaatgctgaatgtataacaattaattaattacctaattagtgattcatttatttagttgttttttagattttaaagctttctcagcggtcgaatgaggtcgccgaatcgtccacttccacaaaaacaaacccaaaaaagaaaaaggaactgatgaaaagcaaaagtggtagaggatgaaatttttttttataatattttgataaaattactattaattaatttttttgcagcaggcgatttgttggtcaacaatttgggaaaaggtcacggaaaaggcacgcaattataaacttaaattaataaa

SEQ ID NO: 59051 - DNA, 560 bp, Heterodera glycines
  Genomic contig location: Contig_ID=SeqID_28425; Location=65..624; Strand=+
  SCN-specific regions: Sequence locations=1-22,44-560
atgatcactgcgcttgcatttgtgccaattcagcatttaactgctgcaattactgcgctgaactacatcgtgggggaagaattggacccaattttaggctggtaagtttaaagcagggattttccaacaatttgcttataaaaataggttccttatcaactacaccggcgttcctttgccaaatggaacccgaacacgtccgcgttttccggtggactattggaacgtacacgaacggactgtcaatgaagaggaacgaacaaacaacatcgcggaagcagcgcatcgtcgacttcaaacgatcttcagctgtcgctatccgtcaatttggcgcttcatcgacgtacttcgaaaggatcagcgttcgcgtgacgctgattatgtgcgctgcgtgaacggcgaagaaccagcgatgaagaaaaagaagtttcggaaggcggacaagcgaattttgaatattattgaaaattttgatgcccaaaatattattgagtttctcaggggaatttcaagtaattgtgttatggacccgtgattttgttatttaatgatttttttaa

SEQ ID NO: 59052 - DNA, 1071 bp, Heterodera glycines
  Genomic contig location: Contig_ID=SeqID_28426; Location=17..1087; Strand=+
  SCN-specific regions: Sequence locations=1-137,160-255,277-631,656 -666,688-736,758-1071
  Gene Ontology: Cellular component=nucleoplasm; Biological process =chromosome segregation
atgtgcggtcgtctgttagaagacattcgcgaaaaactttacccaaatgggtacaggaaaccaaaaagggcaaacaaacccaaaaatgaaaaagatttagaccaaattttgaaaaagattgaaaacgacaggaaaatctgtgttttcaaaactgaaaatattttgagacaatgtactcggattaaagaagttgtcaaagaaaattgggacatgaatgtatttatccaagggagcatatacaatggccttggaagaaaagaaagtgatttggatttagttatgataaactcaaaaggaataccgaatgattggacaaaagacgacagttgccaattttttgacaaattgcgaaaaaggttaagagaatctggaatggcattaacccggactctgataatcccttcccgaaatgtctccattttggaaatcacaattaattctgatgaccaagaaataaatgctcaaattagttgcaataatttgattggattgattaattcgaaatggttggcatgttgtgtgcagttggatgtacgatttaaaactttatattttgccattttggaatgggctgacttttttgaaattcaccaaagtgctaatggaggcggcactttaaattcttatggttggacatcacttttaattttttatttgatgaaaattcctaaccccgttttaccaaatttgatcaaaattttaccagaaatttttgaaattcgaaatgttacatacacaaagaaacaaatttttgaagtactgaaacaaaaacttatttgggagacaaccaattcccagagcatttcttcactactcattggattttttgaattttatacaaaaatcaatttagaagagagccggttgaatatgaaagaaggaaaaatcgacttttgggagaaaagtgctcaagaaatgaaaatgcatttattcattttagagccgtttggggctttcaatgtcgcaaggagtgtgacataaaatggatttatcaaaattaaaaatgcatttcatgtaacatgggaaaaattaaaattcggtattcaaaatccaaaaaagctgttagaagca

SEQ ID NO: 59053 - DNA, 659 bp, Heterodera glycines
  Genomic contig location: Contig_ID=SeqID_28427; Location=660..1318; Strand=+
  SCN-specific regions: Sequence locations=1-26,48-335,358-605,634-659
atggcttacgccgaagagctgccgaagatgggtttgtgaatttaaatttctcaaatatctgaggaacggcagcgatcataaactatttaaggaatctctgaaaggattttttgctcttaaacttaaaaaaatttcctgggtatttttaaaaattttgcaattttaaacccatttttaaaaatagattggaaccttaaatggacatttttggattgttttgatctcatttatttttttcaatgaattttaattcgttttaattatatttgaatttcattattaataacacttgttattaagcaaatgcaaacgatccatcagaaatctctcatttggatgatgatgatgatgatgatggcagtgattcggggagattggatgacccgaacagagagcatttgcgcgattacattcttctgtgaaattgaggaaatgccaattgaggagcaacggacgatgttttggcacaagataaacaaaaagaaaataagaaaaaatttaatttctaatattatttgtatttggaaattcgtttattcatataaagcaagtctctttataatatgttgtgctgtttgtgatgagaaacctaaagctgacaatgcttaaaatattattttatttatataaatacttacatttaatgattaacaaaagaa

SEQ ID NO: 59054 - DNA, 327 bp, Heterodera glycines
  Genomic contig location: Contig_ID=SeqID_28428; Location=937..1263; Strand=-
  SCN-specific regions: Sequence locations=1-327
atgaatattgactcgtatttggacggaatccaattcggaaaccaaaacgccaaactctctgcgactcgtccgaacattgtagaaaagtttaagggcaaatgccaaataaatgagcggactcagaattgccaccagaaaattgtgcacggggtgaagccaatgctcgtacttaaattattcataaatagcttcttcctatttggataagtatcaacaaaaaatgggggactcaattgaaaatataatttttaaaacggaaaattggacaccaaattttgtcttttgcaaaatataagaaattaacttgcttaaggttaagtaaataaa

SEQ ID NO: 59055 - DNA, 261 bp, Heterodera glycines
  Genomic contig location: Contig_ID=SeqID_5730; Location=1333..1593; Strand=-
  SCN-specific regions: Sequence locations=1-163,187-261
atgatcctttgtcgttgcattgttctgctgcagttgttccttgtactgctcgcactcctccccccatcttcgaattgttcgtgttattgcggttgctgcgactgttgcggctgttgtggcggcggttgcttttgttgcggcggcagtcgcaaccgaaacaatggcgcagcggcgacagcggcagcaattggttcgggaattatcgcaaacactgctcaacaggcagctgctgtggcaccgccaattaacgtggccgatgag

SEQ ID NO: 59056 - DNA, 1027 bp, Heterodera glycines
  Genomic contig location: Contig_ID=SeqID_5731; Location=761..1787; Strand=+
  SCN-specific regions: Sequence locations=1-104,126-776,798-817,859 -868,921-926,950-1027
atggttgttgaagcaaagaaagaaaatgtcaccgcttctgtcccaacgtggcgaagacgaaggaaaagcacaacgccaacagattgggggtgagagaagcaaaacacattttaaatttcccaaatcactcctaatgattttattttcgataccataatcctagtcatatacttacgaccactatttgaaaaaagtattttcagatcactctttcacagtgatcgggatactcctaaaatgttgaaaatcgggaaaatttcgcaaataatccctatggggttggggaatttctaccaaaaaatgagtagaaataccgtacagtaaaccgagagtacccaatttacacgatgaatatggtaagaaattgagttgtgtggtgaaggattggagttttcccttcatcgtttggcagagaaggcgtcattaaactcaattaacaaacaaattaatgcaattgctgtctaatttgtccacttacagctccgagaagttgttgactccgcaacagttggagggcaagttccagcagattcggctgcttcaacagcgtccgctggccccgcttcagcccgaacttccgcccatccaaccgcccgactttccgcccctttccgcgtccgcgggcgactcgccgtcgttcgcttacgccaacgaagaaacggcgggcaaatttcggccgcaagtgaccagcggaattggccaattcattcacgtgaagccgacagtcaacggcatcggcgacgcaatgggacagcgcgcggacgccgccgccgaatttgaggacccgacacttaaacacccatttgaggagccattttggatatgaagcagcaattggaaagggactggactgtttttatgtactttacatgaaaaacccattaatttgtttgaatattttcttaaatttttaaaagattttaggaattgattaaatcataattaaccaaccatccattaaggatgggaagttgcagcgcactttatgaacataagagaacggattacatttaatgcattaaagcaa

SEQ ID NO: 59057 - DNA, 304 bp, Heterodera glycines
  Genomic contig location: Contig_ID=SeqID_28437; Location=491..794; Strand=+
  SCN-specific regions: Sequence locations=1-19,41-131,155-242,264 -272,300-304
atgcaaacgcaactgttgcaacagcaacaaaagctgaaatcgcatcaaattttggctgctgcggccgcaaaattgccaccggcggcgacaatggccaaccaacagagggcactgatcaacaacggggccaggcagcagcaccagcaacaacaacagcaaatggtaaaatatagtatatgctatatgacaacgacaacaaaaaaaatttacattttacgaaaagcctggcaatttttttaatcaaaaagagagaaatctcagcattttacagaaaccacaaacaaaccaaaccaaaaatcgatag

SEQ ID NO: 59058 - DNA, 526 bp, Heterodera glycines
  Genomic contig location: Contig_ID=SeqID_28438; Location=32..557; Strand=-
  SCN-specific regions: Sequence locations=1-13,38-39,64-72,94-526
atgcgcgacacggataagaagaagaagaaggaagtaataatgcattatttaccacagtttaacaaaaaaattttcaaatttcaggaaattattgctgctgggacgaacaatgtagtgagcgaacagcagcaggacggagtccccggcgacgaacactcggactcggacaattccactgaagaacgtgcgcagaatggagtgcccggcgacgaacactcggacaatgccactgaagaacgtgcgcagaatggagtgcccggcgacgaacactcggacaatgccactgaagaacgtgcgcagaatggagtccccggcgacgaacactcggactcggacaattccactgaagaacgtgcgcagaatggagtccccggcgacgaacactcggacaatgccactgaagaacgtgcgcagaatggagtgcccggcgacgaacacgcggactcggacaattccactgaagaacgtgcgcagaatggagtgcccggcgacgaacactcggactcggacaattccactgaagaac

SEQ ID NO: 59059 - DNA, 219 bp, Heterodera glycines
  Genomic contig location: Contig_ID=SeqID_28440; Location=176..394; Strand=-
  SCN-specific regions: Sequence locations=1-219
atgtctaattattatggaagaattggacatttggttggcttcaatccgccgtcaaaccgtaatgaagctgaagaaatgataattgaagaagatgcaaggcttttgcttgaacaaagtttggatgaaaatgggctgcttgttgatcaatactttgaagaaatgggtttgaatgaagtgcaagatgaaaactcgcctgatgttaattcagaggatggagaa

SEQ ID NO: 59060 - DNA, 176 bp, Heterodera glycines
  Genomic contig location: Contig_ID=SeqID_28440; Location=736..911; Strand=-
  SCN-specific regions: Sequence locations=1-176
tcccaactatttagcccgttcgcttcaactcacgcgccatctcatcacacactccccatggaaaactttacaacagggcgcattgagtgaagttctcgattactgcgtaaataaatgtaaaactacttagacaacaccaaatatacagaacaacacatggatcaacaacagaatag

SEQ ID NO: 59061 - DNA, 1989 bp, Heterodera glycines
  Genomic contig location: Contig_ID=SeqID_5733; Location=21..2009; Strand=-
  SCN-specific regions: Sequence locations=1-197,298-311,334-946,971 -1064,1086-1989
atggatgtcagaatcggattctccggaggcctggattttcctggacctgtattttcctggatttttgtccaggaaatccaggtccaggtcgaacatggaatccaggtccaggcttttttcaaaataccgagctctaataacgacatagcaccggggtgggttaggttcggatttgagtaaagtaagtgatttttctgtattattttttcatgtttattaaacatttaaatgaatttcaatttagaattaattaaaattaatttttattaaaaataagattaaaaaaaaataataattccatttatcccccggggggataaaaagagacgggggattatttttcaacatcctcagaaagggggacataattggagggtgtacggacatttcgcctactcgacatctcgcctaccgacatttcgcctactgacatttcgcctactaaccaaaaaacattcatttcgcctactaagccaaaaacattcatttcgcctaccaagcaaaaacattcatttcgcctacaagccaaaaacattcattttgcctacaagccaaaaacattcattttgcctactaattagtaggcgaaatgaatgtttttggcttgtaggcgaaatgaaagtatgcgaaatgtcagtaggcgaaatgaatagtaggcgaaatgacagtaggcgaaatgaccgattttgggttagtaggcgaaatgaatgtttttggcttagtaggcgaaatgtcatgtagcctaattggagacagggccttaattagagaaaatacggtattcttcgaattcaaattttaggccattgtctccgcccgccgaccaaaacaacgaaaaaggcgccaatttgtgaacctatggcaattgatgagaaaagaagaaaggaccgaccatttgattacctctgctggacttgatttgatgctatttactctttgaatgtgcttattttttcttttgtttaatggattttcattcaaaatcaaaattagatttttcgcggctaaatgttgatatttaataaaatcaacaaacattaggccatcaaaacaaataccaacgcaaatttttaaaatttatttaagtggcttataattttatgtagagcgataacgcaaaaatgagttctgctatctctctccccattttatttttgcgccaaaagtcatttgaaaaaaattgctttaaaatttcaaaaattatcgaaattttaaaaatgatgttgagcctttctctaccctcgagcccattggcaacaatttaaggcgaacagatttgaaaattgttttgataaaaaatgcgattctcgtgtttttctcatcaagtactatccgtaaaaaaataggaaaatcctaaaaatccaggctttatccaacgcattaattcttctgctatatattgtgtgacatcattcagaatttggccaaattgtgcttatttctgccaaaaaatgaaccgacggtaaggcatttttttaaagccacaattcctcacttatttagcctaattgtttcccatttcagttggatttgcaacgacgtttggatggacattttccccacttttgaccatgcccaactcggcctcaaattggcacttctttcgccacgttttgatgcgttggtggacaaacatttcgatggcaaaagcgaattgacaatttggagaccaatcgaaattagcaagcgcattggaacaaaaccgaaactatctgtgcggatggatgacaaatatgtgccatttccattgcccgacgaccgtccgttgcccagcaaaatccgttttaagagccttcagattaagtaattaaaaatcaaaagctattgcaataaaagcattcttttcctttttcagttacttcgatcactccgtcatcgcttttcttcgttccaatcaccaaattttcgacaaaagaggcaccaatttacaattgcggattcaatcatcacacaccacggaaggccagcggatttgggacatttttggtc

SEQ ID NO: 59062 - DNA, 1275 bp, Heterodera glycines
  misc_feature (94)..(94): n is a, c, g, or t
  Genomic contig location: Contig_ID=SeqID_28443; Location=151..1425; Strand=+
  SCN-specific regions: Sequence locations=1-313,337-562,700-1036,1058 -1275
ttgggcgctgctgccattttggcatttgcttctgctgactttgtattcgtgggtggcaatcaaatggaatttgatccgacggcggtgaattctntatttcctttcaattctttgcctttttgttgccatttgtccgttttcatttgtccgttttcatttgtccgtttttatttgtccgtccgtccctttcagccgatgttccccgattctcagttcatcgatttgatttcgcgtgacatcgaatcattctccggcccaatggcttttggccacaaatttatgagcggtgtggcccattaattgattaattatctttttaattaaatattgtccccttaattcattattaatttgtttcgttttgggcggtgccggcgaaggcgaccaacagctcggccccgacggacccttcgagcatcggcagcaagtgaaaagtgacagcgtactgcccgcttattgtgagccgccgaatccgtgtcccgttgggtacagtgaaaaggacggatgcatggaacagtttgataatacggtagggaaatggaggagtggggggagtacggtaagaaaaaggaaagagcgagatgaaggagagggaggagtgagaggaaagagacgggatagaagaaagagaaaggattaagagagagagaggtgaaagaggagggatagaaagaaagaggattgagagagagacggagatacagtaatggaaaagggcagtcatcaaaaacgattaacgctttaattgagcagtatttaaggccgaattctcgcgcagttaccaaggccagcagcagtgcctatgtgaccaggaacacatgttcaagtgagaaatgggttaaccaattagagaggcaaagcagctccaaattattgtgcactgtccctttgattacggcacttaaacggtccctttgaagttgcccgtcaaaggaaaacgccgaagagtacgcgcagggcctggagcaactgcttgcggacaacggactgcacaaatcgtacgggcctaagcacaaagcacgaattaacactaattgtcccctttgttttgcagaatgatcgccaaaaagttccatctgacgcgagcggaggtgcgcaattaaatacgctaatgactacagcaaattaccgccactttcccgcaaggaaccgcgccgtcggaaacgctccgtcgcttttgttggcccggcacacgcgacgcacagccgctacaacccgtacttggagggcattccgctgaagtcggttgccaaaaaggacggacgaaacttgaaa

SEQ ID NO: 59063 - DNA, 309 bp, Heterodera glycines
  Genomic contig location: Contig_ID=SeqID_28444; Location=385..693; Strand=-
  SCN-specific regions: Sequence locations=1-216,238-309
  Gene Ontology: Mol. function=glutathione peroxidase activity; Cellular component=cytosol; Biological process=establishment and/or maintenance of chromatin architecture
cgattcgtattgcctttaaaattcttgtcaccactcaacatcaagtttatgggtgcaatgagttcttcgtcttctgccgccccatcggacccgcagcaaaaaagcatttatgaattttcggccaaagacattgacggcaatgagaccagctttggcaaataccgtggcaaagtgctgttggtggtcaacgtagcgtcgaactgcggcttcaccgactccaactacagtcagctgaagcagttgctggacaaatacaagtcgaagggactcgaaatcgcggccttcccgtgcaaccaattcaacaaccag

SEQ ID NO: 59064 - DNA, 369 bp, Heterodera glycines
  Genomic contig location: Contig_ID=SeqID_28448; Location=157..525; Strand=+
  SCN-specific regions: Sequence locations=36-40,244-369
atgccaaatgggaaaggaaaagccaaaggaatgccaaatgggaaaggaaaagccaaaggaatgccaaatgggaaaggaaaagccaaaggaatgccaaatgggaaaggaaaagccaaaggaatgccaaatgggaaaggaaaagccaaaggaatgccaaatgggaaaggaaaagccaaaggaatgccaaatgggaaaggaaaagccaaaggaatgccaaatgggaaaggaaaagccaaaggaaagccactaatccgaataattggtagcaccgctgctgttcagatggagcgcctttctgctctattttggctatgcccccggcgatgtgaaggaccaaaagccgttgaacgtgttcaaaatggtcattga

SEQ ID NO: 59065 - DNA, 243 bp, Heterodera glycines
  Genomic contig location: Contig_ID=SeqID_28448; Location=836..1078; Strand=+
  SCN-specific regions: Sequence locations=1-243
atgtcgcgcattttggccggagggggcgctgccaacggagacgaaacgctgctacgaaaacggatcggaccgggcacagcggtggcggtggacaagtcgagaatcgcggcacaaacggaaggtaatacggcacggacaaacggaaatggcaccttccaattttttggcattttagcaatgaaaaacggtgccggaattacgactggcgtcgccgctgatgacgacgaactgcttgacggcgtt

SEQ ID NO: 59066 - DNA, 595 bp, Heterodera glycines
  Genomic contig location: Contig_ID=SeqID_28449; Location=406..1000; Strand=-
  SCN-specific regions: Sequence locations=1-198,225-303,430-595
atgaccaattcaaacactgaatacactccgatggcgcaattaaacgacgaccgattcgaacaccgaataattttccaaagcaaaagcagcaaatggcttggactgttcatgaaatgcattttaatgatgttaattgctgcttttgtatatgctttgatccgaacggttgactcatcgaaaaatatttcaaaaaaggtcaaaattaatttaatttaatattttatggacccattactatttttttccaaaagtaagaagagaatagcaatgaaatttagcagtttttttgaattcattttgtacataattataatttgattatgtcaaaaattaatgtaaaaatgtaaaaatttattagaaaaattaaaatataagttttttcagcttagttttttaattttatagagaaattaaattattttattttttgtcacttttttagttagaatgtccaaaggttaatgatacaaattttcttgcggcacttgccaaacagcagcgtggtttagtcgatgttcggcttaaggacggttccatagatgtgaacggcacgtggacacaaattcaaccgcatttcaatgttcgggataattaa

SEQ ID NO: 59067 - DNA, 330 bp, Heterodera glycines
  Genomic contig location: Contig_ID=SeqID_28451; Location=17..346; Strand=+
  SCN-specific regions: Sequence locations=1-262,285-330
ccaggactcaaatgtcccgctgaggtcaaaaattttttctatttctggaaaaaaatcgaaaattttccaaaaaaattaccaatcgatagagctcgaaaaactatgttttggaagtggtctccgtttttctgggaaaattcgttaaaaaatcataaaattaaaaaacccgaaaaccgttttttaggcctaactcgaaaaattttgaaaattttcgaaattttaaaatctggaaaaatcgagcttattgaactctacaataagtctgctggccaccctgcgctcaggtcaaaccctaatgagttattcggctggtactgaagtgggaaaaaa

SEQ ID NO: 59068 - DNA, 1806 bp, Heterodera glycines
  misc_feature (1748)..(1748): n is a, c, g, or t
  misc_feature (1768)..(1768): n is a, c, g, or t
  Genomic contig location: Contig_ID=SeqID_28452; Location=1..1806; Strand=-
  SCN-specific regions: Sequence locations=1-59,85-719,741-995,1017 -1376,1399-1622,1646-1806
atggacctgcggatcagcactccaaaaaatttgctgcagtatttggtcaaccaatacaacaggcagcaagcacggcaaaaccccaatgcccaacagaaaactgttgatgacattggcagtgttgttcggctgtccgagcacaacgtaaattctctccaatattggaagaaaatgtatgaggattgcaacaccgtttttgcacggtgccatgacgcgaaaaaggcgcgtctcttcatcacattcacgaacaacagggaatggcctgagttcaaagagaatatatataaaaatggtcaagtatttactgaccgttttgacatgtggatgcgtgtctggaccagcaacatcgccgagttccgagaagaactttatgagaaaaagttctttggaacaatccttggatatggtgaatccatggagttccaaggtcgaggaggcccacacgctcacattgttgcccaaactgacctggacgcagtaccacatgtcattcaggaatacatatgggcgcacattccatctttgcccgataaagatgacgacacgcccattgcgaaaatgcatcgcgaaatccgcgaaacaatgcatatgcaactgcacagatgcagtgacagttggtgtggtcctagcgacccaatttacgggcggtgcaagaaggggttcccagccccttactcaaaatgtactgttttacgcccggataggcccgcgatgtatttccggccttcaccatctgatggtggtgcccaattagaggtaaacggcctaatatacgacaactcacatgtcgtgccgtataatccttatgttctgctgcgttaccgagtacaccataatgtactgtttgcatatggtaacaaagcgaatattaagtacgcactcaagtacccgtttaaagggccaggacattgttatgtcgagtgcaaagaagagtccggcaataaaatcggaattgatgagccggctcaatatgccaagatgaacttccgtggtgcaacggaagcatatgccattgttcattcaatgccatttgcccgtctttcacatcatgttgtcaaattggcaattcatttgccaaaccaacagcccattgtatatagggcattccagctggtgagcaaagctcaacaaatccagcaaggcgaactgccagaaacgcattgttcagcatattggaaacaatggcaaaatgagtggaagaatgacccaaagtttaaggacattctttttgaaaaagtcccagagcagttccgatgggcaaaggacaaatgggtcctgtacaaaaggcagcaaataaaaaggccacctatcggccgaattgttcctgtacccccatcggacccggaaaggttcgcgctctattcacttatgcgtcactttcctggagatccagatcatcttaagatggttaatgggttgctttgtacctcattcactgatgctgcaataatgcatggtcttcttgaagacggcaaaatttgggacaaaactctggcggaggcagctctgtcgcgctggccagatcagatgagatggctttttgtgagcatcatggtctatggccagccgagtaatgccatagaattgtggaacaagtacaaagaccaaatgtacaatccgcaaggcattattactccggcacagcataaagcagcagagcttgaagccctagccgaccttgattggcggctgcacagctgctttaacttaagctgtgtgcattttggcctgccagacccgccaaactncatttgcaaaatactgacgncgcaattgaagagtttttctttggcgatgatgatttga

SEQ ID NO: 59069 - DNA, 946 bp, Heterodera glycines
  Genomic contig location: Contig_ID=SeqID_28454; Location=151..1096; Strand=-
  SCN-specific regions: Sequence locations=1-8,30-165,187-191,213 -270,305-387,409-484,515-903
atggtgccgttttgggttggtgtcattttgggtggtgccgtattgggtggtgacgttatggaagggacgatttgggtaggacccacatattttgaccactttttgtacatatttttggcagccctaatggttatattttccaatttattttcatgaattttcaaaagactcatgccttaaataaaactgagaaaaatggttatcttacaaaatgtgattggagagtgaatgggaacaataaatagacaaccaaatacattaggaatatgcaatttaaaagtttttttaatttaaaatttttattgatgataattttcccgaacatcgaacaataatattagtaagtcataactaaaattttcgcattcagcaagggattggttaagtcaaaatttttacaaacaagatacgtattccgcgtgattattccgcaaatcctgcatttaaaacttacaggatccagcatggaattttgaaaatttcgaaaaaaattagaattaaattaaaaaaatatcccaaaaaactaaaatttacctaacaacttttgaaaaaaatttaaggatttaaaaaaatggctttatttaatcgaacttatttggcattccaaaaagcaatgcgggtcctgctggatccctaacaaaaaagctcaaactttcgtttgagtaaagccccagaaatttgacttattttcataggaggagtggcgaagaactcagacgccacccaccgagttgagacgatgactttggtcatgaacaaaagcaatggcataaatttaaaatagagaacaattaatcatacaatttccttattagtgactggctttttgacacccaaattaatttttgacagcttttctaagaatgtcaaaaaaattgtacaagaaaacaaggattttagcagaaatttttttatttattattaataatatattttattaaataaa

SEQ ID NO: 59070 - DNA, 821 bp, Heterodera glycines
  Genomic contig location: Contig_ID=SeqID_28455; Location=248..1068; Strand=+
  SCN-specific regions: Sequence locations=1-24,46-423,445-821
atgaagcgacttaataaatcgattatggatttgcaagagttaatttctcaactcacactagctaacacggaatttgccgcgtgtaggcgtaaaatgagccattatgaattacaagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaaattttttcttaggaattttacagtgcccagggatttgaattatccataaacacatcatagggtaaatatctagcaaaaagaaatttttttacacaaaatcctagtccagcagacagatgaagcgacttaataaatcgattatggatttgcaagagttaatttctcaactcacactagctaacacggaatttgccgcgtgtaggcgtaaaatgagccattatgaattacaatgaattacaagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaaattttttcttaggaattttacagtgcccagggatttgaattatccataaacacatcatagggtaaatatctagcaaaaagaaatttttttacacaaaatcctagtccagcagacagatgaagcgactta

SEQ ID NO: 59071 - DNA, 884 bp, Heterodera glycines
  Genomic contig location: Contig_ID=SeqID_28457; Location=354..1237; Strand=-
  SCN-specific regions: Sequence locations=1-300,324-573,595-820,842-884
atgtcgcagcctcaagaagtacagataatggaagcatttgatgaggtgaacacgcaacaatggcatgacttagataatttaaaatgtaaagcatacgaacattgcggagcagacaaagcagcagctgctgaccccgtgccaattcagctacgcggacggagtgatcgaacgcgtgccgtgcccccaggacgcggaggagtggtcgaaaaatgtcaaaaaagcggtgttgaagatcatccaggtgactgggcatctgatgccgaactgcttgaagttcgtttgccaaaatttcctccttttagttgaacctgaagcaaaacaatgcacagggcttgcatcaaagcggcgcttcgcgtgtcgaacagtttcaacaggaggcgacgggccagagcaaatcgttcaaaatccaagaggtgattgtcactttagtcgtggtttgctaatcagtcccccaacctttgctcagatcaccttggaaggcgcgtgccaaacaatgtacaccatcaacaaagcgcaacgcattggacagcagcagcagcaccagttcaatgtgaccaagacgatcaacttcaaaaagtgccaaaagattgccgacgtggccaacggtttccaggctgatcagccgcaagcgcaatgcgcacaatgccaacagtatgctctcttttgttgttgttgacaatgctttggcataaccaatcaaattaaggtattgggcccagcagcaaagtgatcagcagaacagcccaactgatcagcagaagaccaatgcgtggcaaatgggagaaagtgatcagcacccgtgtgccaaatgcgacccgaaggaagtgaaagaaaatgaggtgatcaatcgatcagattcagtggggagcgatgcggatggttaa

SEQ ID NO: 59072 - DNA, 476 bp, Heterodera glycines
  Genomic contig location: Contig_ID=SeqID_28458; Location=947..1422; Strand=+
  SCN-specific regions: Sequence locations=1-43,65-268,444-476
atggccgaaactgatcagtcagtcagtgattggctgatcggggagcttttggttaagaaaacaatacaaatcattggccgatcaaattatcggcctaattatttaattgatcaatcattaaatggatactcccaattggtaagcttttgtttgttaagcattctgctccaatttgttcgcttcttcgtcgtccgccacctatcggtcggtgctgacgcgcgcttcgatggactcgggattggaactggacgaaatggaaaagaacagaagagacgagaggagaaagcgggacaaacggagagagcggacgagagaggaagaggaggaaaagataatggaagaaggagagagtggcagagagcgagagaatgaatcggagaaggcgaaaagtggagagacaacggcggacgcagagagcgaagagacggagagagcggaagagaacaaaaaagtgagaaatttaaacgctatttgaa

SEQ ID NO: 59073 - DNA, 903 bp, Heterodera glycines
  Genomic contig location: Contig_ID=SeqID_28459; Location=174..1076; Strand=+
  SCN-specific regions: Sequence locations=1-96,120-417,439-464,492 -722,744-903
atgttcatactgtatcaatttgtgcggttgttgtactgtaacgaaacgatgcgaagagacaataaaaaatggacggcacagtttacgaatgccccatttatcaactttcttgtagaggtaaatataatgagttttcggcactattcctggtggtcctgactttttaaatacgtgtccttgtccttaattttgggataccaatattttttttttattttccattttcgagacaaattctaaatattttctcttttttttgaaattttgatttataatttttttttgatagttataatcaagcagggcagtcagatgtgatgatttattcatcattttgattatttaatgagtcaatgatgattttttaattatcaaagcgcaaattaacctaaattgccaattttcagtgaaaatttgttaaaaaatggtcaaacttttcaattttccccggcggtgccactaaaacattcatattattattattatcgctacaaattttcgttgaccgataaacggtaatttactgtattaaattaccatattgcaaaaaagtttgaaaaaaaattgattttcatatgtgcaattaaggaatttgagaagggcatttgcgatgatcatcagcagctcgggcattgggacattccaaaatttaacaaaaaggaggcaatgcaaatttatgagtcacttatggcacagagagaaagggccaaaacaattaatttatattgtattggcatgttaattgaaaggttcattaaaatgcgaatatttttttgcaaaatgaatgctgatcggttgctacaaagcaaaaagaagctaattacgttaattggggagacaggactggttcagttggagctaatgtatccggaagtgatgaaattctgtgggttcaatggttaa

SEQ ID NO: 59074 - DNA, 605 bp, Heterodera glycines
  Genomic contig location: Contig_ID=SeqID_28460; Location=1156..1760; Strand=-
  SCN-specific regions: Sequence locations=1-20,42-63,87-605
atgtaccgcggaatatccatggtgcggatgatgccatggtcacctccggtggtcaacgcgtacttgatgtggttggaggtggtgtacagaaaggcctcattgcccgcgtcccaagcgccgcttttcacccgagtcgactcctgcacagtgccgagcacctggagaaaaaagattgaaagacgagaccaaagagtacaacgccacctccaatctcttggtgacgagggtaacggtgtgtttgctgagcaaagcggcgcattccatgttcttggaccagatgacgtactttacctgaaagcaaaaacattgcggaaacagagtgacgatttaggtttatcgttggataaaacttcaatttcaaacactttttttcaaattttcagtaattttgaacacccagttttgtgttacaacacctttgttgccttgacactggccagcacacgcttctgctgcaagtcgtacatttgcacagagtccgcgttcttcaacagcaacagccccgtgccagcatagaaaatgtcgtcgacggcacccgtgtattcaaccttgaccaattggtgataaaatataagatttaagtgaaaaaatagcatagcattaaa

SEQ ID NO: 59075 - DNA, 1179 bp, Heterodera glycines
  Genomic contig location: Contig_ID=SeqID_5738; Location=866..2044; Strand=-
  SCN-specific regions: Sequence locations=1-353,375-445,467-653,676 -680,702-804,827-838,861-1179
atggcaggatggaattgccgcctccgaaatggaccgccgttcggattcgtacggagtgccggaggcgcgggcgaacggcaaaaagacggggcacacactgtcgatggttggccgttttgtagccaaagtggaccctttggagcattgcgtctttgctgcgattcgtgacattgccaatgcgagttcacgttcggaaacgatgcgcaaattggccgattggctgcgagctttgggcgtcggactgcgcacaaattcggtcatttccgttcgggaacagctccgctgggcatttcgactgtttgacgagaatctccgtctaatgaaatcggacgacagtcgcataaggtggatacaatactatcaaatttgaatcaacttcagcaaatttgattttgcgtttctttttactagtagtaactttggcggtggctcttcgcttggccgtcgtcctgtcaattgcttgctgttggcacccgaaccaaaacggttgggcgtaatccaacgggtggccctcaaaagcaaagtgcacattttcgtcgaatttgcccttcaaattttgattgaccaaatcgcaattattcgccaccatttgatcgaaaagagtgaaaaactcggtgatggtggggaagaaagtgaagacgagcacaaaactgaggaggaaaacacaaaaaatagtgaggattttaattaatttgattgtgaattttttattttcagccaaatctgtgtcagaaaaatcggaggacagacaacaaattgtgtcacttttggagcaattcgttcctttgattattgaagcgcttaaacaaaaatatgataaagtgaagcatgaacaatgttttgatttgtttttcaatttgttcagataattgcactcagtcttcgcgcattgctcaatttgttcaaatgttcacaaattttttggacatcgaatgaacgaaccgcggaattggtggaccgtttttttgtgcttttggccgattattcgtcggttggaagtgcggggaaacagtcgaatgtgactgaattgcagcagcaactattcaaggtgtacttgcagggggtacaccccaaaacgtcgccggacaaaacgtcgccgcaaaaaaaaattaaaaattttctagatttcaagaaaacttaaaagtattttagctttttgaaaatctaagtgttaataaa

SEQ ID NO: 59076 - DNA, 1951 bp, Heterodera glycines
  Genomic contig location: Contig_ID=SeqID_5738; Location=2085..4035; Strand=-
  SCN-specific regions: Sequence locations=1-75,97-945,967-1327,1353 -1479,1502-1632,1655-1700,1722-1910,1933-1951
  Gene Ontology: Biological process=negative regulation of cell proliferation
ggtcgtcagctccgatgggcgcttactcaaatggcactttctgtcgggaaaaaccggcactttccattggctgctaggaatttaattgatgtgtggacttgcaataaagtcccattatttgaccattatttagcttttggaagcattggaaagttgggatacgcgtcgaattgaagaaccggacgcggacagacgatgcgaagtgggcgagtgctttttgaatttgataccaattgtttaaggccctggtacgtcttcacgattggtacgaacatcgggaccggcacattttgttggatgacggcgccgctcgcactcttccgttgttggcacattcgcacgttcattcgatgttacaggtacggaaaataaatttgttgcaaaggaatggcattccattacgacagaagtcggacatttccctccgggggacggccgccaacactttccggcagctgattcactttgtctcaacgacggccaatgactccaatttggacgctgtccaaatgctccgtgcccatttcattccgttgattttgcgcggcttgcgcacttccgtcgatgatgaagtgaaattattatattcatttattaagtaagtaaaaacggtcactttattttttcagtcggctcgacacgaatttatccaatgtttcgcctttctcgtccactgtttccccaatgaaccgcaatttgctgctcttcggcatttaaccgacacaacaccaacatcgacaactgcttcggcgtccgtcgactttgaaattgatcctgacgtcgatttcttcgaatgcgcgacgcatatccaactccaccgtcgtcaacgagcttttcataagcttgctgaacgtttgaacaacaaagaggttctctttccacatttaaatttgcataaatctcccattttcagctctcaattggccattcttcgctcgttcgtttcatcgttccgatcgttgagccctatctgatggacacggcgtccaatcggtcggcactctctgaccaggccctgcatcttttctcctcaatcctccgccgcaccccttggccaaaatattgtcaaatgttggaatatttcttgcgcctattggacaccgctggtgaagagagcacaaaaggtgccatccgagtgatcggcgctgttttgaatgcttttcacttcgatttgcggcacctaaaaataaagggaacgcattcgaatgaaaagggaaactgtgacgaaaaaaaagaagggaaaacagaggaagacgagggtaacgaatttggagaagggtcagaaacaccagtggacgcacaaaaggaaacggaggacatggcaagagacaaaaaggaggaggagaagcggcggatattggaagtcgttcggggaaggcttttgccgcgtctgcgcgagtgtttgcaccgttggaacggcgtcaataagccgggggttggaaatgttcacaagtggctataattcatacaatttttacagaaccactgggacgaggaagaacagaaactgttgcgtgctccgctcactctgtccatcgttaaactgctcgaatggcttccacctgaaatgtcgggccatcatttacatgggcttgtgttgttcctggaccacttgctcatgtccaggtgctccccttctgtttatctcatccttaataaattttgcggcgacagatcgccaaacactcgccaaaatgcgcgaaaattgttggagcaaatggtccgtttgttgggaccagccaaacttccgtttgtggtccgagaagtgaaacagtcgctgaataagggctaccaaatgcatgtgatggccgtaacagtgcacgctttgattggggcgatggagggccatttaaccaacggagacattgagccaattttgaaggaagtggtggacgtttgtcgatgggaaacatttggagggcacgccaaagcaaacagcgcaaaggcataa

SEQ ID NO: 59077 - DNA, 76 bp, Heterodera glycines
  Genomic contig location: Contig_ID=SeqID_28462; Location=588..663; Strand=-
  SCN-specific regions: Sequence locations=1-76
ataaataagagagtgcagagaaaaaaacatctctcattttggcgtactatttctttgtctctgtgaatagagaaaa

SEQ ID NO: 59078 - DNA, 162 bp, Heterodera glycines
  Genomic contig location: Contig_ID=SeqID_28462; Location=730..891; Strand=+
  SCN-specific regions: Sequence locations=1-23,45-132,156-162
cgcgtttgttaaaactgccaatgggtttgaaaacaaaaaatgggcaaaataattaaattaatagcttggctcaaattcaaccaaattaatatttcgtggtatcattcaatagctttaattgttctctttcagaatataattttcctaaatttttaacttaag

SEQ ID NO: 59079 - DNA, 1238 bp, Heterodera glycines
  Genomic contig location: Contig_ID=SeqID_28464; Location=39..1276; Strand=-
  SCN-specific regions: Sequence locations=1-78,103-212,234-322,346 -594,616-633,787-874,938-1020,1059-1061,1116-1238
cgctggggcgaaaaggcaggaatttgtagtggtttggcaaaaattgaagataaatttgcccatttggggtctaattttcaaaaaacaatggtttgtgcaaaattttccaaaattcgcccttttttctggaaaaatctttcattttccatttcgggggaggggggggggggcggcacggataggtcctgttcaaatcttaccatacttctccggtatgtacagattgagattttgcatccaattttaaactctgcggattttataaaaacaaaaaattgggcaagaaaactaagaaaatcccattaaaattcggtattcggaatttttgtttgaattttttaatccttaattcaattcatgcatatgttgcaatgtataaattggaataatttttttaattttgacaagtaaaatttaaaaccgacaaaaaaagcacttataattttctccagcgcaattcccggatttaacatttgatatccctttaaaatttttgaacaggaaatttgaattttaatatgaataatatttgtctgatgcgccatcagttcttaactttttcctaaatgtttcttcatggaatcaagttcatataggaaaaatgttaagaatagctggcaaatcatgaatttgaattaataaattttgtattcatattttaaaaattttattttaaattcttatagaaagataatatttcaatattaatttattttaaaaaagttttaaaaatatttatgggaattcattccatattattattttttttaattaaatatttatattgcctcaagcattttgaattaattaattggcatattaatatttaatgtttaaaaagtgtcgaatactgacaaaaaaagaaaaattacgcaaattattattacaaaaatgaaaaaaattaacaatttcctaaaattaataaacaaatataaaaggacatgtaattaaaaaaatatataaagtttctcccaatcagcacaaaaatattctcaataacatcagttagacaatgcggtaaaaaatagaaataaaaataataaaaatataaaataaaacagaaatatttaatttattataattttattaaattttcatcataaaattaatattttcagctttatttggcctaccgttctgtcggtccgtctgccgatttgattgtgccggccgttgcgatatatttggttgcgttggttggcattgtgttgaacggcacagttttggtggtactgtaa

SEQ ID NO: 59080 - DNA, 174 bp, Heterodera glycines
  Genomic contig location: Contig_ID=SeqID_28465; Location=6..179; Strand=-
  SCN-specific regions: Sequence locations=1-174
atgtgcccatttatggaggagggggcatttgggtggcacaaaagtgccgaaaatggacgacccattgcaaaagcggagggggaaggacgccttctcagtggccaaagtgccgaagaacagccgaaaagaccacagaatgaaatccccaatgggactgctaacaatgcaaattgt

SEQ ID NO: 59081 - DNA, 1127 bp, Heterodera glycines
  Genomic contig location: Contig_ID=SeqID_28466; Location=670..1796; Strand=+
  SCN-specific regions: Sequence locations=1-58,80-133,156-1127
atgcacatcttcaaaaacttgaaggtgtgttctaatatttttgttcaattctatgccatcatttttgaaatgagtttttagcgaatctttctgaagttcgagaaacatctgtggcaattatacagccaattatccaagatggcacccaaagtgttgttgtcggacaaaggaacaaattgaaagaactgaggggaaagctgagtgagcagcggaattgtgccctctctttcatcagttctaaagaagaagtcattcaaaacagtgggtcattcattcatcgtttattctaaaaatgaatttatcttttctctccatcgttaagtttgtcagcgccttgcgacttggattaaacaagttattctattttttccaatttcttttctgttcattttcatcttttaggcgtaccaacgtctccaagatgttgacaaacgcgtgatgtgttttgaccagaaattcaatggtcttcgacagagaatggatttggcacgacaaataacggaaactccaagcatttatatgaccgctgtgccggaagtgatcagaagagaggcgctcaaaagggaattttcgtcgtggattaatttgcatattggcaaaacaatggaatttatcacagaagaaaacaaaattcgacagcaattctttgggaagttggagaagcactttctccgccaacttttccccgggatggatgaaatgatgccgcaattttcacctcaaattgctcctaaaattgaccaattgcttccgaaagtgcctttctcgcatttgcatgagctgagaagtgtaagtgtctcctttgtttaattttccttcatttgtttattttcagagattcccggagatgaaagagctgctttttgtgggtacgccgcggcttttctcccgattggcaatatccgacccaacttctccgattgcatccgcaccaattcggtccattcgtcgtgatgaaagtttctatgagcgagacaaaacttcgaatattgatgtgatgaatcggaaccttccgtccaccaattggctaaggcattattttgattaattacttttttttgtacattggtcacctccctccctatagtaaaaatatttttagaattatttaatggaaaaaaattcta

SEQ ID NO: 59082 - DNA, 925 bp, Heterodera glycines
  Genomic contig location: Contig_ID=SeqID_28468; Location=308..1232; Strand=-
  SCN-specific regions: Sequence locations=1-74,104-925
atgaatggtatcatttcaagagaatcccgaggcttaaaccatgggctaccattagacactgtaccatttcataatggaatggtaaatttaaaaaataaaactcactcgacggcaaatggaaggaaatgtgccaatggttttcgtccctccgcaacgttttgccggtgatccgggcatagaattcgtaacattcaaagggaaacagtcgcacagcaccgaacgattggatgattttggagatcacttgggaggccaatttgaagcgcattatgtcctcaagcttggcctgaatacaaaatcaattaaagccgaaacaaaaatttgtttttggaaaactttcgtaaaagagaggatgattttttacagaaggaattgaagcatacgtagcagaaaaagcataatttaaaaaaattaagaaaacatttcggctcaatttttgtctatgagacgattcgccaaaaattccatgctaaaaaatgatcatgcttttagaagactaatatattgcttggaaaaagcattctaacgagattacagatttgggcagatatttgtaaataaaaatatgatgatgagttaaagatgccagggaaccaaaaaatgagggactcaatcgatcatttttaaccaaaatttatttttatcgaaaattatttgaattttcagaaactcatgggttgaaattaattcatttttccacaagttttacccgttgtccatcatgaatgcacgtgtggaacagcgaaggcgcaaccgaaatgccgatggcgtccggcgtcattcgagtgccgaatgtttgtgccgagtcggtgatgacgcgaaaagtgccaaacaaaagggccaacaaatgttgggaagggacgggcaaagcggtgacaattctaagaatggaaatgaaatgtattacttacaattaggattttag

SEQ ID NO: 59083 - DNA, 670 bp, Heterodera glycines
  Genomic contig location: Contig_ID=SeqID_28468; Location=352..1021; Strand=+
  SCN-specific regions: Sequence locations=1-670
aattgtcaccgctttgcccgtcccttcccaacatttgttggcccttttgtttggcacttttcgcgtcatcaccgactcggcacaaacattcggcactcgaatgacgccggacgccatcggcatttcggttgcgccttcgctgttccacacgtgcattcatgatggacaacgggtaaaacttgtggaaaaatgaattaatttcaacccatgagtttctgaaaattcaaataattttcgataaaaataaattttggttaaaaatgatcgattgagtccctcattttttggttccctggcatctttaactcatcatcatatttttatttacaaatatctgcccaaatctgtaatctcgttagaatgctttttccaagcaatatattagtcttctaaaagcatgatcattttttagcatggaatttttggcgaatcgtctcatagacaaaaattgagccgaaatgttttcttaatttttttaaattatgctttttctgctacgtatgcttcaattccttctgtaaaaaatcatcctctcttttacgaaagttttccaaaaacaaatttttgtttcggctttaattgattttgtattcaggccaagcttgaggacataatgcgcttcaaattggcctcccaagtgatctccaaaatcatccaatcgttcggtgct

SEQ ID NO: 59084 - DNA, 1327 bp, Heterodera glycines
  Genomic contig location: Contig_ID=SeqID_28470; Location=876..2202; Strand=+
  SCN-specific regions: Sequence locations=1-147,172-600,622-626,651 -850,871-895,917-1006,1028-1191,1213-1327
atggatgaattaggggctcaactcaaaaagtgtttaattttgcgacttttacagattgatgccaactttggccaacgcccttttgtgtttgacattttcgccgaaatgaatgtgggtggcacttttgggctgtgaatcaacggatgaaatgttttaaaatataaaggaaaaacaaaattgttttcaggcagctgaacaggcgacaaaaaatgcaattgccgccattgaattgccacccgaaaaagtgctttggatgaacaggtcggatgggagtgagggggcgacgagcggagtcggctttgaaattttgtgatttttgtgttagtacttttttgggataatttttcaaaaaaaaaaaaattgaggacaagggatccggcggtgccgatcacttgacaaatggtcgaaaaaattgcaactttcagcttgatcgccaaatggatgacctacgaaggatattccagggcgttggaagcgctgaaccggtcaacggccaatccaaaatcgtccatttcagagcaggccaaagaagaccgacagcagcaacaacaacaacaacagtcaccaccgccaacgacggctgcggagactgtggccaactcagtgatgcaatccatcatcgtgtttggtggcggtggtggcagtgccgccgacggtggcaccgatgccgcggcgccagcgactacaacgtcggcgggcagcatggccaacaagcgccggaccgtagtacgctctgtgcaggaggcgctggacgaggaaatggaacaccacgacaaaatggaccagcgccggtccatcttgcgcatggtcaagcggggccaacttgacgatgcgatcagtcacattgaggtgtgttgtgttgtgttgtgtgacgggcggagtgagtgagtgcttcaaaaactgaaatttttaatttctttagagatttttctgcatatttaagttctttaaaccgaatttcttaaaccgattttttaaaattttcatttttcatacaattttcgaagaaaaagttatataaaaaatctactattttcaattaaatttttttttgtttttttgtatggatggggagcgtgcgtgaaatgagctgctcccttttttggttcttttgagttttcgagactggcacctattggcatattgcgttttaaaataaccatttaaatcatttatctgcactttggagggaatgaatgccaatgttttacacaaacgaatataggcactaatttccgattattttgcaattttttagcaccattatccaacattgatggaaacgaatcgacagctggcacttttactcaaaattcaacccaattga

SEQ ID NO: 59085 - DNA, 122 bp, Heterodera glycines
  Genomic contig location: Contig_ID=SeqID_28471; Location=237..358; Strand=-
  SCN-specific regions: Sequence locations=1-7,29-122
gaaaatattttaaaaagatgttattcatctcccttttgatagaaaaagcatcagagagccttatttaacttttaattaacatttggtgcgtttcagagcacgttctaaaaaatatttatgaa

SEQ ID NO: 59086 - DNA, 3825 bp, Heterodera glycines
  Genomic contig location: Contig_ID=SeqID_5740; Location=991..4815; Strand=-
  SCN-specific regions: Sequence locations=1-228,250-1079,1101 -1414,1436-1562,1584-1947,1970-2630,2652-3038,3060-3825
atgaaccagcataagtctctcaatgatgtgaatgtggttgaaaactcatctcgggcgacagcccttcctaataattctgaaattgaatatgaggcaaattgcccagcgtcaggaagaagctcaccatgggaaggggtccgaatgatgcccagaattacacctctgcttccgttcattgtatttctgattgtcataattcttgatttgaatggcgccaaagctgcgcctccttctcttccattaatctgccaaaccgacattcagccaacaatttggggccttcctaaacaggttcagtgcccactacccgcagaagtggccacacatgtgccactcattcaaacaagggaactgttcgtcatcaatgacttcgaacacaacacgcaagcatgggcttgccgaaaaataaaaaagaaggcaaggaagttcacaactctttccggtgtgcccgtcgttgaaccgctcgatcccgaattgctcgaaatgtccgtcgatgaatgcaaacgcatggtggaacacaaaacgtgtgacttcggcatcttgaccgaacgtgatggactttgggggaccgaccatacactcgacttgactccacggctttggcttcttggatcattttcgtggtcggacactgaaagtgaggattgctttgcttttaaaactcaggtattccatcattttggtgaagaaaccattagaaccccacttggaacaacttcacattgccgatatttgttcggtaattgcactcttaatgataaatcgattttagtctggacacctgaaaagcagctgaattgcagatatacttcaatcgggaagttcaaaggcagatacgtagcaacacatggctgtcggacgacgcgcaatatggtcttcatttcaagacaaaaactccaaaggtaagtgactgtaacaaaacacttactgtttcagagcaaggatttgccacgaggataattgtgagaaaacgaaagcgcacaaaaaggagctacggctcagtcgaacatcttggattggcaacttcaccggaaatgaatgccaaactaacttatttggatgatgaatgggtcgactcgctcatgtatgcactccgacattccttcaaaacgcagtgcgatttcttctcggtgatgacgaaaatgctgaccaacactcatcttattgatccaacttctcttgcgcgttcgttgttcaacaacaccaaagtctatgcagtcagagctggatcatctcttctcaaaatttggccttgcgtccaattgaagaaaggtgagttccgtttcaaaccaacccgattggataacaaatgctttgacaaattgccaatcgaatttgtcacacaatccgagaacagactagctttccttgacccatttacgatgatcatcgttcctgattcggcaaaagtcgcatgtgcacagcacagaaaaattgtagttcaaattgaaggccagcctctggaggtagatcaggtaacaggagaaacgaaaatcctcaaaataaaagactttgatattgagccacggctcccagggatattggaaattgaaaggcactcatttcaccaaatggctttgtttaacgtctccgacctgaatacacatgcctttctaagcggtatggtcaaggtaagtgaactcacgtatcgaatcaatgaactgcacaaaaaagtaagagtcacagtttctgaccagtggcgtgaattaacagacgaactcgagaaaaaagtagtcggagactacaaactgacatggctatgcgtcctatcatttgtaagtctagttctcttaattgattttctcttaaggtgacttccagtacttcttgaaacttacaccggtcctggatggctgggccgaatgatttggggcgcaaaaaagtcaagaggctcgtgcaacacgggagatgtgacaactgatgaatttccaaatactagcgtaaccgttgaagaaatccctttacaaagcattccagggaacccaatgaactggccaccttcagtgtcaagttttcagaccatattttcatcttccgaccccacagcagcatcaatgacaaccaatgttgtaaacaaatctccacgaaaaaggcttaggccctcttcggtcatgcaggtcggaacgagcacaacaatggcgattatgatgctgatgatctctttgcttgttgtaccactgaacgcagagaaagcatcccaatctgacttgaaagccggaacaggtatctttctcacaatttcagatttgttcgaactgattggaatcgtggtctctcttggtgcaatggctggattcatgcatgccatatgagtgtgctctcaaagagcaggagtttttgggctacggcctcatctaatcattccattatggaagaaattgttgcgaatcatacagtgacgcctcgcttaacagcgacagtccgttccctgatcaacaacagaccagtaaactgtctggctgataccggagcaagtgtttctcttgcgccgatgagtcttgccaatgaattgaaatgcaaaattttccgacaaatcacaccgttaggtcagcctccggacattggatcaacataacagcagcagcaatggtacacatcgaaattgcaggtcagaaaatttttggcgaaataaaactcattcaggatgaagttatgagtgacagaagggattatcaagtcattcttggatgtgacttgatggcaaaacttccaccgattacttttgattttgttcaaggtctaatcagtatttcaggtaaatctgtaaccatgggagaaagaggggacttgctgtactccaatgtcaaagttgtggcacgtcatcatgttgacattcaaccaggatcctatatcatgctgaccggcaaacttgattcacaaattcaacttgatcaagttgtaacacattcactggatggaggacgactctccaaaatgcatgtcgggatgatctcaactgtcgcaaagcccgtggaaggatgcatcaagatgatattaaccaacccaactgatgcaccaatcaacatttgtgccggaatgcacgtagcacttgccaatgaattgaaacaaagcgcggacggtccatggcttgaggaacaatcgcaagtaaaggaagccaatgtcaatccagaaattactacaaatgacccgtcattcaaaatcaacttcgccaaatcctctgcaacgggtgaaaacctcaacaagttgaaaaagctttgcgctgaatttgctgatgtcttctcaaaatcccaatacgatttaggctcatgccttgtgggagaacatgacatcataacaaccacggaggatccgataactgccaagccgcgcagtacgccatttcgtttcagagaagaggtcagagatcacatgcagaaatggattaaagctggagtaatggtcaattctgacactccgtggatttcaaacattgttttggtacagaagaaggacggagggctgcggccatgcatagatttcagaaaactgaatgagattacagtgcctgatcactttccactgccgagactagaagtcgttctcgagaaaattggcaattgccattggtacacctctttagacttgtcctcaggatatcttcagataagactgaccgaacgagccagcagaaaatgcggcatcatcactgaagacgatgtctaccaaatgacgcacatgcctttcggacttcgcaacgccaccagtgccttcgccagagtcatggatcatgttttttcaggactggaagactctgttatagcctatgtcgacgatttcttgatttactccaaatcgcctgatttcatttgcatttattggcactaa

SEQ ID NO: 59087 - DNA, 2674 bp, Heterodera glycines
  Genomic contig location: Contig_ID=SeqID_5741; Location=35..2708; Strand=-
  SCN-specific regions: Sequence locations=1-27,49-341,363-469,491 -1068,1091-2083,2106-2617,2639-2674
atgccttcatcgacctcagggtctgtattgtcttcgggggcgacagcccaacctaacttttctgatgatgagtcgattcttaaagtcgtaaataagacactgtttcaaggcaaacagcaaaatagcacagtccgttttgaggacgtgagaaagttttggtgaactcatacgactcgaagagggagtcagctgcaccatccgacaagttaaccgcaagtcttacaatgttcaaaatcatcttggcatccttgccaatgaagtcaacgtaggctttcagaccttcaccgctgagatttcgaaagttgctggtaaggtaaagtccctcgaaaacctcaatttagcaaacaaaaacattcaacaagctacggctgtcactcaaccacctgtccctcatcatgctcatcctcctgtacagcaattgggacaccaaacaggacagagacctaatcaaagccaacaaagctctagtagcgatgatgaggatgatgatcagcaacgcaatgcactatccttccaaagtgtcaacatgatcactaatgcgtatcccatggcacttgaaggctacaaggatgactgtgtggtcacatttgacaggtgggcaaaacgctttagagaatacatggatgcatttggtcgaaaactcgatgaaaaggacaagcttgtcaggttggtcatttatttggatggtgttccaaaaagaattttggagaaaatggatccgaatcgaaaggccacaattgacctagctttggctaatttgcgaactgatttagattcgccgcaaagcaaaggattatcgaagcaagcgctgattgcctgtcgacaaatggacagtgagccggtcaaggacttcctcaatcgcttcattccactggctgaagcttcagtgtccgatgtgaaggatgactcacaaaaggaagcacaattacgtgagctatttcttgaaaggctacggccaaacatctcattggtcatgaaaatgttagacatgtcaaggggtaagaaattcgaacacctttgctgggaagcaagagaagtggaaataatgctctcggcgcaggctggaggcctgccatttgttcaaaaatttaagtctgttcaagcaatggacaatcaaaatttgcaatcgaattcgatgacaccgccaggtaactttagaacattagctccaacacagcaaaatcggtaccctccgagacaaaataattggcgaaaccaaccaaggcaatcgaacagaaacgaatcaaggaatggaggacgacaaagccgtgatcgggacatgggccacggccccactaatgatcgcagatggaacaatcgcccatattgcaattattgccgacgtgttggacatgttgccaacgcctgccgtactcgacttcgggattaccagaacgaacaacgaggatcctatggcaatactcgctcacaaccacagagacgcactcctgcaaccggagcaaacgcaattcaacatgataggtcaatcgaactgcttaacgaaattgcgtcggatctgcgaaatctgtcacttgacatgaaccagcataagtctctcaatgatgtgaatgtggttgaaaattcatctcgggcgacagcccttcctaataattctgaaattgaatatgaggcaaattgcccagcgtcaggaagaagctcaccatgggaaggggtccgaatgatgcccagaattacacctcttcttccgttcattgtatttctgattgccataattcttgatttgaatggcgccaaagctgcgtctccttcacttccactgatctgccaaaccgacattcagccgacaatttggggccttcctaaacaagttcactgcctactacccgcagaagtggcatcacacgtgccactcattcaaacgagggagctgttcgtcatcaatgacttcgaacacaacactcaagcatgggtttgccgaaaaataaaaaagaaggcaaggaaattcacaactctctccggcgtgcccatcgttgagccgatcgattccgaacttcttgaaatttccgtcgatgaatgcaaacgcatggtggaacacaaaacgtgtgacttcggcatcttaaccgaacgtgatggactttggggtaccggccattcacttgacttgactccacggctttggcttcttggatcattctcgtggactgacacccagagtgaggattgttttgcctttaaagttcaggtattccatcattttggtgaagaaaccatcagaaccccgcttggaacaacctcacactgccaatatttgtcagggaattgcacactaaatgacaaatcagttttggtttggacacccgaaaagcagttgaattgtaaatacacttcaattgggaaattcaaaggcagatatgtcagcaacacatggctttcagatgacgcataatttggtcttcatttcaagacaaaaactccaaaagtaagtgactgtaacaaaacacttactatttcagagcaaggattcgccacgagaataattgcgaacaagcgaaagcgcaccaaaaggagctacggctcagtcgaacatcttggattggcaacttcgccggaattgaatgccaaactaacttatttggatgatgaatgggttgactcgctcatgtatgcactccgacattccttcaaaaccaatgcgacttctttctcgcgatga

SEQ ID NO: 59088 - DNA, 1591 bp, Heterodera glycines
  Genomic contig location: Contig_ID=SeqID_5742; Location=230..1820; Strand=-
  SCN-specific regions: Sequence locations=1-3,32-245,267-775,828 -940,1004-1148,1178-1231,1267-1591
atgaaaatattattaatatttttattattatgcgcattaatattcaaaaaagcaattaaccaaattgaggctggcaaaataagtcaagaaaaaagttttgctgaaatatttggccaaagatgggacgaaagaactgaagaaaatatttatcgaattgggccaataatttatggacaaaatgctgatcagaataaccaatttggacaaaatattcgtcaatttgatcagaattttgatgaaaatgtggaagtgaaagaagaggagagtgaagaaatgtccacagattgtgatgaattgggcgaccaattgccaatgccaacaaataatggacaaatttatgatcaaattcgaattttaaatgacaaacagaaaagagaaattgttgaaaaattccataaaataaaagagaaagttaagcaaatgggaaagaaattcacaagaaaagaatggacaaaaattgaaataaaaattgcaaaaaaattgggtataaatcaaaagaaaatttacaaatggaaaagagaatttggaatgatgaagaacaaaaattattcagttgaagaaaaaagaataatgttaaagcaatttgatcaaatatatgcaaaattaaaaatgaaattcaatgaaaaattggagggaaaaagagaaaaatgcaaaaaaataatagcaaaacatttggacacaaatattagaacaattttttattggaagaaacaattaaaaagtggaaaaatggtgaaaaagcaaaaaactgatgatgaaaaaagagaaattgttgaaaaatattttaaattaaaaaatgaatttatgcaaaatgagaaacattcacgaaaagaatggaaagaatttaatgcaaaaattaaacaaaagtttggtgtaatttttcagacaattgaaaaatgggacaagaaaattggcttaaatcaaattctttcaaagggtgaaatttttaaacaaattgttatttattaattaaatttaaaaatttttattatttaatatattacagggcagaagcattatacatttgcggaaaaaacggaaaaaataaaacaatattatcaattgaaaaaccaaaacccaaagctcaacgatcgccaaattgcggaaattttaaatattacaaaaagatctttagaaagatataaatctgaattcaagagaaaaagtgaaggtgtcacggattgactgagaatatttttaagctttcagggctattcattgttaggttttgataaatttaaatttcttaaaaatttatatattattcggcatttcattcattttccaatttgttgcttatgtaagagttaaaagtattatgcataatgtttgaaggttgtttttttttgttctattttttgttgtaattgccagggaacggatttatatgtgccaaaaaagctccaaaaggcgcggaacgggctcaactctgtctggccaactccgtctgagccaactttgagtcaatataactcttgaagttattgaccgaatcaaacaatcttgatatcattcgaaagctcttcataggctctattagcctactaaaaattacagaaaatttcgaactataaaaaaagatagaaataaa

SEQ ID NO: 59089 - DNA, 409 bp, Heterodera glycines
  misc_feature (17)..(17): n is a, c, g, or t
  misc_feature (110)..(110): n is a, c, g, or t
  misc_feature (136)..(136): n is a, c, g, or t
  Genomic contig location: Contig_ID=SeqID_5742; Location=1..409; Strand=+
  SCN-specific regions: Sequence locations=1-46,68-409
ttttagcacatatttcnggtaggggtcaactccgtctggccaactccgtcctcagcaatgttcaaaaagctataacttttttctttgttggccaaacttcaccaatcatnggtatcattcgaaagccctagatgtntagaagatatttataagctatttctcagtgattaatcagttctcaaaaaagttgtcagtttaaaaccgcaaaaaaggcagaatttcaaagttttttatttctatctttttttatagttcgaaattttctgtaatttttagtaggctaatagagcctatgaagagctttcgaatgatatcaagattgtttgattcggtcaataacttcaagagttatattgactcaaagttggctcagacggagttggccagacagagttgagcccgttccgcg

SEQ ID NO: 59090 - DNA, 1133 bp, Heterodera glycines
  Genomic contig location: Contig_ID=SeqID_28472; Location=37..1169; Strand=+
  SCN-specific regions: Sequence locations=1-80,102-119,185-190,280 -401,423-475,583-937,967-1112
atggacaaaaagccaaaagaacgcattaaaaggggacaaagtgtgcaaattgcaattgttgtcactgacgaagacgcagaagaaggacaaaagacggaggagaaaaaaatgtaaaggaaaaaaagaaaaacaaattaaaaataaaattaaaattaaaaagataaataaaaatataaaaaaataattacagtaatatttatagaataattaaacaaaaaataaacaattcgtaataaaaatatttaaatagaaaacataaatcaaacatttttaattttagcgctttttctgccaatcaaaacaatgtgaagccaaaaagcaacaaaaagcacggaagaagcaaaagcggcggagttttactcgtaaaatcggcgggcgttcattgggaagaaacaaagtgaaaagaaaggggaattaatttgaataattagcaattaattgttcatgatagaacgctttttaggtaacaaaacactttaaatcttaaatatttcaattgaaattattaaatattttaatgtttttttcgaatatgaacaaatttttaaaccaaaaaatttttattaagaaaaaaaaaattaagttttgggaccaatttttgaaaattttttcaattcttagggggtgtattttctgaaaaattttttgagtaatttcttaggggtgtatttttcgcttttattgcatttttgttaaggattttttcgaaaatcctaaaataggcacaatatgtaggcacaaaaaccccgaaatagtcaaaaataggcattataaaagtcatcgtagacaccccaaaccaagcggaaaacgcgtttttcgtgcttacctatgcgtatcaagtacgcaaaaattttagcatttgcctaaaaaaggaagccctagtaattactaatcataagctagcgcaaatatcttagctgacaattttctcatccaattttttatcattctttggaatgggaattgtaaaataagcattaaataggcacaaaaaacctcgaatagatagtaaagcacaaaaacttaatcatcaattgttaggaaaaattttcaatttttagaggtatattttctgaattttttagtcgattcttattcacgcaattctcatgtttaattattagctaaaaata

SEQ ID NO: 59091 - DNA, 384 bp, Heterodera glycines
  Genomic contig location: Contig_ID=SeqID_28475; Location=869..1252; Strand=+
  SCN-specific regions: Sequence locations=1-241,264-361,383-384
atggtagccgcgccagatgaagcgcaatttcatatttcgttttacactgacgaagaagagtgagtaagagtcaaaattcattatcatatatagagagcggatatttttacaaaaaaaaacagccttgtttaggtgtaagaatttgttgcctgccgagtccatcaatgtgcccgcgtcttcgcactcggaccaactcaatgtgttgatcaaccaaatcgggtcgatgaacgatggtactttatctttaatgattttgcaaatgttttatgcaactcttgcaaatgcattcttcacttaaaatgttcggtgcttttcgggtttttcgactttcaaatatagctcgacttttcgacccccgggtacttggtttcaggactttttaaa

SEQ ID NO: 59092 - DNA, 1236 bp, Heterodera glycines
  misc_feature (265)..(265): n is a, c, g, or t
  misc_feature (1180)..(1180): n is a, c, g, or t
  Genomic contig location: Contig_ID=SeqID_28476; Location=611..1846; Strand=+
  SCN-specific regions: Sequence locations=1-44,67-88,111-203,225 -522,544-827,849-1236
atggctaatgcttttgacatggatttagaagtgaaatttgaagtattaaaaaccaaagtgaatgatttggaggaaaaattggcaaataaaatatccacaaatttaccctcaggagttagggtaccaaaatttgatgccaccggggatttccacagttttttacgagattttaacatcttggccaccgtttccaactggcatccacccgactgtgtcaggatgttgccactttttctggacggtgaagcaaaagaattatttttanatatcccaccggacaagaaaaaaacatggagagaattaactgatgctctggcagagcagacaaaaaaaattgatggaccaatgtggccaaagaaaatgctcgcgcgtgtaaaaatgggtaacgaaagtattactgagtttgccaataaagtgagagaattggttgaacaagcatccccaagccctaaatacacaaaagaagctcgggaggatgagagtgtccattttttcttaagcggtctaccgactgcacttaaaagaaaattatttttcatggataagccaaaatcattggttgaggccatttcccaggccaaaaaggtggtacaagtaagggaagagctcgcaaatgatgcgcgcggagatgagctgaaacaacaaatttccgaattaagtgagaaagttagcgcaattactgtgcgtaataacgggaataatgagagaaacggtcgagaattttttaattcgaattggagaggaaataataataattacacccaaatgagagggtatgcaaataacaattggcgtggaaatcaaaacatggtcaggggtcgaaatatgggaaattttaataattttaatccgagaaatgccaattttactccgattggtcagaatcggaattggaatcgaaattttggtaatcgaacaaatttcgaaaattcgcgatttcaacggggaaattttaacaataatcgaggtatgagaggaaggggtaatgaaaggcagaaataccgaataaatgcaattgggaataatgaggaaattccgtcttcttctacccgtaaatcgccaaccccaacaatgacatttctgacgatttcaatggttatattttcactgtttggtctaatcaatggccaatatcaattatgctccgagagagtgccaacaactcctatttggctcccanaatataaccgaatgttcaggggggagagtacaagaaaatggcagaaaccaaagtga

SEQ ID NO: 59093 - DNA, 258 bp, Heterodera glycines
  misc_feature (17)..(17): n is a, c, g, or t
  Genomic contig location: Contig_ID=SeqID_28477; Location=869..1126; Strand=-
  SCN-specific regions: Sequence locations=1-258
cagaacagtggcgacanttgaggagcagtacagcacactgcaggaggagtcccaggggatgggcaaatggttgagaaaggggggcaattttaaaaaagaatataatttctccacattttcccgttaaacggtgcaatggatccaacggcaactactaacaataatcaaaggtgccgcaagatgaacagaaatataaaatatcagaaataaaagacactctttaacaatgcgagccatacatacgtcaattttgtttta

SEQ ID NO: 59094 - DNA, 118 bp, Heterodera glycines
  Genomic contig location: Contig_ID=SeqID_28481; Location=290..407; Strand=+
  SCN-specific regions: Sequence locations=1-118
tgtccgtttggggtactcaaacaattatggggagcaaaaatccaacgcagaattaaagtcaggctatagggaagctattcccgaaggattcggtctccccataaatctgggcgcatcg

SEQ ID NO: 59095 - DNA, 345 bp, Heterodera glycines
  Genomic contig location: Contig_ID=SeqID_5744; Location=490..834; Strand=+
  SCN-specific regions: Sequence locations=1-146,168-345
atggctgaggccagaaatattgctgccttaagcttcaccgtaacacacgatggcatttccgtctcttatgaccaggaagttctgcgggacatttggcacgcgttttcacgcagttataaaaaacgcatcgcaaaattcgaggtttgcttttatttttgatatttacttttgtatttcattaactttcgtgttttccagaatgatttcttcgctgggattttcccagccaatatccgttcgttggccattgtcattttccttgtggccgcattgaatgtttcattcggaaatgacaaaactccgttcaatcttgccgataagctcaattactacgtcttttcctaa

SEQ ID NO: 59096 - DNA, 994 bp, Heterodera glycines
  Genomic contig location: Contig_ID=SeqID_28482; Location=136..1129; Strand=+
  SCN-specific regions: Sequence locations=1-42,64-275,298-665,696-994
atggtcgtgctgaatgggactcgaaagcgcatcccttcgcctaatcagccccaattgcaggaggatgaccgcgatcggcttgcccctctgaaaagtgccacggacggtcggcattgttttacgcccgccgtcggttactccgctcgtccctctactgctgccgttgactcgtcccaatgccattcgacaagtggcggcagacattgcgccgatttttccaatggcttctaccgtaccaccaccgtcgtggctaacggcggcggacttttgtccctgggcagccccggcagcggcactctgatcggagcggagcagaagtcacggtcaaccggaaatttggacaagaatggtgaggaagttcgggcatgggtcttttgcggcgaattgttttttttactttggtcgcgtttccgcgagaaatgtgctgcgagaatctcgactcgggaaatccttgacttattttatctcgcttattttttggttaaattttgacaaattcattgtctctaaaggaatctgtccaccaaatgtcggtgccgttccctcgacttctgccggccaacagcggagcttttccccatcgtcgcgcggccgtgccgaacgcggcggcataggcccacgactccaacgagaacatttgaaatacggtagggttgtcacggtaattagttttgttttggtaatttctcttttgttcaggctcactgcgcaattgtgccttaatctcatcaagcagttcgtcaggcggtcaacatcaattacggcaccaattcagcacgacggtgcccccgggggacgaattgtgcggcgaagcagcgacggcagagcaacagcagcacttaggattcattttggaccgtctgaacgacgggcagcaccaaaatcaacggcacaaagacattgacgagaacggcacggacggaatgccaaggccaaaacaaacagcggaagaatgtgtgagttgctaatgaggggggaagtgggcaagtcggta

SEQ ID NO: 59097 - DNA, 235 bp, Heterodera glycines
  misc_feature (79)..(79): n is a, c, g, or t
  misc_feature (134)..(134): n is a, c, g, or t
  Genomic contig location: Contig_ID=SeqID_28483; Location=126..360; Strand=-
  SCN-specific regions: Sequence locations=1-235
atgagcggtgattacagcaaagatgagctgatggcttacatgggcgaagcgaaccgaatttttgtcggattcagacaanctttgtgagttttttctcgatatttttacattttattgaattcgctcaattattnggaatttttcagggttgagccgacacttttggctttatcaatgaatggttgagtcatccgagcagcagctcaaatgccgaaaataatgatgaggtaataaa

SEQ ID NO: 59098 - DNA, 83 bp, Heterodera glycines
  misc_feature (43)..(43): n is a, c, g, or t
  Genomic contig location: Contig_ID=SeqID_28488; Location=1..83; Strand=+
  SCN-specific regions: Sequence locations=1-83
ttttcttaagaaccatgggtgctctatccacccaccaaatttncatttggaaatcccacggacacctggggaccttcctttgt

SEQ ID NO: 59099 - DNA, 873 bp, Heterodera glycines
  Genomic contig location: Contig_ID=SeqID_28489; Location=786..1658; Strand=+
  SCN-specific regions: Sequence locations=1-110,132-873
atggacccgggcaaaggattatatgacaaaaatgtggacaaattgacattggccattgatgtcacagtgccaaacgaaaggaaagaacgcatttacgaaccaaatgggacaattgaaatggaaattgaaaatttgtcggaatttgcgcgagaagcctttggaagcggacgttttagcgaatccattctgttcatcaaagaacttccgtggaaaataatggcacaaataaattcgaagaatggaaacactgatcagaaatggttgggcttttacctttggtgcgctgctgcagaaaaaggtgaaatttgaacttctacactaattaagaatctgggccaaaactccaaaaatccataatttttctataattttcatcgtaaaaatatcaagaaaaagttttttttttttttggaaaatccatgaatgttcagaatttctaaaaatcaagcggcccgccaaatgctctaaaaagcaccaatggcaaaatatgcattaattctcgaaaaccaatatgcaaaagcatagaatttatagtcctattgatattaaggacgaagagaagtcatttctttgaacgagtggaactcagattcagcttggggtaagcaaatctaactttataagtaaatttttcgactcgagaatttagactttttcaagactttttcaagactttttaaaattgaatttgtttaatgtcattattatctttttttatctcattaagaagaaaattggagttgcaaatgttcggcaaccctccgaattgtttcacaaaaaggcgatgtgacggatttcagcagagatttcagtggccaaatttttaaccaaacgtcatacagctcgggattcccatatttcatcacttttgag

SEQ ID NO: 59100 - DNA, 425 bp, Heterodera glycines
  Genomic contig location: Contig_ID=SeqID_28490; Location=20..444; Strand=-
  SCN-specific regions: Sequence locations=1-317,339-425
atggcaatttttgttggccactcgcttcatggtcggcttgtccattggtggcactttggtagttgtctgcacatttgtcatggaactgattttgcccgcccaacggatggtcagttttattcgtcattcccgtgggcaatattattgatgtgaaaagccgaaaaaatccactcgataatcgagcttttaagcgagaataattacccaatttttaggggcagtcattccttggaaaaatcgttttcacaaatctttaagtgtaaaaaaaattaagcccaaacagatgagaaaagatgtcagttagaagattcaaaatttgaaatctttctcaaggatatcgagcactggtgctctaatttgaaggcctaaatttttttattttgaggaaaaggctgaaccaaaaaggtgagaatatgaaaaataaa

SEQ ID NO: 59101 - DNA, 685 bp, Heterodera glycines
  Genomic contig location: Contig_ID=SeqID_28490; Location=654..1338; Strand=-
  SCN-specific regions: Sequence locations=1-301,323-417,440-555,577-685
atggcacttctcaagatttgtcttccacaaaaaattggcacaaattctcgcgtgattgtgccgtgttcgccgctgtcccgccgatcagctgcacttgagcagccgatcccattccattcaacggcactccaatttgggtggctatgcggtgccgacgcgtacaagcgtgccctctactcacaggtgggtacagcaaaaatggaatttctacggcttaggttccaaaaaaaaactggaaaataggccctaatttatataattttgggggtataaaattgctcctgtaaattcattgccaatttatatttttgttgaaaatcttaacagttttttttggagggggcgctttttgaacatttaaaaggtaattttcttgtaggaataggtgtataattttttattgcaataaattttaggaaaaatgccaaaatactttaaaaatcattggctcaaaaaagggaacaatctaaggcaactctgctccctttcttaatatccgattttttccggagtttaattatttccgcacactgcccatatccgaaagatactctaaaaaaggattttctataataagcctatttaatgttacaattttttctgtgccttcttacccgggatactgtacaaagaacaaatggtggttacagtagtgatacggtaaccaaaaacaaaatggaataaa

SEQ ID NO: 59102 - DNA, 298 bp, Heterodera glycines
  Genomic contig location: Contig_ID=SeqID_28490; Location=1523..1820; Strand=-
  SCN-specific regions: Sequence locations=1-131,153-254
atggcaattcgcaattttcttcgcttctcaaatgcttttcccggtatgtcaatgaaaaacaataagcccaaacagaataaacccaattttacatggtcaatttgatgttttgggctccaattaaagaaaggttttttaaattttttaataaacacattttgcagaaaatgtttatttttttaaagaatcgattattctcaaaaatgatttgttctttagctttttgaagattggttttttgaaataaataagactttattttttactttcaaaaatttttctattaaaaaataataaa

SEQ ID NO: 59103 - DNA, 984 bp, Heterodera glycines
  Genomic contig location: Contig_ID=SeqID_5745; Location=1094..2077; Strand=+
  SCN-specific regions: Sequence locations=1-247,275-899,921-984
atgccaactgtacgtgaaatacttgagagtctgcaaaatccaattaaaaggccccgaattccaacaaatgaagacagcgtactgaatgctgagaggacagacgcagaacaacaaatggaaggcacgtcaaccaggaatgatttggacgtcgctgaaagcgatgatgaagaaaattgtgcgcctgttcatttccaacgtggcaaaacaatccgaggagcgctttgcatttggcaccaaggtcttaatagttttttggggtttcatttgtttatttttaggcttccgatttctcaaaatacgaagcgatggaagctggttcaggtgcgaacggcgcaattgccctgcgacagcaaaattggaagatgaggaattgacgggcgttttgggtcccaaagaacaccatcatggtcttgccccatcgcgttgatgcaccagtgcgattcggtctgcattcgccgcaaccatcgactccaacaattccatcgacagaagaaagcagtttggagcttattcgacgatggggacacgaaattgtccgtccaccacgcttccccataacgttttggaatgtgcacatcagggctcaaatggcacttgaaaggacgaataacggcatggaagcacggccaattcgcagtataaagcaatacatttcagaaaggcatttatttttttggtcagcgtgaactcaaccatcatccatcatttagtgacttcattgctgcattcactaaggacattgacaaacagttagacatcggacgcgcagaacagctccagaaaagcactaaacgacgacaacggtacatcatcaaagaacaaaatgtggtgcggatccttgacgaggccgactttgaatcggaagaaggattgacaaattctttgcacctgctcgggctcgtgatgcaaggctttgtggaggggcttcacgttcgtggaaatgaagagagtggtgaagaaactgatgatgccgatggaaattaa

SEQ ID NO: 59104 - DNA, 2250 bp, Heterodera glycines
  Genomic contig location: Contig_ID=SeqID_5746; Location=1..2250; Strand=-
  SCN-specific regions: Sequence locations=1-561,583-937,962-1001,1023 -1125,1147-1165,1188-2142,2165-2250
atcgcaaccaccgagactcaattctcctgcattccaatcactcgggactcaattctcttgcatttcaatcacagggactcaaatctccaggacttcaatcactgggactctattctcctgcgtttcaatcacccggactcagtttttatgcattccaatcaccgtgactcattctcctgcatttcaatcactgggactcaaccctccagcatttcaatcactgggactcaaccctccagcatttcaatcactgggactcaaccctccagcatttcaatcactgggacctaacctcaccggtccttcggcatcgcaatcatcgagactcaattctgcgatattccaatcaccgggactcaattctgcgacattccaataactgggactcaactaaccagcattccaatcactgggactcaattctccatcattcctattcccgggactcaatcccaccagcattccaatcaccgaggactcaatccttcactattccaaacaatgaactcaattttacggattcatcggcatgtcaatcacgggacttaattcagacctgttcagcataattttggaattttaaaaacgtatttctattatgaaatacaatttgcgtagaaaatccttttcataataaatacttgttctcttacattttaataatttcttttacataaacatctacatacaaaaaaagaacaaataaactgaccttatatcgttaaaagaaacttatttttgtcaaaacaaacaataagtgcgataaatccatccaattaaaaccgtatccattaaaagaggcataattgacatccgctttaattacaaaaacaaaaaaactccatttcaaggtcaaacaatttctcgaaccaaaactttttcaatacaatatcaaaactaagtgtaagatcatttccattgactttgcatatacaaaaacaattctttttctttacaaaagtgttaagagcaaaaagcactttatgatagcattagtttacacataaaaatacaaacaaataaatttcactcgcaaattgagaaaaaggctatttcaaagggaagaaattccatttttaaatacctacaaaaatacgatgttaatccctttgaaataccgaatttagtctttgaaaacaaatgctatcatgatggtgatgaaaaatgtgaattatttgccaacttatttgcaaattcgtttaacaattctgatgttgacccaggctacctaaacttgggcaatacttttgttaatcaatgttttatatcagatatagactttaacatcatcgagacacaaaaacttttgaaaaaacttccgaataaaaacgggacctccccggataatattagctataaaatattgaaaaactgccattcttcattagcaactgttattactgacctattcaggatttcattagactctggttctcttccagatatctggaaggaatcaatagtttttcctcttttcaaaaaaggggacaaatttaatcctgaaaattataggcctatttctataacctgctcactttgcagggttatggaaagaattcttagccaaaatatttacaactttctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaattggtataaagggcaaacttttaatgtggataaagggctttttgagtaataggacttttcgagttaaaattggggattctttatcctcaagtaaaaaagttacctctggcgtcccccagggctctgtcctgggccctttattatttttgatttatattaacgatcttcctgatgctttgccatcaggagtgaaaataaaattatatgctgatgatgttaaattatatatttgttataaagcaagaaccgacacagaaattatgcataaagcattgcataatttattcgaatgggcaaataaatggcaaataagagtttcaatgcaaaaaacttttgtattatatttgggttcaaaaaacccaaaagaaacatataaatttgatggaaatagaataaatgctgtggatacaattagggatttaggagtaaaaggtgataataaattacaattttccgatcatattaacca

SEQ ID NO: 59105 - DNA, 693 bp, Heterodera glycines
  Genomic contig location: Contig_ID=SeqID_5747; Location=339..1031; Strand=-
  SCN-specific regions: Sequence locations=1-265,287-435,457-693
atgccacagcaggacgaagcagggccgtcaacatctgctgcatcaacagaagaagcgatggaaccatcgccatcaactccaggaccagtgccgacgcccgagatggacgaggaaatcttggaatttggcttttcgctgccgtcgacatctgtcacaccagtcggcgatttggtgccgttttcgacaacaccaactgcgccaatggacaccggagagacgatcccgccaccgctggccattgacgagcgatcagagcgcatcgaacagctggagaagcagctcaaggaccgggatgacaccattcaatttctgcgcgagcaggtccgaaaccgagaagcgctgatcagtgatctgcgtcgtcagctggagcaatgtgcggcaccaccaacggcgacaccaaccaccagcaaaagtgagtgaaatttcgatgccttctcttttcccaattaattttctcaaaaattgatcattcattttttgtcaattttagcaacgccaaacagaggaagaccaaggaaggccatcgacgaactccaacgcagctcgcgaaaacggttgacggagcagattttggacgccattgatcgggaccgatcgagatcgtgctgtatccacccaccaaatttcattcggaaatcccacggacacctggggaacttcctttgtgagacaaaaattcaaatctttttgtaa

SEQ ID NO: 59106 - DNA, 75 bp, Heterodera glycines
  Genomic contig location: Contig_ID=SeqID_5747; Location=1452..1526; Strand=+
  SCN-specific regions: Sequence locations=1-75
tagagaaaaaagataatgtttttctctggcactctctatttattggtacacatctcgttttatgaaacggtgtgt

SEQ ID NO: 59107 - DNA, 761 bp, Heterodera glycines
  misc_feature (690)..(690): n is a, c, g, or t
  Genomic contig location: Contig_ID=SeqID_28492; Location=851..1611; Strand=+
  SCN-specific regions: Sequence locations=1-175,220-258,316-378,416 -538,569-581,611-718,749-761
atgcctgctgagggatgcaagctcagtgttggataccttaaagaaacggtgagcaattcgtttctgttcaccaaggggttcgaggaggaggaggaggacaccaagaagggcagtgaccaagcaaatgcttctgcaggtgagttgacggcgggacgtgaaaaaatttcgccgcaggaattttttttaaattaaattttcaacaattttttcaagaaaaaatcttggtaaatcattttttataagaaaaattccaagaagaaaattttgaaaattttttttaataatttgttgtatattttttttttaataataattcaccataaaatacaaatttttcactttttttagaatttcggctgcgagacctttagatttctctatttttacataatttaaaatattttcttttaattttcagaaaaaagatagggagggtattaaatattctgatagaaaatgcttatagttaattgtccaaatgctgagtcggaattctgcatttttttggattaaaatttcgttgaaatttcggcgtggctttttttatatttaaaaaataaaaaattttccattttttgtaccaaataccttaaaatttcttgaaattttatgcctcatcagaacaaacaacggctgaaccaagcacaagcaaaaatcgtcgtaaaaaatcccaatttttgtacgacccanacgatgaggaggacacagtccaggacagtgatgtcgacgatgatgatgatgatgatgaaagcgcggatgag

SEQ ID NO: 59108 - DNA, 383 bp, Heterodera glycines
  Genomic contig location: Contig_ID=SeqID_28494; Location=408..790; Strand=-
  SCN-specific regions: Sequence locations=1-42,136-148,171-263,285-383
atgagtgtgtgccgagttggagaatgtgcggccaaagcgatgtattatttattataagtcattaaaacaataataataaatataaatattaaaatttgataattcaaatataattaaaaatatattcaaaaaaatgtattagaattacgttttgttttcttggacaaatggacccggcaaatgcacgactgaattcgcagtatcacatggaaaattatgaggaggacaataaaattgcgaccaaatgcaaaatggcacagcaaacaaaatgggcaaaacattttgaacaggacaaagtgctgcacggctttcaaattgtaatgagtgaaacggatgaggaaaaagctatggatttgtacacatcgacacaccaagaaaagtaa

SEQ ID NO: 59109 - DNA, 483 bp, Heterodera glycines
  Genomic contig location: Contig_ID=SeqID_28498; Location=378..860; Strand=+
  SCN-specific regions: Sequence locations=1-216,240-483
atgccaatggtgccattcgaattggtgaacgaatggacaaaggaaaagctgacattggccaaagaaaacgaaaatgacttggagaattggataatgaagcgatgcaaaattggagaggccgcggatgttcagcttcagaaagatgaaaattggggcaacaattttaacaatgtgtccatttggcttttcagtactaattgcatcgggtgagcaattaaaaaagtcatttaattttgtttaagtaattaaaatttcgcttaattaaggccattgtctccgccatcagcagaagaacaacaagaagcaggacaaagcagcgaaaaaggggcgtcgtctgctgacaaatgagtgacggacaaacgaacaaaaacaatgatcagccgcagaagaagaaatgaattaattaagaatgatcgatcgaccgatcatattcatccgtgatcaaatgcattttatgaagaaaaacctctcaaatatatataa

SEQ ID NO: 59110 - DNA, 298 bp, Heterodera glycines
  Genomic contig location: Contig_ID=SeqID_28500; Location=1294..1591; Strand=-
  SCN-specific regions: Sequence locations=1-298
atgcctgccgaagagatttggcaagaattcctcgacaaagatgaggcaaacgtaaataactttttttaaaatttttttgtctttcgataattattttattaaaactaggttatacgtgaatttttcggtggaaaagctgccatggaagttgagaagagcctacgtgaatacgccaagaagaaagaaaagagagatgaaattttgatgagaaagcgaaaagaataccaacagaagatggaaaacaacaaggacgaaaattaatctcgtaatgttgttgttaaagttgtttgataataaa

SEQ ID NO: 59111 - DNA, 103 bp, Heterodera glycines
  Genomic contig location: Contig_ID=SeqID_28501; Location=734..836; Strand=+
  SCN-specific regions: Sequence locations=1-103
taatgttttgtatgttttaaaataacaaatgagggccatatattaccaagccacgtatgcacaccatagccaactgggcaccctagttatatatacgttatat

SEQ ID NO: 59112 - DNA, 1226 bp, Heterodera glycines
  Genomic contig location: Contig_ID=SeqID_5748; Location=459..1684; Strand=+
  SCN-specific regions: Sequence locations=1-45,70-181,203-223,246 -295,410-443,481-560,582-645,672-1226
  Gene Ontology: Mol. function=carbonyl reductase (NADPH) activity; Cellular component=cytosol
atggccgggaaaatttttgtggtaaatgaaagaattttttatgtgaaataattttaaatattaaaaattcaggtcactggcgcaaacaagggcattggttacggcattgcgcgtgggttggcccaacaagtgaatggtgccaccatttacatgacgggtcattttttatgggtgcacccccaaaacctcgctgccgaaatttatataaaaaattccataactgaaatttttcaagaataaaaccatataatttttttcaaatttcatacttcgaaattatgaaaattttggtagcttttttttagaaatttaaaaaatatataataataaataataaaactttgaaaatattgctaataaatttaaaattttcttacaaaaaaaattctgatatttttgaaaaattaaagtttgaattggtggcgcgattttgtcccgtgcactatttatttatttatttttgaaaaatttaaatattttgattttcagcacgaacgccttcactaggcgaaaaggcattggatgacttggagaaggaattgggcacaaaacgcatttcaaaattggcatttcatcagttggacatcactgatgagaaaagttgtgccgattttgcggcatttttgaagaaaacccacggcggattggacgtgctcatcaacaatgccggctttgcatacaaagtcggcatttttggatttaagggtggcaaaattttgcctcttaaaactgcagcataatgcgacagagtcggccgcaatccaagccgatgttacgattggtgtcaattattatggtaccaaattgatcagtgatcagctgggcccattgatcagagacgggggaaggtgaggtgaaggggcgcaattgacggcacttttccgttagggaccgcaattctttgccattgccgaaaatttggcatgacgaagaagtgccgttaatggatgacaataatacataattaggcagcctaataaatttgccaatgtatttttttgtgtgtgtgtcagaattgtgaatgtgtgcagtcaaatgggcgtaatgggcagtcagattggtgtgatgggcaacctgtacaaacaggcactgattgatcagttcaaacatgccgatgtcacttcggacgatatcaacacatttgtggaggaatacaaaaagtgggaacattaaatcccaccaattttctttttttttcggaattttcgggggataatttttaaaaa

SEQ ID NO: 59113 - DNA, 450 bp, Heterodera glycines
  Genomic contig location: Contig_ID=SeqID_5748; Location=2371..2820; Strand=-
  SCN-specific regions: Sequence locations=1-368,400-402,433-450
atgaaagcttttggcaaattgaaggactatccgcaaggctcgcgttggttccatgaacggctaaaaaacgcattcgcacgcaacgccaatgtgcaggaagaggccaaagtgcgcgagctgatcaaacggggcgagtacgtggtcaaggagttggaggtgttttttggccattgacaaaatgtacaaaaaaaaagtgccaattattctgggataaggcaagctaattaccacccttccgatttgtttctcttttttttttactaatttaactcaattttgtgattttaaggcgctttatcggctgcgcaaatacagggcaatgaagaacagatattacaatgattaaatgtaaaaaaaaacattaagccaaacaaacacacatttatttgaaaaagctttcacattattaaatatttaacttaaaaattttttggaatatccacgaataaa

SEQ ID NO: 59114 - DNA, 295 bp, Heterodera glycines
  Genomic contig location: Contig_ID=SeqID_5748; Location=2785..3079; Strand=-
  SCN-specific regions: Sequence locations=1-111,135-295
ttgaatttttgttcgagtccgggtcaggggttcgaaatgggccgaaatgatatcagcatcaaattctacggcccacataaaacagttttatttcgaaactttttttgaaaattttctttttcaaaaaaggggggtacaaagtacactattaccgagcctgggaatcatacaaaaatggagcaatagagcagttcgcgcacaataaaaaacaatgtaataaataaagcttaaggcttagcctagcacccaaataataagcatgaaagcttttggcaaattgaaggactatccgcaa

SEQ ID NO: 59115 - DNA, 130 bp, Heterodera glycines
  Genomic contig location: Contig_ID=SeqID_5749; Location=231..360; Strand=-
  SCN-specific regions: Sequence locations=1-130
atgtccatcgttggagggcactcgcttcgtgccgaagtgattcaactttacaagacggtacaaaaaaaaaattgtttttgctattgccaaattatcatgtttgttcatttagctgtaccacttgggcaag

SEQ ID NO: 59116 - DNA, 122 bp, Heterodera glycines
  Genomic contig location: Contig_ID=SeqID_5749; Location=1..122; Strand=-
  SCN-specific regions: Sequence locations=1-122
ggcttttaccatgaagccttggtcaagactcggagaatttgtcttttaaagaaaattttttttcgaaataatgggttttctgggtcatagaattcgattctgatatctatttcggacccctg

SEQ ID NO: 59117 - DNA, 386 bp, Heterodera glycines
  Genomic contig location: Contig_ID=SeqID_5749; Location=931..1316; Strand=+
  SCN-specific regions: Sequence locations=1-175,197-218,240-386
atgaaatcccaaatttttgggaataatttaggtttccggtaagttgagaaaattcgtaaaaatgctttcgaatcacaccatatttgttaattttagtcaaatatataagaaaaagctacaaaattttacagtttttttttcggggcccaaacttccacaggccatttgggaagtgaaaaaattattgtacaatttagcaaaataatcctcaacatcgatatttattgtatggagttttcaagaggccatcattgtggccaattggtcagcggaacagtgccacaaatcgggcatacgaacacagttgaggaacagctggttgaaggacgggttgagcaggttctcctccgccgagcattcctgaaaaaataatatgggagtagaca

SEQ ID NO: 59118 - DNA, 88 bp, Heterodera glycines
  Genomic contig location: Contig_ID=SeqID_28506; Location=522..609; Strand=-
  SCN-specific regions: Sequence locations=1-88
ggattatttttcaaaacacctcgtagcctgggggataattggagactgcgggattaatagagactgggctataattagagcatatacg

SEQ ID NO: 59119 - DNA, 193 bp, Heterodera glycines
  Genomic contig location: Contig_ID=SeqID_28511; Location=125..317; Strand=-
  SCN-specific regions: Sequence locations=1-193
atgcaatgctttttccatgtgatcagtgccagcataaatgaacgattggatggccttcattcgccgttgccgatcgcatttgtaaaagatgaagtcaatccgatccggcggctcattggacacattgcccgtgcatggccaagtgtagccttgatggaagcattggtttcaatgttaaagttcaatgtccaaa

SEQ ID NO: 59120 - DNA, 2158 bp, Heterodera glycines
  Genomic contig location: Contig_ID=SeqID_5753; Location=1226..3383; Strand=+
  SCN-specific regions: Sequence locations=1-236,265-269,316-318,341 -357,398-420,446-481,504-633,663-682,704-961,984-1289,1311-1784,1818 -1818,1843-1856,1885-2158
  Gene Ontology: Mol. function=5-methyltetrahydropteroyltriglutamate -homocysteine S-methyltransferase activity; Biological process =cysteine metabolism
atgataaacggcggagactgcgccaaagaattggcagagaacgacgcccttctcaaagaccattccgtatccccgttgatacacaacggaacagtgaaggaaagggtcaccgccattgaggtggggagggcacggcaaatgacggcattttcacctttgccttagccaaatcgtccatttcttttcccattctttttgaaaacccatttgaattgctaaatttcgccattttcccaggcttctggcgttgagtcatacttccgtaagtcgccctatgagcagcgcattgtgcagcagaaggcgtgcctgcagctgccgcccctgcccaccaccaccatcggctcgttcccgcaaagtgcgacggtgcgcgcgatgcgtgccaaattcaaagcgcacaaaatggcggacgcggattattgggcatttatcaacgcggagacggagcggtgcattcggatgcaggaggacattggtggggcggggaggaggaaaatgggcaaagtgttgaaaaacgataattttcaaatgccattttataaattgggccaatccatccaatggccaaccaatcaatcaatctgtcgtcattcgtcgcctttgtttaggtttggatgtgcttgtccacggcgaattcgagcgcaatgacatggtcgaatatttcgctgaacatttgcacggcttttgcgtcacttccaacggatgggttcaggtgatttttcgatttgtttccgacactttctcttccattttcaattccttcgcttttttcagtcctatgggtcgcgctgtgttaagccccccgtcctttacggcgacgtgcaaagggcgggcccaatgaccgtggcaatgaccaaatttgcgcaatcgttgaccaaaaagccggtgaagggaatgctgacggggccaatgaccattttgaagtggagctttgtgcgcaacgaccaaccgcagaaggacacccttttccaggcaatgaaaaatcattgccaattaattgttgggatttctcatttttaggttgcgttggcattgcgcgacgatgtggccgagttggagaaggagggcatcaattgcatccaaatggacgagccggcattccgcgagggattgccgttggacccggcacagcacaacgaataccttaagatcaccgtacaggcattcaaagtgagttagttgctacatagtcgtatcattgatttgaaatttcaatctgttcctccctcacaattccccccattttttagatttccactggttgtgttgcggactccactcagatttattcccacatgtgctactccgactttggcgacattttcacgcacatcgccgagttggacgcggacgtcctttgcattgagtgctctcgctcgggtaaaagcatttcccctttctttgacgctttgttcagatttgagtctgctctcctgctttgaccgctttggctatccgttgatggtcggccccggcatttacgacattcactccccgcgggtgccgtccgtcgacgaactgaaggcgcgccttcgtgcgatgctgaaatacatcccggccgggcggctcttcgccaacccggactgtgggctgaagacgcgcgattggcccgagactgaggcggcactgcgcgcaatggtcggcgcggtacgttccgtccgtgccgaattgaaatgaaaaagaaccaaagaacagcaaagaatgtgccattttcacttatggaatcctaagaaatcttaattccccttttataataagcatggttttattcgtatcacttttgacactttttaattaattattttgtttatttattaaaagtttttctgaaattacatttttattgtagacgacgacagaatatattaataaatatttaatatttttcaaatcattaggattggaaatttaagtcaaatggttttttctggtgactcgaaattgcttcaaaacgtgatgagtcgaagtgtcaaaagtatgggtaaggggtgaccggaagaggcgggtcatttcagtacgggaaaagttatttaaataacttaattgaataacatctaataataacaaatatatttgtcctctatttcagtttagacgaccacaaaaaaagacaagaccatgtaatattttgacaaatttcatgcaccataactttttatag

SEQ ID NO: 59121 - DNA, 1023 bp, Heterodera glycines
  Genomic contig location: Contig_ID=SeqID_5754; Location=1407..2429; Strand=+
  SCN-specific regions: Sequence locations=1-544,567-673,695-992,1014 -1023
atgagattcttttctacaaaaactttccgcgcttcgacgcgtccctccgtctgcccaaattttacttcggttccgactacagtcccagccacagtaagtcgatctgaccgatcgattggcgcagtttgcccagcaacggaagcgcactgatttctcacacactttttcagccaggaattgtgtccgcttttgtgatcagtgattttcccttcagataatgggttgatcatcatggaggacctgagcagccgcgcttcgtcccttctcactttgccaggcttcgacgatgcccatgtgctggtggtcatcgacgaactctccaaaatccacgcaatttcttggaagcacggcgaactgaagcaacacttcccgatcgaaattcggcccagttttatcgagtcaatgcgatctaacgcgaaacaattggcaaaggcaaaagagcaaagcaaattcaaagtcgaataatttgttcggatttgcagattgagccgaatcaggtcggcccactgatcgaccgtcttttgtcaatgttcaatgtcgattattacgccatggcattgtacaccggagacaaatacggtcagtgaaattggcattggcacaattttaaatgtgcttttcggcttcttaaaggatttcccagttgcattgtgcacagcgacctttggtcaccaaatattttgtgggagaaaaatgccaacggcgaacccagcgaccgtttgtgtgccatcatcgactggcaaacgcttcatgacggcaacccgtgcaacgatctgtcgcgacttttggcactgaacacgtcgggacagtacagacgcgaaaatacggggcgactgttggaatattacgcaaaaaaagtggccgaacaaatgggagggacggcaccattcacaacggaacaggcaaaacgaagctgaaaatgagagcaaaaagaatcgcaaaatgtgaaattcatttcagttgagagttgcatacaaacattcactgcccttctcaatgatgtgagtgagaaacggcacgaaa

SEQ ID NO: 59122 - DNA, 151 bp, Heterodera glycines
  Genomic contig location: Contig_ID=SeqID_28515; Location=54..204; Strand=-
  SCN-specific regions: Sequence locations=1-151
ttacagcttaacaaggcccaattaagattatttccagaaaatctcgcatgaattctcatttttaaattttttacagatttttaaatatttggatatttttttggcttaccaaaacttcatcgaacctggctctttctattctcattcaaat

SEQ ID NO: 59123 - DNA, 186 bp, Heterodera glycines
  Genomic contig location: Contig_ID=SeqID_28518; Location=1230..1415; Strand=+
  SCN-specific regions: Sequence locations=1-52,75-101,124-186
atgaacagacggtaaggaattttttaaacttggaattttcatttccacttaatttttccaagtttcagttggatgtgcaccgacgtttggctgaacattctgcccttctttgaccatgctcaactcggcctcaatttggcattgctttctttccgtttcgatgttttggtggacaaatcattttga

SEQ ID NO: 59124 - DNA, 1153 bp, Heterodera glycines
  Genomic contig location: Contig_ID=SeqID_28520; Location=385..1537; Strand=+
  SCN-specific regions: Sequence locations=1-68,90-238,260-411,441 -612,634-712,734-1028,1050-1056,1078-1079,1101-1123,1145-1153
aaacttgcaacattttgatcgccttggaatgtttctttggcctcattttggacattggatattatgccagcccttttgtggcagtttctggccaaaaattcattcgttacgaacattgtttctgggctttaatcatcccatgtgtgtgtggtgacttggcccaatttacgatggtgaccatcgccatcgatcgactgatcgctgttgcctttccattatggtaagtacagtaatttgtgtttatttttaaatttcaattcaaggttcaaacaaagagcaaacaatcgatacttggccattgtcttttcatttattttcggctatggcatttatgatttgacacttcgcttcttcgattacacatacacaaaagaaatgtaatttataagaaattaagttttgatgattatgtatattaatgaataatttaattaaatattcttcttcagtatggtctcttgcgcaacaaatgaaatggcccaaagttttttaggaaaaatattcaaaatcaatggattggtgttaagcggccttctgatgtccgcatattcactctgttggttcatggtgttcaaactgcctacagtatcacaatgttctttatttttgaatatgaatcttataaaaataattacgtatttattaagtggttagaatttactgtttctctatgaaaattttagatgttgaggaatggaatcggaaactgatcaaagcattgtctttcatcattgtcctgaatttgattggggtgttcgttagaatttctgttgagctgattttccaggcttttgccatcgcggatgtgttcatccgaacaccgtactccatcgtttcttccttcttcactattatcgtatatagtgcagacggtccattactgtacatcgttaggtgacaaataacaaaattttgccaagattcccaaatgaacatttccaaaagcctcagttgacagccaaaaaagcttcacctattttgaaaattagcatcactaaactttaacaaattcagcactgagtaccgtactcgtctaaaccaacagtttccttggttaacaaaaatatttgggccaaatgagaggaacataatccatgtaacaccttcttcaatgaatttacaacaacagcagaggagagaaagaagtgtttga

SEQ ID NO: 59125 - DNA, 785 bp, Heterodera glycines
  Genomic contig location: Contig_ID=SeqID_691; Location=840..1624; Strand=-
  SCN-specific regions: Sequence locations=1-77,99-227,250-252,423 -635,657-785
  Gene Ontology: Mol. function=structural constituent of cytoskeleton
atggccacttacctattcatcgctgctgctgccttcggagcaggaattgtaatgctgcgctttcttcattttttcaatttgcatttcataacatttttgtcttttcagtactgttggaaggcgtacctcggcccgatgctcgaccaaccgaagagcgacgacgaggagaagcccaagccggaaggaggcgaagaagcgacgaccgccggcgacaaggaggagaagaaggctggcagcaagggcgacaagcacaagaagaaggacaagaagggcgaaggcgcagcagcagcaccagcggcggacaaaaaggaggagaagcgcaaggacaaacaccgatcgaaggaggcggggaagagcgacgacagcaaagcgggcaagaaggacaagcacgggaagaaggacaagaagggcaagaagaaggacaccgccgatgcatccaccgtggacgaagcgctgggagaacagagcacagcggagacgagccaagcagaggaatagccaggccctgctgcgtgcaaatgacagtgttcgacgacgacgtctcgcgacaccaacacacccgtcccttgctttcgaccattcccttcccatccgattgctgtgttttgtctgttccaatgcttcctaaatgttccccttgtgaacagtgatccttccttatgtgacctgaatatgtatatattgtatacccattaatatattgtgcttcgcttgttcgatatttgtgaaatctcattcatattcatcgtcattgtatttgtatacacatttgatatattaataaa

SEQ ID NO: 59126 - DNA, 226 bp, Heterodera glycines
  misc_feature (70)..(70): n is a, c, g, or t
  Genomic contig location: Contig_ID=SeqID_693; Location=1..226; Strand=+
  SCN-specific regions: Sequence locations=1-226
ggatgaaatgattgcccagccatgttacaaccctctcaatcacaatgtcgacaatccgctttactttccncctgattatgaagaatcggaagaaatggaagaaggcgcggaggacgaaaacattgcgaaaattgaaaggcgttggatcaaaaggaaaaagcgcatggcaattacccattgattgaactgtttgttttgttttgtcagattaaaatgtttgttgctc

SEQ ID NO: 59127 - DNA, 2079 bp, Heterodera glycines
  Genomic contig location: Contig_ID=SeqID_693; Location=3145..5223; Strand=+
  SCN-specific regions: Sequence locations=1-694,726-879,901-1686,1708 -1878,1901-2079
  Gene Ontology: Cellular component=endoplasmic reticulum; Biological process=signal transduction
atgacagcagcagcatcggagaattttggccctctgtcagcacattacgaggaagacgatgaactgcttacaccgacaaagcgacttcggttatagtgtactttgtaccccccctttttttgaaaaagaaaaaattcaaaaattttttttcgaaataaagttgttttatggattgtctgggtcgtagaattcgatttctttttcataaaaggggggggggggggagtacaaagtaaacgattaccgcgacttcatttaagcgaattgcggctgaattctgacgaaaaatgtgcgatgtccgattcaatcccacgggctgttgagctgtttatggagaagaaacgagcaaggatttcaaaattcctgtacacgtacaacggcaacttgcaattgaatttgccacaattgcacgcatttgcatgctcaacgggcggactgattgatgacgaatttagagaaaggtgggaggaacaaacctcgtaattctcccatagagatctcagtttacaattgccatttttgttctggcttttttaaaaaaatgcactcaaattggttcggcggataagtttttaattatttggccatcatttttctttttactcgaatgaattgtcaagcgcttttaaatagattttttatggcttaaaaatagaagttgtggtcaaaaaattcttacgttgtgttgttcttttgtatttttaaaaccaaaaatcaaaacagaagataaatctaaattgatggaaaatttattgttttagaatttggccaattctcgcaaaaaatctcccacaagcaaaacgatgtaaagatacgcaatgggacgccctccgctcggaggaatacaatgaccaaacaaatcattcgagcgacgaattgcaacaacaacagcaaacccttttcctatcagattccgactttgaatctgcactttccacgttcaccccgtccatttcgggctgtgatgatcaattgatggatgcggaggacgacgccgagggggtcgacgaccaaagaatggccccccaaaacgcaacggtactccgctcatttgggttgataaacacaaaactataaaaattgaaaagaaccgatgacattcgagtgagtcaaggtcttcgacttctctcctgaccagctgcgtgcccacaaggaatggaatcaggtcgaattggacgtggcacggacattggcacggtttccaccgaacattgacgaggacgaaagggcatgtctgcagaacgagttgaccccacttattgtgaggatattgtgcgaaaatgaagacttccgttactatcaaggtgagtgtttgttgtcgatcaactaatccttgaaaaaaccctggcgaaatttgcgttcacaatttaacccatttggcaaaatccgtcctcctttccccaggctttcacgacgtgtgtctgacttttctgttggttctcggcgctgattcggccctccaagttacgcgggacatttgtgcccgaggcgccttccacaattatttgtgctgttcgctcgaagagagtgcaatgcgcgagttgcaggacctgtacgtgttgctgttcctgcatgaccaagaagtggagaagcggctgagaagcgccgagttgggcactctgtttgcgctcagttggcccctcacttggttttcacatgcactccaaaattactcccaggtgaattttatttctgcatttccttttcataattaatttggttctaataactgttgcaggtggtcctgttcttcgaccttttcctctcttctcatccgctgatgccaatttatgtcagtgccgcgttggtcagcgaacgacgggaagaagtgttgggttgtgaagtcgacatgccatcactacaccaactgctgaaccatgtttgtctgttgttgtgtttggctgcgttatttttgacttttaccaaatgccttctccttttaagattccttccaccattaattgccatcgcgttgctgacgctgctcgtgcgctaatggaccgttacccgccgactgtcatttgcgagtttcgagaagagtaccttcgcatctgcgacaggcataagcggctaattgcg

SEQ ID NO: 59128 - DNA, 75 bp, Heterodera glycines
  Genomic contig location: Contig_ID=SeqID_694; Location=1651..1725; Strand=+
  SCN-specific regions: Sequence locations=1-75
atggaaggaacggaaacagcgcggattgttaacggacgaattgctttggaaggagcggctgctgtacgcccgcag

SEQ ID NO: 59129 - DNA, 1911 bp, Heterodera glycines
  Genomic contig location: Contig_ID=SeqID_695; Location=1160..3070; Strand=-
  SCN-specific regions: Sequence locations=1-52,74-870,892-1116,1141 -1287,1309-1530,1554-1911
  Gene Ontology: Mol. function=ATP-binding cassette (ABC) transporter activity; Cellular component=integral to plasma membrane; Biological process=transport
atgaacttgcgcgacgagcgggcaaaattgctctgcgaaattttcaacggaatcaaagtgatcaaactgtacgcctgggaaattccgatgctcaaagcggtcggcagtattcgaagactcgagttgcattgtatgttcaaaagtggagtcattcggaggtgagtttgtctataatatggaaatttgtaccgtttttcatcctttcagcctagtcgacatgctcaacttcacttcaccctttctggttgccgttggctctttcaccacttttattttgctcgaccccgccggtggacggtcattgacgccgcaaatagccttcgtttctcttacactgtttaaccaaattcgaagtccaatgacaataattgggatgctgatcaatttggtcgtacaaacgacggtgagcaacaaacgaattcgcgagtttttgttggaggacgaattggaaaaaaacacaatcgaacaaaggaaaacaccgaatggtgcattttgtcatattgaagtcgaattttattttaccaaaatattcagtcacctctccgctgattcgagtaataaatgccgatttctgttgggacaacaacggaaagaatggaaagtcgaaggagggccatcgacagaatgtgcatcgtcgtacgtcctccgtctggaaccaacagaaggcaactgaacggccgacactcaccgacattggcatggaaatacgacgcgaaaagttgatcgccgttgttggcaaagtcggggcaggaaagtcatcgttactcgccgctctgttgggagagatgaaacggaccaaaggcgaactcaaaatgctggaagggatggagttggcgattgcttctgtaacttttcccaaagtccgctgattttccccatttttcctttcctcaggttccccaattgccttggattcaaaatttatctcttcggaataacattctttttgggcagccttttgaaggagaatggtatgaacgtgtgctcgacgcgtgtgcgttgcgtgccgatttggcgatgctaccgcaaggggacgccacagaaatcggggaaaaggtcggacgaaaaatcacttgagtaatttaactcactcacttgcagggcattaatttgtcgggtggccaaaaggcacgggtttccttggtaagtgttggatttttgcgtaactttaattcaggtaagttttatttgtcctcattttcaaggcacgggctgtttatcaacggaacagcgaattgtatttgttggacgatcctttgtcagcggtcgacagtcacgtgggcaagtggatttttgaaaaagtaatttgacatctgtccaaagcgcagtgttttattatcgtatagtcgacaactcataattgttttttctatgtaaattgagattttgtcgttttatcggacgccatttatctgctaccatttcattcttttcttcaggtgattggccccggcagtattttggatggaaaaagtcgcgtttttgtcacccatggtctccacttccttcatcatgtggacctaattcttcttatccaaggtcctcccccaagttcgctcctcgattcacttttactaactaaattcagatggtcgtatcgttgaacggggaacttttgacgagctgtcttcgctgcttgggggaaaatttgcacaatttgttgccgaaagtaagaaaaatggagaaaaaatagggaacggcacaaatggtcagcgcactgctgtgaattatgacattgaaccgggagtatcgaacaatgatccggatgctgaacctttgagcggccgtgttacaaccgcaactccatcaaatgccactggtgaactgacgctcccaaatggaaacactcctttgccaaagcgactgattcagaaggaacgcgtggaaacgggaagggtaaacgaacactga

SEQ ID NO: 59130 - DNA, 2548 bp, Heterodera glycines
  Genomic contig location: Contig_ID=SeqID_5755; Location=348..2895; Strand=-
  SCN-specific regions: Sequence locations=1-240,264-464,488-618,656 -738,760-1215,1243-1328,1350-1856,1880-2066,2089-2434,2456-2548
  Gene Ontology: Mol. function=RNA binding; Biological process =neuromuscular junction development
atggtacaacaacaacggcatgacaacaagaataatagtgccggcggcgccattcttatcgaatgtagcagcagtcaaatgccgacagaaattgggccacgactaattatgagcaacaatggcacgagaaatggggcggccgagaatggcacggcacgcgccgccacaacgtcacaacagcaacaagtacaacaacaacggtgttcatcgacggacagcaacgggttcccggtcaaagacccggatgccatcaaactgtttgttggacaggtggttgtttttgtggtgccatccttgtttgtgttgggtgtaaatttatgcgcgaaactttgccgcagtaattagaggggtaaatgatgggtgattatggtttctaaggtcttgagggttaaaaaaacgcatgaaatgacagagggaagaattttttgatttatgaaaatgaataaaaagtgatggacggacgtgaaacaaaaatttggcaaaattgtgggccatattaaagtcaaaaatagcatggcagaagtttaaaaaaggagaccaaagaagaaaggcttgcgatttttatatgaaaatttcaaaaaagaaaaatgtaaatttaaagactctccagcagggttcaaatttaaattttattaaaaaaatttaactaaatttacggaaaaaagccaaatacatacaaaaaatatatagtatccagcgaaaaatttttaaaatattctaagggtaagaattagcgggaaattttgaaaattttagtttttcacaaaaacaaaattgaaattatcgaatgtcatttgcaaaatgagtgattccatccaaaaaattgggataaacccatcaaaaaaaaaacaaagccacttttgcagatcccaagaaatctggaagaaagggatctcaggcacgtgttcgaagcgtacggcaaaatctacgagttcagcatactcaaggacaaaaccaccggggtgcacaaggtcgacatttttttttccactccgcctttttcttattgtagtccaacaagaattcttttcactgaacaaggtatacggtaactaaaaaatccaacaagtgttactgtagccggtaatgtgccaatagccatatcacattttctgtttagggctgtgcctttctgacctattgccatcgggaaagtgcgctgaaatgccaggcggcactacacgatcggaaaacgcttccgggggtaaacgagggaaattgttttttgaaaaaataaaattatcgtcaagtttttggcatttaaatacttgtttcaaatttttcatggcatttataagaaaaaataatttcggattaaaaaaaactacgagtatgagaactgtcatgaacaccctccactctccccgttaattgagccgaattaaatgcgttttcccgccacccttctcagatgaaccgggccatgcaggtgaagccggcggacacggacagcagaagcagctcgccaaagcatgaggacaggaaattgtttgtgagtttttttgtccttgactgctaattgttagcattcgctttaccattgaaatttgtccttgaaatcaatgatatttgcattcccattaattagcgcttcatttaaagttgatcttattgaaaagaaaggattttaatgatttacaaaggcgtccttgataaaccgttagcctccggtttagattaaatttgtccttgaaaggaaggacatttccgttgccacatgagcgaacaaattgataacttactttccctcaagcaagaattcttatgattaacaaggacgtccttgtaaaactcttacaatagcctcagctctctgaaaatgtcccctataaaaagggtgggcaatgcaataattgtttaattgcttcatttcaaaggttggcatgctgtccaagcagtacggggaggaggacgtgcgcgcaatgttccaaccgtttggccacattgaggagatcactgtactgcgcgccgcggacggtgcatcaaaggtcggtgtcgctttgacgatatgatgagcggtgccacgagattatgagcacgccagacagaaaaccattgaaaaattcaaaaacacctgggcagaaaaagcctagcaaaagctcgatcgagatcgccaatgcttcttttccggtccatgttcaggacttgggtgcctttttgctcagtttttgatcagaaccgtattccgttgatcaaattcatggtacggcgaacaaagaactcaataaaacttaaagcccgatcaagcactctcgaaacgaggtcacctcatcccggtcgagagtcttgaaacttggtcactaagttcccacacctttccagggctgtgccttcgtcaagttcggccaggcgcatgaggcgcagcgtgccatcctcacactgcacggcagccaaacaatgcgcggcgcttccggcgcgctgacggtgaagctggcggacacggagaaggagcgccagatgcgccgcatgcaacagatggccacccaaattgggatgcttaatccgctgatgggcaaccaattgggcgccgcgacggagttcggatggg

SEQ ID NO: 59131 - DNA, 108 bp, Heterodera glycines
  Genomic contig location: Contig_ID=SeqID_5758; Location=553..660; Strand=+
  SCN-specific regions: Sequence locations=1-108
atgccaccaaaaccatccggcaagggagcgaagaaggcagtcaagtcgaccaaggcggtgcgcacgggagacaagaagcggagaaaggcccgcaaggagtcttactcg

SEQ ID NO: 59132 - DNA, 69 bp, Heterodera glycines
  Genomic contig location: Contig_ID=SeqID_5758; Location=92..160; Strand=-
  SCN-specific regions: Sequence locations=1-69
atgtccggacgcggaaagggaggaaagggacttggaaagggaggcgcgaaccgccatcgtatagcgagc

SEQ ID NO: 59133 - DNA, 1107 bp, Heterodera glycines
  Genomic contig location: Contig_ID=SeqID_28522; Location=189..1295; Strand=-
  SCN-specific regions: Sequence locations=1-407,429-478,500-563,602 -785,811-941,965-1107
gttgagctgggcaaatcccagcaattcgtgctgaaaaaaatttggaatcggaatgaggatgccgaggagggcgtattgggattgggcgaattgaatgccgaaactttggaaggcttggacttggttattgaggtggttggatttccattttgcttcttttaaattaatgaaataatgattattagacaagtttcaaaaaattaaaaatttaagaaattaagtccacatttttgttttttttacgaaataggacttagttttttctttcaatttcataattttttctcaaaaatttagctaatttttctttacaaatttcgttaaattctcaaaaaaaaatttttttcccggcggcactctcggcacctaattgttattaaaattgattcaatatcgcgaaaattcctaaaaattgctgattttaatttgagatttccgtaatataaaaagaaaaataaccttcacaaattttttattaatgattttttgaatcattgttgcttctaatctaatcacatgtttaaaattggaaaagatattgcaatgatcaaattcttcgcaccaaaaaatcattaatttatatatatttttttaaatttttggtggcacatcctgacatcattcgtgatcatgccaagctgattctgtcttatgcggatctttttgtaattttcattaaatattcattcattacttcatttaatttccccatttttattgataggttgggtcaccgacggcactggcaaatcggcaaacattaaaggaaattcatgtaaatttccaattaaaaaatttatttaattttttcattttagcacagccttaagcagcacaaaaatcgctctgtgttcatcccatccggcgcactttggggcgccaaagacatacaaaaaatggccgatttgggcacattaaaagtccaaaaatgaaatttttcgaatttttaaattaattttttaaagagcctaacagtgataatgatgaagccacccacagcatttcgtctgccagcaatgaacaatgattctttgcccgaattaggtgcactgcataaattgtgtgaagaatcgagagccacaaatcaaccgaaagtgctttatgatg

SEQ ID NO: 59134 - DNA, 139 bp, Heterodera glycines
  Genomic contig location: Contig_ID=SeqID_28525; Location=312..450; Strand=+
  SCN-specific regions: Sequence locations=1-112,134-139
gtccaggcctgaatccaggtctcgaggagcctggatttttcctggacctggatttttgtccaggaaatccaggtccaggcttttttcaaaatgtcgatctctaattattacatttataaattcttaaatgtttaaacaa

SEQ ID NO: 59135 - DNA, 662 bp, Heterodera glycines
  Genomic contig location: Contig_ID=SeqID_28526; Location=214..875; Strand=+
  SCN-specific regions: Sequence locations=1-9,31-97,119-310,332 -466,505-662
atgccaaacattttcaaaatccttctcattgtgcttttggccgtcatctcattccgtttctcggcttccactgatggcaaaagtaataacataatggaatgttttttgaattatttataatgatgatccttcaaattatgttaattatgtcaaaatttcgccagtttaatggccatgaaaatccttattccgtggtgaacactcaaaataaatgacataaaattgttgtttgctttaagaaactgataatgatcggaatggaaacgactcatcagctgggattggtacgaagatcaaacgaattgtcaccgctgggctgctcttcacttccctggccacgggtgggacaggagcgattgggcgaagcaatgcccagggaggaattgccgccggcgcaatggtatacgaattgttagggacgctaattgtgccaagttaccacgatacgaatgcaactcagtttcaccaggctccaccacctcctcctgcgaactttgaaaaggcaaccccggtagaaaaaataagcacacacttacacgaactttctgagcgaatgctgttaaataaagcgcccgaggtaggaaaaaagtcgacttcaataattgtcttcttattctgcaatttagcgagtggtacctggtggacccaacccattacatcat

SEQ ID NO: 59136 - DNA, 601 bp, Heterodera glycines
  Genomic contig location: Contig_ID=SeqID_28527; Location=74..674; Strand=+
  SCN-specific regions: Sequence locations=1-95,119-601
cgatttgaacagcgctttctaccgcaaagtacaggacgaacggatgcgtgccgcgggtgtaatgccaaatgatgagctgctgaatccgttgttgccctacgggggcggtggcggcgacactttggaccgacacattccgacggcgccctttggcccaccgcagacgatgttcgagttgaagcactcccagcagcaactgcaccatgcacagcagcagccgtaccgattctgggaaagtggtgcgacctctgccgacacaatgcattcggctggcgtgggatggcatccgccgtattacgttcaacaacaaccccaaaagcaatcctacggcagtgcgagtgccaacaccgaaccaacccaagcggagccgtaccaaatcgcgagcatccaacaagaacaggtcggtgacgacgagttggagggcaggaattttacataattgggcgattaactctcgagtcatttcgttagttttttttcttgcatttagttgcgtttctcggatcagatgatcggcgaggacagcaccacttttttgacactgggagaatgggaaggggcaatgatcagcggtgccactttcaaggcatcaatcgatcaa

SEQ ID NO: 59137 - DNA, 842 bp, Heterodera glycines
  Genomic contig location: Contig_ID=SeqID_28529; Location=467..1308; Strand=-
  SCN-specific regions: Sequence locations=1-112,134-171,193-300,382 -474,498-842
atgcttcttagtgggtatttttcggaaatttttagggctaataaaaacctaaaatatcatcccttgttattagtagggcttcgtttttaggcaaatgcctaaaatttctgtgcacttgatacgctcaaataaacacgcctttttcacttggtttggggtgtctacgatgacttttacaatgcctaattttgtctattttcgacttttgtgcccaaagcctgaacgcctatttttgtgcatatttcgccatttttggcgccttcaggattttcgaaaaaaatttccacaaaaattgattccatataaatattttttttcttgataaaaattttttgtttaaattatccttattctaaaaactttaaaatatttaataattttgctaaaattgaaatataactaaaattaagtgttttgattaagtttttatgtgtttgtaacctaaaaaacgatcaaccctagttattagcatggaatattaaaaataaattaataaacaggtttaacaaaaaaagtttaaataaattagttttatcatttgcaactttttattctttctctaatttcctttctttcaatgcataaacatgcacattttcatgtcaatttttcagagttctgtccagacttggtcagtgcgtacggatgtgcagccaaagcaaaaccgaagacaaatatgggactatccgaactcaagccatcagaaatttgttgaattcatgtccaatattgatggacggcaacgctttggccgacagattgccctgtttttagacaccagcaaatgcgtcattcgaccgcttgagactgatgtacgacctcagtgatcattgatcaataaa

SEQ ID NO: 59138 - DNA, 1092 bp, Heterodera glycines
  Genomic contig location: Contig_ID=SeqID_28531; Location=80..1171; Strand=+
  SCN-specific regions: Sequence locations=1-307,333-1092
  Gene Ontology: Mol. function=ATP-dependent peptidase activity; Cellular component=mitochondrial inner membrane; Biological process =mitochondrion organization and biogenesis
atggacgaagccaaggcggaggtggaagaaattgtcgattatttgagggacccgcgtcgttacacttcgcttggtgctcgtttgccaaaagtccgtgggtcaataacattttgaatctaatatatttttctcagggtgttctgttggttggccctccggggacgggcaaaacgcttttggcgcgcgctatcgcaggcgaagctgactgtccattcttccacgcggtcggctccgagtttgacgagattctcgttgggcagggcgccaagcgagttcgtgaactctttcgtgagttttcctttccgttttgttcctttgtcccctcatttgtcgacctttctttttcttaaatttgctacagatttctctcgcatttattaccatcttttcgttgaataattattcgcctaattttctgattctttactctccaggtttggccaaggagaatcagccttgcgttgtgtttatcgatgagattgactcggtgggctcgaaacgaacaaacagtgccattcatccgcatgccaaccaaaccatcaaccaacttttggccgaaatggacggctttgaacagaaccagggagtgatcgtgatcggtgcaacaaaccgagttgataatctcgacaaagcactgcttcgaccgggcagattcgatgtgcaggtcactgtatcgaggccggacttgccgagccgaaaggacattttcaggttaacaaaatcaaagaatgggttgaaagtaaaaagattttataaaactacttttggtcattcaataatgacccaatcgaacgcaattaccaaaaatactgttaagactgtatttggacaaaattgtgcatggcgacattaacgttacccaattagccaaaggaacgaccggatttactggcgcaggtgggaaattgctttacagggttggaaattactgaattttgttatttcaagacattgaaaacttggtcaaccaagcagcacttaaggcagccaaagaaggggcaaaggaagtggacatggcccatttggacgaagccagaggtttcaaaggcaaacacttaaataaaatttgttaaatttcagatcgtgttttga

SEQ ID NO: 59139 - DNA, 1748 bp, Heterodera glycines
  Genomic contig location: Contig_ID=SeqID_5760; Location=1434..3181; Strand=+
  SCN-specific regions: Sequence locations=1-33,59-85,122-202,232 -658,697-770,802-891,929-1115,1137-1275,1299-1459,1481-1748
cgaaaaaatttaaattgtactctattgttatggctgaacaacaacaacaaaatcttttggggtcaatgccaccttttggccaagtaataattaaataaaaataaataaatataataaataacttaaattgtttaaaggttgctcaattggtggaaccaatgctcgtaaacgcggcccaacagtattttgcggtgctttcttcttatttaacattattaaaatttaaaaattgccatttcagcagcctttctgtacggatggcacgcacaacattcaatttttgaatggatgtgtttcccagttgggtcagccattgccgtatgtttaatattaccaatcaatcgatattaaattgtgttgagttttttagcccgctgtgcctgatcgtcgtttcgattgagcaccgcgcttcacagcagacgccagctgggcctcttcccatgacgaactgtgtgctgcgcacgggtgacggccaccgcgttgaggccgcgggatggcaggcgcacgcgggtgccctggcggacttgtgtgttggcagcgcctactggttcaccaactgtgtggcccgtgccaggtaccagcgactcgactgctggtaccgcgttagcgtaggcggccccaacgcactggtgatgccgcacgtgtccacagcggtaagttttttttattatttttttattattataataataaaatcttttagccaatgttgagtgcgcatccgatgccgcctgttcagacgggggcgggggtattggaggtaatgggcgaataaaatattgataataaataaataaaaatgcatttcaggtcactgttcctgtgcagcttggaccaccaaggtcacgcgacaccgatgctggcgacatcgacatcaatgtaagaaaaaactttattaaactaaataattctttatttaaatataattcatgattttaggccaatgaagtcgttgagcggggccagacctcacgtgagcgactgcctcagcgacgtgccgcgcaacgggttggtttgcgggtccgattcaatttgtccccagaagtagaagagatcccgagaggggaaagacaaaaaccctatcccgcccgtaaaattaggttgcttcccaattttgacatttcacccattcacattgaaaaatcccttgactgcccaatttgcatgtgcccttttgtgattggggatggggccacttctcttcattgctttcatatttttcacacgggttgtattgttccttggcttaggatccaccgaatttgtccaacttgtaaatatttattgccatgaataaatttttgacttaattaaaggcagggagaccgattgaagaatgctttgtgattgagcggacaacggcaatgcgcaacgcgccacgtaacacccgaggcgaaatttgtgagctgcgctttctgccgctggaggatgctgagcggcctgaccttttgatggaggcgctaatccaacatctgctggatcgagtgctagagggtcagccgcgcccgtccctgattggcctgcaagtccacccgccgggctttgatcgcccttatgtcatccgtcttcgaccacctgagcagaacaacgctgcgacactggcggcagcgattgagcgactaaacgaacagtcggcagcgggcattgatttgttggcgggaaggacgatcaccaaagtgctggctgtgtggccccttgaagcaattcgcgcggacccacagagcggaggtgagctgtccgtttattaa

SEQ ID NO: 59140 - DNA, 987 bp, Heterodera glycines
  Genomic contig location: Contig_ID=SeqID_28532; Location=183..1169; Strand=-
  SCN-specific regions: Sequence locations=1-256,278-313,335-987
  Gene Ontology: Mol. function=protein binding; Cellular component =synaptic vesicle; Biological process=synaptic vesicle docking
aggaagaagaactgcgagaaaatggcacaaagagaaagcacagcaaaaaggaaggtgatcagccggaggggggggggcactatttccaagacaagtgccaattaacacaaaaatgattaaactcactctttcatctgaatggttattggccccctggttttccctatggtcctatgcaggaggcactccgtctgttcacacttgggccttttgctaatcactaattacccccctcccctcccctccaccacaacggcactctctctccctctcttccgcactttcacgtaagtcattcgttcttttcacggattgtttttctctgttcgtgtttgtgtttgttgttctatggcgttttgtctaaaccgtcactttcatccaataacaattaccgttcctatgattattagcatttctaattattagcattttcaccccaatcacttctatgtttgacacaatttctcacacaccgaaacacttatcagacttaaaaaaagaaaaaaatcagctaacttctactaatcatagcactacggtgtatcagtaactaatcgaatatttcctttaatttcttctcaaactatcgctccccctcccttttcttgcttactgtgctctttgttatcgtaatccgtctttacatttttctactttgcagtaatcattcatgaacctgcagtgctcatcgaaggcgttctgtttcgggcgcgttatttgggctcaactcaaatgagttcggacggtcggccgtccaaaagttcgcgaatggcacaggcacaagaggcggtggcacgcgtaaaagtgagaaaaacggaatggggatttggaatgaaaaattggaaatccgaggattaaatactaatggatggactgtctatggactttttttttaggctccggacggcgaattgcagcccagcactgagatagacctgttcatttcaaccgagaagataatggtattgaacaccgaccttcaggtca

SEQ ID NO: 59141 - DNA, 896 bp, Heterodera glycines
  Genomic contig location: Contig_ID=SeqID_28535; Location=1..896; Strand=-
  SCN-specific regions: Sequence locations=1-6,28-152,174-624,646-896
  Gene Ontology: Cellular component=mitochondrion
attcaaaaattggcaggcaaactttttattcaatcattttcagcttattatgtttcgaaattgtctcctggatttaactcctctccgttgtgcatttattgcaaataaactggctcattattcttccaaaacaccaacattttcgaattgcattccttcaccaattttatcgggaaatcaattgtttcgaattattcgtgacaaaattcgcacctcaggcccaattacggttgctgaatacatgcaaatttgtgccacttctcaacttggttattatgctggtcaagtaattctcttttgatcttatcagtcatcacaagtgctattttagaatgaaatttttggagagcgtggtaaaatttctggatttaaacggaagcaagtgcatctttttcaggtgactttgtaacttcgccggagctgactcagatattcggagaattagtaggcaatgctttggttgtaagccgtgtccgttgtatttagattgggagttgggttgttcatgagttggaaatgacctcttggaaggaccggtggcaattggtcgaactcgggccgggctcgggcgaattgatggccgatgtgcttaatgtgctgcgccaatttgatgttccttccgtactcattccttttttaattctcttacttaaggtattacaaaatgttgaagtttatttggttgaaagttccgagcgtttagtggagcgccaacgagaaactttgaagaagaaatttggcgaagatttacttagaaccattcgatggtacgattcattggatgatgtgccacaaggggttggtcagcggaaagccaaaaagggcccatgggacggtgcacccaaaatgtcatcggtcgagacgtcgtcgcattttttggaccgcattttcttttt

SEQ ID NO: 59142 - DNA, 820 bp, Heterodera glycines
  Genomic contig location: Contig_ID=SeqID_28537; Location=95..914; Strand=-
  SCN-specific regions: Sequence locations=1-38,61-117,141-317,339 -507,529-594,630-711,739-799
atgccagaactgccaaatttgaaaatggcgtcactgcaaatgccgtgttgtccgcccagcacatcggcatccgcttcatccgcaaacacaaccacatccacgtcatcgatggagcccggtggtggtggcggcgggggtggcacagatgccgaaagtgaacagtcacaacagaacaacggactgctggccaagaaggaccaggcatgttcaaggacatttcaaggacaagaccatagcatggattgagtcccttttttggagaggataatccggattagaaaagccaatttagcggctgagtgtgaaggacaactacagcatataatgaagccatataattcggaaaataataatgcctggattaggaaacggatttgtacctatttggcttataataggggcaatagggatttaaggcccaacaacaaacctctccgaaatcggaagaattctgagaattaaataatcataattggaattctaaaaccctcgagaaatttcggagtcggaatttttatgtttcagaaattagaaattgaaattcgtcgaacctccaaaattaaaaaaaaatcgggaattgtattctatcggccgaaatttaaaaaaaaattaaattttttaaaatatttctcagtttagcaagcgcaggattttgggcaaatattggcctccgatgatgacgacttcaaatggtggacaaacattgatggagatgatcagcaacaacagcagcagaaggtgtccatggagaacttcgcgttgatcagagtgttggggaagggcggtgagaaaaatttggaattattaaaaattaaataaa

SEQ ID NO: 59143 - DNA, 568 bp, Heterodera glycines
  Genomic contig location: Contig_ID=SeqID_28538; Location=134..701; Strand=-
  SCN-specific regions: Sequence locations=1-10,32-249,287-499,521-568
atgcgcacacgattggaggacatcaaggaaattgtgcgcacggagttgcccgaccagcccaaccatctgcatctcttggaaaagcagttggactgtgagtgtgccgaaaccggcacaattaacggagggagaggggttaatggcaaatcgtaggaaaattgaggaaagaattgacccaaaacatttttgaaagaatttccgctttcgatttggggattccgttggtaaattctgaaaaaaaaaataaattggaaaacattttttcaaaaatttccctaaaaattttacgatttccatggaaggcatcacaaattggagcagtaattcttattttgtcaccacttttgcagactatttcgccaaccattccgccgaggcgttggaggcgagcggcaaactgaatctcggcattgcggagcgggcggctgctgccgcgttggcgccctccgtgtcactgtccgcgagcgggagcagcaccaacagcaactggagcaagcgggaggaggaggacagaagccgacgacatgccggtggaggagggatggaatgggaggagaatgaggagtag

SEQ ID NO: 59144 - DNA, 1683 bp, Heterodera glycines
  Genomic contig location: Contig_ID=SeqID_28539; Location=350..2032; Strand=-
  SCN-specific regions: Sequence locations=1-92,135-293,353-377,484 -839,861-910,932-1009,1073-1243,1283-1283,1305-1467,1489-1683
atgggcgattcatgcttaatttctgattcaacaagaggacacacaatttcgccgccgtcctatgattttgtcgcagttttgcgtcggccgagtaataaaaataaataaagaattaattaaaatgaattaattatcttttagttaatacaacgatcctcatcaaacgacaattaaagaacaaacgaacgctgacaaaaatgctcagtaaaccaaggacagaaactgcaattgttttgcctgaacggaggatggacactaattttttgtcgccaaaagaccgagaattgtacgtcaatttattagtttaacaaataataagaaaaatatatttgattatttattattaattaatcatggcattgaagaatttttggctcattaatttttagaaaaaaatatttacatcaatataatattgtttttttatttttattttatagttactatattataaaatttattaataaaatttttattttttttcagaatttatttgtgttggcacaataacattgtgacaagtcgaagcgatctgttccacaaggcaatgcattattgcattcatgcgagcccaaagatgaacgaaattatcgcgtgcggccactattgctatagagacctgacaaaatggccaaaacttaacagaatttggttaataaataatcaatttaaaaaaatgattcttttgatgtggtgaaagaaggaattggagtgtgggagaaagtcggataaaaaacatgggaggaccccttaaaggagttgcccgtagcgcagtcgggtagagcattccacggtatggaagggcgccgtgggttcgagtcccatcgaagcgagtaaacttttatgttctatattttttcttgcctttttcgatatatatgaccttatacaaaattgttgcgttctaaacatataaaatttaataagttatacccaaagttcataccatattttcttaatgagttaaatttatttattatgaaaatcaaattgaaaatgccaacaattctaaaatattttaaatgataataatttaaaaatataaaagtttattataaattatctatttattcaattttcagtcaggcaattttcaagtttttcgataaactgatcaatgaatacaaaatggatgaggataaaatgtacgatgcatgtgtacatcttggcgaaatgcatgcaaattatgcccagtatgggcttaagcaacattttatggacctttttcaacaacaattattaggtgggagaatttttaatataaaatattggtttaaaatgaattagaaaatttaacttgatgtaattttaggcaagtattaattattgtaaaatttaatttacgcctttttaaaatttgacttaaaaagtgaatttgcagaataatccaataaaatattttgttcttctaatcaaaagccacaattttcttaattagcgccaaatatttaatgtttttttcaaattaatatgtatttacatgaatcaaaaattattttgtctgttactgtaacattttattttgtagcaattattgcacgacttgaaatggacaacaaagtcgaaacatgcatcgcatttacacatcttatcacatttgtggtcgatataatgatacaagcgtacagcaaaaagacatcggaaattcgggccacaacgaaatgatcaaattacaaaaataaa

SEQ ID NO: 59145 - DNA, 321 bp, Heterodera glycines
  Genomic contig location: Contig_ID=SeqID_28540; Location=1213..1533; Strand=-
  SCN-specific regions: Sequence locations=1-122,148-262,291-321
atgatggcaattgatggatcgccgccccacacaacaacaatggcatcacaaaataatgctgcggcattggcatttgctggcatgaacggcaaccgttcgtcaccgccttacaacaatcgactgtcacagcaacagcagcagcagtacggtatcatcatggagacggtgccggaggaagtgctgctgcacacgcccgattccaccgatgcggacaatggcacatttttcacatctgccggcataatgatgcaattggcagatgagcagcaactgcagcagcaacagcaacgaacaatttcccgcaattccacacatgtttaa

SEQ ID NO: 59146 - DNA, 626 bp, Heterodera glycines
  misc_feature (607)..(607): n is a, c, g, or t
  Genomic contig location: Contig_ID=SeqID_5761; Location=341..966; Strand=+
  SCN-specific regions: Sequence locations=1-144,346-412,572-588
atggtcgttttccgcgaggacaaaacgtttgaggacgagctgaggacgtggatgttgtggcacaaacggcaacattcgcacaagcagcgaatcatcgaagtgagaacatttgggggaatttggaggggaaagtcagaaattacgaattaaaattgaagaaaaaaaaacaaaataaaatttaatttaataaaaaaacataaataaatcgagacaattaaactaatattaaaaatatttaaaatttattttcaattttttatggcaaaaatgctttttaaatgtaaaataaataaggaaaaattaaaaaaataataatgaaaaatcgaaattgataattaaaatattgtggattatggactcgaatatttaaatgtaaatctctaataatacaagataaaataaatgctttgtgaaattaaaattattaaactcaatattaaaatattttaaatttattttctattttttatgtcatattttttctttaaagattcgatttaaatgtaaaataaaataaagattcataaatttaaaagatcaaattttagaaacaaatgtttaaatttaaattccctaatattcgagtggttaaattaattatttttanaattaaatttaataattaa

SEQ ID NO: 59147 - DNA, 298 bp, Heterodera glycines
  Genomic contig location: Contig_ID=SeqID_5764; Location=2735..3032; Strand=+
  SCN-specific regions: Sequence locations=1-3,25-145,204-298
atggaaaatgaaaggaatggaaatggcggtgccgttttggtcaccggcgcggccggcttcatcggctcccacaccattttggagctgttggatgccggatttgacgtggtggcggtggacaatttttccaactcaattcccggtgatttaaatataaaaattaattaaaataattgaagttaaaattaatttttaattattttcagatgccaaaaacaatgcgctaagtttgcaaagggtcagtgagctgagcggtggcaaaagcataaggcaagtgaatggcaatttgcttatttaa

SEQ ID NO: 59148 - DNA, 2061 bp, Heterodera glycines
  Genomic contig location: Contig_ID=SeqID_5765; Location=1..2061; Strand=+
  SCN-specific regions: Sequence locations=1-203,239-277,424-443,498 -738,761-1052,1074-1677,1706-2061
  Gene Ontology: Biological process=galactose metabolism
atccattttcagaggaatccgtggccaaaccaattgattactacacaaataacattgttggctcgctgaacctgatcaaggtacagtactaccatatattaactgtcattattttgttggttactgtattcttttacgccgtttcgttttttgtcccatttcttttttagaacagaaaacggtgagaaaatttcaaattttgcatttaaaattatttttaatcttttgatttatatttgttttttctcgatttcccaattctacttgtaggtttcggaaataaaatttaaaatttttaaatttgtttaaattaatttattaatatatttatttaattaataattatatttaaaaataaaattttaacaatttttggtagaaattcagaaataattttaaatatttattaaaattaaaataaaagtcactttaaggatgtctagattttattagtaaaaatttagttttttttataattattctttttttgttttaatcgccaaaaacactgtctaaaattctcttttcccccccccctattttcagtgctgcaaaaagttcggcgtcaagcagttcatcttctccagcagtgccaccgtttacggccaacccgagcatttgccgttgacggagacgggccgagtgggcgtcggcatcaccaacccatacggacagtccaagcacatggtggagcaaattctgatggacttgaagcgggcggaacaggtcaatttttggggaatgatcagagagttcatttgtgcgactgaccaatcattttgtttgactcgttcattatggtgaaacgtgggactgatcaatgcttcttatggacctaatagacgcatttgttgttgatcaatttgtggtttgatcagtgcttttttgtgtcttatcggttcatcatttgtgcgttgatcagtgcattttactgaatctgatcaaactgtggttctaatcaatgcatttattggcctgatctctgatcagtgaattttatctctgaccaatggaattgtggcctaatctgtgtatttcttctgtctgatcagcactttttgatggtctaatctaagtgtctaatcaatgcatttgttgatcggatcaaaggatttgtggattgatcaattctttttgtgtcataataattcatttgtttgtggatttgatcattttgatcacttcattgactttcaacaggactggcaaatctccattctgcgctatttcaaccccgtgggcgcccatccgagcggacgcattggcgaagacccgcagggcatcccgaataatttggtgggggcgggacaaaaaataattgcggataaaaattggaaaaccattttgtcacagatgccatacattgccaatgtggccatcggcaaactgccccacctgaacatttatggcaccaaatacgacacgccggacggcaccggagtgcgggactacattcacattgtggacctggccaaagtgccgtggggggtgttggaaattggcacgatttgttggcacactttttgggggaaataatgcatggataaagggtggggggagcggagcaggtccttcccctgaaaaattaaaaaacctaactgaaatttttcaaaaaagcatagaaattttaaagaaaatttcaagcaaaaaaatcagcgtttttaaagtttcatgatgaatttatttataaatttttttaaaaaatcgttgaaaaatttttaaaaacactttctccaaattttctcgtaaaaatttttcatgatttttttgaaaattttcaagcaaaattgcgttttttttgggggggggggaaatttggacagcagatcagatctctgggcggattttcccgatcagaaatccgctggatttaattgggtaaataagtttttcaggcccacgtggcggcgcttgtccaccttggcaagcacacaccctcagcagcggatggcaaggagttgtgcgaggtgtacaacttgggcaccggcaaaggccattccgtgcgcgaaatggtcgccggctttgagagggcggccggcaaaacggtgggagagaaaactc

SEQ ID NO: 59149 - DNA, 249 bp, Heterodera glycines
  Genomic contig location: Contig_ID=SeqID_28545; Location=39..287; Strand=+
  SCN-specific regions: Sequence locations=1-166,203-249
atgccagctgttgactgtttgaatgggtatcgcagttacactgatcgctgtggggagttttttatgggggacccattggacccaaatatggagacagacttcgattttgctggaaacttggcgctttttgacaaggctgttagtaattaatgtgatacttatgcagttttaaattaaatttttttttaataatatatatttagtacaaaaaatacgctggctcattttgattcctttccacctgctaaa

SEQ ID NO: 59150 - DNA, 231 bp, Heterodera glycines
  Genomic contig location: Contig_ID=SeqID_28545; Location=462..692; Strand=+
  SCN-specific regions: Sequence locations=1-231
atgggcttgactcggccggcgattgttctcggaactatcgcaatgatgagaatgttcttcaggtatgtaaattattgtttacttctgctctattcatttcgcttaaggattcttcccgtgttatctcgtggaccaaaaataccactgctgatgatgatgacaatcaaaacaattctacctcctctccgatcgactgacctcataaaacgatttgaacatcgcccaatttag

SEQ ID NO: 59151 - DNA, 1282 bp, Heterodera glycines
  Genomic contig location: Contig_ID=SeqID_28546; Location=13..1294; Strand=-
  SCN-specific regions: Sequence locations=1-27,49-138,165-568,590 -866,889-1282
  Gene Ontology: Mol. function=structural constituent of cuticle; Cellular component=extracellular; Biological process=cuticle biosynthesis (sensu Nematoda)
atggccgacttcgaagggcgtgtcaaagcttaccgcttcgtggcttacacgaccgtttctttctccatcatctcacttttgtcggtgtgcttgacactgccaatgctgaagagttacgtgtcgaacgtgggcatgaaaatggactctgagctcagctcatgccaggcaaagaatacggcacacaatttaagtgctaaaagtgccattttcagcacaatgccaaagacatttggtccgaagtcagtcagctgaaggggctgcctctgctggtctccggaaaccgtacggcgcgtagcgcatacggtagctgccaagagtgttgctccggcggtgcccaaggccagcccggccaacccggacagcctggacgacccggaaacccgggagcacccggctcacccggacagcccggacaaaccccgcagacgccttgtgagcaagtgcacccggtaaattcgggttgggtttagtcttgagtcccgtgaatttggcatcaaacgtgtaatcataatttccatgctcagcctccatgcaccccgtgccctggcggtcagcccggaaacaatggcccaccgggacccccgggagcgcctggatcaccaggccaacccggtaccggaggaggacagccgcaaccgggagagcccggtccacctgggcccaatggccagcctggccaacccggacagcctggagcgcctggacagcccggacaacctgccagcccaccgcagacggagccccctcctccaggcccacctggtagaccgacacagacattcgcttaatttttaacggactaattaatctctgtttcaggagaggctggtgcacccggacagcccggtcagcctggagcccctggacagcccggcgcgtccggacagcccggcccgaagggaccgcctggaggcccaggacagccaggcaacggcggagcaccgggccagcccggccaacccggacagcctggcaaccccggagagcgcggaatctgtcccaaatactgtgccgtggacggcggagtgttcttcgaggacggcacccgaagacgttgaaaaaagctattctgatcaggggaagaaaacgcagaaaatcagtagcgattgccctcccctcccccgtgcccttctcctccccattttccactgcctttcttttccttcctttttttattttgtttagcttttccaattcgcccaaattcccccccccccccccttaattgcttctctttgtaatcgccgctatgccaagttgccaaaaatcaacaacaaataaa

SEQ ID NO: 59152 - DNA, 475 bp, Heterodera glycines
  Genomic contig location: Contig_ID=SeqID_28547; Location=533..1007; Strand=+
  SCN-specific regions: Sequence locations=1-211,234-475
atggcaccaagaatgccgttaacggctgtcggtggaataccaaaaagcagtaaaaacgcttctttgtttaaagcaattacctatgctttaatcaattcagatgcaattggtctctgtttgatttgcaaggaactttcttttggcaaacactacggtttgtttgggaagaatcatttctcgagaattgacttcaatgcccttgtttaggttgtataagttgccttggttgtaaaactttctttcgtcggtaattattccctttttatcccttttgcattttatgctttcttttttgaatttcgttttagtgctgttatgcacaaccaggacactgtgtgcaaaaagccaggcttttgtgagttcgaagtgtcggctcgtcgactttgtcgttcgtgtcgatttcgtaggtcctcgatggacaatgaattttgtcgtttatattttgattatcataggtgtctcgagatgggaatga

SEQ ID NO: 59153 - DNA, 607 bp, Heterodera glycines
  Genomic contig location: Contig_ID=SeqID_28549; Location=175..781; Strand=-
  SCN-specific regions: Sequence locations=1-46,85-481,521-607
atggtaaatttgtggcgcctaattaatcccggctctaacggcacacttaaattaatttatttttaattaatttattattatttacatttctacagtcatttaactctcctctgttaagctttaaagaaaatgaacaccatttgtctgcttctgctgataatggtggaaaacgtgaacagttggacaattgtttggccgagttggaaattttaatgaacggtgccatggaagcaattccaatggaggagattgaccgaaacgaacaccgtttactctccgatttatttgaaaagaaaaatgaacttttcagcgaaaaaattgcgccaaaatatttaaaaaatccatgtgccagggaaaagcatttgcagtttttgtttaatttgcacgaaatcgcaatgaacaaactaatggagggaaaagatgcatttacgaaacgattggaaggtaaaaaaaagtttatattaaatttagtcaatggccgaatttttttttaaataaataaaataataaaaataattttggagcctatgaaagtaggcatcattttttataagaaggctatttttctgtggctttattatgctaaatttgtagataattaaataaa

SEQ ID NO: 59154 - DNA, 225 bp, Heterodera glycines
  Genomic contig location: Contig_ID=SeqID_28551; Location=85..309; Strand=-
  SCN-specific regions: Sequence locations=1-225
ttttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgg

SEQ ID NO: 59155 - DNA, 3507 bp, Heterodera glycines
  Genomic contig location: Contig_ID=SeqID_5766; Location=129..3635; Strand=+
  SCN-specific regions: Sequence locations=1-54,76-140,162-367,389 -543,565-758,780-988,1011-1318,1343-1418,1440-1658,1691-1911,1933 -2006,2030-2274,2297-2515,2537-2720,2752-3089,3112-3164,3193 -3369,3400-3413,3435-3507
aaaatgtcgccccggcgaaattggcactcagcgcacactgctcaggcattgagcaacattcaaattgttcttgcattttgctggaagaagtgtttccgaacttgccggccatggaccctcttcgacgcgtccaattgtcatcacttggagaattaatcccaatttcaatcgccaaacagaaagggattttgctgggccatattcgcagttgggccaatttggatgaagaatcagcttcactcctttgccacattccaaatttcagtcccgacattcaaaatttcattcctccaattttaatgtgggtggaccgttgtgccgtcgcatttcaaaccctcaaaaatacgggaatgaaagttgtacagcaagagatttgctcaaaaaatccgctccaccggttcggggagttgatcagcgaagcattcgaagaagtgaaggcaaaaaatataatcggcttttcatcaatggaatccgaaaaattccttttttacggcgactcatcggttcgagagtttgctagtaaaatggaaacaaaaaccatcatttttaaaaacacactggaaatggccgaagcattcaaaaatacttattttacgactaaagtccaagaaattctgatcctgatcggaaatgacgatttggaccaaggccttgtgttaaatgatgtcgaagaggccattcgcaaaataattgttcatgcaaataaattctcaatcaaaactattttcattccacctccttttcactattcaaaaagaattttgcatggaaaattgataaatttgttggccaaaatgttgccaaacgatggaaaaattgtgttggcaatgaaaagaggcaaacggagtttggcagaggtaacccggttcgggaacctcgaaaatcgccgaacagtgaatgaaaatggcaagttgaaaccgcctggcattcattttacaatcagttttttaactgatgtgttttggatgaccacgccggtgaaaatgtcgtcagaatcagggagttcaggaattcgaaccccagccacttccaattcgcgtgctccgagtttgctcaatgtgcaaattccaccgccaatcattcctcatccccgtcaagagcaaaatgcttacaggcgtttcaatcgtggtcgaggaagcggccaaaatttccaaaatcggggggcttaccgcaattaccattggcaaaatcatggggattatccccctccccctaaacgtggaaggttctgaacggatcgtcattaccttaattgtgccggataaattttatttttgattgtatttccctgcctcagacctacttataaatgacctcattattgtttcattttgttgtttatttatttgttttttttctcatttaataaattttcatcgcttaaaacattcgtccaaaaagagtagtccctcctatccaccccttcccctttatttcatttcagctctcgcctcttcgcttcatcaaatccgctgtttgagcgccgacgtcaaaactcgcaggcgctcgtctttcgctgatccgggggaggtgcgcggcgatcagaccgtgaggacactggtcttcatacggcgggggacgtaggataaataatgatttatccttattttattgttttttgcaacgattgtttttcgcgttaatttaaaatattttgatccttcatttaattttcctttttatttttgtcttcgtgttctctcaagtttatatatattttgtgcttttgaattatttaataaaactacaaaaatttggtgcttttccccgtggactttcattcagcaacaacaaacgcccaaaggcttaattggtactgttgtctgagttcctaattgcaatttcccttattctctaattccttgtcagtaaagtggtgttgaaaattaagtaaatctttccttgaccccagaatctcaacccaaaccccagcaaatcccaaagtccctccccgaaaatacgccgtctttctccaacggagagagaacattggcaacggacgccgtcccctccccccccccccccccccgcgcttcgctaatccccctcccccagcaacaaaaatgcaaaagaaaaagttttgtaaaaaatacaaaaataaaaatagccctaaacccttgggtttaatttttagcgttcaaataaaagcggggaaaaatttccccgcttttaaaagaaaattttcgaaaaatacagtaacccaaaaaaaatgcgggaaaatttcgcgcactgtccccaggcctcggacagcccccggttcactgctaaaacacgtgttttcacacccccctaaaggtgtgaaaacatgtgttttcacaccggtcagtggatgggtaccgtgtgataactactcataagagaagaactcgaactttttgtttcatatatggaaaaacaatggctaactaaaaacgaacccgcgaatatctggaattttaatagactttcacggaccaggtcaacaaaccctgccgaggcatggcattctttgatcaaaaagttagtattatttcatatttgtataaaaataccctttagggaaccaacgagtatgcgacatgcatcagttacaaattttttgtatttttttcaaagtattatgtcagaaactgatgacagaattaataaaatcaatatgggaaaaatacgagcgcgggggagagatcaattttacgctaaattagatgaccaaattacagaaaccatagatgaatacgaagtaaaattattttataaattgaataatattttcctgattaagggaattctcgaaacaaaatttcatacggacgaggattttaaacaagtttcaaatcattatttaagtaaaatttcatatttgctccttgaaatgaattcaaaaggaacagcaacaaaaaaggaggaaaaaataagggaggtagagcaaaagtactgttatgaatatttttttaaattaagagaaaacgtaaatttgcgagttctgcgtgtagttctaatgaagaagcttcggactagcttgtagtaattgaaagttggataaccaaaatacctaacaaatctgaatcactggaaataatatcgaatttgcctgaacaagtgccagagtcaaaacttttattttttaacccaattgcagtggaagaccaacaagaaatttgcagacaatgggagcttcgttttggtataatttaacttattatttatttaattcctaatgttatagtccgtccttcttattcctttggaattcaaagggaattttttgatttggagactggtccaggtgtttttaaggttatttcttaaacaaattaattttaaggacgtatgataaatgttgaagctgatggaaattgtttttataattcattatcagttttacttaccgggactgagttaaaagaaaatgctaggatcatacgacgaattattacacagttcattgactctgaggttgagcttcatgaccttggaattccttggcatggatggtgggaaatgttacatcccggtcaaactatttga

SEQ ID NO: 59156 - DNA, 497 bp, Heterodera glycines
  Genomic contig location: Contig_ID=SeqID_28552; Location=27..523; Strand=-
  SCN-specific regions: Sequence locations=1-18,40-497
atgaatcgtggacggaacaatcaaaattatttaattcatggtaaattctcgattagaaattacatagcataccaccaatctgttcaagattttgtcttttaaaattttttttaaggaattagcaaatactggcaagtcgtcggcgctctgggtctgtgcgttgtcatggtatgcatcacttatcaattgtttctgcacgtggacgaaaagcacaaatcgttcaaactgatgatcagtggacatttcaacgatatcaagcaaatcaacaacgatttcacggcgtggtcaaaaaatttcacatcgcatctcaatgagcgtttcgaacagcaacaggctcgatcaagggctcgtttcaaacaacagttggcgaagtcaagagagcgttttgatgaacaacacactaattttgtcaaaatccgtttggattttgataaacaatttcaaaaaacaatgtaccgttttgccgaagttgagttggaaaccgtgctgaacaaaag

SEQ ID NO: 59157 - DNA, 319 bp, Heterodera glycines
  Genomic contig location: Contig_ID=SeqID_28555; Location=229..547; Strand=-
  SCN-specific regions: Sequence locations=1-47,98-116,138-142,164 -225,260-319
atgtttcccaatttcttttggcttgttcaacctcgtttattggatggtaatttattttaattaatttttatttatttgaatttaattaattcactttttagtattacacggcaagggcacaagaatgaattaataaaatggcacaacaacaaagagcttccattaacatcactttttttgttaaatattcaaaatttgttaatctgaaaaaatctcaagcacaattgtttatttaaacatttttaaattggcattttgtaaacataaaaaaccatagagaaaaaaagaagaagatttttaatgccccaaaggaattaaa

SEQ ID NO: 59158 - DNA, 297 bp, Heterodera glycines
  Genomic contig location: Contig_ID=SeqID_28555; Location=789..1085; Strand=-
  SCN-specific regions: Sequence locations=1-53,88-212
aggcccttccgaagacccccgtgccggcttggccacagacccttcccaggtacaaaaaaaaaattttttttttttttataattttttgcaggcggtggcgtttgtggcacggacgtggatgaaccgggcaatgtcgcgcaagcgacggaagccaaagcctgtgccaaaactgttcagcaaatggacgggcgaagacttggacaggtgaaaagatataaaaaattatatttaattgtttataatgataaaaataatttgaaattggaaaaaaaattaatattttaaattgaaattaaa

SEQ ID NO: 59159 - DNA, 775 bp, Heterodera glycines
  Genomic contig location: Contig_ID=SeqID_5767; Location=104..878; Strand=+
  SCN-specific regions: Sequence locations=1-26,48-447,469-753
atggacaatgccggcaaatacaatgtgacatttgacacgggtggcaaagtgacagagtgccattacgaaaatccggaaatgccaccatggacagtgcaatacatcgcggtaggaaattctgaatcaattatgcccctaattaatggccaataggcatgactcttctgcgctaattagcgtcacaaattaattaattatgaagccctaaaattataagcattaccatattaattaaaccaacattaatgttatgaaaatgaaatttgtcgttaattaacgagaattagtaagatttcctttttttaattgtatttagttatatgctttttaataatgattaatgcatgttaatcaaaatttttcacagtaaaattgtttttttcaatatctcaatataaattacataattttttttatgtcttttaatgttcaatcgcatttttttataattttcttaaattttaggttatacttaaaaatgaccctcagcagttaattaagccggaaatcagttgtattccgcaaaatcgttgcatgaaaatgaaagaagttgatgacctattagagaaacaaacaaatgggatgaaaaagaagctttagccattggcataatgccaagaatttttattcaaattgaattttcattaattcactaattaattcataaaattttttaatgaaaatgtgtaatataaagtacaaagcctattgtaatacagtatgaaattcctatgaataaggctaacctaaaaaacattaaagaatgtttagctta

SEQ ID NO: 59160 - DNA, 1548 bp, Heterodera glycines
  Genomic contig location: Contig_ID=SeqID_5768; Location=358..1905; Strand=+
  SCN-specific regions: Sequence locations=1-522,544-1106,1128-1548
atgcaccattgctcagagtacaaccgctatgccgaaagtgtgcttccaagcaagcccactgacttcacgctggcgcagacgatcgacaagctcaaggccatgttttgtgcaacaaaatccattttcacccgtcgattagaatgttttcagctcacaaaatcaatttcacaatccccattagatttcgccagccaggtcaacgcaatgtgcgagcgatcacaaatggatctgaccaaggacgaaatcaaagcaatgatcttccttacaggactttcggacactgatcaagagctccgagagcgttgtttgcgacttttggaggaagcgaagaagaagacaccgccggaagcaatctcatacgagaagctcacagaagagtaccgcccgtttctctctcttcgcaacacttccaacgcattggcacattcaactcatgtggccaattcggtcactataaaaccccaaaaattaagggatcataaacagcgaaagcgggatgggtcgcgaagctcgtcaaagacgacgtccaccaccagcaacaatcaacgatcatcccaatttcagcgcaaaccgcaacaaccaccgtcgccatgccgtttctgcaatcaaatgcactgggtcagcgactgtccaaaggcaccgatctgctcaaactgcaatcgtcgtggccaccatcattcaaaatgccgtctgccatcgccatcatccaaatccaattcacagcgcaaccatgcaacaaaagtgacgcatttgattggtatgtctacgcacaacggcgtttaagattggaacgtgcaccttccaaaccacacctgcgccttcaacaactttaccctgcaaccacatgcttttgttgtaccgatagttgagtatcagcacgttgtctccaatcgcgaaagtcgacggtgaacttctttttgtcaattgaactgttttggcatgttgtcgttgctgtgtttggtgttgtttgctgggtgtgaaaagttgttgagagtggtggcaatgggatgttgaagtgccgcttcgaacgccctgatccatggaagaccaaacaaattcattgccccttttggtgcgacatgacactctaattgaagtgtgactccttggaatgtgattgagcaaatgaaatacccggagatttcgaaaaagtgccccgaatatgatttggtctttgaaatgccctttttgagtttggggctgcctaactgttcccataatgcttgctgaatgacggccaaacgtgatccagagtcggccatcagtgatgccttggtgccattgagttgacagtcgaccatgatccaatccgaatttcgccacgatttcccaaattttatttgaagggtagggttagcaaccggaaaatttttggaatttttgatcgattttttttaatttgcatctttggcagactccgatggtcactttggaatcgcatcgcgagcccgtgatcggctgcgcgtggcatccgtccaactcgggccaggcgatcactgcttcatgggaccatcagttgatgctttgggacctccaattggcaggtga

SEQ ID NO: 59161 - DNA, 95 bp, Heterodera glycines
  Genomic contig location: Contig_ID=SeqID_5769; Location=2543..2637; Strand=+
  SCN-specific regions: Sequence locations=1-95
gttggcgttgtgtccgatgtctgttggcactcaaccgaccagcatttgtttgtttcggccagctttgacaacacagttaaaatgtgggacgtccg

SEQ ID NO: 59162 - DNA, 177 bp, Heterodera glycines
  Genomic contig location: Contig_ID=SeqID_5769; Location=2856..3032; Strand=-
  SCN-specific regions: Sequence locations=1-7,30-177
tttgtacagaaattttaactataataaaacaacaaatgatatcacgataaacaattagatattttcttcggtcccatgtgagaacactttcaccgtcgagtccaccgaaccgctgcaaatacggctcggcactgtccaatcaacgcacagcacgcggtccgaatggcccatcaaatc

SEQ ID NO: 59163 - DNA, 799 bp, Heterodera glycines
  Genomic contig location: Contig_ID=SeqID_5769; Location=3350..4148; Strand=-
  SCN-specific regions: Sequence locations=1-291,314-626,653-753,775-799
gttcgtcgggaggcgaagcacagcgcgaggaattgcatctttgtctcaatgtgctggtttttcctaaaattgttttacttgcgtgttcatttaaaattccattgttttttatatagtattttattttgcagcatttttatcgtctctgttcatcaaattttaattttacgacagttttcagtcattggtcagcactttggagagcgctgacgcggagagagaggcgaaatgggaacggctgaagcaatttttgagggtgtgcggaacggccgcaatttttgccgttttggcatttctgttcactttgtattggccggtgagtgagcgaagggattaacggtgctaatttaagcaaaaagtgccattcacgttggatgaaattattctacaaaccgttagaaattttttctacggtataatgaatttgaaacttttcgaacttaatttgggttgaaaccgctctaaaaatttgaattttttactttttgttcaaatccgggccggaatcaacaaaaaatgaagggtcagcggcccttaaaacctccaaaacctgacgtgtaaagaaggccgctttatcccccccccccccccccctcaaattggccaatttctacgcttctttttcggctcagttgttctcttctctggcggttggcgttgtgcgcaccgtttggactctgatcagttctctgcgcgatctgttggtcgcccattggcccgatttgctcttcggcggtttgctcctcagcactttcgtcgacatggaatcttccgactcgcagcaacagcaggcggaaac

SEQ ID NO: 59164 - DNA, 127 bp, Heterodera glycines
  Genomic contig location: Contig_ID=SeqID_28563; Location=1..127; Strand=-
  SCN-specific regions: Sequence locations=1-127
atgattgcacgtaattgccgaaaaaattcgagaccaatttccgaatgttgaccgactaattgcaaaacgaaagccgtctttatcaaagcgccttaccgagtcaaaaaatttggaaattttatcctcc

SEQ ID NO: 59165 - DNA, 274 bp, Heterodera glycines
  Genomic contig location: Contig_ID=SeqID_28564; Location=280..553; Strand=+
  SCN-specific regions: Sequence locations=1-99,121-274
atggggtatgaaaagtttattgggggaaaaaagaagcaggaacaagtgatcagctttcttcgacagcagatccgcaacatagacgcactgatcactgcgcttcggcggcagttggaggaaaagatggcaccaccgatggagacaccgaccaccaggaaaagtgagtgaaactaaaatcccctttttatctttttcaaataatttctcttttttaattttagcaattccaacaggacgaccaaagatgaatgtcgatcatttagctgaattttaa

SEQ ID NO: 59166 - DNA, 804 bp, Heterodera glycines
  Genomic contig location: Contig_ID=SeqID_28565; Location=232..1035; Strand=-
  SCN-specific regions: Sequence locations=1-320,342-390,419-804
atggacatttggtcagcgggaattgtcatttttatgatagcgacaaacattgaattagcaagcgaattgtatcgaagcgcagcattgaatttggaagccgatattacggatgatttgctaatcaaattgcacctgataaacacaagtgcgcgtccgggtgccaaagaatggtgggaaagatattttgtggtgatcattcaaatccttagcacatggtaccaaatgccggacatcgcattcctcttgggggtaagacaaagttgcaacaaaatataccatacctatttagattagtcgtgtcataaataccgccatagtccaaaacaaattcttacatttttatcggtattagagtgctgttagttttcgacactgattgatttcgacagtaaaattttgtttttaaaaaactttttctatacggtataaatctcgttaacttttggaattaaaaggatatgctcatactcttattcatttagaggggtttcgattttcgaattctgctataagagcctgcagtttcgaatcttggcacccaaacccggcaattattagcaattcccacgcgattcaagaagcttatctagaaaacttgttgtatttttgaatgcagtccagcaagagatgtttgtatagaaaaaagcgataaatcttggcaaaattctattgtcgaaacccactgtcgaaaacacttggcacggatattagcatggctaatttattttatatgggaaatgttttggacggccggaaaagggttacgaacaactcatcaccagaaaaaagcatggattaaataaa

SEQ ID NO: 59167 - DNA, 723 bp, Heterodera glycines
  Genomic contig location: Contig_ID=SeqID_28567; Location=127..849; Strand=+
  SCN-specific regions: Sequence locations=1-14,36-69,91-278,300 -587,610-621,643-723
atgatgggtttgaattatttcgaaatttttatgttcaaaattttgcatttcatcatagagttatattgtcgtatgtatgtatttttagaggaagtaaaattggagaatttggaggatgagggcgactcacgcaatggatggctgatcaaaacgcgcaccaaatcttttgtcgtttatgcggccactcaaattgaaaaggaacaatggatgtcacacatcaggcgatgcgttgaggagctaattgatagttaggattattccatcagacattttatcaacaaaatatttttgttgtttttgatggaaaagtgccaccatcggattatgccgcactttgggtacctgacaaagaagcaaccaaatgcatgtgctgtcaaacatcacattttggtgtcatccaacgtcggcatcattgtcgcgcctgcggaaagggttcatcaatttgttcaaaagttttggtactaaaaccatttaacatttttattagttgtgtgtagtggctgttcatccaagtcttttgtgcttgatggtataagtaagaagccggttcgcgtctgtgatacggtaggattttttttattcatcattttttggaaaatgaatttaaaacaattccttgaaattgcaaaaattaagaaaaaagaacttaatttcgtttacatggaaaaaaactaatttttttttgtggtgggcgggaaatgattagaggagagcagaggaaaa

SEQ ID NO: 59168 - DNA, 171 bp, Heterodera glycines
  Genomic contig location: Contig_ID=SeqID_28569; Location=1..171; Strand=-
  SCN-specific regions: Sequence locations=1-171
cagtgtcatttctgcgcgccaccatcaggcgcagtcgcgcaacgcgctcaaaccgcgggcaccaaacaacacaacctctttcttgatgagcgatttggagaagcggcaacaggacgaggaagatgatccgcaacagcacacggacgcccttaaagaagtcgcggggacgcg

SEQ ID NO: 59169 - DNA, 1042 bp, Heterodera glycines
  misc_feature (273)..(273): n is a, c, g, or t
  Genomic contig location: Contig_ID=SeqID_28570; Location=392..1433; Strand=+
  SCN-specific regions: Sequence locations=1-80,143-277,304-471,532 -969,993-1042
atgacagcggaaacttcgtcgaagtcgtcgttttgttgtgtggcagcaacgacggcagctgcggaggacacaaatttaataaaacaaagcgaaaacaaaacggaagaggagggggaagaggatgaagaagcggaagagggggtaattcacctgggaggtgcccaaatcatagatttggtgtggccaccgttggcattgaaattctatggctgccgatttcctaagcagtttgacgatcttcttaggttggtgatgcgtctctgccgcctccgntctgctcatcgccctcctcctcctccttttgcgcgttgcccaaagagtcggaactttcggagagaaagcgaccggcggccatccaggaactgctggagaagaagcgggcacgacttgcgcacaacgaaagtggaagtaaaagtgaacgccgatcgatgacaccgacgacggacggaggagcagagacaaaattggcacggggagaggggacgaacggcggaggatggaggaggagggagagggagaagaaaggggggacaacggacggacaatgccaatgccatcgaagggagaaaatgacggcacgggagggaacggcagcaacagttattggtcaacggaacgtgaggacagcgaagtgagcggtgtccataggacggcaaaaccgagaattaagagtagggcgaatattttgtccgtttcggttccatttgtccgtcctccctccgtccgctccctttcctttccttccgttcatttcccccctcttcagactgtcagcagttgcggttcgtcttcagcgttcggcgcttataatggcggaattttctgcaacagcagcagtaaatcgccgttcgcttcatccgccatcggcgagctgaacctgggacaactgctgaagcgcgcctttggcgagtcgagcagaattttggccgacccgcaaatgttcgctgccattcaggcacggcaagaaatgaaaatggcaccgattaattgggccataaataataatttgtcaggagacaatgttgcaaaaatatgccgttaa

SEQ ID NO: 59170 - DNA, 235 bp, Heterodera glycines
  Genomic contig location: Contig_ID=SeqID_28571; Location=675..909; Strand=+
  SCN-specific regions: Sequence locations=1-16,39-114,150-235
atgcaccaaattttgcaaggtaacagctgagaagaagaggtaattaggtttaaatttcctttccattttgtggaatttgaaattttttcggtattcttattttgcgtacatttcaaattttgaaaaaaataaattcattaatattttttcagagagtgatctgaaacgcaccaaattttattttcaagttaacaagccctctgatgcttttactatcaaaaagggcgatgaataa

SEQ ID NO: 59171 - DNA, 716 bp, Heterodera glycines
  Genomic contig location: Contig_ID=SeqID_5770; Location=150..865; Strand=-
  SCN-specific regions: Sequence locations=1-364,394-481,548-716
atgggcctttactttggtctgacacttttgaccgtttttgagctgatcattttcttcctgtttcacaaaaaatcaacggccaccagcagtggcagtggcagtcagcctcggcaaaatgccagaacagtaccagctgtatacagtattcctcgtccaaaaacagtagcaaatgcaccattatcagtggccaaagatcgtcggcagccaattatcatcaaaaggggaaaaacggtgcgaagtcattagttgcggattttcgtaatccaattcatgtattcttactatgattttgcaaattattggcccaattattgtaatttggataaattggtaaaaatcaactacaaaagtcaaacattcacagtataaatttatttaattttttctttatttgcgatgaattttaaagacaaaacaaaaaacggaaaaaacaaaaataaataaattgtttaaaccctatgtataataaaccttatacaccttaaaataaaaaatgattgaaaattatatcacaattacaaaaaaaaaaaaaaattaagaataatttcgcagtttcgagaggtatcattaagcaattgggtaatatttacaaggttaacgcggaattatcgttgagagcattgtaagcatgtagaaggagcagttgcagttattttagctttaccatgcttaaatgggcactcacagactaaaacgactcccactcaaaaattaaa

SEQ ID NO: 59172 - DNA, 1240 bp, Heterodera glycines
  Genomic contig location: Contig_ID=SeqID_5770; Location=1572..2811; Strand=-
  SCN-specific regions: Sequence locations=1-141,163-240,263-350,374 -397,425-436,459-486,508-913,957-1214,1236-1240
atgaatgatcggatgccattccaatacccacgcgggctcaacagagaaatgtttgttcgggagaagaaccgccagtccaggatgctggcggaacgcgtccgccgtctcaacaatgacgcatttcaaccatatttgtgggcggaagtgtttaaaatgaaaaaaccaattaaggtattatgagttcgagaaattgattcggcacttttatgatgggcacagccgtattttggcattgttcaatttgccaatgtattattttcaaattgctaaaatttttatttggttgtaactcattttccaaattaggggggctctcatagaagagcaattgtcaatgagcaattatttgcacaaaaaccaaacatcagaagaattggaatgctcaaaaacggttttgattatattaatataaatttaatatttagtttcaaggtctcaagcattttaaaatttaaaaatgatctaatcgaattggtcaatcggaattggcaatttgattggggaagagtaagtgattattgtgattatcaactcaatttgaaaccctttctaatcattttgtgttcagcacaatgaagatgtgactgacatcaccttttttgaggcggtcaaataccgtatccctccctcgccaataccggtgtttttggcatttgtttaaaatgatccattgcttttaataagatgatcgaagcttatcagaaggagacgcgaagcaaacgaaaacttgttgaagtgagaaattatctgaagctaaccgtcagtttaattataacaaacagcacaccaatcaactgttccgcttgttgctcgaactttggcgcgatttgtccaaaaatgttgcagcccgtgaaaatgcgaaatgccaaaaagtgattgctgaaattgagcagatcatcaaggtgtttgttccttaattttttatttttctaattttgtttcatttaaatatttatcataaatgcatagaatgaaccgttggtggcccgggtggcttacaacccggtacggagcacgcttgtgcgcaacttagaagtcattcttcaatcaaagatcagttttgccctttttaccaatgtccatctcattttatctgtagattgattcaaattgttaggttttctgtttcaaaaattgatggtgacttttcaattgggaaatctgaaagatgatttaatcggcgtaaatttggcaaaaaaagaactgagaatttaaaaaattatccaaaaataataataaa

SEQ ID NO: 59173 - DNA, 1043 bp, Heterodera glycines
  Genomic contig location: Contig_ID=SeqID_5770; Location=3942..4984; Strand=-
  SCN-specific regions: Sequence locations=1-21,43-215,243-594,616 -875,897-1043
atgactttttgcttgtctctgttttttcttagtgccttttttggtgcgagtttcgttgacgaagtaaaaatttgtaacccataaaaatgtaaactttgaacatgccttggtaggctttcgcctgtgccgcagtgacaattggcaatggctgctgcgactcggaatcaatgccaatgcacgaatggaacatcactgtgtgcgcacttcaatgatatttaatgaattaaaattaaattttgaacacgtttctctttttcacaggtgccccggccatctcgtcccaaagtgcaacattttcggccacaattgcgtggcgtgccgttacgattactcgccgccctcgtgcaatgttagcgtcgcctgcagctgctactactgttgcgatccacagtacgcctctacttgtccggatgggtgcaaaaattgcgttaaggacggggagggcggatgcccgcagaattcagcagcccatttcaagcagatcaagtacaaaatttacaatgacagtcggatagtaaaaaaaacataaatgtatgatacaaagtgtgatgagtacggtagtatttgtgcatttttgggaaaatgccactgggcaatattaataataattattatgaaaatgctctctgtcttaaatgcctttattaagaattaataaagcactcatatttgtagtgacaattcttcgctttcacacttggaatcggctgcaaaaaagcgaggagaattcgggaaggtattttaacttttaatttttgaatggcataaattaatcatttttgtaattaaactaatgtgcagattgacgtggacaaaagcggcggaatttcgtcaaaagaggccattgcgcatttggttaagacaaagaatggcacttcagctgacgatttggccaaaaacatgtcctggtttgcccacatggacagcaatgggaacaatcgaattgaacctggagaatttgatcgatcactgacggagtgaaaagtgacaaagcgaatgaaaagcggacaaaatgtataaatccaaaggacgattttaataaa

SEQ ID NO: 59174 - DNA, 1302 bp, Heterodera glycines
  misc_feature (1235)..(1235): n is a, c, g, or t
  Genomic contig location: Contig_ID=SeqID_5771; Location=1..1302; Strand=-
  SCN-specific regions: Sequence locations=1-109,131-757,780-980,1002 -1025,1047-1302
aatgcttttaatcgtcctcaaaattgttgggatgtcaccacttgccaaattggacttgagttgattgacaccggatttttaactgtccgttgtaaagaaaacggtgaattaattaatgcatttagaaattttcatttaaatttttttctaattaactcaacttcaggcaataggagtgcagttttcgcgaaatatccagtgcaaaatgggattcattcttctgccacctttttttactatgaattgagcatcttacaaatgaaacaaaaatggtaaggaatatttggtgaatgtttgtttaaaaatttaaaaaaaagtcaaatggcacaaattacggtgcaccccaaaacgtcgtcggccgaaacgtcgtcggaagactttttgaaccataactttgttcactgtcaatcaaattaagaattgttggtgttgttcgatagctctatgtgtttattattaatttgcaaaatctcaaaaattttggttaagtttcaaaaaagttatggccagaaggaactcaaaaacccagtatttcgaactttttttgctctgatttttttgtgcataaataaaattttttgaaaatttacaggctaatagcatttttcgaatgctttcgaataataccaagaatgtttaatttggttgagaaagaaaaaagttatggtcgaaaaattcgttcgacgacgtttcggctgacgacgttttgtcctactctgcacaaattatgcctaaaatatgtaattcaattaaaagtttctttcaagaaatacttttataacaccaaaaaatgaattttttcatgtttgtttgttttcgtaaatgttgcaattttttaggattccgaataaaattttggcaattttaaccaacgaaattgtcaaacaaaactcaaattttcatcctgtccctttctccttattggggggggggggggggagtcgagttaattaatgttaaagtttgccaaaaggcattgtagcaaatttgtttaattttatcttgactcctattacttaattaataaatgttaatttggcacatttcattcagttgcgtttacattggactcgccctcaagcaaagtgaccaaagtatcggcacttcggcagggaccatcgtttatcaaagtgatggctatttttggtttgggaatgaatggctgccaggaaaaccaattttcacgactggtgataccgtcggttgtgggctcaatatggtactaatggacaaantaattttcacaaaaaatggcccgggggggggttagaaatgccaatcaaaaaaaaaaaatgaaataaa

SEQ ID NO: 59175 - DNA, 388 bp, Heterodera glycines
  Genomic contig location: Contig_ID=SeqID_5771; Location=587..974; Strand=+
  SCN-specific regions: Sequence locations=1-388
agtaggacaaaacgtcgtcagccgaaacgtcgtcgaacgaatttttcgaccataacttttttctttctcaaccaaattaaacattcttggtattattcgaaagcattcgaaaaatgctattagcctgtaaattttcaaaaaattttatttatgcacaaaaaaatcagagcaaaaaaagttcgaaatactgggtttttgagttccttctggccataacttttttgaaacttaaccaaaatttttgagattttgcaaattaataataaacacatagagctatcgaacaacaccaacaattcttaatttgattgacagtgaacaaagttatggttcaaaaagtcttccgacgacgtttcggccgacgacgttttggggtgcaccgtaattt

SEQ ID NO: 59176 - DNA, 763 bp, Heterodera glycines
  Genomic contig location: Contig_ID=SeqID_28572; Location=145..907; Strand=-
  SCN-specific regions: Sequence locations=1-763
atggtcgcccaatcgtccgaccgaccaatggaggaaatcggaaaggaaaggggagaagcaatttgcgataagcaacaaatggcggaccatggaggagaagcgattgacagtaaaacgcagcaacaaacggaaaagggggcaagggaaacgacaacgtcgacggacaggtcggatttggcagggaaaggcaggaccaacggaggggcacagaaagacggaagatcaggggggggggttatgggaaaatggaattgtaacaatcgatcgcgggagggtatttttaacaaaatggcaactaacagaatgccatcgacttcccatgggtcaaagagcactccgacgactccgtccaaagaaatttgtgagacgaacatttgcaaaaaacaccgagaagaaatagccagtgaaacaatagacaagaggagagtgaccgatggagaagggcaaaatgaggaggacggagcaaagcgaaatgccatcggaaagtgccaaaatgggaagaaaaaggctcaaaagcaccgaaaaggtgcaaatgggacacgcgtcgactctccgagtaacgaatctcactcaaattttaactttcttatttcatttatgtccaatttttagtgtccgcccttagttccgacattttgacatggacaaactctcaacaaagtgttgcatatcccaccgaaacaattgctcaaatggccagacacttcttcactcgccgggacggctttaaagggaccaaaatttcagcaattttagttcagaa

SEQ ID NO: 59177 - DNA, 506 bp, Heterodera glycines
  Genomic contig location: Contig_ID=SeqID_28574; Location=345..850; Strand=+
  SCN-specific regions: Sequence locations=1-179,218-279,304-304,333-506
aaaccttaaagcactagccgattgaaataaatggacaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaagacaaaaccttaaagcactagccgattgaaataaatggaaaaaaaagcaaagtcaaagacaaaaccttaaagcactagccgattgaaataaatgg

SEQ ID NO: 59178 - DNA, 141 bp, Heterodera glycines
  Genomic contig location: Contig_ID=SeqID_28574; Location=903..1043; Strand=+
  SCN-specific regions: Sequence locations=1-79,101-104,133-141
gtaatattttgtatattgtatatgcatttaatcaaatttctactttctttataaatgttagctaattagtcagcgtctatttattttctgtaaaaatttgactgtttatttaaaattaaattaatataatttcatgaaata

SEQ ID NO: 59179 - DNA, 775 bp, Heterodera glycines
  Genomic contig location: Contig_ID=SeqID_28577; Location=26..800; Strand=+
  SCN-specific regions: Sequence locations=1-174,196-397,428-475,498 -680,719-775
atgaaggcactcgccgctcgtgccgtggacaaaatcaaccgacagacgaacaatgccttcctgtttatccctgtgaaagtgctcagtgccaaagcaatacccgtagctggagtaagatatgaactgcgcattttggtcggaaagtcaaaatgcttgaaaaaggtaagtgcaaaatggggagaaattggcacaaaaatgggcaagtcggcactgtaatttttaagaaggcgtataattttaagagggggatataatttttgggggaaatcgggatcaccaaagtcggataagccgagctcagcagtagaccctggactgacagtttaaatcggatttgtatcgggattacttttttttctcaaaagtcggattggaattattgggagggataaatgtgaaatttaaaaaaaaagaataaaatttaaaactccaatgaaaagcaaagtaaaaagtgaaacaaagcatgtatacaattttaatttaaaaaagtgatgtttttaaagcagccaaaggcaaagcgcgcaaactgtgcaacggaaactgttccggcagagcgaaaggcatcgatttcttatttaattatctgctaattagcctaattatctattctttaggtctttgaagtgagtgtgttccaacaaagttggaaaaatgttgaggacattacattcgtacccgaagaacacatgggcaattcgacaaaaaattgtgaataaaatgataagcaataatcgtgggtgaatacaaatttttaatttggtgcaatttttaatta

SEQ ID NO: 59180 - DNA, 360 bp, Heterodera glycines
  Genomic contig location: Contig_ID=SeqID_28581; Location=105..464; Strand=-
  SCN-specific regions: Sequence locations=1-18,40-189,211-250,272-360
atggtagtggtaatttgggagtacacaggtgtgtggcataggcattttctaatgacacaaaatgattggccgacatttgcggcgttacatttgcggcgcctagtcagaacgacatttgcggtgtcgacacttgcggcactaagtcaaaatgacatttgcggcaccgccgacattttgtggcacccccataattaaagctcaaaattaaatctcgaacacccttttgttttctccttatggtcataagaaattattttcaattagcaataacgaaccactgaatgaattctttttttttaatatttttcagcgtgggctttaagaaatcttttggattttgccgagttcattaatttttaa

SEQ ID NO: 59181 - DNA, 813 bp, Heterodera glycines
  Genomic contig location: Contig_ID=SeqID_5773; Location=187..999; Strand=+
  SCN-specific regions: Sequence locations=1-80,102-813
atgccaactcggattcttaccgaaaatggaacccaattcgtcttggcatccaaagtttccgcggccctcgaagccggtagagtgccgacttcagcactggatcgattcatggcacgagaggcaatccattggcgttttatccctcaattgtcaccttggcaagggggagtctacgaaagactcgttgccttggtcaagagctgcttcaaacgagagctcggccgcgcaatgctctcatgggaagagctagtcacatacacagccgaagtcgaagcagtactcaaccaaaggccgctctgccatgtctctgaagagcctgatggaatcctgccactccggccaatcaacttcctccttccgagagcaaaacttggcattgtgtttactgccgagaccgaccacgatgagttccgaatttcttccaccaatcaaagagatgcgctcatccaacgttggcattccgtgtcatcatcaatcgaccatttctggaatcgctggcagaaacaatacctgctgatgcttcgccagagacttcagtggaagtttaagaaacaacggaaccaaattgcgcgagagcccacggaaggagaagttgtgctcatctccgaagaaaaacttccgcgcaactgttggccaatgggacggatcgtcgagttacaacgctcacacggggaaatccgaaatgccaaacttcgattagccacaggaaaggtgctaagccggcccctgaatcgtctttatccattggaagtggcttcctctgccgaacaaaatgagagccaccagcagctgacagacccgccgcttgagtaa

SEQ ID NO: 59182 - DNA, 1562 bp, Heterodera glycines
  Genomic contig location: Contig_ID=SeqID_5773; Location=1712..3273; Strand=+
  SCN-specific regions: Sequence locations=1-1562
atgtcaaactcgaaccagcactcgccgatcctgagaagcgcctaccaattcagctcaaaaacttgcttatccgaaatgaaaagcgagacattttcgccgaaatcacctacgcaccgattcagctgtccattcaatttgaggggcttcgaatcgccacggaagaagacctcacaaaatgccatgccatgtccaagggtcttttcgggtgctattcatgccacactggatctcatctccatttgcaatgccacaccgactttggttcagcacttatgctacgttcgttgttcggatggcaccgagttcacagctctctgccacaaaacgccagaagttttgaatgtcagcctatcatttaaccgtgccgaagtcgacatcaactgtaccattgaatgcagtggaggacggaacccatttgtgatcggtggtcatcttcgctacgtgccaaaacattttcaagcacctaatgaggggagctcattcatctcgaaggccaaacccagcaactcatgcctaatttggtgcccagattggaacttcgatttttctgatgtcttctggtacttctttggtctacaaaatgctctacgaaccattcgcatcatcactctggcactttttatcgtctatatcctattgcgctgcaaccctgcccttcgatcttggagagccataaaccgaattgttcttctgttccttgctctttggccagtgacatgtcattctgcagcgggagggctgagtcgcccactcagcattcaaaacgcaccaaaacggcagttcgaagaccattgtgcaatgtcagaacggatgactacgcctcatggcatttttgaggtccaattgtggaacattcatcccttcaacgaccaaaaattgctcataactaccctataaaagcggttcccaagtcactcaatccaccattcgttcaaatccttgaatttgccttccacttccgaaatcaatcccaattctcttcctttccaatggccaccctgctctctttcctcgccaattcgatgaacatcgatgtcgaacgctttggacttgccgtcactacatccttgagccgttggaacgaagcccaggcgatcgttcaaggactgcacgatcgaggctacgaattgaagacacggcacttgcacccatttgagcgcaatgtcagactccacgggactgaactgagccgaatcgctgctaatcgtcttggcgcttacaacggacaggcccgagggcccactgtttctgaattctaccgctctcgccatggaatcgtccttcgatgcccctcagctccttgtcttatggaacctggcggaaatgggcaccgagattttttccctattgaactcatccgagtggtgtctcctgatcggatctcggcgccgcggcgactcgcgactcatccactccctggccctcgcccctcacactccgattgttcgaccgatttccccattccgccatgcccggtcatcttttcgttaacatcagcaccgacgacgtgccaattggagagccgggaatggagcgccgactttcacgtggacaaacagtaa

SEQ ID NO: 59183 - DNA, 987 bp, Heterodera glycines
  Genomic contig location: Contig_ID=SeqID_28583; Location=118..1104; Strand=-
  SCN-specific regions: Sequence locations=1-67,89-135,157-987
ccgaaaagatgcaagcctcgtcccgtgccattcgcgttgcgttccgaggtggagaaggttataaaccaatgggaaaaggaaggagtcctcgagcctgtggcgacatctgaatgggcaactccgcttgtcattgtgccaaagcctggcaacaaaattcgtttgtgctgcgactataaggtcacagtcaatccgtgcctggacatccatcagtacccgctccctcgaccggaagaactgttcagtgctctcaacaatggcaacaaattctcaaagttggacttgaaagaggcctatttacagcttccgttggacgatcaggcgaaggaatgcctcacaatctgcacccataaagggctgtaccgattttcacgcatgccctacggggtggcatcggcaccagcgatattccagcaggtgatggaagaaattctctgtggaattgacggagtggcagtgtatttggacgacattgtcgtcactgctgcaaacgatgctgaacatttgaagagattggatgccgttctccaaagacttaaaaaggcaggactacgagtaaaaaaggaaaaatgctcgttcatgcatgaaagcattgtttatttgggacacattatcgaccggcaaggaattcggacttcgccagagaaggtggaagcgattcaaaaaatgccggcgccggaaaatttgaaagaacttcaatcgtttctcggcatggttggctattacggcaagttcatcccttcattggcgacggtttcggaaacattgaatgaacttcgccggacagaaaagaaatggcactgggggaaggagcaacaaaaagccttcggagaaatcaaggaaatgttggcttcaaacgacatcctcgtgcatttcgaccctgaaaagcctcacttcttggcaacagacgcgtcggattatggaattggagaagttttatttcataaggatgccaagactggaaaagttggagtcatcgcttatgcttaa

SEQ ID NO: 59184 - DNA, 308 bp, Heterodera glycines
  Genomic contig location: Contig_ID=SeqID_28585; Location=65..372; Strand=-
  SCN-specific regions: Sequence locations=1-20,60-270,298-308
atgtcagacgaccgaaaagaggcagaggaaaaaatggcaaaagcaatgtaaaattaaaacccaattttaatttccaatttcaattttgttttccttttttcagtttcatctccggcgatggttggctggcggtgttcgatttgcttgcgccttcccaacttggcctcggaattgcgctgatcagccaccgttttgacttttacgtggatgaacacttcaaaacgcgcaaatgggcattaggaattattcgaattggaagcaaaattggggagaatggcacaaaggaaatggaaattgccaattatcat

SEQ ID NO: 59185 - DNA, 63 bp, Heterodera glycines
  Genomic contig location: Contig_ID=SeqID_28586; Location=693..755; Strand=+
  SCN-specific regions: Sequence locations=1-63
atggctctaaggttaaatttgttttacgatattttgtgtcctcgttcttgggttttctaccag

SEQ ID NO: 59186 - DNA, 415 bp, Heterodera glycines
  Genomic contig location: Contig_ID=SeqID_28591; Location=1100..1514; Strand=+
  SCN-specific regions: Sequence locations=1-31,55-96,144-415
atgccaatgccccaactgcgagtgccaaaagcaaaagggacagtgccaaccccaggggaagggatgctgtgcttagagaagcgaacggaaaggacggagagaggggagagggtgaagcaaagagagagagagggagagagagaaaaaagggaccacagtgatcggaatgaccaatttgtgtgccaatgataagagcaaatgacaaacataattactaattgtaagcaaaaagacttgtatttttaggggttcgcttccgtatttcctatggaagagtttcttgccgcattctcatttcttagtggcgccaataattgcccactttttcaacattcgatgaagtgtatttttctattaaattccttttttttggcaattttttgtgactcaaatcaaaatatttatggctgaaaaa

SEQ ID NO: 59187 - DNA, 920 bp, Heterodera glycines
  Genomic contig location: Contig_ID=SeqID_5774; Location=376..1295; Strand=-
  SCN-specific regions: Sequence locations=1-66,89-234,278-920
atgacgagaatcattcgccatttccgtcgaagagatcaattcgaacttccaacggaatacgacggggaaaacgaattggaaaaggggggagagaatgggaatgattactacaattattaccagcagcggatgcaaatggacaacgaattcatcgcttctctgctgaacgaagacaacgcaaatggaaacggcggaaatgccaattttctatataggccacaggacgaaacattccatcagcagcagcaacagcagtacaacatcagcaacaacggcatcgatggcgtggaatttgtgctgcctcaaaatggcggtgagtaggcgaagaccgacaattttcatgggtgtgtgaccttttccgccctttttgttggggaaaagcctccggaaattgatgtaaatatttctctccttccgtcgtccttttgtcggtgcttttcttccaaaatgcactgacaaaacagaaaaaaatatttttaaaagtccatggattagcgcaaaaagaaggcgaagaatgggttttgtttggtgcgcgtgggaattaacagaaaatgtgaaattttgttgtgaagagtgctctcagacggttagcaaatatctctcctccccccgtcccatcatcaaaacgttcgtcgtcgaagttattgtctctcttgtgggaaaacgggaggggatgaagtcgttggaggagttgctggggggggggggcaaggggaagggaatatttgcattaacgggggccgtctcccaaaaaaccgcacgcacccgcgcccaacgcacggctaaaacgcatcccattccccaaaaagcgaagggctatcagcccaaaacttttttacctcatttgtctaatatctatccccatttcgagtataataatctgaaaaaagtctaccgtaattctctctcataataataaa

SEQ ID NO: 59188 - DNA, 229 bp, Heterodera glycines
  Genomic contig location: Contig_ID=SeqID_5774; Location=1..229; Strand=-
  SCN-specific regions: Sequence locations=1-72,106-229
caagccttcgcattcctttcctctcccaacctccctttttcttttcctcctccttttttattcgttccctaatctctatctctctctctctctctttctctctctgatgcaaaagcattggcatttttattaattaagtataaccgaattaattgattaatattaatttacgattaattgggtttgtgtgaattggtgattaatccgttccgttgccattgctctcttt

SEQ ID NO: 59189 - DNA, 276 bp, Heterodera glycines
  Genomic contig location: Contig_ID=SeqID_5776; Location=697..972; Strand=+
  SCN-specific regions: Sequence locations=1-235,258-276
atgcaggccagacgagaagaagcggagaagcaagcggctaatatgggcatggagggcggtcaaatgcccccggcgatgatgatgatgatgatgtcagcagccaccgccgctggaggcgaaggcgcagccgcaaattcgttcacttttgcggcgcctccgtcgccggccgttccgcttgacccgcacttggaacggatgttcatccaacaaccgaaacacgtcgccggagaagaacagcgaccacagcacgaggacgaggaaaattatgacatttga

SEQ ID NO: 59190 - DNA, 963 bp, Heterodera glycines
  Genomic contig location: Contig_ID=SeqID_5777; Location=1..963; Strand=-
  SCN-specific regions: Sequence locations=1-180,202-963
  Gene Ontology: Biological process=embryonic morphogenesis
ttgtccttaaaattgtcttaggcgtattcaaaaaccgaagtcagcacagtaccgtacagcgatggccgacatcagtcagggtatacggtatcgacagtgccaagcgaatggggcacaggacgagaccggtaggaaagaagcggccattaaggaaagggaggaaatgccaatcctaccgggcatgccaacacacagaaaacactcgcgagtggtcgaagtggcggacactttcgtggatcgccaattggccgaagccgccccattggcacatcgctacgggggccgaataacgctggaggaggcgttggacgccattttccaatccaccaaaccgttggaggaaccgcccccggccgacccggggtaattaagggagcgaaagcaacggggctaaggaagaaaagctattctcgcacaagcagattgtccgaacagcaaaaccagctccgcaacatggacggccccggcattttctcgcccgatttggcattgatggaaaggctggcggaacagccgcacttggccgagaatctgttgaaggtcagagacagaaaacaaaaaagtgtgatagagagagtaaaaggcatttgacaaaacactggaacgtttaataatgagaatgacactaataggctcattaggaatacgatccattttcctttattgcctttcccattaacagaatgagcctctccttgtccgttgcgctttctgcgcctgcgtccgtccgttgcgtgacgcgcgttcgcatttccgttggtgccgccactgctacacttactattgctctcggcaatgtcgactcagtgattggcaccggcacagagaccgatgctcatttgcccgaattaacaggtgggcgggtggcgggacctcataattatgagaaaaagccatggtttcagcttgtgcaaagaagtgattatgaaggtgaggaataaaaagcaattagtacatatcact

SEQ ID NO: 59191 - DNA, 164 bp, Heterodera glycines
  Genomic contig location: Contig_ID=SeqID_28594; Location=494..657; Strand=-
  SCN-specific regions: Sequence locations=1-164
atgaagcaattaaacagggaaattattcgagttccgaaacaaatgatacggtaaaaattgatttattattaaagaaatagtccatatcaatttaaaatggtggaaatttacagaatgcaaaaagcattggggaaagtgatgatgaattggaaatattaaataaa

SEQ ID NO: 59192 - DNA, 833 bp, Heterodera glycines
  Genomic contig location: Contig_ID=SeqID_28597; Location=92..924; Strand=+
  SCN-specific regions: Sequence locations=1-192,216-358,380-833
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcgggggggactgcccccgaaaacaaaaaaatacgatttttt

SEQ ID NO: 59193 - DNA, 302 bp, Heterodera glycines
  Genomic contig location: Contig_ID=SeqID_28598; Location=1030..1331; Strand=-
  SCN-specific regions: Sequence locations=1-54,76-188,223-302
gttcacgcaacaaagaaacgcggattttgccaagtaatgcaagagcaatagaacaaccaatacatttgtttttacgaattctttgctttttgacttgacttacaattaaaagggattttcaaacaaattttcgaaattcaaaatcaaaaataactgtacatgcaaaactctatacaatttcaccgagcaaataataaattaaagtatttttaatattttttagactcgagaagtacgacaaatttgtgaaatagagcgtttcatccaatggaatgattgattttaagttacggggcagcaga

SEQ ID NO: 59194 - DNA, 1386 bp, Heterodera glycines
  Genomic contig location: Contig_ID=SeqID_28600; Location=464..1849; Strand=-
  SCN-specific regions: Sequence locations=1-558,580-711,797-905,1360 -1386
atggcattgctttccgatcgtttcgatgttttggttgacacgcattttgatggaaaaacgacggaattgacaatttggagaagtgtcataattcggaaggacaaaggaccaaaagcgaaaatatatgccgattcgaagcctgtgcaatttccgttccccgaccgtccgctgcccaacaaaatccgctttaagaaccttcggattgggtaaattaaacttatacggaaaccaattaatatggttggtcgtcgtcttcattgttcccccttttcagctacattgaccattctgtgctcacatttcttcgttccaacaagcaaatttgggacagaagtggcaccaatttggaattgtctatatggccaaacaaaactgaggatgatcagccaatttgggatgtttttgtccgtgaaatttggccaatttttgcgaccaacattcgtcatttggtcttttgcaataccgatgctttggacaatttgcgtcgtcgcatatcgccaacatttctcactgatcttgatcaattgaattcgatcaattccggtaatctgttccccgatggaattgctgatgatgggccaaatggaaatgctgctggtccactatagtaatttggtggatgtatacatacgtacgccccgccctttttttataatagctcacttattaaaacgatttcctttttgtttacctttattttgcaatgagaatagagagaaaaacaaggatgattgagcgagagagaataggtaaaaagagaaaaacaaagaaaggagaagaggtgagggagagagaggtgagcaaggtgaattggaaacaaaaagaaatgtgatgaaatgaaattttcacaaatatcttgcagatgaaagagaagagagagaaaaaagacaagaggagaggaaaacagagagagggagagagaaaaggggagagagagagaaaataagtgagagagagaaaggaagcgagagagagaaaaggggagagagagaagttagaaagaaaataggagagagataaggagagggagagaaaggagagagggagaaacgagagagagggagagagagagatagaaatagagcgaagagagagagaggaagaaagggtaaaatgaaagagaaaggataagagcagaaaaaagaagggagagagagagggagaaagagaagacagaaaaagacgagagagagataaggagagacagagaggagagacagagaaaagagggagaaacgaagacagaggagatgagagaaaagagaagagagtgagagaagagagagagcgaaagagagaaaggataagaggagagaataagaagagagagagggagagagtgagaacgagagagagagaaggagaaaaaaatgtaagaaaaataaa

SEQ ID NO: 59195 - DNA, 373 bp, Heterodera glycines
  Genomic contig location: Contig_ID=SeqID_28601; Location=180..552; Strand=-
  SCN-specific regions: Sequence locations=1-373
atggcaaattcggaaggaaatgatcgcttcagccatggccaagcactgcacgcatttgccaacatccgacgcaaaatggagcaagccgaaagggcagtgaagcggagtttggccacgatggaagtgccattgttaatggacaaattgtttggcgaaacgttttttgaagtcggatttaacggatttggcgagaagcaaagcattgaaaatgtgcggaacgaattggagacaattgtacaactgaatttcacacaaaacatgatggataaggcgaaggaaacgctgaaactgatcaatggcacgcgggcggaggccgaatcggaagcgaccgccgcgttggaaaccatccaaatgattggcgaagaagcccagg

SEQ ID NO: 59196 - DNA, 795 bp, Heterodera glycines
  Genomic contig location: Contig_ID=SeqID_5779; Location=207..1001; Strand=+
  SCN-specific regions: Sequence locations=1-29,52-246,277-297,327 -441,463-467,512-560,582-626,648-795
atgaatactgaaatatatttggtgaggaatttatatttgatattttaagtaagttggggagaaatgggacagtgagtttgtaaaccgaactgactttcatctccacattttcgctaagtgccttcagcttccagatgaagtccgaccgtgccacctgctccgagcggcgactttgcatgccaatcagaaggacagcgaagaagatgaccagcgtgttcagcagttgcaacttcagcgaatcgttgctttaaaataaaaacaatattttttaattttgctattgccgattgaaaatcctattattttaaatttaattatatttttttgaaaattcactcgcaaatttcttcagcttttacggatggagacattgtggccaatgttgttaatttaatcgaattttggccatttgcttcggcgttcgtagaaggaaaatcgagcatccaacatctgttgtttgttaattgaattatttttataaaaataattgaattaattttgttaaaaattagcaaacaataaaaaaaagggggtacaaattcattaaatttaaatgaatacaattttatttaaaaagaaattgttaatccaagttaatatttcagttatcaaatttatgccaattcccaattaaaccaattaattggccacctgctccaaattgtgaccaaaatgggcaaacacagacaaatggcgatgaacaccttctcaagtgcgagcagagaatggaaagcgcaaacgcacaacaaaaggggcagcgcacattcaaagattagctaaaagttaattagccaa

SEQ ID NO: 59197 - DNA, 1432 bp, Heterodera glycines
  Genomic contig location: Contig_ID=SeqID_5781; Location=44..1475; Strand=-
  SCN-specific regions: Sequence locations=1-235,257-493,532-618,640 -1432
atgtatcacattaaacatgatttaaccctaataaacccagacaaatccggacaaaggatggttctactcggtcaattcgaaaaagttttttgccaaaacagtatgaataagaattggctcagaaagaaatgagcttctgcatacaatcaacccattcccatttatcaatcattaattgaaattctgccttcagaagatgccaattgtgtgcatctgagttcatcagttgaaagcatcatttataatgcacacaattggcgttttctgtttggagtcgctgtcaacgaatgtgtactataatcatgttgttttgtaaattttggtccatcccttttggtatgataccaacccagggctctatgcaattaaatgttttcgtaaacttctgaatgggcacgcataaaagttaatagcccttaattttcttttgtaatattcgatcgagttggggcagtatgagttgggtttttaccggaaaaagaataatagaagctgtgaatttatttaccttttaaaaatgaatactaaatgacaagcaaatctgagacggagagagacattcaaaaaaaaagttccatgacagataatttgattcactttattgtcatttcgtttttgctgatcctccattcatttcaatttctcatctggactaaaaaaagaaatttcacaattcgatctatccaatcttcatcaaatcgttggccaccgacacggaaattgagccggaagttcgtcagcggacgagtacgaattccggcgggaccgagccaccaaaattccgcgtaattttttgacagaaaatttaatttaataaagaaatcttgcgtttcaggttgggaggtgaaggcgcttgagcaggactttgtcgaggacggggacgaaccaagtgcgttggaagtgcccgtggagccgatttgtgccggtggtgacgggacatcgtcgctgacaacgactaacggacgacagagtaccaacggcgtcgacgcaatgatcggcgccggcgccgaccatgacaaagatagtcagtcaaagtttgacattataatcgataaagcaatggcaatttttgaaaaaaatttggcactgattgaaaacttgtgccaatctttcagattttctggagttccaacttcgcaaaaccgccgtcggaggctttgcaatccgcgaagccaaccactgcactctaatgatgccaccagaaacgatacgtcatcattctgatggtggcgacggtggcacatcgacggcaccacagacgacggaggaaccgaaggacgaacagacacagcaaaacgaggacaaacacgccgaaccaaagccttcgtcatgttctctgctgaatccgtcaccaacaatcgcatcagtggagctggatgcactgaaagtacagcttgaaaaagtgggaagggaaatgcgcacattattttga

SEQ ID NO: 59198 - DNA, 1602 bp, Heterodera glycines
  Genomic contig location: Contig_ID=SeqID_5781; Location=1547..3148; Strand=+
  SCN-specific regions: Sequence locations=1-18,63-231,262-467,489 -554,577-973,1010-1245,1267-1447,1469-1602
atggagcaaaatgaaccccaacaacaacaaggacaggaacaacaacaacaaggacagcaacagggacaggaaccgcagggacagggacaaggacaggaaccgcagggacagcaacagggacagcggcccgagatgggcaaaaccccatcggtttgctttataaaattgaataaggcttccaaacttacctatttaaaaattttggtaatactggagaattggtgtccctgcttaaattaaaaatttttcttttctaaaaattaaagcatttatgggagttttctgggtcgatgatcacgaatctgacattaattttgatcaaaattcgaatccctgacccggactcgaacaaaagtcgaaattcaaaattctcacacacaaaaacaagttttttcggaattggccaaaactaaggtcatattcgtgattaacgactccaaaaacaccagaatacatgtttcttacataaaaatttattaaaaaatcaagtatttggtgaaaaatcatgacaaaatcaatgatttttcgaattctgagctcagatccgtaatcagcgtattttttacactagaaaactcgaacagaacgattttaaatttattttccgtcgggactacaattctgccctttgccacaatttgcatgtttcattaagtttgccattaaaaaactattaagcgaaaaagctccgcaatgcgcaatcgaatttggaaattcataaaaatatattcagtttttttttaccggcggtaccggtactagacaaaccagtaacggtaatttcatttttgaaaaaaccggtaccggtaccggtaccaaaaaaaccggtaattaccggccagtaccggtaccggtaccgctcaaccctactattaagcgaaaaagctccgcaatgcgcaatcgaatttggaaattcataaaaatatgtttagttttgaaacgattgtctttgtaccataacaaaaatatactgaatttttaaattttatttgtttcaatattttaaattcatggataattcgcataaaataaaacttccacccgaactcctttcggaaattgtccgaacccttcctttcaacatccgttggtccattgtccggatttccttcactttcgattatttggttgtaaaatggcagctaaattgggttagaatggaaaagcttcgtcgtcttaaaaagagagaggaaaaattgcgacgacaaaaagaaaaaattgtaaggagtgatgatgcgaaagcacaaaacattttcttacctgaaatattaattgaaagaaataatttaactgttttccgttgggacaacaattctccactgttaccaaggtgtgggttcgattcctacccgaggcttaaaattttagctttttattactaagtccagtaacgattttatacaatttcatttttttacattacagcgggtcaggacttatattgaccatttggagcgccagttggagacggtgcgcgcggcgcatgctcaagaaatggcgacggtgcgcgcggcgcatgctcaagtcgttgatgagcgggattttttgagacgcataatagaaaatttctcaaatcatgccgtggcaccaacaggtcagtga

SEQ ID NO: 59199 - DNA, 594 bp, Heterodera glycines
  Genomic contig location: Contig_ID=SeqID_5782; Location=857..1450; Strand=+
  SCN-specific regions: Sequence locations=1-258,285-381,403-415,438-594
atgcataatgatattcatttaggcaacggaggaggaaatcactggtggcaaaatgcgcccggacatggaggtcattttcattggcgttttatttttcgtttttaaaatttttctatttcgttcagtgcccttcggtggagcagtggcaaacaacggtggacaaggaggctatgggcaaaacatcgtacctggtctaaacggtggtcagggcggctatgggcaaaacatcgtacccgctcagggtgatttactcaagactattcagtttattatttttatttaagtgtaaatttatagaataggtaaaaaaaacattttttgaatccaaattttacttttttgcattttagctggcgctggcggcgttggatactttccggcggcctaccagcagcacggagggcaaaatgtgccgggtggaggtcctttaaaatcaattaaatccttcacctgaaaaactgattctcattgtgttttaaattaacaggccagtagtgttgttcttcggatgagactgattgtatgatgaaagactccgtcgatcgcttttattctcattctgtcgtcgtttttcccgctttattttggatgata

SEQ ID NO: 59200 - DNA, 1447 bp, Heterodera glycines
  Genomic contig location: Contig_ID=SeqID_28603; Location=111..1557; Strand=-
  SCN-specific regions: Sequence locations=1-324,361-488,514-629,656 -796,830-990,1016-1447
aaaaaatcgatttttcaagtgtccgttggggtactcaaacaattatggggagcaaaaatccaaggtaaaaataaagtagaggtatatcgaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggtactgccccgaaatccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaataccacacaagtattatttttttttaattatttttttcatttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaacccttcaaatgcttataaattttcttagaattttttgcctggaggaacacagttcttcacacttaccacacaagcttaaaatttttggcctgtttaaaaaggaattaaaaatttttttaaatttattcatctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 59201 - DNA, 138 bp, Heterodera glycines; identical to SEQ ID NO: 50950
  Genomic contig location: Contig_ID=SeqID_28604; Location=414..551; Strand=-
  SCN-specific regions: Sequence locations=1-138

SEQ ID NO: 59202 - DNA, 676 bp, Heterodera glycines
  Genomic contig location: Contig_ID=SeqID_28604; Location=554..1229; Strand=+
  SCN-specific regions: Sequence locations=1-59,81-676
gaaaaaaatatttatgaaacaaaaaaatcgattttttcaagtgtccgtttggggtactcaaacatttatggggagcaaaaatccaacgcagaattaaagtacaggctatagggaagctattcccgaaggattctgtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 59203 - DNA, 687 bp, Heterodera glycines
  Genomic contig location: Contig_ID=SeqID_28605; Location=106..792; Strand=-
  SCN-specific regions: Sequence locations=1-29,51-209,263-376,398 -497,519-601,623-687
atggacaaccgccaatttggtgcgactgatcagtttgaaaagtttttggcaacgggacgtcaacgattacaaagagaatgtgccgaattgaaacgccaaaagctcgtcagtgcacgttttgaacggaagcgcaagcgcgacaatgagatggcactgctcgctgacgaagtggatcagctcaagttcgaactggtcattaaggtagatggaaaaaattaattaattgttatttgctatttaaaataattaaaacaaaattaatcatagaaaaagttgaccacaaaatgaatatagcacaagcaaattaggaaaattaaagcaaggtgcttgaagggcataattaattgtctaaggtgcaaataattgattatacacggattagaataattgttttccataaatttttgtagataaacatttgaagtttaagaatttttttttaaagttaaattcgtaaataaacctgatttatagggctaatatttatagttgctaaaaactaccaaaataattagttttgtttctaaaaaaacccaaaatagttgctaaaaattggtaaatagttgctaaaaagttccgaattttagggggtgtaaaatcgaaaattttcttcaaaaagcaaaaatattatgccaaaccattaatgagatacataatttttacaatcaaaaaattatcgtcaataaa

SEQ ID NO: 59204 - DNA, 615 bp, Heterodera glycines
  Genomic contig location: Contig_ID=SeqID_28606; Location=5..619; Strand=+
  SCN-specific regions: Sequence locations=1-362,384-399,425-615
aatgccatccaattggcctggctcccgccccatcccgaaacttctccggtggtcgcttatcgtctccgttacggccccgccgcaggcacttaccggccgcaggaagtgattctgcagggcgacgaactcagctgtgccgactacgagtcgcgcattttgactggcgaacacttgtgcacttcggccacgggtctgaagccggccacgatgtaccgcttcgcggtgcaggcgcagtcttcgtctggcaattggggcccgttcacctcggacagtttcggcaccactgaacccgaactgaaggcggtggaggggggacagttgcgactgatcggcgcagggcacgactttttgcgagtgcggtggacggcaccgccggtgattgttgcgcacatcgaacaatacgaggtggacaaggcggaggacgagattcgcaactgtacctatttgtttaaagttgcacatccaaccgaccgaacgacttgtccaagcgccacaacggcacgaagtgccggacagtcagacggacttccaattcaaagggttggtgccggtgacagtgtacaacgtaacggtacaaggactggcacagcaggggaagagcctgtggaggattag

SEQ ID NO: 59205 - DNA, 1090 bp, Heterodera glycines
  Genomic contig location: Contig_ID=SeqID_28607; Location=1..1090; Strand=+
  SCN-specific regions: Sequence locations=1-359,382-878,900-1010,1033 -1090
  Gene Ontology: Mol. function=hydrogen-transporting ATPase activity, rotational mechanism; Cellular component=hydrogen-transporting ATPase V0 domain; Biological process=hydrogen transport
gctaaaagagaagctcgtaacggagttcactcacttgcgcaacaattctctggagcctcttgcgacttttcttgattatataacgtacgcgaaccgacggaaatatttattagaagcgtgatttttaagttattcatacatgatcgacaacatcattctgctgatcactggcactctccatcaacggccaatcaacgagctgatctccaagtgccatcccctcggctcatttgagcaaatggaggccattcacattgcatcaaacccggctgaactgtacaacgctgtgctcgtcgacactcccctcggttggtcgttggagaagggctttgattcgttggcctcgaaatcttcttgcttttatttacttagcattttctttagccccatatttcgtggattgcataagtgagcaagaccttgacgaactcaatgtggagattatccggaacacactgtacaaggcgtacattgaggacttttataatttatgcaaaaagatgggcgggaaaactgctgaggtgatgtgcgaaattttagctgtgagtttcctttttctctatttcatcttttttatcggtgtattaagttcgaggctgatcgacgagcaattatcatcacaatcaacagttttgacacggagttaaataaagaggaccgcgctaatttgtaccctcggtgtggaaaactgttcccagagggattggctgggctagccaaggccgatgattatgagcaagtgaagcaagtttgcgagtactactccgactataagcaactcttcgagaacagtggcctcaatccaggcgaaaaaacgcttgaagacaagtttttcgaacatgaggtgatccattccagcgggattgagttcttaggcgactccaaaatcatttatttaaaatgggtcaaatcagtgttctgtcgtttccaggtaaagctgaacgtccaggcctacctccaccaatttcattttggcgttttctacgcgttcataaaactgaaagaacaggaaatgagaaacattatttggatcgcagaatgcatagcacagcgtcaccggaccaaaattgacaattacatacccatcctg

SEQ ID NO: 59206 - DNA, 1344 bp, Heterodera glycines
  misc_feature (1192)..(1192): n is a, c, g, or t
  Genomic contig location: Contig_ID=SeqID_28609; Location=1..1344; Strand=-
  SCN-specific regions: Sequence locations=1-318,340-408,430-498,520 -763,933-1071,1110-1225,1249-1344
  Gene Ontology: Mol. function=signal transducer activity; Cellular component=plasma membrane; Biological process=invasive growth
aaaagcatgcggggttcatccaaaaccaatggcacgacctctaagccaaacatgccaagcagagtaacattacggctccacccaatgccactggggaaaatgccgaacagagcaacattttggcattagaaaatgccaacaaaaccgcaacaaatgccgaacagaacaagatcgtggcaccgaacaaaaccgtgacaaatgccgaacagagcaacatcgtgacacccaacaaaaccgcaacaaatgtcgaacagagcaacatcgtggcacccaacaaaaccgcaacaaatgtcgaacagaacaacatcgtggcaccgaacaaaactcaaacaaatgccgaacagaacaacatcgtggcacccaacaaaaccgcaacaaatgtcgaacagaacaacatcgtggcaccgaacaaaactcaaacaaatgccgaacagaacaacatcgtggcacccaacaaaaccgcaacaaatgtcgaacagaacaacatcgtggcaccgaacaaaactcaaacaaatgccgaacagaacaacatcgtggcacccaacaaaaccgcaacaaatgccgaacagaacaacatcgtggcacccaacaaaaccgcaacaaatgccgaacagagcaacattgtggcaccgaaaaaaaccgcaacaaatgtcgaacagagcaacattgtggcaccgaaaaaaaccgcaacaaatgccgaacagagcaacattgtggcacctaacaaaaccgcaacaaatgttgaacagagcaacatcgtggcaccgaacaaaaccgcaacaaatgccgaacagagcaacatcgtggcaccgaacaaaaccgcaacaaatgccgaacagaacaacatcgtggcacccaacaaaaccgaaacaaatgccgaacagaacaacatcgtggcaccgaacaaaaccgaaacaaatgccgaacagaacaacgttgtggcatcgcctaagttgtgaagaaataaccaatgaatgaagagacttttaaatgttccgtaattcataaaaaatgtcttatttatgtttgtaaagcaatttaaataaaatattctgaatatcggccatatgcttttttatttatttattttttctttaatttctaaatttccgtattgtgtttagttggaaacgccgaaaggttaaacaggaaattttgcgcaccaataatacccactgcactatcatttgtntgcttttggcccagcaataaaatgcttttgtccacaaaaatattcttttttgtatggtgctcagttggccacccccgcgatggttggactcaaatgaatacgctcaattgtccactcccccccccccaatttcgtcatcttaatcacatctt

SEQ ID NO: 59207 - DNA, 515 bp, Heterodera glycines
  Genomic contig location: Contig_ID=SeqID_28610; Location=144..658; Strand=+
  SCN-specific regions: Sequence locations=1-74,109-279,364-488
atgcccattcgacctaggaggtacgacgaagctggcctttatgtaagtattttgatatcgctaatattgcttgcttttatatattaataatagaaaataaattttattcgtctttttttgaatattatttttttcataattcctttttcatctgtctttcctagttttagataataaattatatgtttgcataactattattaatgcctttgtaataatgatttttagcttacttgttgacatttaataattctgtcctttttgtgtttataccggaggaatttttaaaaaattatttaattttttcactaatgatataatttttttaattttaataataaaataatgattaaattaaatttacttttagtttaaagaattggtggctggacgtttcgccaatgaccgtttcgccaatgaccgtttcgacaataccttttcgacaatgccgtttcgacaatgaccatttacgactatatcatatcgccaaaatttaaaatatcaaattaaatata

SEQ ID NO: 59208 - DNA, 1600 bp, Heterodera glycines
  Genomic contig location: Contig_ID=SeqID_5783; Location=262..1861; Strand=-
  SCN-specific regions: Sequence locations=1-127,157-303,344-728,751 -1030,1053-1079,1102-1600
  Gene Ontology: Mol. function=translation initiation factor activity; Cellular component=eukaryotic translation initiation factor 3 complex; Biological process=regulation of translational initiation
atgtcgaagttctttcgaggtgctatttcaagctccgagtcatcagaaagcgaggagtctgccgatgagcaaatcgttcaaacccgtacgatgtgagtgattgaaaagaaggaatgtgcactttcgcttttataattaaatttttaacatatttaagagctcgcgatttcgcatatccgagtgattctgaggacgaaggcccaaaacgaattgtgcgcacccaaaaggacaaaacttatgccgaactcaaagaacagatccgttcttcacgaaatgctcgaaatatcaaggatattgctaaacttcaaacaggtttttattttacattttagataactaaagcatttggatatcgtcgagtgtatgtcataaaaaacattttaattttgttttttactttttaagtgtttgaggctcaactgaaattatgggaaaaggcaaaaacgtttattgtacgcgaaaatctgagcattcctcgcttttacattcgctatttggccgaacttgaggacttcatcaacgaacaatgggaggacaaagaaggaagaaaagtttggacaattttcaaccaatttaatagagaaattgaacagataatgtcaaaagcgaattcgaaggcattggcctcactaagacagaagttgaagaagtacaacaaggactttgaggaggatttgggcacttaccgaacggagcccgacccaatgggttattccagcggcgctgctgaagacgacgaggacgaggaggttatgggaagagagaatggagttcgtcatttttgagcattgaactttaaccataccaacgaaggaatgttcagatccctacagcgccggccattgcaacaaatgacgtaaatctgaagaagagatttatgggcgcggagtccgagtcggaaggcgaagagtccgagtggggtactgagtcggacgaatcgtcatccgcttccgatttggaaccattggagggcaaggaaatggaggagcttcgacgctatttcttaaagtgagcattgccacatattccctttaattttaaattgttttttaggaaggataaaacggacagaggcaaaacaaaggaaaagaaggaaaaggcggcacaacgcgagaaaatagcgctggagaagaagaagttggaggaggcagacgggcagaacgaggagtcttggcagaagatcacctacaaacatgacgtggccaagcccctcttcgacggccaggccgaagtgactggcgatttggtggtgaagaaacttctcgaattgggagccaaccgaggccgacgggcgaccaaccgaaaggtgtacgtgcgctacttgcaggagttgtacaaagctgcagatgaacacaatttgggcgttggactgctcgcaaaggtgctcaccgccattatcgctgcactttttgagctcaacacacgcatttccgatgcaatggaattcaattcgtggatgaagtcggttttcaattgtcacttcgtttcatttgcttttttaaggactgtcgaaacggtggatggattgtttagccttttgtccgaacatccaaatgttatcatttccatttcgactaatgaagacgaagaaaacattttg

SEQ ID NO: 59209 - DNA, 454 bp, Heterodera glycines
  Genomic contig location: Contig_ID=SeqID_5783; Location=2445..2898; Strand=-
  SCN-specific regions: Sequence locations=1-402
atgtcgactgaaagtgtccaactcggccagcagcaacaggaaagggaacagtcgcccgatttggcgggactgaacagcgacagtggcagcgaaaagaggcgactgcgcgtggccaaaagaggtggggaaagaatgccgacaattttcacgtgagatggctcttttgaggtgagaagtcgcgtagaaatgccactttggtcgcggtggagcgtgccgtgccgagtccgcccattgctctgcccaagtccacgtccgtttgttctgccgcttcttcgtccacttcttcgggtctgtcttcactatcattcagccattatttttatattcaaatttatgaaatgtttttaaaggtgtcccgcaattttccaatggcattgaagaaggagaaactgagactgattgatattttttaagaaaatcaaataattcatttttatattttatttcaaataaa

SEQ ID NO: 59210 - DNA, 506 bp, Heterodera glycines
  Genomic contig location: Contig_ID=SeqID_5783; Location=2931..3436; Strand=-
  SCN-specific regions: Sequence locations=1-31,55-94,116-168,190-506
atgccaaaaggtggcggtgtaagtgccaatcgaaagaaaaagggaggggacagagttaggatttatggcaaacacgaaatacaccctcagaagcaattttttaatccaaaaatacttttaaaaaccggtctcatatgaagcgttaattactgtaatcacgttgcaacgtattactgtattccattaaaaatactgtcaatgacgctttatccgagaactgaatgagcggacttcagaagggttttgttcccaatcccatttcaaatgctttcagactttcatgaccgcgtttgatttgaacttgcacatgggcacccacacggggttcacctacgactgcaaagattgcggcaaatgctttccctgccgaaagactctggcggagcacaaccgttcgcatcggatgattcttagtggcgggggcggagggagtgccagccccgaattgtctaaaaaggcaaatcattcattttgagtaggaaatacgcttaaaaggagaaaataaa

SEQ ID NO: 59211 - DNA, 1060 bp, Heterodera glycines
  Genomic contig location: Contig_ID=SeqID_5784; Location=497..1556; Strand=-
  SCN-specific regions: Sequence locations=1-39,183-185,207-371,393 -647,669-763,786-819,843-856,878-1060
  Gene Ontology: Mol. function=general RNA polymerase II transcription factor activity; Cellular component=SWI/SNF complex; Biological process=chromatin modeling
atgaaattggataatttgttggagcaaatgatgatgatgcaacaacagcagcaacaccaccaacaacaaaatcagcagggagaaaacgaacacggagaaggcaatgtgcagcagcaaaaggaacagagccaaacgcaacagaaacaacagcaaaagcatcgacaacaacagcagcaacagcagtgggaggaaatgccacaaaataatgtcggaacagcaacgaatggggtgagggacaaggggaaacaattggacaaatgaatgaggggtgccaaaggtcactaggatcaaattagttttagagtgaaaataaacaattttgatttgcttgttgagggggggggaggcgtcttttgggaggaagggtcatctcccccggggagggggaaagggtgcaaaatgcgtcctcttcgccccccccccgtcaccgccctccttcctattctatctacttgaaagtgcacagcaattacttggaatattacagtcttttcagaacgatgtccaatcaccaaacggcgatcatcaaagttttgctgaactttcggcgtccacagacaacgcaaaacgacaaaagacaaatgcatttttggccatttctaatgggaccagaaatgcggcacaatgcaaagaccctttccaatcccaaaatcaccagcaaatgttgacggtcggtggattcggtgaaaacaatggcagagagtccctccctcagcatttggaatcgttctccgcctttttaaggggtgagcaattaattgtcaataattattatttaattatttcttattgatcaaatttaacggatggattaatttgctttttgttaattatccttttctatagcatttaaaagctcccttttccttttctctctaattaattgtaataaatttcagcgaatttgtcgcttttgtccgccttttcgcctcctttgctcccgcctcaacagaattcggtccttccgccgatccttccctcgcctattcctcaacaaatcgttccgttgagcaaggaaatcgcctcgcagggccttttggccgtcggtggctgtcgtccg

SEQ ID NO: 59212 - DNA, 1044 bp, Heterodera glycines
  Genomic contig location: Contig_ID=SeqID_28612; Location=1..1044; Strand=-
  SCN-specific regions: Sequence locations=1-90,112-172,646-649,671 -675,929-1044
attccttttttggttccgccttgtccaaaggggtccgtcttctgccgttgtttctgacgctctttgctgtcctcgtcgcactttgtgtttctgtggaggggcagcagccatccgccgaggtaagccatcacaatttagcagaatttatttatgatcatgatttttggaacatttttctttccttcctttgctagtctcttattcgttttctctccctcccttctgatcactttcactctcttcttttcccttatctctgactctttgtttcccttatctctgactctcttcttttcccttttatctctttcattgcttttctctcttctgatcactttcattctcttcttttccctcttcttttcccttatctctgactctcttcttttcccttttatctctgtcattgcttttctctcttctgatcactttcactctcttcttttccctttatctctgtcattgcttttctctcttcttttccctttatctctgtcattgcttttctctcttctgatcactttcactctcttcttttccctttatctctgtcattgcttttctctcttctgatcactttcactctcttcttttccctttatctctgtcattgcttttctctcttcttttccctttatctctgtcattgcttttctctcttctgatcactttcactctcttcttttccctttatctctgtcattgctttctctcttcttttccctttatctctgtcattgctttctctcttcttttccctttatctctgtcattgcttttctctcttctgatcactttcactctcttcttttccctttatctctgtcattgctttctctcttcttttccctttatctctgtcattgcttttctctcttctgatcactttcactctcttcttttcccttttgtattgttttttttttttgctttgtttcgtcctgatcactgttcccccttatttcagcagcctcgcgcagtccttttggatctgatccctaaagaacttgtggagaataagcgatcgccgcgacactttgcctt

SEQ ID NO: 59213 - DNA, 553 bp, Heterodera glycines
  Genomic contig location: Contig_ID=SeqID_28620; Location=13..565; Strand=-
  SCN-specific regions: Sequence locations=1-553
cttctgtcaaagcacaaacttgaactggagagggccaagcgcaagtttggggacaatcagcgttcattggtcgacgcgaagcacagtttggacgtgatcagacagaaacaccaggccaccgtcgacgaactgggcaaaattgacctgagattgggcaaactccatgacgaattggccgagaagcacaaaaatgtaaaatgcattcgcagtgatagactattaaatgtttcgaattttaataacagtatttggactacaaaaatcgtttggacacacaatacaacgaattgttgtcggcggtgctggagaaagtcacgaaactctgcgaccactttcagcagatcgaggtaaaaaaagagcagaaaacagttggtattgttcggtttctcattgaatgagagatttttttttgctttagtcttcacaaattattaattgtttaattcaggaccagaagaaatgcttcgcagaattagccaatgaaatagtcacgaagaacaaggaggatttgaagcaattggaggcgaaggaaaaggccgaagcggaagattaa

SEQ ID NO: 59214 - DNA, 703 bp, Heterodera glycines
  Genomic contig location: Contig_ID=SeqID_28621; Location=350..1052; Strand=+
  SCN-specific regions: Sequence locations=1-53,78-214,244-379,404 -540,570-703
atagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaatatcc

SEQ ID NO: 59215 - DNA, 833 bp, Heterodera glycines
  Genomic contig location: Contig_ID=SeqID_696; Location=2757..3589; Strand=+
  SCN-specific regions: Sequence locations=1-19,56-577,684-833
atggggaccaatgttagaggagaaaagcgaagcaaagaaaaggcgaagggaaaagccaacggcgagggaaagcggcggaaggcatcgccggagggggaaaagtgccgaatcaatcgacagaggaaaagacaaagcgacacaaaaaacacgcgaattgcgacaacttttggattttgtggacgaccgaaagcaattggcagacgaagttttggacagtttggacgtgaggactcggaacagaatattcccggaattaaaagtacaaaaaaacagacgcaaaagtgattggcaaatcattttttcaaatttagacaatgtcggagacggaaatgcgaaggattgtctacggatttatcaacggaatatcaaaaaagcgaattgtggcattgctccaacgtccgttgtgccaattttcaattaaatactcgtcatttgcaggaatagacttcgccgacagttcgtcaacctccgattcggaggaatgtccaaattccattccgtcgacttcgtccgattgtcgaaatcgctcaatttcgaacgaaccgaaaaaccctaccaaaacaaagagtaattcattgaaagaaaagcacaacagaaacaaaagggagaaggagttggaggagggcgaattgatttcggaggaggaaatggaaaaaggagaggagaagggaggggaagacggatcagaaccaccaccagcagcagaaagggcgacattcgaagacgacacggggagccaatcggacgacgacgaggaggacggccgattggcacgacgacaaaagaccgaaccgcaattcgtcatttcgcgtaataaacaattagtgttttaa

SEQ ID NO: 59216 - DNA, 1626 bp, Heterodera glycines
  Genomic contig location: Contig_ID=SeqID_697; Location=520..2145; Strand=-
  SCN-specific regions: Sequence locations=1-362,384-425,447-1059,1081 -1131,1153-1187,1209-1515,1537-1626
atgtccaattcgtccaacgaacagcagcagctgggcaatgggcagtcacaaaatggctcgaataggtcttctcttaacaatgctcaagccaattcgtccaattccatttcgccagaagttgaagatgaagttcagggacaacctcccgaggtgtttatggaatccttggacgaatattgctttttgatttccaattttgacctgttaacctggaaccagatatctattttcattggtccatgtttacatcggtagttaccgtaggtgtagaaatttataaatagacatatttttggcgaaacgcctttaatttggtaaaatgaaaccgtagtactacacgcagatggggattctttaaaccgagaaaatacccagaaataaaattgaaaacgcaaaaatgaactttttaggtgtttcggaacggatgtgaaattgaagacatggaggaattttggaaacaagcgcaacaaatacaaacggacaatcacgaattgtccgaaagagtgtcttctttaactcgagaggtttaacagatggggaaataacaaaaaaaattacaattacagcacaaccgaattcttgtcgatcacaacactcttcgcaccgaacatgaacgaattcttgtcgatcacaacactcttcgcaccgagcatgaacgaattcttcagcgacagcttgacgatttccactattgggtgagtattgctaaaatttaaaaccatgacagaagagtttaataatttttgcaaaattttagattctttgtttcgccttctttatcccggtatgttaattcgtataatgaataagtgtaattgaaaagattaagccgctgtcaatattagccaccgcgcgtaacaatgggctctcatttccggtaactgttctgtccgcactcgccgcgacaaatttctggtgcgaaaacaggaactcggtacaaaaattaatttctaactcatttcagtgcctttctgtggatccccggcattctcttcgccttggcattttattttggtttgaggaagaacgcgaagaaagagtgatctgtacgaattggaattcccagtctttcagtctgagtgtattttaaaaaaagaaggacaattttctgtccctttaatttttattgcattgcatctttgcttttattttgtaaaaatttcctgccttataattgtgttttagtgtttgttatttcaaataatgaccaccatcgaagaaaatttgttggacggtcctccggctggttactgttcctcatctgaggaagatgaagaggagtttgcggtttcaagaggcgcaatgccatgttcttccgcagtcagaggtagaatagagggggttttgcacgaccatcccaatttttttgttcagcttgcaattagatcgagacgaacggcaccgcggacggggccgaagggcgttttggcggactttgaacgttcccgacgagaaatgatggcacaaattcacactttgggtcgacaaatacgcgccgagcacctttctggatttgttgaccaaagatgtgaggcaatttgagcaaaatgttaatttattaaaatttagcacttttaggagacaaatcgaatcggtgagaatttaaatgagaattaaaaaaataaa

SEQ ID NO: 59217 - DNA, 785 bp, Heterodera glycines
  Genomic contig location: Contig_ID=SeqID_697; Location=4080..4864; Strand=-
  SCN-specific regions: Sequence locations=1-475,504-785
atggcggagctgaagtcgcgtcttgaaaatgccaccgattgcacgtccattgacgcgccttccacaatttgtccgtctccgccgcttcgacaggtgaagcaccgccaccacacgtcggcactcggccgtgctgtttcattgtggacgcggtggaacaagcgtcgccggaaatggttggtggacgggccggacagtgccatgaattcgagcattgattccctcctcaccccatgtacaggttcaattcctttgttcatgggtccgtcgttcccgcgcttcctccgtcgtctgtcggtgtcccgtcatttgcacttgcgcctccctttggcgtgcgcccgcgctgcgcgagttgcgcgccaactgcttgcccgtgcgcgtgcagcggtgcaatcgccagcggatgcagcgacggcttgagtaggtggggacaaacgcttgcattttgaatggaccagaggtatacgaatttcgtttttggttgttttgtttcattttcataaaaacagactacgaaaggcagaactaaaactgtccagaattgaaattactcccctaattttgaattgtcagatttgccattacgaaggcgtgcgaattggccgtgatcagctggacgaactgttcctttcccacggcagtgacattcgcctctgtctgaacaccctccaattcagcacgctgaaaacgcacacttccgaccgaatccaagccaacaggacgaccaccgggacgacaacgacgacaaatgccaattttgtgagactatttttgctttcgtccggtag

SEQ ID NO: 59218 - DNA, 969 bp, Heterodera glycines
  Genomic contig location: Contig_ID=SeqID_698; Location=3427..4395; Strand=+
  SCN-specific regions: Sequence locations=1-569,593-627,650-969
atgtcacgcaaagtgttcaaatttatgttggagaaaaacgacggatggttgaaaaagaaattggacgaatatttggaggagaacgactacgaattcatcgacgaactgatcaatccgccaaaagacatggtgaacttctccacgacaacactttcgatgcaaaataatttggtgttttttctattttcagatgagcaacgaccattggaccctcaggggacgaacgcgtgaaaagtccgtcctttaccaaattgtgtccgagccgaccgccggattggacgtgggtgagtgatgcgttcattcaccgacaacaatgaatgatccgctgaaaatgggcctttttatgaagataaaatcgactatttgcttcgtgattctctgctgaccgatgtttcgatcaatttgagttcggtagggttttgaaaattgcaagagacagtggcaattaatagtgaaattaaattaagaacgaatggcaccgcattttgggcgctgtcggtgtcaccgtcgacagcaaagggttcaatcgcatttgccacccacacaaaatcgtattacaatttttaccatcggaattcattatactaaatccatttccttaacattttcgaaacttggccgcgtttttgattcccgcaaattgatgcacgaatgtgtttatggacacaaaacggtgatcgccgcagaaatcatgtgcgttgccttcgcatcctttttaccatttttttgaatgtttctaaggtacgtccgagcacttagggcagccgacccgcacctcgaatttgtcggacagaacgggacaaagtataaaatgtccaccggtgatcactttaaagggcaacaccttaatttacctaattcaaaattgcagcacacaaagacccgcaggcattttgtcgcctcgacaataatgtcatttccctggtagaaaatcgtccatttttcaaattccaacagacaaattgttaa

SEQ ID NO: 59219 - DNA, 1368 bp, Heterodera glycines
  Genomic contig location: Contig_ID=SeqID_698; Location=305..1672; Strand=+
  SCN-specific regions: Sequence locations=1-156,178-210,232-359,381 -669,692-831,854-889,911-1368
atggacatttctcgacttcgaaggatttgtgccatttacgcttccgatgggattaacggatatccattcagtttggcggtgattaagaaggcattggagtcaaaattaaatgtgtgctcattattgttccttcatctccggagggatctgcccgatactctcaaaaataacccaaagtaaggcaataaaaattgtaggaaatactgccgagtgacccccagtcataaaatttgttttactagtagagggttttcggagtctcagattacagatctgacattgattgtcacaaattccggacccggattcaaacagaaagttgaagtttcaaattttgcgagtttccgacttaggttctaaaattgaataaaataatggaaaatcaatcaggcaaataaactatgcctttggaatgtccaataattgacttgtttaaacagcaaaatttgattgttcattgtgttatttccccaccatctttaaagtgcagattcgtcgcgttggaatgttttggtttcgattcattagaggcaattcgcaaaagattggcaaaggaagacatttcgcgcgaatctttggtgttcatcgactcgcttcccgttctgatcgagcagttctcgctgccctccacctcgtggttcctcacccaaattgccgaactgtccgcctgcgttttggcattggttcacagctcagaatccgaagatgaccaaaacagcgaagattggcgacgaattgaatcaattgcatcgactgttttcgagcttagggcgagggataaacacacattgtgccgaacgaagaccaaaaaaaggaatggcaccgcagaagagaaggcaatggcaattgaaaaatgcacaattaaaaacagacatttggaagttactcgtttattttactttcagcttgaacaattctccatcgaagaagactattccatcactttttctccatttgattattcttctgatcggactgacgacaaattcgtcgagaattccatttcggcaggcggaaccgtcggcaatggcaccgccactcatttgtccacacttccgtttgacctcggcttgaatttgagtgaggaggagcgcaaagcgaaggctcgcgtgcctttgccttatttggacgcgcaaacagagaaaggtcgactctttgggagttctttgccttctcatccaaacaaatttgcccttttccatttgtttggacagctaacaaaaggccataaatcgactcttttaaggtttggttggtctcaacatttcattcaacaaaaaagtgagggtcggcggtcgcattttgtacgtaccggacaaagaggacgacttcgacgagagcgacccggacgacgatttgacaatctga

SEQ ID NO: 59220 - DNA, 1053 bp, Heterodera glycines
  Genomic contig location: Contig_ID=SeqID_700; Location=543..1595; Strand=+
  SCN-specific regions: Sequence locations=1-641,670-836,858-875,898 -1053
atgtttaaaagtgcccgcggcaaaggccttcgtcgagtcaatccgacaacacttttgtattccacaaaaagggatgggaacgagcgttgggaggaagaggtcgcaatttgggaaggaataggcgacgaaaacgaaaatgccaacggaggcgaaatgcttttgacgcccattttcgctatgccaccgaatcaaagcgacggagcggcacaaatggacgaacatttgcaccaattggttcgcatttgtacgattgtccaccgccaagcgtacgctgtgacacaaaaattgggaagggcggtggacgcggtcaatgcgacggacggcgaaagtccgcgaaaagcatgcgaattgttgcgcatttacgaagtgagcagttacagaaaaaaaccaaaatcacaaaaacctatgtatttttaaattgaccctcccaaaatttgcagcgcataatttggcggtccatcatagaaattgaccagaacatcaaaacactttcgagttccgtccgcggtgaattgcaaagaaatgctatgaacctaatttttttcttgtcaccacagaaagcattgactcgtgcaaaatcaatgaaccgcgactcgaatggctgctgagcatcagcaaatttcgggtcaccgtttttgaccaaattaaaatttaaaaaataattttaatcccattttccgttggcaggtggaaatggaaaatgccattgacagcgaaattggcatttgtaaagaaattgagcgcattctccgaattcgtgcgaggggcgaagttcgcggactccggattaaaggggaaacagtcgcaaaagtcaacgcgataacaaacgaaatcgccaacaaaacaatgaaaatcattgaaaaatgaaatgctatttaatttaatctttgtttttattgagcataatatctaaattaagaaattgaggtattcctaatcaccggatcgttctccttctgcttttgttgtccatcacctgaaaacagcgctttacattcggccattttttccgggtccaatttgttgatcaaagcgaatggcttaacgagggaa

SEQ ID NO: 59221 - DNA, 136 bp, Heterodera glycines
  misc_feature (96)..(96): n is a, c, g, or t
  Genomic contig location: Contig_ID=SeqID_700; Location=1..136; Strand=+
  SCN-specific regions: Sequence locations=1-27,49-136
taattgtctttcgatgttttattccgattcttcttctgtctctcctttcattttcacatgtgtagaatctttcaaattgtctaaatgcttctttcncagattccaagccgattttgataattaattttacaaaata

SEQ ID NO: 59222 - DNA, 1111 bp, Heterodera glycines
  Genomic contig location: Contig_ID=SeqID_5786; Location=186..1296; Strand=+
  SCN-specific regions: Sequence locations=1-60,124-143,231-662,684 -700,722-1074,1096-1111
atggaaaaggagaggagtgaaagactaattaatgagagtgagagagattaatgactaatcagagagtgagtgtattagaaagtgagagaaggagacagaggaagagagagagagcgaacgaaataaggaatattaatagtgaggaaagagagagagagagagagataaagggagagagagagagagagaaagggacaaagagagagagaaataaagggggagagagagagtaaaagcacaggatgaaaaatgcccaaacttggctaaaaaaatttgaatatgaaacaaaaaattttatttaatttcaaaccgaaacccaactcataccgtaaacgaatgaaatcattcagttatcgtaagaacagcaaaatttcattatttaccttttttcgttttcttctatttttggctttgggttcatttattttatcttccatttttcgtttggaccgtaccaccgcctccccccccccccttcttactaattaactaattaatacgaattatgaacaagaattataaattgcatttttcagtgtgtgtaaaaatgggtggggaattcactgataatcaaaacgaaaatgatttggtgacaaaaaaggcaaaggaacgaatggaaaaaggaggggaatttaacaaattagaaaagcaatttaaattaaaagagcattttaaaatttgattgaccaatccttggaaatgttttctgttagtgcttttagcttttttaggctaattaactgatttaaacaaattatagagtctttaatcaaactctttaacaatctcatttatccccccccccccccctcctcaaattggtcaatcttccgatcgtttttcctccactgaaaaagcaccatattattttctctccctcccccccccccgggggattcgtttttgtccatcgattgattggtccgttggtcgggcgaaactctctaaatttccccgtactatctcttcattctctgctatacagcctctctcatcttacgtttactctctctctcctctttttttattatgttaataattctgtagataattatcaaatcagtgcctaattagttgaaagaaatgtttaaaaaagtgacgaaaaaagata

SEQ ID NO: 59223 - DNA, 862 bp, Heterodera glycines
  Genomic contig location: Contig_ID=SeqID_5786; Location=5580..6441; Strand=+
  SCN-specific regions: Sequence locations=1-138,160-205,227-862
aattcggtgtccaactcatccgaatccgccagcagtgatcagcaccagcaaaagccgtccctcgtgctgcactcgtcgacagcagccaatcgcccgccgatgttcccccattcgctgctccagggcttcactgcttccgcctcctcctcgtcgtcgtccgccgcctcgggcggcggtgccgtgccgaacggcgctgggggcggtgccgtctccggcgcttcgcccgccacgccgtcgtcgctgctgcagacggacagcaaaccgtcgcccaccgaaatgctgctgtccacgtccgcaacggtgccgcgcacattaatgattgttaaattaatgatcaaaaaggcttccttccattcattaattgcttttaggcttccgcgaccgccgctcaattggccgttgccgcacaaatgtcggcgatgaccccaaatcagcagcagggtgtgttcagttggaagaaggaatagtagggtccaaacagaatgatttgatgctggaatctgaagcagttcattcgcaaaaaacaacgaaattcccggctaaaaaaatgctaaaaaccccaaatctttggaattatccatgtaaaaattgttttgtcattttgttggtcgaggcggactttttgtggcactttttttttaaatcgtctcttcggccaaatcactccatatttgatcctttcccccttttaggctccaatcgcgagccaaagccgttcaaatgcgggcactgtccgaaggcattcgccaacaattcctacctctcgcaacacatgcgcattcatttgggcattcgcgcgttcggaccgtgccaattctgtggcaaaaaggtggcacaaacaaatttcgaggaagacaaatga

SEQ ID NO: 59224 - DNA, 1180 bp, Heterodera glycines
  Genomic contig location: Contig_ID=SeqID_28622; Location=258..1437; Strand=+
  SCN-specific regions: Sequence locations=1-303,325-375,397-447,470 -827,849-1123,1145-1180
  Gene Ontology: Mol. function=RNA binding; Cellular component =cytoplasm; Biological process=pole plasm RNA localization
tcactcgtcaaaagtttgacctgccttcgttgtccgttgaccagttggtctctgagcagaaccagcaaatcattgggcccgactttgaacttcatcagaatgtcagtgtcactgtcagaggagggaaaagcaacaatggagaccaatatttgatcaggtgaaagcagcatttagatgaagttaacttcattttagctcattccaagaggcaaatttgtcccaacaaattctccaaaatttggcccaaattcgtttcatccgtcccacagttgtgcaaagtcgcatcattccacttattatgcggacaaatggttggccaatttgaagcaaaagttgaagcaaattctgtccatttttagaggatttgctgtgtttggcgtccaccggcacgggaaagaccggcgcctttctcattccgttgctaaacattttgcacatgttttgctccatcaaagagcttgggaatcttctctttccagtcaatcggcactttccgaaggcgattatcgttgcgcacacaaaggaattggtgctccaaatcgacaaaatggcgcgaatcctcgcagacggtgaattttgaaccattcattccaaatcaaattgcgtcgtctttgtttatccttttccgtcgatttgcagggactggcgttggcattgttctaatgatgggcgagctgagctacgcttcgatcaacagccgaatcaaccgggacggatgcgatgttttggtcgccacccccggccgactaaaggaatttctcctgaagaatcggatcgaattggattgtctgcagtttttggtgatcgacgagatggacaaattcttttcggtgtttttgcctttgtttttgatccgattaattgcttcttcatttttaggactttgaatttctgcaattgtttcacgaattgaacgaaaaaaagagacaatgcaaagtgacaaatgttttgtccgcttttatttttccactttttcagagcaccgtttggccctttcgtacttttttgttcagtgccacttccgattccctcgacggcgtcgttccgttccttcgccccgatttcttccatgtcatcgctgggccggtcaaccaaagtgttgcgcacgtgcgacaacgcatcatttcgacaaacattttcatgcgaatccatcaacttgagcttatcttgcaaagagaag

SEQ ID NO: 59225 - DNA, 825 bp, Heterodera glycines
  Genomic contig location: Contig_ID=SeqID_28623; Location=89..913; Strand=+
  SCN-specific regions: Sequence locations=1-363,387-517,540-591,613-825
atggtcaatggatgttcaattttgaaacaaaaaaagacaacaacgggatactgtataagaatattaacacaagacgattggacgggattggatgataatgcttcaatcgatttcgtagataaaaatggaacggtaagcatttaaataactataaatacccaaaggccctgaaatagaatttttttttttatgtttaaatgtagaaaaaaaaagattcaatataattgaaaatttttcgaaaaatgcaaaatttattattcaaaaaccccaaaaaaataagtgggtgaattttgagataatatttagaggtggaggtgtattttttttttgttaattaggaatatgcgttgtatctttttgcatatttttctgcacatatgttatgaaaaaacggctcaatattagcatttctgcgtgaaaatttttttgatgctttggtttaacttttttattacatatgtataaatgtgcatatttttacattatttggttttaaagtatgtatgttttttcttagttctaaaaatattgttattttacagattaaaactatagaagtaagacagctgcgcgtaaaaaaagaaagtatattttacaccaaaccctaaaactcatatggaatttctgtctatttcaatgaacaattcattgttcgactactaataaattatgatgactcggtggataagaattatttggagatattgatccaaagcaatggctacaacgaaatcccaatgatatgattacattcaaacgcaatggaccttatggaatacagacagacaggtaggtagtaaatgaaaattataaaagtttttaaaa

SEQ ID NO: 59226 - DNA, 79 bp, Heterodera glycines
  Genomic contig location: Contig_ID=SeqID_28625; Location=13..91; Strand=-
  SCN-specific regions: Sequence locations=1-79
atgaatataataaacgaagaaatgaacattgttaatctttttaatttatatgtgcatgacaatgacgaaaacttgtcag

SEQ ID NO: 59227 - DNA, 689 bp, Heterodera glycines
  misc_feature (33)..(33): n is a, c, g, or t
  Genomic contig location: Contig_ID=SeqID_28627; Location=194..882; Strand=-
  SCN-specific regions: Sequence locations=1-166,188-438,460-689
  Gene Ontology: Mol. function=phosphoribosylaminoimidazole-carboxamide formyltransferase activity; Cellular component=cytosol; Biological process=nucleobase, nucleoside, nucleotide and nucleic acid metabolism
atgtccaccttcagcgatttcatcgctctgtcncaacgctgtgatgagctgaccgcgcgcattatcaaccgcgaagtcagcgacggagtcattgcgccagactttgacgatgcggcgctgtccatgttggccaagaagaagaacggcaactacgtggtgctgaaggtgtgcgtgcattcattcattctcttgccaattttcctccgtccgttcttttttttaaattggcgccctttggcgatatgtttctctccccgccccctcctcagattgaccccaaatatttgccggcagaggacgaagttcgcacagtttttggtctgaagctgaagcaaaagcgcaacgcggcgcctctctccgcagaatcattcgccgatgttgcggtcggagacggcgacgaaatcactgcttcgacggtggacgatttgctggtgaatttttagggaaagtgaatcaaaatgccaataaccgtcaaaaatttttctacgctttttcaggtcgcctgtgttgcggtaaaatacgcacaaagcaacgcggtgtgctttgcgcaccgaggacaggtcaatgatcagtcaaacaaaagcaatttgaaagggcgcgaaaagaatggcattggcaaagtgccattagtgaaaatgcccgaaaatgcttttatcattgaattagcagttgaccagtttcatgttcag

SEQ ID NO: 59228 - DNA, 669 bp, Heterodera glycines
  Genomic contig location: Contig_ID=SeqID_5788; Location=24..692; Strand=-
  SCN-specific regions: Sequence locations=1-669
atgtccagcgaatcgttgcacattaagccacaagcaagtggccaaacaatttaccaaaatccaaatctacaactaattggccaacccaattatcaaaatccaaatccacaactaattggccaaaccaattatcaaaatccaaatccacaactaattggccaaaccaattatcaaaatccaaatccacaactaattggccaaaccaattatcaaaatccaaatccgcaactaattgcccaaaccaattaccaaataccaattaatccacaaccaattggccaaaccaaactaacacataacttgccaacagaagtacttagtctcgatatgttaagtttgggggatacctcacaaaatcaggctcaacaaatggccattgctcccgcaaatttggcaaatagcacagaaaccgtacgaccaaatgataaaacgactacttctaaaccacgtaaaaaaaagaattcccatgatccatttgcggacaatgcgggcaatcaaatgccgactcagtacccaaaagtgccaattagcaaatggacaaatcaccgattgcctgttcatcccaaagagcttatagcgaaaggacaatttgatgttaaaaagaaattcccagcagagactaatggacttgacaaaattgccgagttcatggatgacacgggcgaatga

SEQ ID NO: 59229 - DNA, 1802 bp, Heterodera glycines
  Genomic contig location: Contig_ID=SeqID_5788; Location=820..2621; Strand=-
  SCN-specific regions: Sequence locations=1-278,333-446,557-630,652 -873,895-1145,1167-1549,1571-1802
atgtcgcgccaaaacttcttgctttaccaccaaggaattgcacttttgtccgacaaattggccccaatacatgtaaaatttagttccgaaactccatggacacttggcatgaaagcgtgtgacaattcagcgcttttgggaacttttcagtgttttttccattttttttgagggttttgtgatatgctttttggatgaaacgacattttcaaaacgatgtgatgcgttcggcttaactccctcctcatactggaagtgtctctccgagcattccacggaattaaaaagttatttttttgtgtaaaatttaatatatttttttttgaattttacacataaattttcttttgattcagtgatttgctctcgtttcgtatgcctatgctctcagatttttaaattccatttttcttctttatttctattttgtttttaaaaaatggttcaaatatattttttattaaaaaaattttatttttaaaaaaagatattacaaaagtcaaatattgttcaaataaatttggcttaaaatttaaaaatttttgttatattttttcttattacctcataaaatgaaaaacgagtgaaaataaacacattataatacatattaatagagctcgacctggacctggatccaggcctggatttttcctggatccaggtccaggtcatttttcggcaacctggattttcctggattttttgtccaggaaatccaggtccaggtctattataaattagatatttttagatgttcccaagcaattaattgattttttcaaaaatttatttgctttttaaaacaaatttcaaaaaatccagtccaggcctggatccaggtctcgaggagcctggatttttcctggacctggattttcctggatttttgtccaggaaatccaggtccaggtctaatgtgaaaaaaaaatccaggtccaggcaaaacccgaaaaaatctggattttcctggacaaatttttagaatttattatttcaagtgaccgatgttttttcaagttttcaaaaaaagatcaaataaatcctggatccaggtctcgatgagcctggatttttcctggacctggaatccaggtccaacatggaatccaggtccaggcttttttcaaaatgtcgagctctacatattaatattaataataattgcctgtcagtattagtttttcaaggaaatggttcagcggcgtaaagccacgtctatattataagcagagattcagccagagagcatataagaaaatgaatttaagtgcgttggcaatcgatttggcattttttgccatttttcaaagcaaaaattcttttggctttattatatttctttttatgcatatcatttactatattcatattttttcaggaattgttctcccatggaattgcttccttttttccttttttgtgcctcctttttctgcgtgccattgagtcaagtaaaagccgcttcaaaaaatgggcccattttcgacgcttcgcccccgcgcgatcgcccaaatcaaaagccgtcgctgaccgatctatcatcaattggacagaacaaaaaaggagcggcaaatgcatggcatttgccggaaagagcggctgaaacggcgtcagccgaagcggcaaatgtcacaagctcaagcagtacccaagcggatagcagccattccagcaggaggcaaacagtagatattacgaaaagtcgaagaacccgaaggcctagcattgcagaaaatgaaccaattaccaagcagctaaacgatttggccatccaagaacgtattcattgggtttcttaa

SEQ ID NO: 59230 - DNA, 1773 bp, Heterodera glycines
  Genomic contig location: Contig_ID=SeqID_5788; Location=1947..3719; Strand=+
  SCN-specific regions: Sequence locations=1-24,46-119,230-343,398 -735,759-761,793-819,842-1182,1205-1213,1353-1396,1420-1440,1468 -1494,1523-1526,1548-1631,1654-1697,1719-1773
atgacctggacctggatccaggaaaaatccaggcctggatccaggtccaggtcgagctctattaatatgtattataatgtgtttattttcactcgtttttcattttatgaggtaataagaaaaaatataacaaaaatttttaaattttaagccaaatttatttgaacaatatttgacttttgtaatatctttttttaaaaataaaatttttttaataaaaaatatatttgaaccattttttaaaaacaaaatagaaataaagaagaaaaatggaatttaaaaatctgagagcataggcatacgaaacgagagcaaatcactgaatcaaaagaaaatttatgtgtaaaattcaaaaaaaaatatattaaattttacacaaaaaaataactttttaattccgtggaatgctcggagagacacttccagtatgaggagggagttaagccgaacgcatcacatcgttttgaaaatgtcgtttcatccaaaaagcatatcacaaaaccctcaaaaaaaatggaaaaaacactgaaaagttcccaaaagcgctgaattgtcacacgctttcatgccaagtgtccatggagtttcggaactaaattttacatgtattggggccaatttgtcggacaaaagtgcaattccttggtggtaaagcaagaagttttggcgcgacattttggttattctgttgattggcattccttttgcggtaaatttttggattttgatttttttaatgtcaaatttgcagtttttgtctgagaaaataaacaaaattaacaacaaaatagacgaacagcaaaaggtaaattcattggcaataaattaaaatattttatttgaaggttttccttttttcaggcgatcgacaaaatttgggatcccaaagaaattcagcaggtgtaccgatttttacaaaactgaatcatttcttttgatattttcttcaaagttcattattagggtggaaaaaaggacctttgggaaaatttttagaaaaagtttataaatggaaaaaattttcaaaaattaaaatgggatggatataaattgtctaattcggataagtaattttgcatattttcagtcatttgtcagcgcatcgacctatgagaaaatggcattttttgtgtgcggaatcgtcgttggcttcacactttctgatcaaaggaaatgccaacaaaatttgggcggaaaaacaacataaatgcaaaggatgatgaggaagaggccaattgaaaagaaaattggggaggaggaggagagaatgggagacgagtggaggcaattttagaagcgaatgatgagcaagaaaaggaggaggaggataatgatgaacaggaaaaggaagatggaagtaagtgaaccatttttgagcaattggaagggatgacgaacgatgaggaggacaaggaagaattcgacaatgaggaagaggaggaattggaagaaaatgaaggaaggcaattctggtggccaatgatgagagagaaaagggggaggagaaggaggaggaggaagaattttacaatgaggaggaggaggaattggtagaatgaaaaggaagaatttgacaatgaggaggagttgacggagcagaaggccatttagtgagtagcattctcaccgagaaaaaatttttacaaaacaaaattttttttttgaaggaaatgggggaattcagcgaaatttgcgcatttttaagatttcttttagcttttcggctccattccccttggctttacactaaatttcattcatcaatgaaaaaaa

SEQ ID NO: 59231 - DNA, 343 bp, Heterodera glycines
  Genomic contig location: Contig_ID=SeqID_28632; Location=443..785; Strand=+
  SCN-specific regions: Sequence locations=1-343
cggaggaatatgtcaaattatgcttcgaactgagcaattgtgcggcacaaagtttgggcgccgattggctaaaatcgtcggataagcaattcctgcgtctgttggccagtctctccagtggtcgtcttcgcattttgttggataaacctgaggaggtctctttttatactacgattctttaattgtcgacgtttaatttctcagattgacatggctcagctcatcgcctgtcttcagctccaggaatatttttgcggctgtgttgaggatgaacagatttggatgagcgacgatgagcaagtttttctgtcatttatgaagcgagttgataaaactgtcgaaa

SEQ ID NO: 59232 - DNA, 83 bp, Heterodera glycines
  Genomic contig location: Contig_ID=SeqID_28634; Location=674..756; Strand=-
  SCN-specific regions: Sequence locations=1-83
aaccaaggcccctgagcaaggcggacaagttgcggggcaggcaaaatcggctgctcgcgcaaagccatcccgactttttggag

SEQ ID NO: 59233 - DNA, 226 bp, Heterodera glycines
  Genomic contig location: Contig_ID=SeqID_28635; Location=105..330; Strand=+
  SCN-specific regions: Sequence locations=1-71,140-226
atgaatatttcattgtgtattcttcagaatcagcaatcggtttgagcattctttcttcgtcatattttaccaattttaataattctaagtttttttcaattaattattaaaattaaattaattgctttttaaataaattctagtttgaattgttttgtttttttgttttctaattttgattcagcctcctttttagatgaagttccttctacaattactttatgta

SEQ ID NO: 59234 - DNA, 310 bp, Heterodera glycines
  Genomic contig location: Contig_ID=SeqID_28636; Location=311..620; Strand=+
  SCN-specific regions: Sequence locations=1-25,51-170,199-244,266-310
atgctgccaaatgatcataaaagtaagggtttttctttttaaacatataataattttctattcagaagagaacaaattaagaaagttgaagcaatattacgaaattaaagaatcaaatccgaaaatgagcgacgaaataattgccaaaaaattgggaattggaagtgcaactctgaaaaaatggaaaaaggaatttgtttaaaaactgatcttttgttcttggaaaaaaatgttcgaaattttgtcatttggagaaaatctatataaaaattattctttgtttcgaaaacattttgcacttttcgtataa

SEQ ID NO: 59235 - DNA, 384 bp, Heterodera glycines
  Genomic contig location: Contig_ID=SeqID_28638; Location=137..520; Strand=+
  SCN-specific regions: Sequence locations=1-279,304-384
atggcttcttccggtgcttctcctctgtcctactccaaccctgacgagtcgctaactccgtcctccaccaatgcgtccacaccaacggccacaaatggggcgacaacaattgtagggggacaaccgcacaacggcacaagcagcaacatgggcaatggaacagcaatgcttcaggggaatttcgaagtaattggcagtgccggcggaattgcgcactttgcgagcagtgccggcggagagtcgaactgctcgagcagttcaagttcagtggttgtgcacaagggaaagaaaagcaaaaaggacaagtcggtgagaaaagggagggaagggatccatgggaaaggcattccccggggacaaaatcgaaatgcaatcagtgagtga

SEQ ID NO: 59236 - DNA, 49 bp, Heterodera glycines; identical to SEQ ID NO: 51181
  Genomic contig location: Contig_ID=SeqID_28641; Location=406..454; Strand=-
  SCN-specific regions: Sequence locations=1-49

SEQ ID NO: 59237 - DNA, 505 bp, Heterodera glycines
  Genomic contig location: Contig_ID=SeqID_5790; Location=1444..1948; Strand=+
  SCN-specific regions: Sequence locations=1-240,262-332,354-384,406 -433,469-505
atgtctataactcaaaataaagtccatattcatgatcagcgacccaaattacgtaagaaaatatgtttttttaaattttagagcaaaaaaatgtgtccatgaaatttccaaaggggtatccctttggattttggctccaaaatcagttttatttttataacttttttcaaaaaagtgataaaaatgctaaataaaatttatataaaagagaaaaaaattgcggattttatcaatatttttgtataccttagcacattgtttggaatgagttatgaatttttatgtgaaaaatcgaatttttcaactttttcaggaataacatttttcatattaattgtagaaaaatgcaaaaataatgataaaattctcccaatttttctgcattttttgatcatttaatcttcacatttgacccatttcaaagggagttattaatttttgaaaattcccccaaatttcccctgggcgaaaaatgaaaaattcaaacacacccaaatttggtcaa

SEQ ID NO: 59238 - DNA, 5082 bp, Heterodera glycines
  Genomic contig location: Contig_ID=SeqID_5790; Location=412..5493; Strand=-
  SCN-specific regions: Sequence locations=1-152,174-375,397-508,533 -782,804-1037,1059-1172,1194-1463,1486-2087,2109-2111,2134-2480,2502 -2605,2637-3188,3210-3385,3433-3493,3548-3582,3618-3645,3667 -3697,3719-3789,3811-4055,...
  SCN-specific regions: Sequence locations=...4092-4351,4373-4373,4398 -4557,4579-4689,4939-5082
ggaagtcatcaaagccgttacccaggccgcgtgggcgattttggcgaaaggctcgaggaaatgtctcgaaacgcccgggacgcttcgccgtttatcaacgacaaattctttaacgatgagctgaaaaaacgcgaagatttgctcaacaacccgttttctttaagggtaagtttgccttatttattctatttgggcttgaatcctactcctctcggtctaatgagcaaacacgaaagaatttttttgcggcaactaatcgctgaatagttacaaacccggaactgatataaccaaatgactttgggattgaaccgtccaacggtaaaaaaacgcatgaatgtttagcaaattttatattatgagacaaaacccattaaaattgttttatcctgttcaatcagaaaaggaaaaaatggcaaatttaaaaagattaaattttgggtggttaaagacagactgggaggagttaattgccgttaattttggccatattctcgatattcacaaaattttgttctaaaacaaatatttaatgagttgaggtcattgacaatgaaaaaatggtttcttcgcttaattcaatacacatgtgcaatgtatataattttatttggtttcgttatttaatttatccacttttgagaccttccatgaattgcacaaaatcgcggcatcacacaaacacggtgctggacaattcagaaaaaccgaagcgagcgtgggcgtttgttggggagcagccgtttcacaaatattaccagaaatggaagcgctagttatggaatgcaataaagcaaaagaaatagaagacgcagtgatttgtcatctgaaatttgtaagttacacgaaaaaattaaaatcagaatagttgggttttgaaacgtgctgaattttttaatttgtttgctgtgagtatatttttatttccggttttacgctaattgctttattgattccattaaagcctgttttcgatttttaaaacaattgaccaaaatcaaccctaagaaatgcaaaattcgaacggaatttgagaaataaagaacttatttcaattctgaacaacaaaattggtgctctctcagacagtgaaaaggataaaatgcaacaattttggctgggattttctgatgtttttgcattaaatgaatttgaactcactcaaaccgatttatttccccatgaaataaaaactgaaaacgcaaccccaattaaaactgctcctagtccaattccattcggtgtccgaacaaaagtcacagaaatgataaatgattatttgaaacgggaaataattcgaccatcaaactctccctgggcatctccaattgttttagtagccaaaaaagatggctcaatccgattttgcgtagactaccgaaaacctaacagtgtgacaatcaaagattcatacccaataccgaacattgaccaaattttgatgtatttgggaaacaagcactattttactgttttggatctaatgtcggggtattggcaagtacgagttaaagaagaagatattgaaaaaacggcgtttacagtacctggtggtctttatgaatttttggtcctcccattcggcctttgtaatgctcctgccaccttccatcgttttatgaataaaattttgggcgaatttgtgaatgattttgtttttgtctatttggatgatattttaatagcctcaaaaacttttgaagatcatatggtccatctcagaaaggttttcgaaaaactgaatgaaaacggaatgaaagtcaaggcagaaaaatgtggttttgctttagaccaaaccccatatttaggacatattcttacacgagaaggactcgcaaaagatccggaaaaatacaaacccatcaaagaatttccgatgccaaaaacaatcaaagaattacaaagatttttgggaatggtcaattggcaccgaaaatttattatgaattttgcaaaaattgcggcacctttaacaaaaatgttgaaaaaacaggatgctaaggtgttaatttggtcggacgaagcaaaaaagagttttgaatcattaaaatcgctaattgttcaggaagttgtacttaaatacccggattttaatttggcacaaaattatccaaaatttaaatttcatattttttcggatgcgtcgaaagatgggttaggtgcagtgctttgtcaacgggatcaatctgggaaaatgagaccaatttgttacgcatcaagacgctgtaaacaaaccgagtcaaattatgggccaacagttttagaatgtttaggcataaaatttgccgtacaaaaatttaagcattttatcgcatggcttccaacaatcgtatataccgaccataaggcccttccccaaatgttcaaaagcaaaaattcggtcggaaattcaaaagtagacagatggatcatggaattaggtgctccattaaagagaatcacgttgctgacgtactttcacgagcctttaactcaaaaactcttacttggaagaaaagggaagcgaaaattgcgcatcgggcgataagcacccgtgtaagttcaacagatttaaaaaacgggcgcgaagcgcccgtcttgagcctcgatgtggactaaaagcctctaataattttttaaaaattcaaaaaaaaaatctccaaccaattcgatcaatttgaatcgcttcacagtctaggtagcgaagctcaagaagcgcgaagcgctttatcccaagcccagatccgacggttcacgcacccgctagtttatatattatagaaagaagtggggattcgcacttttttgctattttgagcctaacgagcgccgggagggctttgcaaattcgatgtcccgaccaactttttgaggcggattcaggaaaaatacgggctttccggtccggtggccaggtgagcgccagcggcgctgaaatggcccctgtttgcagtctcagtgttacgaaattttttgcttttgctcagatcgaaaaacgcttgctgggaggaaatccagttggactatgccggataacattgccagcaaacatttttcgatccgagcaaatccgtgaccgggacaggtggccaaaaattggtacccaaaaaaccggatttctgtttttcgtgaataactcggccgcaagtgctcggagccggtttccctgacaagtagcagtgcatctttttgagctgcatccaaccgtgtttttggatttttgaaattttcgaccaaaaaaaatccaggccccctcgacggtttttcggttttttgccaataattttttttacatttgcgccatcgaaaaacgcacggcacttttgggttgcaacttttcaagagctttcgaatgatataaaaaaaattttgaaaactcaaaaaaagtttttccctgcagaaccggttggtccagtggtgtgtgctgggggccccccgggaggggggcccgggttcgaatcccgcggcgtgtggatgattttttatgacgtgtaacgatgttctaaggggctggaaatattttctaaaatttttctatatttttttcaattttttaaattttttatttgaccaaatttgggtgtgtttgaatttttcatttttcgcccaggggaaatttgggggaattttcaaaaattaataactccctttgaaatgggtcaaatgtgaagattaaatgatcaaaaaatgcagaaaaattgggagaattttatcattatttttgcatttttctacaattaatatgaaaaatgttattcctgaaaaagttgaaaaattcgatttttcacataaaaattcataactcattccaaacaatgtgctaaggtatacaaaaatattgataaaatccgcaatttttttctcttttatataaattttatttagcatttttatcacttttttgaaaaaagttataaaaataaaactgattttggagccaaaatccaaagggatacccctttggaaatttcatggacacatttttttgctctaaaatttaaaaaaacatattttcttacgtaatttgggtcgctgatcatgaatatggactttattttgagttatagacattttggaattttttaaaaatttttgaaattttaaaattttttggcccttgaaaatttaagctacattttgaaaattcataactcccatcaaaaaggtccaattcagtccatttaaagtttaaaaaatagagaaaaatagggagaattttttgagatttatttgggatttcgatcttgcaaacaataaaagttattccagaaattctggaaattttcgatttttcataataaaattcagaactcggttctgaaaaagtattttataaaaataataaactcaaaaaatccacaattttttgctctattttataaattttattttagctttttatcacttttttgaaaaaagttatagaaataaaagtgatttttggattcgggatcaaaggggtgtgaccatgatttttgtgtggaaaatttttttcaccaaaaatcttccaaaaaatgattttaggggttatttgggccgctgatcacgaatatgtaatcagatttcactttagagatcgttaagacttcagaatccctgcgtgattggggattctgaggcatcattttgcgttggtcaggttcgaacccggacggtgtaaatcattttttgatttattttttgctatattttaatgctaattattaagtcaaaattatttttgttattttttataattcaatttttaaaaaatgaaaataatttttctataaaataaataaagaaaaatttaaaagtgcatgcatttttaagtaacttttatctatttagattatttttgcatatgttgttattatttatttatatttaattaaatgaattttaaaacagcataatattttaatgttttaattagaataaatattagttaaaattaattaattaagaataataaaaaatgaggccgcgaagcggccgaatgaacactttaggtggggcagaatccattattaaactgcttaaagtagccgcgcaagcactagcaacgaagtctttttgcgcgaagcgctaatttcaacacacacaatccaatgcattttcaaa

SEQ ID NO: 59239 - DNA, 683 bp, Heterodera glycines
  Genomic contig location: Contig_ID=SeqID_28645; Location=86..768; Strand=+
  SCN-specific regions: Sequence locations=1-160,183-188,221-524,561-683
atgccgcttcacgttcctgcttcctttccgcgcccacctctccaaacattttttccacgtccaccccccccattgccatgtcctcagccgttctccacgtcaaatcagcaattttcaaatgtttgtccgacgccattaatcagccatacctttagcgccgataaattcacgtaatttcaatgattcacatattttttataatataattatttcaatttaagcaccatcaaaaaaacgacaaataattgaggacagagcgggtaatctattaatggaaagaaattgctaacaaataattttgataaaaaaagcaaactaattccttatatttagaacgctggcgctgcggaacttatcgaagcatacgccgggatgaacgacgaccggacaaacagcactacggagttttggctgaccgaaatgggcgctgtgttgaataccgagcatcctcaagacgcatgaccgacgacaaaaacaaggccgaccgggaccgacgttcaagaaaaggtccgttgaaaattcgcaaaatttttttgtatttaataattttaaaaatttttgaataacctaattaatctcaatcgtttttttcccattttaataggaccgatcggaaatgctgatgacaaaaacaaggccgaccgggacgaacgtttaagaaaaggtccgttgaaaatatgcaa

SEQ ID NO: 59240 - DNA, 343 bp, Heterodera glycines
  Genomic contig location: Contig_ID=SeqID_28646; Location=176..518; Strand=-
  SCN-specific regions: Sequence locations=1-16,38-96,118-168,228-343
atgccgcggaaggatcgcagcagcagttggagtgggaggcccctttggatggaagtggcggaggccatcagaataaaggcaaacactgccagcagcagaacaaaacttggccatccgtagcagaacactttaatggccctgctttttctcactttttgcattaaatccttaattaaataatttttcttttttagttttaaattcttaatttatttgatttattttttctttctcaggtgccccacactttccaagtgcacagttacaaacggccgacggtgtgccaacactgcaaaaagctgctgaagggactgatccggcaaggactccaatgccgaggtga

SEQ ID NO: 59241 - DNA, 667 bp, Heterodera glycines
  Genomic contig location: Contig_ID=SeqID_28647; Location=24..690; Strand=-
  SCN-specific regions: Sequence locations=1-226,290-349,372-667
atgtcccaatattcaattgctcaagtgtgcaaccacggagcatcgatcattttggacccgttgagtaacatcatccgatttgtccattgtgccctcggcgttgccattctgatcggtgttgcggcactgatccgacaatgccaacgatcgcgctttatcttccacggcaatttgatggtgagcacaaaagttcataaaagttcgatttactgttttccaatcagacaattttttgaaaaaaaacaataaagtttcatttttaatttttttattaaaaaataaaaataatgaatgacatttgaattaaatttgtttgctaattaattcagtttatttccaaattttctgcatttttaataatatatttttttggcattttttcgtaacaattaaacaaaaatattgaactggtttcagctgctgattgctaatgtgctatgcctatacatagtatacaccatcgcactgatcggaatggctggccgatcattggtaaaagttaaatattctttttcgatttatatttaattttgccatccaaaatatgcaggccttatacctgttctggccagttgctcaatttgttcagcagccgtataacaacagcagcggcggaaacattagcaatagcagtgatgggactgaaatggcggctgacaaaaagtaa

SEQ ID NO: 59242 - DNA, 148 bp, Heterodera glycines
  Genomic contig location: Contig_ID=SeqID_28651; Location=943..1090; Strand=-
  SCN-specific regions: Sequence locations=1-148
atccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaaca

SEQ ID NO: 59243 - DNA, 344 bp, Heterodera glycines
  Genomic contig location: Contig_ID=SeqID_5792; Location=1768..2111; Strand=+
  SCN-specific regions: Sequence locations=1-203,227-344
cttcctgtccgatgtggatcgaattgcaattcccacggccattacaaatattggacagggcactgatggaaagtgccagcgaaatcggcatggaagaagtgcacagcttttcctgaccaaatcaattcgtgatcagtggtgccttcggcataccgaattataaaaacaaagacattacccgtgttacaatccaaccgatcatttttcatttttattgaacaaaattcacttttgactttcgacccaacaaagtttaagtttggtaacacgggttgactaacacaagctttgattaatttatttgattcatataatcagctaaataaacttgaatttattgcaaa

SEQ ID NO: 59244 - DNA, 2775 bp, Heterodera glycines
  misc_feature (9)..(9): n is a, c, g, or t
  Genomic contig location: Contig_ID=SeqID_5792; Location=2284..5058; Strand=-
  SCN-specific regions: Sequence locations=1-77,155-302,327-476,498 -1288,1334-1640,1675-1956,1978-2049,2078-2506,2528-2775
  Gene Ontology: Mol. function=protein-glutamine gamma -glutamyltransferase activity; Cellular component=intracellular; Biological process=spermatogenesis
tggtgctcnagcgaaaataggaatagtggctcggaaattgtctcggcaaaacattttcattggcttttgtttaagactttttaactttaaattaattaattttgtttattaaatcgatttaattaattaattattttcatttatttttaattttcgtttcatttatttcttagaaaagttctcctccaaggcggcaatgccgtggacgcggcactttcggtcggtttttgcgtcggtgcgcttaacccccactcggctgggctcggcggtggctttttgatgacctattatcagcggtaaggatataataataattatatttaaatgcattttatttgactaagcttttatggcaaatgcacaacaatcgacgcccgcgagacggcccccgcgcgtaccgccaaagacacttttggcaatgggccgaaggaggacagtcaatttggtaaacaaaacaccactaacaattagcgcttgacaaatgttaaatattttttattcgggctacaaatcggtcgcaactcccggcttattacacggcttttggacgtctttcaaacgctttggcagtggaaaaatcgcttggatggatttgctaatgccaactgttcatttgctgaccgatggtctcatgctcatctatttgaaaaaacaaaaaaaaaccaattaaggatttcccgtctccaaacttatggaaaagactttggaaacgtacagcgagaaaatcattaacagctcccatttggggatgaggtgggcaaaaaaaggaagaggagggcattttggggagagaaggaattttgggcggagggattaaaagcacttagaaagcaaacttttcctaaggaaccacttcattaatccggcaaccagcgacctttacaaggagggcgaacagatgagggacggcattttggccgagacactcaaacgattggcactcagtcacgagccgcttcagctgttttacagtgcaaacggcgaaattgccagaattattgccgaagaatttgcaaataatggtaaaaattgggaacaaaacgtaaaaattaaatggataaagcaaagcaattttttaggtttggattttgattttttattttcaatttttttgagggggttttattacgcgaaaagaccttcacacgtaccgaactgttgtggacgaacagcctttgctggtcacgagcgcggccgagcccaaattggtcttctgtggcgcgaagccttcctcgagttttgccatcactcagctgattttggccgtaatgcttagtgagtggtgccgaatttattaattatttaaaattttaatttttttttagaattttatccccccggaagcaatgcatcgatcccttggcattctgccgattattaccaccgtttgatcgaatcgcaaaagcgcgcatttgcaattcgacacaaattaggcaaaaagatttgaaaagtttaaaataaaaattcaataagacattctgtaaattaaaggcgacgtcaaattcgacaaaatttcggaagaaattgcgctgaatatgagcaaaagtgaaatggttgacgaaattgccagtgaaattcaaagaatgggcgcgaccaaatgggcggattttgccgaatcgacgaaagaggcacaattttgcatattttaaataattataaaagaataatttttaagtttttccctgaaaatagcgggggcacaacgcaagtgattgtggtggacgcggatggaaacgccgtgtcaataaccagctcaattaacaaagcgtaagtggtggcaccaattgccaaccgatggccaaataattggccaatcgtttggcaatccgtcagaatttgtgcattattttcagtttcggctctctgatccgatctccccaattgggcatcatttggaacgatcacatggacgacttcagccaacccaacagaacaaattattacggactggcaccttcaaagacaaattttattgaacccgggaaaaggccaatgtcgtcgatgagtccgctgatcgtttatcacaaagagaacaaaaaggtgggcaccagggggaaggagggagagagggaggggatactatcggaaagggatactgtatcttctggaaaagaaaacggtatagattcaattcaaatttgaatatatatactccgtactgtatcactaaacgtaataaataaaacaaaggggccaaaataggagaagcttccccgagaggaagaaaatggaccaatagaggcgacaattaatccaatattatcgagcattagtgggcgagagaagggagtgccgtagttcagctgatagactaagaacgcctttaacaggcttcttactcaaggcaaacaacaaatgaaatgaaatgtcaataagtccgtccgacaaatgatcacattcgccccacaggttaaactcgcgatcggtgccagcggagggacaatgatccccacggcactgtcccaagtgttggtccaactgttggccttcaatcactccgtgaaggaggccatcgacacgccacgcgtgcacaaccaattcacaccttttgtcactgattttgaggaagaatttccccaagtaacatttgatcattttaatttataattcaatattcagtccattctccaatcattgcgtgcccgggggcataatatgacaacgaactcgcgcgattttagtgcctcggtgcaggcggtgctaacggacgacgagggtaatttggtggccaacaacgacttcagaaaaagggtccattcgtgccccgtgggatat

SEQ ID NO: 59245 - DNA, 511 bp, Heterodera glycines
  Genomic contig location: Contig_ID=SeqID_5793; Location=651..1161; Strand=-
  SCN-specific regions: Sequence locations=1-18,63-139,162-223,246-511
atggcaagaaacggcaccaatacgaacaataacaacaataatagtcatcataacaataataaccaacggactgcgaatattttgatgaggaaaaagtgcgtaaatcttattaaacttattttataagacaatgtaattgaatataatttttattaattattcagctttcatttttaatgcaattttaattagggtaaataattattataaacttttatcgtgtcaggaccagtcagctgtctgtgtgcataaagaccggatccatggcccaaattagaagggaaacatggacccgaaggtcgggtcgtagactcgcatacgatccgtatgcataaatattaccatttgcgatccatggatcattttggcgattcgcgtatcagaatccctatctacctccaatggattaggagtgatacgcggattgggtgggaaaaactttttttctaaaaaaaagaatttcttttcgttaagactccaaggaactttttttacacacgaccaaaataaa

SEQ ID NO: 59246 - DNA, 567 bp, Heterodera glycines
  misc_feature (561)..(561): n is a, c, g, or t
  Genomic contig location: Contig_ID=SeqID_28652; Location=4..570; Strand=-
  SCN-specific regions: Sequence locations=1-12,34-535,558-567
atgctttttctcctttttatatttgtgttcttaatcataaacaattcaactgacaaaacattgtcagttaatctgtgtaaaaaatgtcggccaacttttgctgaaatatttggcgaagaatggcaaaatgaaataataattggaggagatgaaaatgaaaatgagactgatcaaaatgcaaattttcatcaaaatgatcaaaatgaattaactgatcagacagatcaattggatgttcaacaaaaaaacgaaattattcacaaatttcatgcaattagagaaggaattaagaaaaagggaaaatattcggcaaaattttgggttaaaaccgagcaaaaaattgcgaaaaaattgggaattaatcgaccaaaaatttacgaatggaaaaaagaatttggaatttattattataaaaagaaaaaacaggaatttattgaacgaatcgaagagattaaaagaatgtccaaatatggaaaacagaagcaatttgcgaaagaattgggcattaacagagcaacattaagcaaatggaaaaaggaatttggcattgaaattggcaanaagtaa

SEQ ID NO: 59247 - DNA, 862 bp, Heterodera glycines
  Genomic contig location: Contig_ID=SeqID_28656; Location=745..1606; Strand=-
  SCN-specific regions: Sequence locations=1-71,95-270,333-334,356 -364,391-680,705-823
atgagaggcacaagcagccgcggcaccagtcaaaatgccaaagaaaatgggagtaggaggcggagaagtatgccattcattcattcattgaatgtaataggaaaagtggtggtggtggcggcatttaccgaaaattgtacccgcgggggctttcgaagctcattagacttgattttttttcttaatggtggaaacggcaaattggaaaggtaatttgagaagaagacgacgcacttttaaccctcatccctacgtagaaaatgccaaatgaaaaaaaattagaaagtaaaaaatatgtgatttatttttaaattttatgtattttaaaaattggaaaaattttaaactggaaaattcatggtgattttgttttttaagaaaatttcagttatgcttataaattttatttttaggaaaagcctaaaaacatttaaatagaaaataacaaaaacaaaaattagtaaaagataattgtttgggatggcactcgagcatttcttcaagaaccacccatggacacttcctgtcctcattagatttaatttttatggctgaactcacaaactcacaaattgaaaaggtattaacggaaaaattacttccctttctgccattatcaaatggcattacatcgagcaagcaattaaagcccaactaaaaatggcatttaaagcaattagtaaaataagaaaaagaaaagaagattcgttgaaatgtaaatgcattagaaagctaagaaaattgaaaatattttttacaaattgttgcaaggattgagccaattgaatttaaataatatgcttaaaaaattcattctactacctaaaaatttttaaattaaaccaaatatttttaaaataaa

SEQ ID NO: 59248 - DNA, 1155 bp, Heterodera glycines
  Genomic contig location: Contig_ID=SeqID_28659; Location=157..1311; Strand=+
  SCN-specific regions: Sequence locations=1-387,409-1060
  Gene Ontology: Mol. function=RNA binding; Cellular component =nucleolus; Biological process=nucleobase, nucleoside, nucleotide and nucleic acid metabolism
atgatattattcaacaagaaaatcggagttgtcagtattcttcacttttaccctcttttatgacttataactattttttagggctttagtgagagtgaaatcacttcaaaagttaacgaatatcgtaaacttttgtttaccgagtttgagaacggtcgattggatatggacaccgaattggatcttcggaacactcattcgagggctaaagttgccaaaggtactaactattctagtttacaggtctaaacgtttcaattcttattttttttaaaacttattttagataacagagataagtggcgatcagcacttagaattgacgcagcttttgttgacggctcttcgctggaaaaattgaaaaaagccagcgaatcggtggttgaaatggcaaagaatgtcgataagaaggcgctggacaaagaaatggaaaaatcgcttatggaaaaattgatggaaaaagtataactttcccttacaaaataattctatcggtttttgaagattaaaaaggaaaaagaacaaaagaaagagagaaagaagatgaaacgcgcgatgcgcaaagagtcttcaagcgacagttccgactcgacttcctcgtcggacacttcctcgagttcgtctgaaagtgatgattcgtcgtcaacttcgtcctcatccgaaagttcggccgatgaaaaagccaaacgtaaaagaaaagccgatgagaaggaaaagcgcaaaagaaagagcaacagaaggcgcagtgaagagacgaaggtcaaaagagaaccgatcgaatcgcccgtcggaaagagaagtcgcaaatgaaagaggggatggaaatgtcggtttattacctatttatcatttcattgataaatgatggttttggcacttttcacgaaaattaaatgttgattcaacttacagtattatttttgaactgttaattgtaagcattatactttttagtagagtagagcgggaccgggaattttgagcaaaaccgggaccgggacctgaaaagccgggaccaaccgggacctcgatttttgtccggataccgggaccaactgggaaatttaaaaattcaaaaaattaaaaaaaatttaaattttatttatttcaagtaaaaataatacaaaattaaatttttattttgttttttattta

SEQ ID NO: 59249 - DNA, 996 bp, Heterodera glycines
  Genomic contig location: Contig_ID=SeqID_28660; Location=66..1061; Strand=-
  SCN-specific regions: Sequence locations=1-95,117-594,616-955,978-996
atggatccaggtccggccgagctctgcttatttgttagccatgtgaggcagccacttccctcattctaaatttcaggaaaaccaaaaaatcaaccacaaccgcaacaaccgccgcagcaaagtatatttttacaataaaatttcaattttcctaaagtttgggtttcaacaaataggtaagtgttattgggcccgtggccaacggttgatgagtcaatttaagtctttatcaaaattttcgttaatcgaattttcaacttttttattacaatatttgctttgaataaatcgaaatgaacccaaaatcttattcaaaaacgacttatagtcattgagcatttaaaaaaaattgcaggaaatccatggcataagcagctgaatgggcaaggacaacggtcgtcgatctttttgcttaatgatgttaacgagggacatggtcaagaagatgccgaattattaaacgaggtaatttaatgggatgaaaattaatttttttgagagcgaacaaaaaagcagaaatactttttttagaaaaagatggcgttaaaaaaatgaaaaatttcttcccattaattgaggaattttgacgtgcattccgtaggaagtagttagaaaaactagtgttcgtcatggtaataatttatcgcagtaatggtaaatttatttcatatcagtcgatttttggaaaacatgtaacggtaattgctactgtttttaccgtaaccattaccggtaaatcgtgttgccgaacaatactaataaaaactgatttagataatgcttttttttacttataggacagtgccgattcgcgttatttgggagaatatttcatcgacccattgaaattgcctcgtgacattgcttactcattgaatgaactgattggctaattgatccctaattgataattgaggatgctgaagtgataatgatacaatgttattgagtttttaacaatgatttatttaaaaaatgatgggcaatacaaataaa

SEQ ID NO: 59250 - DNA, 1067 bp, Heterodera glycines
  Genomic contig location: Contig_ID=SeqID_5794; Location=983..2049; Strand=+
  SCN-specific regions: Sequence locations=1-253,306-316,339-381,403 -491,513-638,667-679,711-785,826-1067
atgaccccttctgccgttttaggctttcaagggtttggcattggcacggctcttttaaatgaagcgcaaaaatacgcgcaaaggcaatggcacgtcgctgagatgcaattggaagtgcacggcgtcagacgaccgattggccaaggcgaaattgggccaatgacagcgcaaatgaatttctatgcaaagcgcagctatcgaaggacgggaaaggtgcgaaatgagaagcaaaacgaggagctaaatttttaggaaaaaaataaaaaattaaatatataaaataaaatgtaaataaaaaataagtataccgtaaaaattcattttaaagatttaaattatgtgatccaaaaatgttagaaaatacgttttttttctctaaaagatgttaaaataagttcaaatgattttccatataaaaatttagcaaatctatttataatgagaataattttgaagcatattttagtacttttttagagaaaaatgtttagtttgaactttttgcattttctattctatttttcgcaattattttagttattttggggtttagcaactgaaaatccgttcccaactaaataaaatagacgtagtacatttgttttggttattagcttattcagcccccttgttagctcaaattaatatttaatctaaaaatattttgcttttttggttgatttaaaaaataaaattgaaaatatattattggtacatccattactgggacgcaataactgtgaagatttttgtcaaattctacaaaactaaaaaagccaaaaagcttttttttattttaaaaagtaattttttttttatttaaaacgtatattatcaaaaaaaacaattttaagcggattttattctttccttttatcaaattcgaacgcttcttaaattgaatgaatgaattcaggtgcgatggttcaataagccatccgatgccaatttcgtggttgtgccaagtcatcttgcatatctggaattgatggtcaaacatttgagtgaatttggtgattattaatagaataattccaatcgtataatgaaattcgatccgtaaatga

SEQ ID NO: 59251 - DNA, 1119 bp, Heterodera glycines
  Genomic contig location: Contig_ID=SeqID_5794; Location=2958..4076; Strand=+
  SCN-specific regions: Sequence locations=1-754,777-1008,1035-1119
atggtttccaagcttcttccggtcattctctgctgcttgtttttggtatgtttaagcattcggtataaaatactgtaattcgagtagaaaatcagggagtacggtatctatgatattattaatttctaaaacagggcttaaaaaatccgtgaactattttaaataaagattaagcttaaactttactttttaggcttctttcgccctctgctcgcccaaggctgctgatgtgctggtaaatggctcatttttggcattatggaaaatcaaaataatattaatatcttgagacctaaaaactcaatttcacggacatatttgcaggattaggattcaaaatccgttaccggatgaatccgctttattaatccagcaaaatgccaaacaaatgcacacgattgtgggcccaataagccctacaaattcttccgtctccactattatccatattaaaattgattttttcagaaatttaaacgagaagcggcgatcagcagttgtggagctgtaagacatatttaaaacaatagaaatattcgacaaaatattcatggaggtcgcttaatccctaaatttgttaatgaaatttaaatttatttgtaccactaaaagcgttagatgttttttaattagccatttttgtcctgttttctattttcggcacttttagggacagtttgaatacgggggcggctgttgtacgacatgcacaagcgatgctgattgtacgggcgggaaggtgagttagccaaattttgagaagcatttgccactgttagaatgggattaatcacagatttaagtgaacgattattaattaaatcattaattatgtccaatcggagtaaagtttgacaaattttccaactattttttgtcttaactttttcaattattttccactcttttaatgtaaacttttaatttgtttttatctaatttagctttgtgtgcccatcctcaacttgctcagcgtcagtctgtgctttgccccatgcggaaattaagacagaaaagaaagcagcaaatgagggtgttgatagtgtgataaattgataggattaaatggaaaatggggagttaataattacttaaatgcatttaaatagtgattgatca

SEQ ID NO: 59252 - DNA, 580 bp, Heterodera glycines
  Genomic contig location: Contig_ID=SeqID_5794; Location=5842..6421; Strand=+
  SCN-specific regions: Sequence locations=1-253,306-316,339-383,405 -493,515-580
atgaccccttctgccgttttaggctttcaagggtttggcattggcacggctcttttaaatgaagcgcaaaaatatgcgcaaaggcaatggcacgtcgctgagatgcaattggaagtgcacggcgtcagacgaccgattggccaaggcgaaattgggccgatgacagcgcaaatgaatttctatgcaaagcgcagctatcgaaggacgggaaaggtgcgaaatgagaagcaaaacgaggagctaaatttttaggaaaaaaataaaaaattaaatatataaaataaaatgtaaataaaaaataagtataccgtaaaaattcattttaaagatttaaattatgtgatccaaaaatgttagaaaatacgttttttttttctctaaaagatgttaaaataagttcaaatgattttccatataaaaatttagcaaatctatttataatgagaataattttgaagcatattttagtacttttttagagaaaaatgtttagtttgaactttttgcattttctattctatttttcgcaattattttagttattttggggtttagcaactgaaaatccgttcccaactaa

SEQ ID NO: 59253 - DNA, 570 bp, Heterodera glycines
  Genomic contig location: Contig_ID=SeqID_28662; Location=225..794; Strand=+
  SCN-specific regions: Sequence locations=1-29,55-273,295-488,511-539
cctatcaatgcaaatgcaagttcttctatagaacaacaaaataaaaaagaaattgatcaaatgggttcaaagctcccagtaaaaagcggattgaacaagattgaatgggttctaagctcccagaaaaagcggtctgtaaaccttgataacactgaaatttataatgaattatcaacctcaaatgaaagcattgaaagacttaatttgaaagaatgtattaaaaaaagatgagattttgttcgtttttatcaagtgtctctattttaaattaacacccctttttcgggaaaaaattcataaaatttttttccgtcgtcatttcgccttctccttttcagaatcttaatattttcagaattgctacgtacagttaaaaattcagctcgatcggttcatgggaagtggtcaaactcccaaaaaacagggtgtctttattttaaattaacacagtgtatacgcaaacaattttttttttacaatttttgctgatatttataattattttttatacatttctattttgtttatgttaaagagcgtaattttataatgaattatttttttatttaa

SEQ ID NO: 59254 - DNA, 1065 bp, Heterodera glycines
  Genomic contig location: Contig_ID=SeqID_28663; Location=556..1620; Strand=-
  SCN-specific regions: Sequence locations=1-205,227-389,413-420,443 -742,764-1065
  Gene Ontology: Cellular component=integral to plasma membrane; Biological process=cytoskeleton organization and biogenesis
ttttttcaaaaatgcctccaatcgatagagctcgaaaaacggttgcttgaaagtggtctccgttttcctgggaaaaatctgcaaaaaataataaaattcaaaaacgaaaaaattttggagggggccatgctggaaaaatccccacactcgacaaatttttaaaaaaaaactttttttcttagaattttcttatgaaaaaactttgtaagagttttttcttaaaaaatgccgcaggcggcgagcagaagagggccggcgggcagggccttccgaccatagaaagttggaaattctaggaaaacttgtccatttgatggatggatgaagatttttctgttatttgcaatttttacgttcaggtggcgtcaagttgggcctgggcgacttcatcttttacagtgtgctggttggcaaggcgagcagttttggggattggaacgtgaccattgcatgctatgtgtccgtgttggtggtgagtgagtgttgatggcattccaagaaaatgtcccccaaaaaaaaaaaaaatttcgtacctctgaaatccgagtccaaaaatatcggaaagcccgatgcattccgtatttatgggttaaagtgtgaaatagtttttcaggaaaaaaattttgaaaattttttaacgatttttctaatttttatgatgaattacaaaaaaaaaaattgcggaaaacttaatttccacgatcaaaaattccgatgaatttcagacagctttttgccaaattttcaacaaccaaataaaaaaccaattaacaattaattacctcaccgaataaattttaaaactgtcacacaaattgcccaattaaaatttagtaaatttgatgcattttcctggtcgccattttattttttcataaatttacatgtgaaatgtgtccccatttcctccagggtctcgcttttacgctgatgttgttggcgctgtaccgcaaggcgttgccggcgttgccgatctccattttcaccggcatcatatttttcttcgccacccattggctgatcacaccctttctggcccaagtgagcgtccggcagattttgttg

SEQ ID NO: 59255 - DNA, 483 bp, Heterodera glycines
  Genomic contig location: Contig_ID=SeqID_28665; Location=747..1229; Strand=-
  SCN-specific regions: Sequence locations=1-24,46-360,382-385,438-483
atgacctggacctggatccaggaaaaatccaggcctggatccaggtccaggccgatcttagtaaaaatgttaaaatttaaaaaaatctgttttttttttggcaaaaccatgaagtttattgtcttggtgattgattgtcccattgtgttttcagcaccgaatgtccgcctccgattgtgacagatcaggccgtcatcagccaagtccgttccgcgcatgataaagtaggtttggcatttctctttttggcaatacttacgaacattggtcccataagaaaaaatgattttatgcaatttgagatgtgatcggggattttttagggtgttgccacaaatctaacatcagacttacgacgtcatataatctatgatttttgtcaagctttattaatgttttttaatttttaaatgtgaaaaaaatatttttatttttttgggtacttttctgttttgagattcccacctgaaactttcaaataaa

SEQ ID NO: 59256 - DNA, 60 bp, Heterodera glycines
  Genomic contig location: Contig_ID=SeqID_28667; Location=229..288; Strand=-
  SCN-specific regions: Sequence locations=1-60
gaagaggccaaagtgcgcgagctgatcaaacggggcgagtacgtggtcaaggagttggag

SEQ ID NO: 59257 - DNA, 748 bp, Heterodera glycines
  Genomic contig location: Contig_ID=SeqID_28668; Location=95..842; Strand=-
  SCN-specific regions: Sequence locations=1-98,172-367,431-558,582-748
atgcgtccggtccacggccagcgggaactgatgcaccacgagtgtatgcagcgcaaccctacgctgcaccgacgcgatcaatttgtgagtgaaatttgaattaattttatatattttttattgtatatatcaaaaaatgttgataaaaaacatttctttatttatatttaagcatctgtcagcaaatcgaggggctcaattggtcccgaatatgagcaaacggcggccgaacaatcgccgccatcagtgaaaccgccgagtacacgcacaaaagcgcagcctgccggatcggcaccgtgcaacacgcagcggtgcaacggaagaggcggaccaggagaccattcttgggcatacatcaagaaaccggtaattaaaaaattaatagatttatattattttgataaaaattaatcttttttatattaaatttgttcaagaaaaaaggcggatctcgacctgctggaggtggtgcagcgcagcaagcagtgacgccgccgcctgcggcgggcactgcacttggcggtcttggaaagtatcataccaatgcgcaaacacacataattttatatttttgtatttttcaggtattttacggcacttccgcaaggtgttaaggttaagcacacaaaaacacatgcacaaacaacaaatgataacacacaattgcaccctttttaacattccgaaaactgaatggcacgctaaaaacgcaatttattattacaatggcctaatatgactaaataaa

SEQ ID NO: 59258 - DNA, 264 bp, Heterodera glycines
  Genomic contig location: Contig_ID=SeqID_28669; Location=168..431; Strand=+
  SCN-specific regions: Sequence locations=1-75,97-229,251-264
atgtccaccatttttccccctcttccgtttgttgccatttttttgttcgcactttttgccaacagcgcaaatgcgtggaaaaaggaggcaaattcagtggagtccgccgacggacacacaaaggcattcatggacctgatcagattcattttgccaatggaagagcccgagggatcggaggaaagggaaggagcaaaagcagagacagaagaaggagcggaagaagcagggtgaagccaaaccaaaccaaatcagagcaatcaa

SEQ ID NO: 59259 - DNA, 356 bp, Heterodera glycines
  Genomic contig location: Contig_ID=SeqID_28670; Location=362..717; Strand=-
  SCN-specific regions: Sequence locations=1-288,345-356
atgactgtgcgacttgtaaatgctgttcatctgctcctcagactgatcaaggttgatcaactgatcaaagctgttgcacactttgccgtcgaccaactcgtcacaatggcgacagttaaacaaattcccacccgattcccggcagaatgtgtagaacactgtcgggcactttttctcattatctcgtgcgcatccattaacgcggaaaatgtctttaccatttccttaaaataagatgaaaacttaattaattacatttgtttttcagcactatctcgaagctattggaaatttaacatttaaatattatcatacaatatataattgaatttatatattttattcgggaaaataaa

SEQ ID NO: 59260 - DNA, 651 bp, Heterodera glycines
  Genomic contig location: Contig_ID=SeqID_28671; Location=323..973; Strand=+
  SCN-specific regions: Sequence locations=1-52,74-123,146-272,294 -425,457-651
atgccacacgattgggacgcaattgtaagtgaaaatgtttatgtgtgtgttagctaaaaataaagcgcaaatagggttggagtccgagtgaagatgaagcgtccgatgatggtggaaccgagggccaagaagcagctgcaaagagtgcggttgtgcaaccaaagacaacaagcggacgaacgaaaaaagaaggtaatctgcaagccagcagcaacataggaattcattctatctataatgaacaattttttttctacttcacagcaccaaaagaaggctctgtgacagctgcaaagagtgcggttgtgcaaccaaagacaacaagcggacgaacgaaaaaagaaggtaatctgcaagccagcagcaacataggaattcattctatctataatgaacaattttttttctacttcacagcaccaaaagaaggctctgtgacagctgcaaagagtgtggttgtgcaacaaaaggcaacaagcggacgaacgaaaaaagaaggtaatctgcaagccagcagcaacataggaattcattctatctataatgaacaattttttttctacttcacagcaccaaaaaatgcctctgtgccagctgcaaagagtgcggttgtgcaaccaaagccaacaatgggaggcacgaaaaaagaag

SEQ ID NO: 59261 - DNA, 1024 bp, Heterodera glycines
  Genomic contig location: Contig_ID=SeqID_5797; Location=2283..3306; Strand=+
  SCN-specific regions: Sequence locations=1-219,260-314,336-357,379 -521,567-604,663-788,811-855,877-945,970-985
atgaacaataaatattttttttatttgttacatgggacgggggaaccaagctgctcccatgcagagtattttattcactcttttattcgagaaaagaacgcatttacagtactcgcatccggtaccattggctaccgtatcaacaacgatgacaccaccgtttccgtcagcagctgcggcagcagttcaaccgcagacggtagcaccgagcgccgttaaacaacaccgcggcagccataaaagggtgggcgctaattatagtaacaaacacagcaattaatttttagtcataatatttcatgaaaattttgacaccaagagttttctgagtttagtgatcatgaaaccaaacatgaacttgaacaaaatgagtcaaaaacatggattttccgacttttgggttcaagattcggaattagccaatattggttttatatttatggttagcaatcccgaaaatccacggtacaaattttcacgtatacaatccttatgtgggaaccaaggagtttttcttttggttataataaaaatttcaaaaaataataaatattatttatttttatgttaccaatgcttcttttaaaaactgatatttcgtttcttttaattaaaaaatgtttaaaattaataaatttaaacaaaaattttttattttttaagcccaaaacagcggcaggccccggcggtttgcccgcgtacattccgacaccaatcgctcaattggaaaaggagcagaaagagcgtgagcggagaagagaagaaaggcgggcgagaaaggaggacggacagccaaagaaagaaaaagagcatggggcagagaagcagagcgacgatgcgaaggcggcgagacagcgggagcaaatggagcagcagaacgacagaggaaggagagagagtgttggcgagggagagagcgtgctcggcggcggcgcaggcagcagcagagagacagtgaaagagagagagggtgggcagagaaatgaaattaaaaaaaataaattaattattttttactaataaa

SEQ ID NO: 59262 - DNA, 204 bp, Heterodera glycines
  Genomic contig location: Contig_ID=SeqID_5798; Location=1233..1436; Strand=-
  SCN-specific regions: Sequence locations=1-204
ttcgaattactgggtttttgagttccttctggccataacttttttgaaacttaaccaaaatttttgagattttgcaaattaataataaacacatagacctatcgaacaacaccaacaattcttaatttgattgacagtgaacaaagttatggttcaaaaagtcttccgacgacgtttcggccgacgacgttttggggtgcaccg

SEQ ID NO: 59263 - DNA, 666 bp, Heterodera glycines
  Genomic contig location: Contig_ID=SeqID_28673; Location=13..678; Strand=+
  SCN-specific regions: Sequence locations=1-5,27-201,224-569,591-666
atgccggtgaagcttgagtcgctgaaagcgacatttaatttggactgtgaggacaagccctttttcccctattattacaacaagaaagaaaattatggaatacgattggaacatctgccaccgatggaggactattcgccgggatctatgaacaaggataaatttataaaattcgaaaaatggtaagaaaagaaggacaaaattaacaataaataatttttcaggtacaacgaaaacaaggagacacctttttatttggatgatgaattgaaaaattattgccgaaacgacacggagattttattcctgtcaattattgagtttcgaaggatattgattaacgacattactaagggatttgacccactaccgaggagttgtacgaatgcgggggttgcgatgaatatttttaaggcaatgtttttgttgacggagcagttatcgattgtgccggagaagggatatgagcggtgtgatcgcgccagtgtgatggcaataaagtatttggagtggcggagccagcgggatggaattgagatacggcgcgggcggggaacggacgagaggtcaaagttggaaaatataaattggatggatttattgcgaataacggagctagggacaaatgcatcgaggttatgggatgttacatacacggatgtttga

SEQ ID NO: 59264 - DNA, 455 bp, Heterodera glycines
  Genomic contig location: Contig_ID=SeqID_28674; Location=284..738; Strand=-
  SCN-specific regions: Sequence locations=1-143,176-304,326-455
atgtatgtccgcctcaaccagcaaatcttgttcccgttgaattggccggtaactaccgtacctgtaatccatacgccaggtccggtaccccacaggtcagtgattcctttcttcttatttattttcttcacattattttaacgcgtttttaaatcaagaatttttgaatttttaaggcctgcccagagaattctgcatgtcgtctgtacacaggccaagacaatggctttatatgttgccgagtgcagctgcaaagttcgcccttttcctcacgtcgtgtgcatcgatttttacattagaaaattttgaaaacaaatttaaaatttcatcatacatgtatgatttcataaaattatgattattatcaatggaaacgaaacaaaaactgtttttaaatcacacctgtcttttctgtaagcgattatatcacttccaaatgttcatcaaaaattaaa

SEQ ID NO: 59265 - DNA, 146 bp, Heterodera glycines
  Genomic contig location: Contig_ID=SeqID_28677; Location=425..570; Strand=+
  SCN-specific regions: Sequence locations=1-146
atgcccgccgtcccttccggctaccaagtggtgcagcagggccgtcaaggaccttcgtgcatggacaagctgaagttgggcttcgccatgggtgttctgatcggtggctcgaccggcgttctcatcggcactttcacatcactaag

SEQ ID NO: 59266 - DNA, 621 bp, Heterodera glycines
  Genomic contig location: Contig_ID=SeqID_28679; Location=58..678; Strand=+
  SCN-specific regions: Sequence locations=1-554,576-621
atgggctatgaatttcccttcagcagtgccgaattgacctgggcaaaggtgaaattgggcgagaaggtcatggccgcggctgttgccgcacaggcattcgatgtgaaggctgatctgcggaagcacactctgttcgtcgagccggttgtcatcaacgagatctcaacccgaagcgttgtcatccaattcgtcatgccggtgacgagcattgaggagctcaccgaactgtgcaaaatctgggagatcgatttggcggtgggttgcaaagtcaatccggcagccaaggcaaagccttgtgcgcatgggtatgtgctaagcatcaaaaaaagggcgttatgtcgggggtacgaaattgatgttaaagtgatcctttcctaccaagaagcgaaggatcaggacgcgcaggaggaattcgatcagatgcgctgcggcgaactcgacggatgcgttgaactcatcccgcagacgtcagtcagggcactgcaggaacggatgttcactttgcggtccaatgactgctcgaaagtggcaacggacgaaggaaaggtgggccgaatcatgtcaattttattgggccgaccggtaaaaccggaaagcccaaaggccaataacccattatga

SEQ ID NO: 59267 - DNA, 600 bp, Heterodera glycines
  Genomic contig location: Contig_ID=SeqID_5799; Location=1109..1708; Strand=+
  SCN-specific regions: Sequence locations=1-71,94-234,256-600
atgcgttcagtaaaacatggaggaaaaaaaggaatgcgattcagatacaaattgtcagcagttaagaggcaaaacaaaaagcagaagaaaaagcaaaggaacatagctggatggtaaaaaatattgaagttttaaattgctaatttcctgttgttgtattcaatttgctgatggtctcacattattttaatttttttttgaaattcctctttcagaaatttggaattcgattttgaattttattttcatttcaaatacatagatcaacaagctcagcaaatagatacaattaattcatggcattttttttaatacttttagctctttgatcaaaaaagcatggcaaacccaactatcatcgcggcaaaatttaagtgcaatgggactggtctatgatccaaatgaggcattgaaaaaggtatgtttttgatttaaccatggccatttaaatcgaatcctcgacaatactcatttagaatcctgaattcgccatggaaatggaccaaagcgaaattgaagtaattggattgccagaagccaaagctttgggaagcgtgaaggaacaaaaaaaggcgaccaaatcaaagaaagcattcccaa

SEQ ID NO: 59268 - DNA, 256 bp, Heterodera glycines
  Genomic contig location: Contig_ID=SeqID_5800; Location=894..1149; Strand=+
  SCN-specific regions: Sequence locations=1-256
atgccttcgggaggcgacgatgaacaacagtttgaggaggcggtcaaaccggcattgggtgggcaatcgaagtgccattgggacaatggcattcattcaatgagtgaataaatgaaacggtgcctttcgcagagtcccttttggcggatttgcaaaagaccaccgaagttcttcggcaaggcaaacatggcaaaggccgacggcaacagaaggaggacgaatccgccgctttgttggacttgaagaagcttcggaa

SEQ ID NO: 59269 - DNA, 114 bp, Heterodera glycines
  Genomic contig location: Contig_ID=SeqID_5800; Location=327..440; Strand=+
  SCN-specific regions: Sequence locations=1-114
agggcatgtctcgtgatcctttgaatatttggcaaaacactccaagacaaattgagcgaaagattggcgtatacaaacgaagcatcgcctgtgactgaatgtgaaaagcgaaaa

SEQ ID NO: 59270 - DNA, 2098 bp, Heterodera glycines
  Genomic contig location: Contig_ID=SeqID_5801; Location=2325..4422; Strand=+
  SCN-specific regions: Sequence locations=1-464,532-567,849-1637,1660 -1690,1713-2007,2032-2098
atggaaaattataaattgatggattatcaaacgactacttgccaaaaatttggatttacgaaaaatattacggaatttcgtgtcaacccggacgtggaacgccccgatgaagcgatgaaggatgcgatcgacaacatgataaaggtggctttaaaaactacggaagaaaggatgaagcggaaagtgcggatgtttggagtggcaattacgggtgctgggcttgctttcccggtatgggtaccgtacagggcgtacccgcagaacaatgcggatgttatcatgcaggagattaataagttggggcagagcggggacggagatgaaaataagaaaatgcttttattatctgagccagttacgatgaaaattacttgcgtgaccatgcccagtggagaggggccgaggaatgtccataaatttgactttggattcaaggaacaccagcggatagggtaagtgtttttaataaaataaaattaaaatagaaaaaaactaaaataaaaaaaaatcaataaataaatttaaaataaatacattaaatttatttaatgaagcaaaaaaattttttaaagaaaaaaattgaaaaaataataatttaatgaaacaaaaaaaaacagaataaaattaaaaataaagaaagtaaaaaataaatttaaaataattattttaaaaaattaaatgatacaaaaaaaaacagaaaaaactaaaaaaaaaaattaattaaataataattaaagtaaagaaaaaaagaaataattatttttaattaagcaaagcagcaaaaaaaaaaacagaaaaaaaaattttaaaaataaattaaataataaagaaaaaataaatggaaataataataattttattaaggattacaaatgtggataaattatgtctgttttacgcgctcgtagcctcgaaattttatctggaattgcatgtggacagcttcaggagatttatgaaaaatattgtgagacagagggatgcagctattgaacttttacgtaattgtggaattgatggaaacgaaattagttatggtgtggagcaattgccgacggttcagaattattgggtgggtttaaaaacggtgaaaaacatagaaatgaccaatttttcaggatgagatttaccccggaaaataccggattgtggcgtttgaaaaatctgcggatccgagaaaatcgatacgtgttttgtggaagggcccaatggggcgagaaagtgtagtgccgatatttttggagaacggacattgggatggtctgaagaattatgtctgctttttcaatcgagggaaaaaattttgtgttgattgtgagtgcttttactatcaggatgttaaacatacgatggagtgcagggccaggtgttattactgcaacaaagtgggtggagtgccatgtcaaaaggagagtggagtgaagattgaatgcccgaagtgtcatcgttatttttacaattgggagtgttataattatcatcagggacatcagacttgcaaattatggaggcgttgcgtgatctgtgacaagacatatttatttaacacgaagaagggacatgaatgcggagagacttattgccagctttgtagtgtgagccacgaccccaagcggggttgctatattataccgatcgaggagaaggaggaaaaagatgtctacagaattgtagtttgggtaagttctacaaataaaatcaacaaaaataagtctttaactccaggattcggagacttcgcaggattctatttacaagggggaccagaaggagcatataattaattatatttcggcgagagtgacgtgtacagaatgctgtgatgataaaaataggacaaattgcaacatttgcagggaggtgaggaccaaggattggagtgaggctgagggacatgagccgaccaaggattttgtggagtggattttaactgcttttaccaattacgatacgtacatattcgcgcataacgccgggcgttttgacggtaatgaaaaaattaatctaaatttttaaatcctaaaatttttaggtcattttgtttttaattacctctgccgtaccgggaagaacccgctaccgctcatcaatggattga

SEQ ID NO: 59271 - DNA, 111 bp, Heterodera glycines
  Genomic contig location: Contig_ID=SeqID_28682; Location=1249..1359; Strand=+
  SCN-specific regions: Sequence locations=1-111
atggctgaagaagcggtcgttgtgccggagatggaatcgcttgctctcacttcttcgtcaccgtgttcgccggtgctctctctgctcagcgaggaaatgcttcagaaagag

SEQ ID NO: 59272 - DNA, 945 bp, Heterodera glycines
  Genomic contig location: Contig_ID=SeqID_28686; Location=211..1155; Strand=+
  SCN-specific regions: Sequence locations=1-187,209-437,460-647,669 -696,718-945
  Gene Ontology: Biological process=ubiquitin cycle
ccctcaacttcgacggcttccgccgcaacaactccctcagtttcgactgcgccgacgggtggcgctgcgccgaacttagctggaactccgccgtcgttaggcggaattggcgatcttttcaacaaccctgaacttgttcaaggcattctgaattcacctttcatggagaggtctgcgataatgtttgtttataagttcataaaccattttagtatgctggccaacccggacataattcgaacgatgctgagccaaaacccccagtttcagcaaattatccaagtaaagaatgggtcattttttgttgccttatcatgtgttgttattagaacaatcccgagctgggccacattatgaatgaccccggcactatgcgacaagccatggaaatgattcgcaatccaacggctcttaatgaggtgttttcaattaactaaaaacaattcattttattttagttgatgcgtaaccacgaccaagcaatcagaaatctgcaagttcggacaactcacatatatttaaccttttaaattcgtttacagggaattccaggcggcgaagcggcgcttcaacgcctttatgaacgcgttcaggagccgttgatgaacctaacacagcccggcgctgacaatgtcgccggttctggtgcacaaaatacaacagatgcttcaatggccggtacaaatattttggaaactattgagttaaggtaacatttactttcgtgcagcttctcggagtcagcatgccggagttgaaaatgcacaaccgttgccaaacccgtggagcagcatcgtgaaccaacaaaatcgtcaggctgcgggttccgctggcaatgcgccggcacagggcgcggcttctacaggcttaccatttgcaagtaaagtgaatgagtacagaattgtttatggattggacaaaggtctacaaatactcattgtttag

SEQ ID NO: 59273 - DNA, 764 bp, Heterodera glycines
  Genomic contig location: Contig_ID=SeqID_28691; Location=261..1024; Strand=-
  SCN-specific regions: Sequence locations=1-764
atgcgacgaagtcgcttttcctatggcactgccggctttttcatggacataaaaggtaattaagcacaatttttaattgaaataatctggctctcattaatgtccattttggcattgcattgtcaaaactaatcagtttacttagctcaatttggtcattcttggtgaattttctcaattaggtttcgtccgccaattaatgcaattttaagagccatgttaatcaagagtcttgtcatgacaagtttttgcattcattacatttattaattgacattaagcatatttgtacttcaatccaataaaagtgcatgaattggacccaacagtgatcgacattgagaaattgatctattccggttataatcaaatttaaacatgtaaattattttttcaattcaccccatatttatcagtaggccccaactcgcgcgtgtattacggccgtttccgcttcgcagaagcggaattccgccgggtggtggtcaaagtgccgtcaaaggacgcgttccgcgtgcagtccatcatcgccgagacgcgcatcaacgcgcagctgcggcacccgcgcgtggtggagtacgtcggcttctaccgcgacgcgttcgacgacgtgcgcattgtcagcgagttcatggcgggcggagacctgcacacattccttgtggacaagcgaaatgtgcgtcgggggatatcatttttgtatgatagtgcatctaatagccatcgattacggcactaattagagaaggggaaaaacaaataaa

SEQ ID NO: 59274 - DNA, 4731 bp, Heterodera glycines
  Genomic contig location: Contig_ID=SeqID_5802; Location=779..5509; Strand=+
  SCN-specific regions: Sequence locations=1-3,27-135,178-209,264 -380,402-563,608-760,782-800,823-918,940-1175,1198-1206,1228 -1389,1412-1428,1464-1653,1683-2654,2676-2718,2742-2770,2797 -2878,2900-3055,3091-3095,3117-3210,...
  SCN-specific regions: Sequence locations=...3232-3622,3653-3788,3810 -3825,3847-3866,3902-4108,4134-4290,4313-4627,4679-4731
  Gene Ontology: Mol. function=protein serine/threonine kinase activity; Cellular component=microtubule cytoskeleton; Biological process=asymmetric protein localization involved in cell fate commitment
atggtccaaaaccaacaacagcagaaagcgcacgaagttggcgaagtgaacgcggaaagccaaaagagacaaacgacgacgagagaggacgaaacagcggaaggacagaagcaaataacggagcagcaacagattaacagcaacaacagcagcaacacaacgccaacaacaacgacagtgaaagtgggaaagaagcaatttgaaaattgaaattaaatataataatagaaatcataaagttttgtaaataattaatatttattcaggttggcttctacgaggtggaccggaccattggcaagggaaattacgcggttgtaaagttggccaggcaccgaatcaccaaaacagaggtgagaaaaaacacatttacgaattatctattttaaatattattttaacatttgaaatcatttattttggtgaattttctgatactctcagcaaaaaacccattgaaattttattgtactctcgccaaatgcctaaaattggatttttagctgcgaaaaaaattcctgtgttgtaagaggaaaaacggacacaaagggttgatttaacggaattttattttaaaattttctatttaaacaataaaatattaattgatggggcgcacaaaatgcttacgggacgcataatataatattctgtgaatttggcgaacttgtactattctctataatcttacaaaaatatatatgaatataattcaaaaatgcttttatatcgttaattacctaattaatttaaataggtcgccatcaaaattgtggacaaacgtcgtttggactcggttaatttggcaaaaatttatcgcgaaattgatgtgctgaagaaactcagacatccgaacattgttcgactttatcaggtgacaaattgaggacatttattactaattgattgataattaattaattgcttaattttgtaattcaattgaaggtgatggagacgaacaacatgctttatttggtcactgaatacgcaccaaacggcgaaatttatggtcagagatttaaatttaaaaaagcatttgcattttcttttcagatttaatttcaaaacaaaaaaaactcagcgaggaaatggcaaagcaaaagttttggcaaattatttcggcggtggattatctgcacaatttgaacattgtgcacagggatttgaaggtgttttttaatttaatttaaatttggaattcatttttatttttgtatgattttactaaaatttctttcctttttgttatatttcgcatcgatttgccctcttttttacgtcattagcagtttaatttgttttatcattaggcgaaagaaggcgaaattatcaaaatttggcgaaatcaaaaaatgattaaataaagttcagtgacgtaaaatgagacctctaaaaaagcaaataaaatccctttttttctaaaagtattttaataattaataaataataaaacaaattaaggccgaaaatcttttgttggacgcaaatttgcaaataaaattggccgactttggcttctccaatttcttttcttatgatggcactttggacactttttgcggaagtccgccgtacgcggcgccggaagtgtttgagggcaaacgatacgccgggccagaaattgatgtttgggtgggcatttggccaatcattattttattttaaactaattatttaatgggttgatttaattgaagagtctcggagtgattctctatgtgatggtctgcggcgttttgccatttgagggcctcaatttgcagctgcttcgtgaccgtgtgctaagcggacgcatccgaattccctactttatgagttcgggtaataaatgttgtctgaaaggcattggtttcattttccaatattggcgttgtgttcagactgcgaaaatttggtgcgtcgtatgctaacggtggattcgcgccgccgtccgaccattgaacagatcaaacaccaccggtggatgcgctacgaagagttcgccccgaagtacgaactcaacgagcaggaacggcacgcggcgacggagcaacacgtggcggaaccgcacccgcaaatactgagactgatgaacaacattggcattgagtcggagaaaatcaaaaatgtaacacagaggaatattcttttcataaaacaatgaaagcggatattgtgcttttcgcttttttcaggccattcaagcggacgcctatgacaatttccacgcgatttatttgcttttgttggaacgccttcggggccatccgctgtcgcgcagccattccgcctccagtcatgccaaccatcctctggtcaactctccctccgcaacttctttgccctcgccgaccgcgccacacgcacaagcagtactcgcgagtccgaccacaaaggcggcaccggcagttgttctgacggagtcggcaggaggaggagacagcggagaacaaagaccaccgatcattcggggggttacggtccgtaatttaaatgatttgaactatccacattgatcgatacgatttgcagattcgtcgccaatccgatggcattgccattgtgggcggtgccgtgccgtgccattgctattgttgcagtgctgcccgagcacatccgatgctacagtcaatacagccgcaatacgcgcccttgggcatcatgacgcgatttgcgcaacatcagcagacgcgacgggacagtgatggaatcgcaatgcaatttgcatatcaaatgcagcaacagaaacaacagcagcaggaggaactcgcgcgtggcgtacaaaacacacagcaaaagcagcagcagcagaataacgtcgttgttggacacgtcgcggcacaaccacagcaaaagacaggacggcaacagaacggcacgcaactcggcaccatggtaaagggagggggagaagcaaataaattaggaaacgattaaattccgatattgccagcaccatcattccaccacttcggactacgagtcggagaattgtttttcgggttcatccgctggaggctcaacactttccagacaatcgacaatcggaacaatcagctcattcgatgatgtgattttatttaattaaatatttttattcttttaaatccttttaattgttggaaattattttcgaaatttatttttcttttggtgagacatttttggagttataataaaaaaatgtaaaatcacgcaaaggtaagtcagtgccgacgatataaacattaaataatttgtttccaaatttccccaattttagtgttgtcctgacgattctgcggccactccgtcctgttcgcatgctgcgggcggtggccccggcggtctgtcgctgttcggcggtgtcgcactgcccccgcttcaccaccaaccgccgattggtgccaccgctttttgtggtgccgaccaattgccgccctttgacagccaactgagtcaggacccgctgttctcctcacagtcgtccaacaaaagtgccacggcatttcgtcctatcagcggcagtcggtcgaccaataacagcgaaaatggtaaatttggccaaattaattactgtcataatttaagtctttttttgagtttaccataatagttttaacagtgctcatttagcttataaatgactttatcatttagcaataatttttatatttttctttaatttaatgctattattgacgtctttatgtgcggtgtgctcagtttccttttttcgtcttaactttttctaaaaattgcgatgggcgcactttcgtcgatgacgcaaattggggaaagagaagaaaggggacaaaagtgaactttttaaaatgacaaagaccagcagtttattaagtcgaaaacaaaatttattatttttgataccttaacataaaatggcgattaattaacaaaaagaaaaaatatatattattaagctttgacataaataattaggcttttgtattgcgtcattcgcttcttttcgtgctgcttgcctacttcatttttatttttctgttccaatgcttcttggctcatcatttgcgtcatccgttgttcgcccttttgttgttttttgcttgtgcaaatattttacgatggtcgagagtctcgaaaagcggcgatgcgagatgctttacgtggagggggggggggggggggggaggaatgatgatgacattttgggatgaaggatgactgacccattcacccatacattcgcagttgcgtaattgcatttttcacacgttatggaaatttgtgttgacatggccaaaacaaagtccaaatgcgtcatcaaataattgcaaatgggagggatgtttaatcaaataataataataaattggtaatcgcaggttgttgctacggtgttgcaccggcgggcattgtcgtcggcccatcaggcggaagcagcaacctgctgatcaaaaatgcacaggcacagcccccgccgatgtttccgaataatcatgcgaacactcaccttcaccatcgtctccatccccacctattgcaaccgtatcaacagcagcaattgcctccattcctccagcagcattactgccaacaacaacaacaacagttgacgacattgtcggcacgagcgcatgggacgacgacgaatgaaacgacgaacgaagacggcgccggaggggacgcagcaatgcaacgacaacaccagcaacaacaacagcagcagcagaacagcctttgtccgcaacaacacatggggatgatgtgcgagaacggatggagggcgag

SEQ ID NO: 59275 - DNA, 2692 bp, Heterodera glycines
  Genomic contig location: Contig_ID=SeqID_5803; Location=705..3396; Strand=-
  SCN-specific regions: Sequence locations=1-149,178-181,203-254,306 -424,459-649,673-795,817-1154,1176-1346,1368-2482,2504-2692
ctgcaccggacagtttaattatggaaaagccaatttggtcaacctgggccaccttttgggtcgctgtgaaccaaacacaggtcgcatcaaattcaaacacaattaaattgcaatttttgttaaaattttatttgtatctaatagggatgaattttatttaaaaaagataattattaactagaagtgaaacagccaaaagtaacggaataactaaaaaaattacgaatttaaattttgaatgcaaaaaattaaccaattttaaaaaaaattaaaataaatttctgtcatttttattttttattttacgatatacatataagcggttcgtcatgagcggattgatactggcggacctgaaaaaattataagacgcgtaaaaatcctttggccgcatatttgcactaggactattttttttattcggaatatttttttattatttaattaattataaatttgaattgttgcaggtcgaaagttatgtggacgaaattaacagttatggaatgccaatttcgcaattggaattggacgacatgtggaccaccgcttacggagactatcaaattgacagcgcaaaattccctaactttgccggaatggttaattacatcagaaacaaaacgggtgccagactgactggtacagttttgcattaaattgatttttattccattaaattcatattgtttgttgaagcctgggttcacccattcgtcaacgacgactcgaagaatggccaggatttgtcgttgcgaaatacaattttcatgaaatcatcgcaaggcgacgttccgctgacctggtggtgggactgtccggtgaccaaggacagcgcaggcaatgaagagaaaaagccatgcgcatatgtaaaggagaagcgattaaaaccaaatttgattgtggaaccaaaacatgcacaagggttgtctcaagactcttgccccctttggttgtgattaacaaatcagaaccggcggagccttttggcaccgccggaccctttcttcgttgccaactaaaacttaatcgtccgtcgttggcttgagaagccccttatgcatgtattatgtaaagaccaactcactgctaatgtttagtctgtccaatttacagattttggatcttaccaattctgatacccgagattggtggagaacacagctcaaaaacatgcaaaaggcactgattcaatcgatttttgtgacgagggagtggggcaaccaatctcttcattattcattgtttcttcggtctttaactgtctgtccgcattctctcttccacccagctattgattccatccggcccggctaatggggatagaacgtacgcttttatttcaaatttattttcaggagggcatttacacattcaaattcgatgccggcgagactaattggtttccgaaaaattttgcacttaattacggacaaaatccaaacagtaaattctttcaaaagtaaacaattgtttgatcgtattttcattcaaggcttcggccgtgattatgcccattttgcggccgaatttgggccagccgttgaaaaccgttacggcagtaactcacaggacgcgaatatctttatgagaacaatggacagaagttcatattggttgaacactgaataattaaaaaaacatatttttcattcggatttgtttagggacaaatccgaaggtgaaggcggactcagcactttgatcccatggtcaaattaattaagaattgagaattgaaagatacacgcatttaccaaaaagaaaaaaaagtaaatgttttgtttttgccccgcagggcattgcaagcatcactgcacggctattattggaatttgccggacatggtcggcgggaatgggattgaccacagccccaccaacatcaaaggcaatccgcctgaggaggagctgtacatcagatggactcaggtgaggacatcaattgcaataattaaacaagcaaattgtttaatataattcaattaatacttctttccattaggctaatgcctttctgctggccatgcaattttcatatcctccgtggcatccgagcttcaatcagtccaaattcaaagtggtggagcaggtgaaaaatgtgctcgaattgcgagccaaatggatgccgtacattctggaaagtgtggaggatgctgtaaaaaatggagagccagtgatacggtatcataagtacagtaatcactgtgaaatggacaccaacagggaattcaacaaaaaataacctaaattattgcatctgaattttaaacgagaatgtttcggggcacttaattcccccatcccttccgttcgtttcaaaacgagtattgaaatttaatttatcgtgtaataattttttaaacagtacattttttgcacagtccaatgtggtggtccagtgacaatgccacttttgcttacggctgcaaagaccaatacatggtcggctggaaattggtaattaaacatcggcggataactcatttattcatttaattcaattgttattgtcactgcacaggttgttgcgccagtgctgcaaaaaggcaaaacgaaacgggacatttttttgccaagaggcgaatggaaagacggcaacagagggggcgaagcagcgattattgtgggagagacactgttgaaggattacgaagtaatgtttatgatttaaaattaaaagaattatattt

SEQ ID NO: 59276 - DNA, 54 bp, Heterodera glycines
  Genomic contig location: Contig_ID=SeqID_28692; Location=239..292; Strand=-
  SCN-specific regions: Sequence locations=1-54
atgaaccaaggagcgcagagaccactggaaaagccgaagaagagacaggtaaag

SEQ ID NO: 59277 - DNA, 813 bp, Heterodera glycines
  Genomic contig location: Contig_ID=SeqID_28693; Location=1..813; Strand=+
  SCN-specific regions: Sequence locations=1-91,113-813
atttatcctttgttatacctagtgggaacaagagggtggaacttcgatatataaaaccaagatggaaaaagaatttcgtactgtgattttacaaaatttaagctatttttcagacaaaattattttttgccacatcattattcgaaaaaacttttccagcagtgggtcgttgatcaagcggcccgcgttgaatggggaaggttaaattttattagaactcatcaaaaagaattaagagcatgcagttataaaggattagaggattttctttttaataaagccgaacaaacaggatcaattattcgaaaacaagtaattttaccttcgtcttttttgggcggaccaaggaataaagaccaacattttattgattctatggctattgtgggagagaatggcaaacccgatttatttttgacatatactataaatcctgaggatcctgatataaaaaaatgtttattgaaaaaccaaaaaacagaagataggccagatattgttgcacgcgtttttaaattaaaatatgataaattgattgaagaagtcgtaaaaggtgaaatttttggtaaagtgattgcttattgttgggttgtagaatttcaaaaaaggggtttgccgcatttacattttttaattaccttgcatccaaaggacaaatttaaaaatacaaatgacattgaccgattcattcatgctaatctcccaaataaagaaaaagaaccatttttacgttcattagtaaaaaatttatgttgcatgggccatgtggagaataaataaaactgctccatgtatgagaaacggaaatatgcg

SEQ ID NO: 59278 - DNA, 56 bp, Heterodera glycines
  Genomic contig location: Contig_ID=SeqID_28694; Location=768..823; Strand=+
  SCN-specific regions: Sequence locations=1-56
gctatagggaagctattccggaaggattcggtctccccataaatctgggcgcatcg

SEQ ID NO: 59279 - DNA, 208 bp, Heterodera glycines
  Genomic contig location: Contig_ID=SeqID_28697; Location=1166..1373; Strand=+
  SCN-specific regions: Sequence locations=1-55,77-208
atggagatgaactgcgaaggattaaaaggaccaaaacaatggcaacgacgacgaccaccactgacagtggaaaaagtagcagcaaaagccgaacaacaacaaccaacacgacgacgacgacgtcgagcagtacaagcagcagcaaaaaattgttggtggtggatgaaaatgcaaaaacgtgtggtggtgttggcattggtgctgatgg

SEQ ID NO: 59280 - DNA, 331 bp, Heterodera glycines
  Genomic contig location: Contig_ID=SeqID_28699; Location=561..891; Strand=+
  SCN-specific regions: Sequence locations=1-49,85-285,312-331
atgctttcatttacaaaattcgactgtattaacttttccaattttcatgataatttaattttaaaatgaaactaaattaattttccatttttaaaatccattttttcagctcagtgctataagcagcggaaagcggaaacgacggcaccgtacaattttcacggagtaccaactgtacacgttggaggaggtgttcaccgcctgtcagtacccggacgtacaaatgcgggagcatttggcggacaaattaaaattgcgcgaagaacgcgtggaagtacgtgaaactattttttaaaaatttaaaatattttcgtaaattctaaataacata

SEQ ID NO: 59281 - DNA, 121 bp, Heterodera glycines
  Genomic contig location: Contig_ID=SeqID_28700; Location=641..761; Strand=-
  SCN-specific regions: Sequence locations=1-121
atgcacccacttgtccaagctgcaagtgcagaagcaggtccaaaaatccgaagaaaccgcgcaaaaaggctgagccatcggaattgcgaaggaattgatcgaaagttattcatcgttcgat

SEQ ID NO: 59282 - DNA, 2089 bp, Heterodera glycines
  Genomic contig location: Contig_ID=SeqID_28703; Location=10..2098; Strand=+
  SCN-specific regions: Sequence locations=1-1100,1122-1187,1209 -1372,1394-1708,1746-1975,1998-1999,2021-2089
atgaaggccgggacactgtatgtgtcgcaatatgcacgaattgaagaggaaatgttggagtatcgttcccgactaaacactttgcccttagctaccttacgaactatacaaagaccaaacattacagaagtgattaagctgatcaaagctgaagctaatgagacacttggtgttgtgttcggaaatacgggatggattgaaatgatgaaaaatattccggaaaaggcacggaatattgtgaattacgtaaaagggatttcagtggtactgattgcagtcggaataattatacttacagtaattgtcatttacgtaattgtaaagtaccgatttattattatggcgggactcagagcaggcacaattatggcaagagtaattagagcaatattcggtgttaaaaggagaacacgagttgccgccgtgccaacggcaccagacctagactcagtggaccaagaagcatacattttggattatcttcccccaagagttgctgcaattacaaatgaccctcgaaaattaccatcaatacgagtttatttaaatggtttgccaacttcagcgttggtcgattcatgcgctagtgtttcttattgtcgccaaagaacagcaattaaagcgggactcgaaataaaggacttaggcagtgaaaacccaaatttaacagcagcaaataattcatcaatccaaattattggaaaagcaaatgctaaattacgagttggagatacagaaacaggaaaatgtgcagaatgggaggtaacgttattagtgtcaatcgataaagattgtcctggcccattattactcggactgccattgttaagtgatttaaagggtgtaatagcatttggggaacaaaaagtgcgtattggtgaaatttggacaaacattgtctctgttcttgaggccgataaacccaatcaaattaaagttagcctcgatcagactgaaacttttgagccaagaacggaaaatattattacggcaagagtaaatgagtgtttttcagcaaatcaaaattttttggtaaaaggaattaaacatcagtacccaagtataataatcggtagaactttggtcacaccaggggacagtaattgtgttacaatacaaattttgaacgctggaaaaatgccagtaaaagtatataaagggtcaaacatcgcggaattggaaatggtcaaaattaatgctttaccaggggatgaaattccaccgaaagattatattccccccgagacaaaatggcatgaaaaattaccgtatttaccgacagaagggaaaaaacgactaccatctgaaagaataaatctgacggggacaagattgagtacaaaatcacaaacggaactaaaaaatattgtggacaaacatgatgaagcttttgtgggcgatgatggcaaaattgggttatacaaaggaccaattgtccataaaattgatttagttcccggttctttaccatttcattttcgaccctacagatacccacccgaaacgcagaaagaaattgaaagacaaattaaaataatgttggaccagaatatcataagagagagcgaatctgagttcgcatcccctatcgtaatggtgcccaaggcagataagaaatcttggcgttttgccatcgattaccggtcgctaaataaaatgacaaaaaagcgagtattccatttaccaaatattcaagaattgttagacttaatgggctctaaaaaatattacacatcaatggacatgcaaagtggtttcatgcaaattccaatgtcaacagaagacatagacaaaacggcatttatttcacaccttggcatttatgaattcataacaatgccatttggtcttactgctgcccccgatacatttcaaagagtgatgaattcacttcggaggcgcctaacagcagcaatgttaatttatctggacgatattataatcggaagcgaaaccgaagagatgcatttgattgacattgaaaactttttaaaattattaaaagaagttggatttaaattgaaaatggacaaatgccattggggaatggcagaaattcgatatttgggatttttgctaagtgaaagag

SEQ ID NO: 59283 - DNA, 264 bp, Heterodera glycines
  Genomic contig location: Contig_ID=SeqID_28705; Location=318..581; Strand=-
  SCN-specific regions: Sequence locations=1-79,101-232
atggacaaaaaattaattcacgaaaactgctcaaacaactggtaataaatactgaaattcacatataaataaaataattttcacccaaatttaaaaattttgttttagcattgtctcctccatctttgatattattaaagaactgaccaaattcagtggcagaattgccaaaattgagaaggaaacaaaagtaatggcgaaaagcaaaaagcttctcacgttaacactaaagttttaatgaattaaaatatatttaataataaa

SEQ ID NO: 59284 - DNA, 181 bp, Heterodera glycines
  Genomic contig location: Contig_ID=SeqID_28707; Location=150..330; Strand=-
  SCN-specific regions: Sequence locations=1-181
gacggttaccgaacacaactgctcgtacaagggggcggcaacgagtgcaaatggtcctccgcttaaaagggccgacggagaggcgaagaaacgcgcgattggtgacgaagcacagagaatgccttggcaagagcaggacggagatcaaaccttggcatttgttgtcggcacttatgcggca

SEQ ID NO: 59285 - DNA, 1437 bp, Heterodera glycines
  Genomic contig location: Contig_ID=SeqID_28709; Location=60..1496; Strand=+
  SCN-specific regions: Sequence locations=1-87,109-219,257-562,584 -742,780-871,971-993,1015-1024,1058-1087,1119-1150,1172-1188,1210 -1237,1259-1298,1343-1386,1408-1437
atgattcaaatacccgccattattataaataatatgttgccattattctggcaagagatcaataccaatggaaaagtatttagggagttagtgttaagtaagtaaaaatggtcattttagaggtcggcatttttgatggcagatttaaagaaaaataaattagatacagagccagagaaatagtgattaaaaagagcaaagttaggactataagaacacaaaaatataaaattttaattacaaaaattgaattattggagagccgagactgaaagtggtctccaaaaacggcatttttcaagaccaccaagtaacataatgttttaaaagtggttttggaaattctgaatttaattaaacaaggtaaatcgggtatgttgagttcgtatagtcttagatttggtctctgggatcgcaacaaacctgtacagctcgaacttcatgcatggagttggagcagtacaagctcaggttgaaaagataggtccctttaaggccatattcggattctactggtctaaattgtatagaaaaactaagattttgttatatcagctttggtttttgaccataaaaaattcgagaaaaattagtgggccaattttcaattttggcatggtcgggaaaaaaggcagaaaaatctatcaatcaaataaaaagtgaaacgatagtaagatataaaagaggacaccatgaagaacaaaataaaaaaagaatcatttaaataggcgcagaaataacggagttatgaatttttaaaaattggaaaaaatttgggtatcataaattatgttccaccctaaggttataaagcagcacattagaacatttaataaatatattatctatagaactaaaattggatgaattctttatttttcataaaaaaaaatctatataattgaaactatcaaagaaataataaacttaaaataaattttaaagaaaaaataattattattcattaaaagaaatgaaaattgtataaaatccttgttttaatgtttcaattcattttgacatgttaaaaaaatataataaaatttaagaaaaattaccaaaacatacatagtgtaaatgaaattgcaaattaatataagtattttttattataaattcatagaatagaatgaatgatattagatgatattttcatatttgtgaacaagatataaatgcaattaattcatttaaaaatcaaagggattaaataatttatattttacaatcagtgtatcattaaaaacatttttagaaatcgcaatataagattagattattaaaatagtgacagcaacaataaaaattataaaatttaaatattaaatattaaaaaatatttctagtttcagaaacttaaatcaaggaattaattacatatgggcagtaaaaacaaaaattatgtatccataaatcatcaaaagttcataaaaaata

SEQ ID NO: 59286 - DNA, 270 bp, Heterodera glycines
  Genomic contig location: Contig_ID=SeqID_28710; Location=882..1151; Strand=-
  SCN-specific regions: Sequence locations=1-16,61-163,197-226,248-248
atggcctccagcaaggtaaaaaaaataaatttagaaatttcaaaaaaattcaaaattttagttccgcaaattgctcaaccgagagctttccctgttcgccggttcgtccaaggcgggcccacaaatttccaaatttttattgtgagtaaattttggtgaaaacttttcaaaaatttaaaattttctcaagaaatacctacatggctcaacagcccgaggatgagcttgccaccattgaagaggtggacatatatttttttaattaataaa

SEQ ID NO: 59287 - DNA, 1496 bp, Heterodera glycines
  Genomic contig location: Contig_ID=SeqID_28711; Location=257..1752; Strand=-
  SCN-specific regions: Sequence locations=1-27,49-280,302-391,413 -433,455-653,675-1208,1230-1423,1459-1496
atgaaaatggggacggagacacaacgcgaagaggaagacgagcgggaggaagaggagagagcgaagagtcaaagcgaagaaggtggggacaacggagggtcgaccaaaggcaagcgaagaccgaattgaatagggacagacgacgacaacgaggaatcgcgaccgaacccacttgtgttgagaatcaaaaaggaaccgcaggaagaagcatctccaacgaaacacgcaacaacacccaacaattcatcggcaacaaaattactctcacaatcagcaagacaaaacgaagaaacggaagcgaaaaagagacaccactttggtgcgtaaaggacgagcgaatggatgaaacacatccaaagagtgggcttcaccccgcttcgtttcccccctgaaattaaaagaccaaaaactttaattttctaacgttccatcgttagagattttcctatttaaatttttttaatccaagtttttcagaaattttagctttcctgaaaacctctaaaaaatttcatatcggcttgccacccttgggaatgtataaaccatataatttgataagattagtccggttcagacgatgactgcgaaactttcgaggatgagcagccaatcgacgccttcgcctcccaacttgccgctgctgacaaagtacaaaaaagtttaccgaaaaagcccaaaaaggtatcgatgccctccgcagaaagcattcaaaattcgttgctggattcgttgaagaatccatcgaactttggaccgtccattggtaaatttctaaatttggttaaatggaaacaactaatgaatgctaacttattgttagcccaaccccaaccaaacaatcagcaaatatccatgcccaccgacctcaacataaacatgttcaaagcgcccaaagaaaagaaacgcgtttatgcgggaaggcgaaaaacgacgggcgatgtgcaaattgtgccctaccttttcgacatttgcatgcgatttttgctcaacaacatagacggtatttgccaattcggggttgggaatgggaattttcaaaaatgatttggattagccctatcatgaacaattgcataccaaaactttatttcacctttaaaagggtgtttaagtaattgcaagacggcctattcattattccaatccacagactgataatgagcatggaatttgcttaatttagcaatcgatgagacgggcgacattccttttgatgtgttaaggccgatcatggagaaagctaacgccgaacagctgatgcgactggagaagaaaaacccggtgcaatttctatttttgctaaggctaaaatgaattacaatttcgttttttttcagtatctccgtgaggatacgaattatttgtggaaaaatcactgcaagaaagaatttgggaaggaattgaccaaattgagggaagagttcggcagtgatgaggaggaagcggaggaggacgacgagacggacgaaatagcatggcggaagagatacaaa

SEQ ID NO: 59288 - DNA, 507 bp, Heterodera glycines
  Genomic contig location: Contig_ID=SeqID_28711; Location=714..1220; Strand=+
  SCN-specific regions: Sequence locations=1-365,387-507
gaaaattcccattcccaaccccgaattggcaaataccgtctatgttgttgagcaaaaatcgcatgcaaatgtcgaaaaggtagggcacaatttgcacatcgcccgtcgtttttcgccttcccgcataaacgcgtttcttttctttgggcgctttgaacatgtttatgttgaggtcggtgggcatggatatttgctgattgtttggttggggttgggctaacaataagttagcattcattagttgtttccatttaaccaaatttagaaatttaccaatggacggtccaaagttcgatggattcttcaacgaatccagcaacgaattttgaatgctttctgcggagggcatcgatacctttttgggctttttcggtaaacttttttgtactttgtcagcagcggcaagttgggaggcgaaggcgtcgattggctgctcatcctcgaaagtttcgcagtcatcgtctgaaccggactaatcttatcaaattatatggtttatacattccc

SEQ ID NO: 59289 - DNA, 4213 bp, Heterodera glycines
  Genomic contig location: Contig_ID=SeqID_5807; Location=3156..7368; Strand=+
  SCN-specific regions: Sequence locations=1-575,597-714,737-801,823 -1702,1724-1854,1876-2085,2107-4101,4123-4191
atggcagcggttgtaaaggctggcaaaggaccaggcccttatacatcggaaacgtcgtggaccatttgggaagaacgatttgagtttttcatcaaactccgaggcatcactgatgcggagacgaaaaaattgctcttcttctcggagattgggccaatatacgaagagcttcgccaaatggcgttgccagacgacgtccgcgacatgtcaattgatgagatcaaagcgctgatggaggaacgatttggcgagacgaagacgattgcggcaaaaaggtttgagctgttttcagccaaacaatcatcaggactgtccattcgtgattactcaatccaacttcggaccttaatttccaaagccgaatggcataaggattcggtcgacatgtgcctgagcgctcttttcatcaacggccttaaaaaggattcaattcgggccgagttgataaagaagggagtgaacgaaatgaagttcaaagatgccgttgaaacggcagtgcttctcgagcagtccgacttggacgcagagcaaatcggtgggcataagaaagcggaagtggcgaaagtctttgctccaaagggaggaagaaagattagcgcaccaacgcagcaaatgcaatgccatcgatgcgggaggaatggccaccgcaacaacgagtgcccgaacaaggactcaaaatgccgaaagtgcggcaatgttggacactgggctgtgatgtgcaagacaaagcagggctccaattggccaaggaggcaagggaagccggttcaccaggtcaacactgaaagccaaaaagcacacgatattggaacactggccaagtctgaagaagtcaaatcgatttcagtgccaccagcgatgataaaacttcagctgagtaaaaaggcgacagatttcgaattggactgtggcgcagatgtcacactcatcaccaagaatgattggatgtccatcggaaggccgaaacttggacaaacttcaggattgatggcatatggaaaaaagccgatcaaagtccttggatcgttcaaaacggatgtggtgtacaacggcaaagaagtgaataccgaaatttatgtcgtggacggcgaaggcaaaaatttgtgtgggagagatttgattggtgaattgcaaatcgatctcaacaaagcgttcggaatgcgatcgatcaatgaagtcaagtgcaaggcagtggatcgagagctgggagcggtgcttctaaagtacgatgaggtcttcaatgacggactcggccgatgcacaaggcaaatttcgttgaaatttaagccggaggtgcaatcgaagaagtgcaagccacgccccgtgccttttgcattgagacccgaagtggagaaggtcatcgacaactgggtcaaagatggagtgttagagcaggtgacaacgtctgagtgggcaacaccgttggtgattgtacccaaagccggaaacaaaattcgcttatgttgcgactacaaagtcacggttaatcaatggctcgacattcatcaatacccgttgccgcgcccagaagaattgttcagcgtgttgaacggaggcgaaaagttttcaaagttggatttgaaggaggcttatcttcaactaatgttggatgataaagccaaggaatgcttgaccatttgcacgcataaaggcttataccaatttacgcgtatgccttatggtgttgcgtcagcgccagcaattttccaacaagtgatggaagacgtccctcgtggaatcgacggagtcgccgtctacttggatgatattgtggtgacagcccccaacgacgcggaacatttgaaacggctggaaatgactctccaacgcatccaaaaatttgggttgcgtgtcaaaaaggaaaaatgttcctttatgcaaaagcaaattgcttatttggggcacatcatcgacaaagaagggattcgaatgtcgccggacaaagttgaggccatacagaaaatgccagcccccaaaaacttaaaggaattgcaatccttcttgggcatggttgggtattatggcaagttcattccgtcaatggcaacaatttcggagccgttgaacgagctacgccgatcagagaccaaatggcattggggacaacaacagcaaaaatcattcgaacagatcaaaattatgctgtcgtcgaacgagctgttggcccattttgatcccaaaaagccactttatttggcaacagacgcatctgactatggagttggagcgatccttttccacaaagatggaaacacaggagagtttggcgtgatcgcatacgcctcaagaacattgagcccagccgaaagaaattatgcgcagatcgaaaaagaaggacgcgcagtaatcttcggcgtgaagaaattcaaccagtacttgtacggtagaaaattcattctacagacggatcacgagcctttaaaaaggatttttggaccaaaaggtgaattgcccgtggttgcggcacgacgacttcatcgttggagtttgaagctcatgaattatgacttcgaaatcgaatattgttcgacaaaaaatttcggttacgccgatggattgtcgcggttgcctagtccagaaattgatcaggtctgtaaggaaagtctcgagctgaacaaaatccagcaggagagccaaaacgctttgccgatcactgcgaaggacattgcgaaagaaattggcaatgatccggtcttcgcaaaagtaaaaggttttgtgctcaatggatggccaacaaggatagaagacgagaaaattcgcccattttttctggtaaaagacgaattggagctgaataacgaatgcctaatgttgggatgtcggacagtgattccgagcaaattccgtgagaatcttttgaaattgatccacgagacgcatccaggaatcgtccgaatgaaggcattggccaggcaaaaagtttggtggccgggcatcgacaaagacattgaaagcatgaaaaagaagtgcaaaatttgtcaaacgaatgcgccggaaatgaggaaagtccctctccatccatgggaagtgccagaaaagccatggcagcgacttcacattgacttctgtggcccatttttcggaaaaatgtggctgatcacggttgatgccaagacaaaatggccagaagttgcaatcatgaaaagtactacgaccgaggcaacgattgaggcacttcgaaaattgatttggacccacggattgccagaacaaattgtgtctgacaacgggccgcaattcgcgtcaaaggagtttgaagaattctgctccaaacgcggaattgaacgaacgctgacggcaccataccacccgcagagcaatggggaagccgagcgttttgtccaaacattcaagaaaggaatgttgttggttaaaaaagaaaccaactgggacaatgaattggccatgaaccaattcttactcaaataccgagtaactcctcattctgcaacaggacggtctcctgcagaaatgatgttcggcagaaagctgcgaacactgctcgacctcgtgcgcccgtccgaatcgaccgaaattgaaggaggagaagagaaggcgaaagaaaatgctgaaaagcatggccaaaaatatttggctcgcgccaaaaagaactttgatcgacggacgtggaaacgatcgtttaaaactggacaaagagtctttgccaggaattacagagacggttcgaagtggatggcaggccaaatcatgagccaaataagcccatcactgtttcttgtccgaacagcccgcggggtctggaagcggcacttagatcagctgaaatcggacgagacgaagcctgatctggagagcaacaccgacgtggactcaacatcgtccataggtgatcagacggaggatgaaaaggacggaggacagcagacggacgtggaagaagagccgaacgatccgccaaatttgcacgatccgccattgagaagatcggtgcgcgaacgaactccacgacagatcttcgaccccagcgcgtgatcgctgacttcagctggtggggaggagatgttgtgttcgttaattatttgaattaacgccaaaagatgctcgtttatcgatcatccttttgacccttcgtgttgtccatttaaaccccccttttcccccattccgtgcattctccctcattcattaattgtttccatttaattgtgacccgctccctcccttcgctatttattatatttatttgtgtgga

SEQ ID NO: 59290 - DNA, 117 bp, Heterodera glycines
  Genomic contig location: Contig_ID=SeqID_5807; Location=1646..1762; Strand=+
  SCN-specific regions: Sequence locations=1-64,86-117
accatcaacgctcatttcagcgaagcaaaattttttgatgtccgtctcatgccattccgtctgtttgactttggccatttcaatgattgtgctgccaagtgtttgcaacatttttgt

SEQ ID NO: 59291 - DNA, 462 bp, Heterodera glycines
  Genomic contig location: Contig_ID=SeqID_5807; Location=198..659; Strand=+
  SCN-specific regions: Sequence locations=1-210,248-462
  Gene Ontology: Mol. function=dihydroorotate dehydrogenase activity
ctctccccacagattgacgcgtggccaaattccgatcatcggctgcggcgggatttccagcggcgcggatgcgtacgagaaaatcaaggcgggcgcctccgctgttcaggtgatgggatgggtgtttacgggaggttaacacgagcccacccagaaatttgttggtgactattttggctctctcaaatacggaagtgtcccactctgtactttttaattgaaattttcaaaaaaaaaaaattattttcagaaaatcaacctaaaagcgttgttttttagtagtgtttcactaaacaaaacctcataaaaattttgccgcttttgcagctgtacaccgccattgtgttccaaggctttccggtggtcggacgggtgaagcgcgagttggccgaactgctccaaaaggatggctatgcgcatgttgcggaggcggtgggcgcacagcataggaaaaaatgatca

SEQ ID NO: 59292 - DNA, 614 bp, Heterodera glycines
  Genomic contig location: Contig_ID=SeqID_5807; Location=4368..4981; Strand=-
  SCN-specific regions: Sequence locations=1-103,125-614
tggagagtcatttccagccgtttcaaatgttccgcgtcgttgggggctgtcaccacaatatcatccaagtagacggcgactccgtcgattccacgagggacgtcttccatcacttgttggaaaattgctggcgctgacgcaacaccataaggcatacgcgtaaattggtataagcctttatgcgtgcaaatggtcaagcattccttggctttatcatccaacattagttgaagataagcctccttcaaatccaactttgaaaacttttcgcctccgttcaacacgctgaacaattcttctgggcgcggcaacgggtattgatgaatgtcgagccattgattaaccgtgactttgtagtcgcaacataagcgaattttgtttccggctttgggtacaatcaccaacggtgttgcccactcagacgttgtcacctgctctaacactccatctttgacccagttgtcgatgaccttctccacttcgggtctcaatgcaaaaggcacggggcgtggcttgcacttcttcgattgcacctccggcttaaatttcaacgaaatttgccttgtgcatcggccgagtccgtcattgaagacctcatcgtactttagaagcac

SEQ ID NO: 59293 - DNA, 303 bp, Heterodera glycines
  Genomic contig location: Contig_ID=SeqID_28716; Location=494..796; Strand=+
  SCN-specific regions: Sequence locations=1-303
atggcacggatggagacaatgttggcattgctcaacgcattcagcaacagtaataatggcacaaatggagtggtcccccaacagctgcaactcgtcgaagacatcgtcaaacagcaaatgaatccatttgacgctgttgggcctccggcactgccaacgccggcggcgacagtgtcggcgttgcccaacccgagaccgatcaacccgatggatctcgaaaggtgccaatgaaaatgctaattttaagtaattcgttcaaaatttctcacaaatctaccgtaatttcctcctacttttttaaaa

SEQ ID NO: 59294 - DNA, 541 bp, Heterodera glycines
  Genomic contig location: Contig_ID=SeqID_28718; Location=705..1245; Strand=-
  SCN-specific regions: Sequence locations=1-237,259-541
gtttctgacgaacaaagccatttggggagaccgattcagaccaaagtcaccactaaggacgtgagtggaatgcttgccatggtctgtccattgcctctttttgtgatttcactcaaacaattttttacagagcaccgattttccgatcagcctcaatttggcacttgtaagagtttgcgggtctttcttttctcatcttttaaacaaaacataaaacttttgacattttgtaatttggtgttctccaggacattctcagcgtcatggagccggtgaatccgacggtggccaaattacgcgaattttgcaccgctaaactgcctgaggggttcccggtacgcgtggaaatgccaatttttgcgacgattcaggcaagggaattcaaaaagcgtatttccaaaaattaattctttatcaggctcgggtcatttttcaacaatttcgctggtgcggtgaaggcgcctctccagcatttccggatgcaatgttcagaacaccggacgattatcgcgaggacccgaagagattcaaacggatgtag

SEQ ID NO: 59295 - DNA, 441 bp, Heterodera glycines
  Genomic contig location: Contig_ID=SeqID_28719; Location=1224..1664; Strand=-
  SCN-specific regions: Sequence locations=1-87,127-330,352-385,409-441
atgtccattcgtcgccttccttttgttgtcgcaagtttttttgctctcgcatttatgcacaatttttgtgatggtaattttgtttagtttttttttatttaacaaaatgattaaattaaataatttcttaattgagcattggaatgcgctcaagggtcaatcggagttgttgatccggaggaagagccattcatcgttaaagaatgtcccgctgatgcaaaatatatgttctgccacaaaaccaactgttcatctggtaaaaatgcatttcagcagattgttctctcgagcacataaatacgtattcaagacctttttaaacattagtatccatagaaaaaattttatatttttgatgcgtggaagtaagaatttggaactgcaatttttcacaatcacaaaatttttcggtgtaaaaaacttagaaaaaaaagaaataaa

SEQ ID NO: 59296 - DNA, 552 bp, Heterodera glycines
  Genomic contig location: Contig_ID=SeqID_703; Location=194..745; Strand=+
  SCN-specific regions: Sequence locations=1-353,378-389,461-500,525-552
atgagtccagcagtgattagaagaggtacaacagtgattagaagaggtacaacagtaattagaagaggtacaactgtgattagaagaggtacaacagtgattagaagaggtacaactgtggttagaagaggtacaactgtgattagaagaggtacaacagtgattagaagaggtgtaacagtgattagaagaggtacaacagtaattagaagaggtacaactgtgattagaagaggtacaccagtgattagaagaggtacaactgtgattagaagaggtacaccagtgattagaagaggtacaagtgattaaaatttgaacaaaagtgattagaagaggtacaatcatggtttaaaatgaaataaataagaaaattgtattattggatgtattataaatttatcaaattaaaaaaatccttttacttattaaaaataaagttagaaatttataatatattgtagaatatttattgaaattgaaaggaattaatttctcgaaaattcaaattaaataaaacatttattcatcagaaataatttaaaataatta

SEQ ID NO: 59297 - DNA, 3711 bp, Heterodera glycines
  Genomic contig location: Contig_ID=SeqID_703; Location=212..3922; Strand=-
  SCN-specific regions: Sequence locations=1-1048,1079-2073,2120 -2379,2410-2489,2511-2711,2996-3036,3230-3269,3341-3352,3377-3711
  Gene Ontology: Mol. function=protein binding; Cellular component=DNA -directed RNA polymerase II, core complex; Biological process =regulation of transcription, DNA-dependent
gaaaattgttcctcttctaatcacagtttgcacctcttctgatcactgttgtacctcttctaatcacttttgtacctcttctaatcactgttgtacctcttctaatcacagttgtacctcttctaatcacagttgtacctcttctaatcactgttgtacctcttctaatcacttttgtacctcttctaacaattttgtacctcttctaatcacttttgtacctctgataacaattttgtacctcttctaatcacttttgtacctcttctaatcactgttgtacctcttctaatcacagttgtacctcttctaatcacagttgtacctcttctaatcactgttgtacctcttctaatcacttttgtacctcttctaacaattttgtacctcttctatgactgttgtacctcttctaatcactgttgtacctcttctaatcactgttgtacctcttctaatcacttttgtacctcttctaacaattttgtacctcttctatgactgttgtacctcttctaatcactgttgtacctcttctaatcactgttgtacctcttctaatcgctgttgtacctcttctaatcactcttctaatcgctgttgtacctcaaaatttaaaaaacgggcgcgaaacgcccgtatgagttcaacgaatttaaaaaacgggcgcgaagcgcccgttcaaggccaacaaaaattgaaaaaccggcgcaaagcgcccgactgaggccgcgaagcggcctaacaagctaaaaaacgggcgcgaagcgcccgtatgagttcaacggatttaaaaaacgggcgcgaagcgcccgttcaaggccaacaaaaattgaaaaaccggcgcaaagcgcccgtctgaggccgcgaagcggccttaatagcccaacaaatttataaacgggcgcgaagcgcccgtctgaggtctctaagctgccttaatagcccaacaaatttagaaacgggcgcgaagcgcccgtataagcccaacaaaattaaaaaaacgggcgcgaagcgcccgttcgaggccgcgaagcggcctaaaagtcccagataattttttaaaaattcaaaatctccacaaccatagcttatctaggtagcgaagctcccaaagcgcgaagcgctttttcccagctaaatagccgacggttcacgcacccgctagttactatatacgttatattgacaaggagtttcgtttgcaaaaacaaaatctcccggccgaaggccgggagcgccctgaaagtagtggaagggtcttacaactttttgaggcgcatctgggaaaactatagaaaaaaattcagcgcggacgactgagtcccggcgaccgatttctcactttttcttgcgtttgatggcccataactttttttctaaaactcgaatcaaaaaatgttcgctgtgagggggctaagttgaagtgttttctaaaaaacaaaaaaaattccaggcctctacctataataggaagggctgcagaaaaatggagaaattcagtaccaactttgtccacttcagtcccaggcgaataactcgccagggtttgaactgagcgagggggtgccagcagacttattgtagagttcaatgagctggatttttccagtttttaaaatttcgaaaattttcaaaatttttcgagctaggcctaaaaaacggttttcaggtttttgaattttaggaatttttaacgaattttcccagaaaaacggagaccactttcaagcaaccgtttttcgagctctatcgattggtgatatttttgaaaaaatttcgattttttcccggaaatagaaaaaatttttggcctgagcgggacatttgagtcccgggtccataactcgttaggggttggttttatcgaaaaaacgccttagggcaaaattgtagagcttttgaagctctatcgaatggtgtgccatatggcgggaaattttcaaaaattttcgagctaggccccctagaaattttcggaatttttttttgggttgaaaaagagggtgaaaatttttttctgggtatttttaaggtgctgagcacgaatctgatgatcattttcagtttaggaaattttagaattttttaaaaattcaaaaatatttttcaattttttggccctcgggattttgggcgaatattggaaaattcataactcacctcagagagggtaatttttcatacaataaagctttaaaaatagcaaaaaatcgggagaattttatgagatttatttgggatttctatcttaaaaagaaaaaaagttattccagaatttctgaaaattttcgatttttcagaaaaaaattcataactcccttctgaaaagtcattctgtaaaagtaatatactacaaaaatccgcaattattttctctataatataaattttattttacatttttatctcttttttgcgaattgttataaaaataaaagtgattttggtgttcgggaccacaggggggtgaccaggatttttgagtgaaaaaattttttcgacaaaaatcttccaaaaacatgtctttaggggtagtttatgacgctgatcacgaatacgtgatcacattttacttttgacatcgttaagacctcagaatccctgtgtgattggggattctgaggcatcattttgagggggggggggggaagttcgaatccgggcggtgtaacattatttttctgtgcattttttcattattttcaatgtttttattaataaaaaatagatttcttttattaataataaataaaaatttttaatttgaagtaaataattttggtaaataaatgtattaatttaaaattaattattttttatttttaaattaaagaatttatttgtttttttaattataatttgtcaaaaatttattttcaatacaataatactcaatcattgtaaatttaaagtttatttttaattaataaaagaaagcattttttaataattttttaaaaattattaatacatttttttaattatattttttcataaaccatttttttctgtgcattttttgcttacttttacattttttaattaatttgttttgtattattaataataaataaaaatttttaatttaaattttaatttaaattaaattattttggtgaacaaatgttttaatttaaattatttaattttttatttaatttaatattgttttattaattattttaaattatttctgatgaataaatgttttatttaatttgaattttcgagaaattaattcctttcaatttcaataaatattctacaatatattataaatttctaactttatttttaataagtaaaaggatttttttaatttgataaatttataatacatccaataatacaattttcttatttatttcattttaaaccatgattgtacctcttctaatcacttttgttcaaattttaatcacttgtacctcttctaatcactggtgtacctcttctaatcacagttgtacctcttctaatcactggtgtacctcttctaatcacagttgtacctcttctaattactgttgtacctcttctaatcactgttacacctcttctaatcactgttgtacctcttctaatcacagttgtacctcttctaaccacagttgtacctcttctaatcactgttgtacctcttctaatcacagttgtacctcttctaattactgttgtacctcttctaatcactgttgtacctcttct

SEQ ID NO: 59298 - DNA, 1665 bp, Heterodera glycines
  Genomic contig location: Contig_ID=SeqID_704; Location=1785..3449; Strand=-
  SCN-specific regions: Sequence locations=1-399,421-1209,1231-1665
  Gene Ontology: Biological process=DNA replication
atgtacatccacagggcacaccagtgcgctatacgccaagcacgggagcaggaagcgctagccgacattgattggcgattgcacttctttaactcaagctgcgtgcactgtggcctcccagatccaccaaattcaaaagccaaaaatatcaatttggcagttgaagaagctttctttggtgatgatgatctgaatatgtcgcctggccagcaaaatcctaggcagcagcaaaacgctccacctccactcaacagcgaccaacaaacggtctttgatgctgttgttaaggcaattaagtctgatccaagagatcagactgtgccgcgccgtttcttcattttcggcgatggaggtacaggaaaaacattcctgtttggccaaatcataaggcgcttgcgcaagcccccatacacctacaaagtgcttgctacggcatccacagggtgtgcagctattttgctgccatatgggaaaacggcccattccacgttccgtctcggtagagatgtctcattggacaagcttcccagcattccgcttgagagcttctttgctcgacggatacgtgaggctcagctcatcataattgatgagatcaccatgctgcacaatacggtgattgaggtcattaaccgcgtgtgcaaagagatggcaatctcacagtacaagaacctccccttcggaggaaaaacggtcatagtcagcggtgactttaaacagtcgctgccggtcgttcctcacgagggcctgactgcgcaagtaacagcttgctttcaaacatccccattgtttggtgaattcaccacaatgaaattgactatcaaccagaggttgggtcaagggcaacaagcatacttacaaatgtgtcgtcaaattgggctcggagagaccggagaacacttctggattcctccgcagttcctggtaaagagcagggaagagttgatagactttgtctatcccgacttccaaaaactccttggcaatgacaaggagctgctcaatcgtctgatcctcgcacctcacattgacacgtgtgatgagatcaacgaaatcatgatggcgaatgtgcctggtcaagtgcgcgaatatttgtcctcggataagccgcttgacgagcgtccactggacatcgatgaaatcgagtccgaagtggcagcgttgaaccggcgcacagactctgggatgcctccccaccgtctgcgactcaaagtcggaagcgtcgttgttctccttatcaacaaaagtgataaagaaggactgatcaacggcacgcgcatcgttcttgaagaacttggtgacgatcgcctggtcggtcgagtaatcaacagcaacgctgttggtggccaagttaagttcttcattgaaagaacacgtaatgtgtatgaagacaaaacgcctggcggcttaaaatatgagcgtttgcagttccccataaaacctgcattcgccatgaccattctcaaaggtcaaggccaaacaatcaacacggtcggaattgaccttgaaagggatgtattttcccatggtcaattatacactgccttttcaagggcaacggacggtaacaacgtccgagtgtacgctcccagaagggagaccgatgcacaaggtcaaaccaaagtgttgaacattgtggccaaaaacatgctcaaattgcaataa

SEQ ID NO: 59299 - DNA, 4348 bp, Heterodera glycines
  misc_feature (26)..(26): n is a, c, g, or t
  misc_feature (4342)..(4342): n is a, c, g, or t
  Genomic contig location: Contig_ID=SeqID_705; Location=30..4377; Strand=-
  SCN-specific regions: Sequence locations=1-927,949-1397,1419 -1459,1481-1709,1731-1828,1850-2258,2280-2574,2596-4091,4113-4348
atggtatgggaaaatggcttggacgntgtcatgcaatataaaaatatgacatttggggtatgacccaaatgttcaggcagaagtcattcttttgccagtacatttccctggacattggactctaattatccatgatgttcagtgcggtacacattttgccgattctttgcctaccccttatggcaggttggattggcaactgacggaaaaaattggaaagatcatttctgacattttgccgtcaacagtgttgaccgggatttttaatgccgtaaatcttacggtacaacacgatggtaacagctgcgggtacttcgtgtgcctatatgctgaatcatggctcatgaacaatcgcacgtttgttctgccagatttgtccatcaattatgaaaagcggcgcatattgtggcacattaacgagctgtataactctgataatgttccatatcatccaagggaaggggtacctactccgtgcccaattgtctatcgacatgcggatgaggctccatcgacatccaaggccgctgagccagttgaagttgatgatcatgatgatataatgatcatcgaaccacagacgagtggacaagcagttgttgccattccaacacaagcccaagtggcaggtgaaaaccaagctgacacgcttggattggtgtcggaaacttgcgtcccgcaagagccaattgcgcagactgacgattcaatatttgtcagaccaaagacgcctccaaggcgttcatcgcgcattgggagacggcaatcagcttcgattagccgttctccttcacccgcgccgagacgtcggtcatcgacaaatgccgctgagcaagtcacagcatttacgcggcgttgctaccttgtccacaagggttggtgctgtgctgcagcagcggcaaagcattatccagaatactcagattctggtaagcttggtgacaagaagtgttctcactgtggagcattacatttcccacacgaggacagcagcatttgctgtcgtcagggaagggttgttttgccaaagctcaaccctcacccaaaagagcttgaagagctaattgtggaggaaaaacaatcccgtaaaggaaaagaatttgtacgacaaatgtcgcggtacaataatttgctccaatttgcaagtgtttcggctggccataagccaagtcctgcaggcggaccgatggcagtaattctcaacggagaattccatcgccgcattagcagcatgcaggcgggtacaacacagatacctggcttcggtcagttgtacattctggatccagttgaagccatggagcagcgacgaaaaaatcccacctttacgggagagaaaatcacaaacgaggaagagtttgtgcagggtcatcagcttaatgaagagacccttgaaattttggaacaaatgatccaagaaaatcacccggctgcatctgcttacaagcaggctcgtgagcagctacaagagttgttaagacaacaaaggactgaagagctgcggttcttcagaatgactttgttgaatgagcgctctgctccgggtggtatgaaagaccctaaattgcatccccaccagataatcaccccctcaacgggtgaaggtatgttcgcaatacacgcggatcccacaggtgccccggcaccaaaagggatatgggtcgaaaacaagcaagggcagttaaacgaaatagccccgttcagtccatggactgatagcttgacttatccattaattaagcctaagggcgatgatggatatcaaattggtattccatatgccaaacccgcacaaaaaaagcggagaagcgatcaatgtgtcgatcaaatgtttgacactgatgcaatgtccgacgatggctcatgcgagactgagtcaattgctgcatcagatgctgagtcggtcgaatcgaccgaatcattgattgatcgcattgataagacgagaaaattcatttctctgcgagattactgcaagtaccatctcgcaataagggatgaaaatttggagtggcaatatcaccacattctgtcatgtggcggtggtcttggccagcgctgggtcttagaccaagcggccaaaattgattggcaaattgccagttttttgcgccgtccagacatggacctgcgcataagtactccaaaaaatttgttgcattatttggtaaaccaatacaataagcagcaagctcggcaaaaccccaatgcacgacaaaagactgtcgatgacattggtagtgttgttcgcctttctgaaaagaatattaattctcttcagtattggaaaaaaaggtatgaagactgcaacaccatttttgctcgttgccacgacgcaaaaaaggcgcggctcttcatcacattcacgaacaaccgtgagtggccagagttcaagcaaaacatttacaaaaatggtcaaatgttcactgaccgttttgacatgtggatgcgagtgtggtgcggcaaaattgctgtcttccaccaagagctctacgagaagggtttctttgggactatccttggctcaggagagtccatggagttccaggggcgtggtggcccacacgcacacattgtagcccagactgacctggacgcagttccagaagtcatccaggaatacatatgggctcatattccatctttgccgtgcaaagacgatgactcacccatagcgcaaatgcatcgcgaagtccgcgaactaatgcatatgcaactgcacagatgcagcgatagttggtgtggtccacgtgaccccaactttgggcggtgtaaaaagggcttcccagccccgtactcgaaatgtacgatactacacccggacaggcccgcattgtattaccggcctagcccaaccgacggtggtgcccaaattgaggtgaacggcttaatatacgacaactcgcaagtcgtgccgtacaacccatacattttgctgcgttaccgagtacaccacaacgtgttattcgcatacggtaacaaagcgaacatcaaatatgcactcaaataccctttcaaagggccaggacattgttatgtcgagtgcaaagaggagtccggcagcaaaatcggtatcgatgagccggctcaatatgccaaaatgaacttccgtggtgctacggaagcttttgcagttgtgcattcaatgccatttgcaaaactctcgcatcacgttgttcatttgtcaattcatttgccaaaccagcagcccgttgtatacagggcattccaactggtgagcaaagctgaggaaattcagcgaggcgaactcccagagacgccatgctctgcctattggaagcaatggcaaaatgaatggcagcatgttccttcgcttaaggacatgctttttgaaaaagtcccagagcaatttcgctgggcaaaggaccgatgggtcttatataaaaagaagcctagcaaaaggcccccaatcggtcgtgttgtacctgtccctccaacggaccgggaaagatttgcgctctatgcgttaatgcgtcactttcccggtgatccggaccacttaaaactggtcaatgggcagcagtacaacaccttcacagaggccgctttacagcatgggcttcttgaagatgaccaaatttggcacaaaacgctcggcgaggcagccttgcatcgctggccggaccagatgagatggctcttcgtgagcatcctcgtctttgggcagccgagcaatgccctagaactgtggaacaagtacaaagaccaaatgtacaatccacagggcatcaccagtgcggctatacgccaagcacgggagcaggaagcgctagccgacattgattggcgattgcacttctttaactcaagctgcgtgcactgtggcctcccagatccaccaaattcaaaagccaaaaatatcaatttggcagttgaagaagctttctttggtgatgatgatctgaatatgtcgcctggccagcaaaatcctaggcagcagcaaaacgctccacttccactcaacagcgaccaacaaacggtctttgatgctgttgttaaggcaattcagtcggacccaagggatgcgactgtacctcgccgtttctttatattcggcgacggagggaccgggaaaacatttctgtttggccaaattataaggcgattgcggaaggtcccatacacctacaaagtgcttgctacggcatccactgggtgtgcggctatcttgctgccatatgggaaaacagcccattccacgttccgtctaggcagagaagtctcgctagacaagcttccaagcattccgcttgaaagcttctttgccccgacgatacgtgaggcccaactcatcatcattgatgagatcaccatgctgcancacacg

SEQ ID NO: 59300 - DNA, 2642 bp, Heterodera glycines
  Genomic contig location: Contig_ID=SeqID_5808; Location=1001..3642; Strand=-
  SCN-specific regions: Sequence locations=1-26,48-153,177-275,297 -508,530-650,672-761,783-819,841-1049,1071-1086,1174-1193,1215 -1430,1481-1485,1515-1552,1585-1729,1768-1776,1798-1909,1935 -1957,2034-2205,2229-2642
atgattgaactgattagaaagtttgatcaattaagaaaagaaaaaattcatggttttaaatatgacgataagaaaagaaagatattgaatataattacagaaaatttgggaatttgtcgtcataaaatttacgaatggaagaagcaatttggtaagaagaaatgaaaatatttaaatcttacaaattgactcattttaagatttattaaagagcctaccaaataaataaaagctgaaaaaaattgagcaattcgaaaaaatcaatgaagaatttgaaaaaaaaatttaattttaaacccaattggaaaattaaagtaaaaatagcggaaaaattggtgtttcgtgggattcaatttatcgttggaagagaaaattcggtttaatcactcgtaaggagatgaaaaaaagaaacaaaatgattagtaaaaataaaattgataaaaaaattggcatcccatataccaacttacaacaatggacgaagaaatttggcaccaaaccaaatattataattttatttactatttgaataaaaggtaggccatgagttcaaaagccatccgagaaagtattgcatatttctctcattttgccacttcttaagtgctggctcgtagccagcgggacatcccgtcaaaccggggaatggtgagaacggagatgaccaaaccaggatccccgaaacttcggtcggtcggtttcggttaaatatactatgattactaaaataagacaagtgaaattattaataattgatccacaatatttttaaaaaatttaccgacaattttgacccttacaattcatgactatggtaataataaaagtatttgataaaataagattttgttcagtcaaaccaatgaaacattttcgagtcttatgcgtgacaaaagaaatggcctttgcataagaggctttggactttcacaattaaaattgccaatcattcactcacaaaaattaaaaaaaggcagtaaagattgaggattagtcatagctctcaaacttaaaacttctcaaaaatggtggatacgatttaaaatgacccaaaaaatgagaaaatacaattatggcgagcttgacattaaaagttataaaactaattaaatttaataacttttaacaaatttgtgcttaaaaatttatattttcttgaaaattaaaaaaatagaagaattgaaacctgatgatcttattatttagtctatttagtcaattcttacagctgtttaaacgtaaggttagacgtgtactagttttctgtttggacttagacctgaatacccggcttatttgggcccgaaaatatcaagagacccgtctaattctatttaaacttataaatcttaagtcttgaacagactgagcttattatggggctcccaactgaaaatttccaaatcagcatttggccgacaaaaatcagcattttaaaattttattataaatgaaaaaaataaattaaaaaaattttattcgggctttttaaaatttttttttttgaaaatatagggccggtggcgtcgggaggcgccgcgaagataaaatttgttatgattgttaacagaatttgtccaaaaatggccatttctctgtattttgggacagaaaagggatttttggtccgcattaaaaaatttttgcaccaaaaaaagatcaatgaggattttcaggctaggttttaaaatgtaaagaaatattctaattgtttatttatttttggtggtaataaaatttcaattaattaaattttgaaaaaataatgttttgctttaggaaaatttacaaaattaataataatgaaattttgttaagtgtgtggcgatcgaatccgggcagaaaatgaagaaagattgatgctttaaccagttgaccatatatgtatgtttcacactgtagattgatcaaattattatttttatttaaattttccttttcataatttttctgttcgattaaataattttttttattattattattaaattaacgtaaattaaaaattattcttcaaattatctaattttttactttcgggttttatgtatgtctagtgtaaggcctctgacttataaatctacatataagacatgtcgtatctgagataggatccgaattgaaataggccccaacagggaaaagtaaaactttttttagatttattttaaattttcccgtaaaaatttattcatatttttttactctttaaattgttttaatgtgctcaactaccccaagcgtttttctcgtcctatttttatccagtaattccttgaaatttgactcaaattaagccaaagctgctgccgattccatgctttatgtatggggacacaaaaactaagcgccaaatttgtggtcgctgactttattaatcaatttactaaaaatgttggctactatttttttttaaacatttatttcttattttagctttcctaacaaaaagactaatttctgcgcttttctattttcattggaaaacttctgtcaaatgcagcattttctggtgtaaaatctgccaatttacacgcgcaaataaggcacaaaaatggcttttggcacttttgaaagaaatgttataatttgaccatttaaaatccctcatggccatacttatataaattctaaataataaa

SEQ ID NO: 59301 - DNA, 577 bp, Heterodera glycines
  Genomic contig location: Contig_ID=SeqID_5808; Location=3654..4230; Strand=-
  SCN-specific regions: Sequence locations=1-26,67-141,163-311,334 -420,450-577
atggaaaaatacacagctatcgattcgatcccgaaaagttttaaaaatcaaaaatacacagaaaatcaatcgataaaggaaacaattattggtaacaatgaaaattataaacaacaaaatgctaaggaaataattataaagtctgaaaattacatagaaaaagaaaatgaagacctaaagccaataattaagcaagaaattaaaacagaaccattggaggaacaaaagaattatttaaaaacaacactcaaagtgccaaaaattgaattcgaccaattgagcgaaagatcatttgaaaatgagattaatgatattgatgagcagtttgatcaaaatgctccgtattctgatcagagtatttttgaaattgatgaggattacaatgatacggtaatatacgataggacttccacaagctcgaataaataattattattttttaatttaatgggtccttataatatttgaggtagaaaaaagaaaaggaaaggaaaaaatgggcgctgatcgaaatacaatttgtaaattgaagaaaaaattaggacaaaacagaagtgcactgtacttaaggacataa

SEQ ID NO: 59302 - DNA, 492 bp, Heterodera glycines
  Genomic contig location: Contig_ID=SeqID_5809; Location=285..776; Strand=+
  SCN-specific regions: Sequence locations=1-137,166-239,261-492
atggaaaatgtcaaagacccacgggaaagaacactttcgccagaacaaagagcgaaaaagcagatgatttggctgaaaaatgtgctgtttatgagccctgatcaaatcaaagtttgtcattaaccaattaattacccaattaaataaatatttttaaattaaattcaggataacagaagcacaactttggtgaaagacttggtgtggttcgtcggtttgctgctctacagaatgttgttcaacaacaaacaccccatggacaattgggagccaaagcgccgtttggacatggaatttatggcaaagatgggcttctcagggtcagattatttctacatgtacaaaagagatgattttgtgccgggagactttcgcatctttccgttgaagccaaaaagtcggtggatttggatgccggagaatgggcgagacgaaactggggaaatggcactggtggaggaacgaattggcatggaacaggtggccaattaa

SEQ ID NO: 59303 - DNA, 515 bp, Heterodera glycines
  Genomic contig location: Contig_ID=SeqID_28724; Location=416..930; Strand=+
  SCN-specific regions: Sequence locations=1-111,213-296,319-515
atgggcaaaaaaatggagaaaatttggataaacaaaatgttgaaaaggaaaagcataatgactggtcaaaaatgtgcaaagtaaatcaaacggaagaagaaaatgaaaggcaaaaaatgattaaataaatattaatcaattaataggaaaaaatttaatttaatttaaaaatataacaaaattttttaatgaattattttaatattaaatttgaaggcttttcccaagagattttgacaaatatttattcgccacttggggcggactttgtggcggaattggaaatcagatggtactctaaacaaacacttattaattaattaatgatggccgtttagtggcgttttgcttctttgtatggcattggaaaaccgtacgggcgaaagccaatttttaaggaagaccaaaaatgcgaaaaagcacatggagcgcacgaaacggaaggagagaatgaaatcgaaaaactctttcctgtctatgccagccaaatcaaatacattgtaaaaacaaattaa

SEQ ID NO: 59304 - DNA, 752 bp, Heterodera glycines
  Genomic contig location: Contig_ID=SeqID_28725; Location=10..761; Strand=+
  SCN-specific regions: Sequence locations=1-518,542-752
atgcatgaaggccttgcgaatgtttgtctgatcggttcttcaatgaccgtggtgaagtccaaaattgacatgcaggttggtcggaacgggatttatttaattgtctttttagtaattaaaaattgtttgtttttttcagatcgctcgcaaacggaagggactgtcctcgcaacatgacaaaagtttggtcgcctttatgaatgcaatttgtgccgcatttgttcggcacgtgaacatcgaagtgactttcccccccccccatctctttttcactgccaaaatctctcaccgattttcagctgatcaaatgcgttgttgtcgatagtccgggattccttcgcgatcagttcatcgagtttttctggcagtacatcgaacgcgaagggctaaagcagcagttcgccccgcacagaggtaaatttgtgctcgtccattcgtcaagcggcttcaaacacgcgctaaaagaagcactttcggacgccactgtcagccaacggcttagcgatacgaaggcactgatttttggaaaaatggcattttccaatgttaggtcattttaggcacaggccgaagttaaggcattgaacacgttcatggagctgatgtgcaccgacccacagaaggccatctactggtacagacacgtggtgcacgcacgcgaacaacagtccatcgacactttgatggtgtccgactcgttgttcaggcaggcgaatgaatttggcatggaaataattggcagaaacatttaa

SEQ ID NO: 59305 - DNA, 951 bp, Heterodera glycines
  misc_feature (78)..(78): n is a, c, g, or t
  Genomic contig location: Contig_ID=SeqID_28726; Location=537..1487; Strand=-
  SCN-specific regions: Sequence locations=1-360,418-630,652-674,708-951
atcgatgaagaacgcagccaactgcgataattagtgcgacctttagaaaccttgaacacaaaacattcgaatgcacanttgcgccattaggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttggcctgctagcctccagactggggtttgctgtccttctgttcagtggcgaatggggcatttgcaggcggagtgcgctgagatgctcggagtagctgcgtgagctcggtcttgaggccagcctttcggggtctggtaccc

SEQ ID NO: 59306 - DNA, 1582 bp, Heterodera glycines
  Genomic contig location: Contig_ID=SeqID_28731; Location=125..1706; Strand=+
  SCN-specific regions: Sequence locations=1-223,245-322,353-545,567 -736,793-968,1000-1130,1178-1487,1529-1549,1572-1582
  Gene Ontology: Mol. function=ubiquitin-specific protease activity; Cellular component=nucleus; Biological process=pathogenesis
atggaagaaaggttcggcgtgtttcagcactatttcgatctaaagttaagtgatgcccctgggctttttccatcgaaatttcccacgcaccgacggaacaaaaacgaaggcacaattgagatggaaattgaaaaagtgtccgaatttgcggtggaggaggtgggaagtcgccgatttagcgatgccatggacattgggggaatgccatggaaaataatggcagaaatcgaaacgaaaaacgaaagcaatgagaaatggttgggcttttacctttccgacgatggccttgaaaatggtaaaaaaaagtctttttcataaatctgtcagggaaaaacaaaaatatattattttttactcattgctttaagcggaggaatacatttactaaattcttttttccagaggtttttaaatattatttaaatcattcgaactaaataaacgattatgtagacaattttctacaaaaatagaaattcaaaaattgaaaatgtaggtgaaaagtaccctttcaacttaaataagtaccggatttaatgataatggtaattttattgaatatttatttattgtgcagaatattggacttgtaaaagttcggcaaaacttcgaattgtttcacaaaagaatggcacggaggatttaattggaagaattggtgattacatttttaataaggaagggagcagttatggtggatttcctaatttcattagttttgcggtgagtgggattcaaataaatttaataaacttcatattttgaaattaaaatttttaaaattttaaaaaagaaagtgacaaaaaatagaattttttgaaattttttggttataactctttgtaaatttttttctagattttaaaaaattaaataagataggatttgataggatatgtaatgcatcgtttaataccaatttttattaatttaactaaatttaagctaagttatgctttcttattagcaataaaattaaaactaataataaatttaaatgtttctatcattgacacttttgtaactttggctcaccatgattttatattacataattgatttaaaattaaagttataatcggaaacattgctgattttcatgttaaaaaattaattacaatatttgtcaaatttttgtattgcaaaataaatcactaaaaattaaggaattgttggatccgggcaaaggattttacatcaaagatgaggacaaagtcacattggccattgatgtcattgtggatgagccaaaaactgagaaaagcatttccgatccaaacaaatccaacggcacactttcgacggaaattgaaaaactatcggaatttgcacgagaaatcgtttggagtgaacgtaaaagtgaaactgtgtacataaagagaatgccatggaaaatattggcaaaaattagaaagaaaaatgaaagcactgagaaatggttgggctttttacttttgtgcgatgcttctaaaaaaggtttggttatcaaattattaatagaaataaaaattattttttctataaaattggtgtaattaattattgaaaaaacttatgtaaacagtaattttttaacataaaa

SEQ ID NO: 59307 - DNA, 815 bp, Heterodera glycines
  Genomic contig location: Contig_ID=SeqID_5810; Location=86..900; Strand=-
  SCN-specific regions: Sequence locations=1-28,51-429,467-584,606 -619,665-815
atgaatactaccaaaaagtcagaatttttgcatatttttacttataacttttttatatgtcggtatatccttgtggtttttgggaagccgatagagcttattaagagctttcgaatgatacaattattgttggatttggtcaacaaagaaaagagttatgatgctctaaacttggttcagaataaaccggccagactaaactgtcccagtccggtacgaaagattgcgaaatatatacgaaaaaagtccaaaatatgtataaaaatatgtacatatgtaatatgtagaaaaacccaaaatatataccaaatatgtaaataaaggtcccaacttttgttcgcaaaaacaaaaaataaagtgattttcctactattcaaagcatgtagaaaccagaaaaaaatatgtatttacataaaaaacaatccctagtaataattatataattttttataatatttttatttttgggatttttctctccgttgtttgcactacattgatcgaaatatcaatgctttgatcaaatcagaatcctttttgcaaattgatcaaaatttgttgtgtgaaattctcaaaagagatgagctgagaagcagtgaaatcgaaatttggaatgcggtaaattaaatattataaattacaattatttattttctaaaattaaggcactccgttggtccgacgaacagtgccgtcaaaaaggcatcgaatgttcggctgaaaatcgaggcaaaattcttgacccaatattgtccaacattcgttttccactcataccaaaagaggattttacaaaaagcgttggtaataaataa

SEQ ID NO: 59308 - DNA, 780 bp, Heterodera glycines
  Genomic contig location: Contig_ID=SeqID_5811; Location=95..874; Strand=+
  SCN-specific regions: Sequence locations=1-238,264-317,364-548,571-780
atggactcgaacaagagcttttacaacaaagcagaggacaaattggcattggccattgatgtcataactgttgatgagccaaaaatggagaaattcatttccgatcccaacaaatccaacggcacactttcaatggaaattgaaaaagtgtcggaatttgcgcgagaaatcttttggagtgaacgtaaaagcgaaactgtgcacatcaaaggatttccatggaaagtatgggcacgaaaaagaggggaaattggaagcactgacactgcgaaatggttgagcatttatctattgtgtgatgctactgaaaaaggtgcaaaattactaataattaatatatatattaaaaacaattaattaattgatattgagcagaaaattggagttgcaaatgctcgggaaatgttcgaattgtctcacaaaagaacggagtgttggacgaattcgttgaccttatttttgacaataagaccatgttgcaatgtgtcgctatcatttcttttgctgtgagtgacaattaaactttcccttaattgacccaattatggaaaattaaggaattgttggactcgagcaaaggattgtatgacaaaaaagaggacaaagtgacattggccattgatgtcacagtgaaagaagcaaaaacggaggacgaaacataaatgcccaatatgatctggcaaaaatctcatcattgaattatcatcctatggacctgctgtgtttagcttctttcttattgtttatcttttgggttttacaatattgatttatggatta

SEQ ID NO: 59309 - DNA, 1616 bp, Heterodera glycines
  Genomic contig location: Contig_ID=SeqID_5812; Location=1384..2999; Strand=+
  SCN-specific regions: Sequence locations=1-366,398-402,424-874,898 -1463,1487-1616
atggccgatgaaattcaacaaaaaattgttcagggaattggtccggattttttttctgtgacctctgatggatggtcgcaaattacaaaatcacccgcactcttaaggttctctattccttttcatagtttataaaaacagactttagtgttactgtacaccatataaatcaacaatttgtacacgccgattttgtacttgatgtgattccaatgacaaatcacacaggagttgacatagcggaagaaattggaaacgctcttcggacaaatggattaaacccagaaaaaattatttgtttggttcgtgacaacgcaaaaaacatgataagggccacaaatattttgaacttgaataggttttacctaatttttgttttttataattatttttttaagctttcaatgtgtgtgccattttcttcatcttgttatgggagacgtattgggactgtctgagttggcaggactcatttccaaaattcggtcttgggttactttttttcgtacaagtaaaggcctgtccttgctccgcgactatcaagaaaagacaaattctaagccaaaaaaactcacaatggtttcataaattattgttttcacaattattcttttaaattaaggcctgcccgacccggtggaactcgacctttgaaatgatgatggcatttcgtgaacaaaaaaacgttcttttaactattgaaggagaaagacgaggatttggtgttggctcatcaaaaaagtcgcgcctagatattgtccctgaaaatttaccaaatttggaaattaacgactttgattttttgcgcgaactgtgccctttattggaaattaatcatcgagagactttaaaagcaagtgaaatatgttaaaactaaaacaattgtaaacaatttcagttttctaatgaaaaatcgtcagcatcaaccgttatttcgactataaaaagattgcgtgattttttgcaagaaaaaactttctcaaatcgcattttgggcgtttctagggtcatagtggagtctttaaatgaacgagttcgtgaactttgcagcaacccactgttgcgagtcgcaatgctacttgatcctcgatttgcttacacagaactgttttctcagcaaaattggagggttgtcgaacagcaattaatcgaatttgcaaaagagagttggttgaattattagaatatttggtaattaaaatatgaatccctttagaattggtctgcccaacaatagaaatggacgataattttgatgtgaacaactttggtcaggttgaatcaggaattgaccgttgctgatcaagaattgagtccaagcagcaacgagagcatagagaaatgtattgacgattgcatcacataaatcggagtaggacaaaacgtcgtcagccgaaacgtcgtcgaacgaatttttcgaccataacttttttctttctcaaccaaattaaacatataaatactttattttctttttagatgatatctgggcccaaccaaaatcaccatgtggtatttctattccctcaacaatttccggagatcatgactctgattttttatcaaaaattgaggctgaacttgcttgttataaggcaggccaaaggatggagtga

SEQ ID NO: 59310 - DNA, 269 bp, Heterodera glycines
  Genomic contig location: Contig_ID=SeqID_28734; Location=571..839; Strand=-
  SCN-specific regions: Sequence locations=1-103,125-247
cctcaacgggttctgctgttgttgctgctagtacggtttgctaaacaaattcggggtcgattcgcctcctcttttagagtctcgcctcgctttgttccatcggttgctccttctcccctattccgtccccgggcaaaaatcgcccttttatcagctccaaattgcttctgtagaattcagtcacgaattgcgacatgtgtacagtgccctcaatttgtattggcgtaatttgcggagtatcgccgggctaatataaaaagaaaatgaaa

SEQ ID NO: 59311 - DNA, 296 bp, Heterodera glycines
  Genomic contig location: Contig_ID=SeqID_28734; Location=1221..1516; Strand=-
  SCN-specific regions: Sequence locations=1-296
atggtggccatcatcgctttctccagcattttcggtttcacccgcgcgatgggaacgatggaaggccgacggagggaagtgacgaaacaatcgcaaaactcagcggcagagggtaaagccaacggaggagacgcattcgccacaaatcggacatttcagaagcccttgaaagagaccgatggctaacccactttttcatcgtccttctgatcggcgaaatacttctgatgctaacgatcgcatgcatacgctgtaatttgaagttcctaaaacagtgctttcgactcgacccctaa

SEQ ID NO: 59312 - DNA, 484 bp, Heterodera glycines
  Genomic contig location: Contig_ID=SeqID_28737; Location=626..1109; Strand=+
  SCN-specific regions: Sequence locations=1-106,154-255,277-410,433 -440,465-484
atgccgggttccgggccgggttgcattttcaaaaacgaccgggttccgggcccggcctctcaaaacccggtcaacccggatttccccaaaaatcgccgggccgggttgccgggcccgggaaaacccggtaccgggcccggcccggtccggtctctacttactattacctgttttagttctcgaatatatttggtttgaaaatattgagattgatgccagtgacagtctcaggattagaaacacttaattcgctgaatgtttatgaaaatatgtattaatttttaaaacagaattcaggcaaaaaagtcgcgaagacaattaaaaaaagggagaaaaaggaactgaagaaattggaaaacctgaagatgaaggaaatgaagaaaaagcagaaacggagaccttagttgttgagcacagattcggaggaggagaataagcgaagaaaaaagacgggaaaaagggagaaaagtcactgaaaattata

SEQ ID NO: 59313 - DNA, 382 bp, Heterodera glycines
  Genomic contig location: Contig_ID=SeqID_28738; Location=893..1274; Strand=+
  SCN-specific regions: Sequence locations=1-54,79-162,203-251,322-382
atggacaatccgtcagtggacaatccgtcagtggtcaatccgtcagtggacaatccagcagtgaaggacaatccgtcagtaatggacaatccgtcagtggataattcgtcagtggacaatccgtcagcaaattttttttgagcaatgatcaaaaaccttgcgaaaataattgttaaatataataaatataaatttttttatagcttcttaacatttctagttacttcatgcttcaattaattgccatatcgaaaataatcaattaattcttttttaaaatgattattcgtaattttttttaaataacacaaattattaattcaggattttagcgacttaaattaattttcacatgattacaaatagagatgggtgttttaaa

SEQ ID NO: 59314 - DNA, 95 bp, Heterodera glycines
  Genomic contig location: Contig_ID=SeqID_28738; Location=830..924; Strand=-
  SCN-specific regions: Sequence locations=1-95
actgacggattgtccactgacggattgtccattactgatggattgtccactgacggattgaccactgacggattgtccaccgacggattgtccgg

SEQ ID NO: 59315 - DNA, 136 bp, Heterodera glycines
  Genomic contig location: Contig_ID=SeqID_28739; Location=46..181; Strand=-
  SCN-specific regions: Sequence locations=1-136
atgtataaaaaattatttactggtgcagcaagtattcagtattctgtccttagatgacaaaataaacaattctgaatttttaggtgagtttttaggatcaatttgtgtaatcttattggaattttaaaaaaataaa

SEQ ID NO: 59316 - DNA, 661 bp, Heterodera glycines
  Genomic contig location: Contig_ID=SeqID_28740; Location=154..814; Strand=-
  SCN-specific regions: Sequence locations=1-661
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttt

SEQ ID NO: 59317 - DNA, 264 bp, Heterodera glycines
  Genomic contig location: Contig_ID=SeqID_28740; Location=877..1140; Strand=+
  SCN-specific regions: Sequence locations=1-264
ccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaaggattcggtctccccataaatctgggcgcatcgggttcgggggggactgccccg

SEQ ID NO: 59318 - DNA, 1385 bp, Heterodera glycines
  misc_feature (1313)..(1313): n is a, c, g, or t
  Genomic contig location: Contig_ID=SeqID_28741; Location=141..1525; Strand=-
  SCN-specific regions: Sequence locations=1-91,114-185,207-1000,1035 -1117,1153-1385
  Gene Ontology: Biological process=regulation of protein activity, epigenetic
atgcggcacggcacaacttttttccaacaattgcttttgtgtgctatttccgtcgttggcattttccgggcccaatctatggactttcggcaccagcaacagcaacaaccacagatgagaaaccagcagccttccgctggaggcattgttggagttggcacattgcctgcggcagacccggcggcacaacgccaacaacaacaacatcgacagccaaatttgaaaaacccttacgacccaatgttgttgccactgtatggccatcaacagaatcagcagcagcaaaatgctcatggcatcatcaacaaccgcaacaatggcacatggagtgccattgggagcggcacatttggtcaaatggcaccggctgatgccagccaaaacgtaacaacaatggcatttgggcagcagcagcagcagcgaatgtttggtgccggtgggtcggcagagactggtggcggtggcgttggccatggtcatgggtctgtccaagtgcaggtgggctttcaacagtgaagataatccgagtcgaggttctcggtccaggcggccggaccgagaaatttaggatatttcttttgttttcgagtcatggaaatttttcgaccctcgagatttctaaatttatggcggattaaatttttgaaaaagtaataatttgaaaattcaaataaaaaaatgttaacgcggcgttggaaaattctgaaacttattttcagcccctgctttcacctgcttggcttttcaggtccaactccgctcatacgctaaccccggatttcggctgcccgactcgcgtctgtgcacatgcccggcgggcaatgagcgttgcttacatgcgagcccacaacgcaacggctacaactgtctgacgtcattggctgtgtttgtgctgtcggcagagtaaggccataaagtgcagggctcattaggggtaattaacgcctacttgggcaattaatgaatttaggcttgcttattccaagcaaattaatacattaactctggtgattaaaataaattaataaatccatggcacgggctcatttattttgattagtcggaagtgctaaatcctaattacctaattaaatttgccgcacatacgcagtaatacaaatttactattattaataattgtttttttaattagttttcgtttttcggtttgcaatttttcctaattgcctggggcattgttttcagtgacaccattcatttcgaggaaacgccgtactttccgctgaacccggctggacagcttggacaacagcaggagtttggcactccattgcgcttccatctgaactctngaaccggtgggcaacacgtattcaagactttctcgacttaatttttcaaaacagaaaatttttttaaataaa

SEQ ID NO: 59319 - DNA, 1993 bp, Heterodera glycines
  Genomic contig location: Contig_ID=SeqID_5814; Location=932..2924; Strand=-
  SCN-specific regions: Sequence locations=1-165,187-210,234-590,612 -1119,1141-1298,1322-1351,1376-1429,1454-1551,1583-1620,1642 -1722,1745-1792,1814-1831,1853-1993
  Gene Ontology: Mol. function=calcium-dependent cell adhesion molecule activity; Cellular component=integral to membrane; Biological process= gametogenesis
ttggaccgagagtctcggtcggagttcattttgaccgttttggccgaagacggcggagaaccgccaaaaaatgcgtcccttagggtaaaaatttaaaaacgaaatgttttaaatttaaaaatttcagataaaaattcacgtcaaagacatcaacgacaattcgccttttttcccacaaatgctttatcgaattgaacttgaggaggacacggtccgcttccgctgcttctctttttgctaattagtcctaattaagccccgcggccattcgctgctttccctgcgggcaaatgacgcggacgaaaacgactcgcagaagctttcctatcgaatcgggcgacaaacgccggcggcgagcgatttgttcgcattgaccaaaatgggggcagaacaggcagcgaattgacatattttaaattagttttgttttttaattgttttcatttttaagggcgccgtcctttccctggcgcgcgaattttcgccaaaagacgaggaatttttgttggaaattttggccaccgacgaagacggactgagcggacaatgcaatgtgtccataaaagtgaaggtgggcacttttaaacatacaaatccaagagggatttatttattgtaaatccgcaggatgtcaaccgaccccctcaatttgtcccccaccaatttttgctgcgaatcgccgaaaatgcgcccatcggagcgccggtgaccaaaatggaagcgacggacgaagacagaggggagaacgcacagctcaaatacacaatgaattcgacggaatttgggtgtgaaagttgaaagccaaactcaaaataaatcccaagatttccaatttcagaattgaccctctgaacggaatggtcaccgtccgcgcgcagttggaccgcgagcggaaggcggtgtacgcggtggaagtgcgggcggaggacgcgggcaatccgccgctgagtgtggggacgacgctggaaattgagctggacgacggtgggcgaattgggggggggggggagaaacgacgagcaaatcgagacgaacactcagtcccggcttggaccccgtttattgatgcattttaaattttaaatgcttttccgtttgtcaaaatgacatatgtcccctcctcctccccaaattcacagtcggatgggcaaatttggagggcatctcccctttactgccccccccccccgtctttcgctttgccttttgtctctctctctgtgccattttattcattcatcggttacttttgaatgggagcagcgaagcattgacaaattggtcatgaatcggtaattactccatgaaaaatattttttggttcaaattccaattaaatatgaaaattcactaaattttttaatttatttattttcatttcattttattgtctcccattaatttttctctttttttttgcatatttggggtaaattaaaaagagaaattaagtgccaatgccaacaaattttagtgggaaaataagaagcaactaaaaatgaaaaaaattgtggaaaagggaggcaatacggaataaatgagctgtgaattaggaggagaaaagaagaaaaatgaaaataatatttccgaatttaaatggataataataaaataatatgttccaatttcagtgaatgacaatgtcccccgctttttgtcctcggaatatcgcgcgacaatccctgaggacatttcggtgcccatttttttacctttttgccatttcttagccattttggtttaggtcggcacttcatttttgcaagtgaacgcggaagacccggacgaaggcatttttatttgtttttaaagctacaaatattttggaattattccattccaatttttcctcatttaaggtgctaatggccaaattgaccatttgttggactccgacgacccttccgttcgcttgggccttttccgattggaccgaacttccggcactctccgcgtcaaccaaccgttggacagggaaaacgtgtcaaagtag

SEQ ID NO: 59320 - DNA, 736 bp, Heterodera glycines
  Genomic contig location: Contig_ID=SeqID_5817; Location=316..1051; Strand=+
  SCN-specific regions: Sequence locations=1-244,316-355,378-408,430 -677,699-736
atgagacaatcgaaaaagaagaactttaaatttgcaattgttttttgggccattttattttttttggcactaatcgaaaaatcaaacggaggaaaagccaaaaaagtggcgaagcaaaagcaacaaaatgtgaaaaaaagcgaacgatcggcggagggaaaagcggcggcggacagtgaaacagtcgcggagaacagaaaatgtccggaaaaaggcgaaatggcagaaaattttatgggtgagcaaaaaaaaaaaagaaaaataatttcaaaataattttaaaaaataataaaaataatttaaaatgaaataattgtaagtcacgtcagcagcagatgaagacagcatcgaattgattggacaattcaaaaaatttattatcggcgaataccgcggaacactttcggcacaatttgagctaaaattccaagaaaattcgctgatttggcatttcacgcaaaaaatttccgagctcctaagcgccgacaccagtcaatttagtggaaattcggtggacgaattggaggcaaaaattgaacactttcgaaataaatgggcacaattaaaaaagtatcaaaagaatgccgacagaatgtttgtcttttgcatactgtacaaatacagtacggaaatgatcagagaaacggccgatttgaaaatcaacgattgggaccaatttctaaaggggaacagactgagagaacagattttggtcagtgatttgagaagggtgtga

SEQ ID NO: 59321 - DNA, 612 bp, Heterodera glycines
  Genomic contig location: Contig_ID=SeqID_28742; Location=580..1191; Strand=-
  SCN-specific regions: Sequence locations=1-400,445-448,470-584,611-612
atgcttaaggcctggattttctcccagacgaaattcccgggcgatcaggatttgaaaattcggaccgtcaattctgcagttgtctctacgagtaatcgagccgattctcgtatgaacccgacggttgttgtggccccgaatgttaccgcaagagatcgagtcgatccttgtcggattggaccgttcccgccccaaaatcgccgtggcacttcgactcgccatcatccgtatgctggacaatggcgcaacaccaatcgctatggaccgccgatgaatcgtcgttccgatccgtccgactctcgcccttttcgccgttgactgctcgtggacccacctttcgatggacgagtgatgtttttgaggcgaggacgcctctcgagattgttcgggggtgttggagattttaatttaattaagatatttgttttaatttaaaattattatggcattttatctctatttattttatgtttgttgacctctttaatttatgtttggtacattttttttcacttctcattattctcattaatttgttttccaaaatttcctctctaaatttcgttctcaatttgcttcacattggtgatctcctcggacttcaaaaataaa

SEQ ID NO: 59322 - DNA, 49 bp, Heterodera glycines; identical to SEQ ID NO: 51181
  Genomic contig location: Contig_ID=SeqID_28743; Location=559..607; Strand=-
  SCN-specific regions: Sequence locations=1-49

SEQ ID NO: 59323 - DNA, 1221 bp, Heterodera glycines
  Genomic contig location: Contig_ID=SeqID_28745; Location=40..1260; Strand=-
  SCN-specific regions: Sequence locations=1-38,67-235,270-513,535 -643,672-828,850-1221
atggaaactgctgaagatggatgcacaaaacgggcccaaaatgagaaaaaattgttgttttatgatctcatcgtgggtttttgcagatttcctaaaaatcctaccaaaaaaattccgaaaagaaaatctggaaaagaaaaaaatctttactgggcgccaaaaatggcataaagtcaaaaaataataattgaagaccagcaaaaatagttatcagcaaaaatagttaaactaattcatttaaaatatatttttattaaatttcatatttagttttaacaaccaacaaaagttacgtggcagttataatttgatggcttgaaaattcagttcattaagaattttgtttattcagtctgattaacggattcattaagcactaacagacacattggtaataaatgggcaattgtttaaataaattttaagttttttgatgaaatttatgcctggcatttacagctaagcaaatttaagtgattgaaaaagttcaaaatttgcatctataaaatcagcaatgaaagaaccaattagcacattttgaaattggcatttagaaaccagtaaacaaaatgcgaacccaaagcattttctcaattttcttccttctgctaatttgtgaaatgatcaactcattcccagtacgttttttaaaattaaaaaaataatattaagtttgggttttaattaatttttaagcagtttataccaaatcacattttggctttgaatggccaaaaatgttttgcctgcctggttttgaggatacgtgcccttttttctcggtttctcgggtttttgcctggtttgttattttcatcgttttgctatttttcattcggtttgtcagattatgaaaatgtttgcccggtatttgagcgcgtctagcaagtttttgagatttggtgatataaaccgttttttgtgagaataacgggtccccttaaaaattcattagaacctaattttcccccatatttaatttcttctgaaatgaaaatgcacaaaaaatgatacaaaaagggctaaatattttagccatgcaaagccaaattatgaaaattatctcattttatcaaaagctacatcaataattagtagatgcatgcgtttagaatataagtattgtgcttaagtgtaaaattaatttatttcagtcaaagtcgagtgaaagcggcgaaccgcctgctaatggagcagaagtcgcgcaaatccgaaagaaac

SEQ ID NO: 59324 - DNA, 546 bp, Heterodera glycines
  Genomic contig location: Contig_ID=SeqID_28746; Location=125..670; Strand=+
  SCN-specific regions: Sequence locations=1-269,309-449,471-488
atggtgcagcttccatgccatgttcgtgtccactttatcaaaaatatgaataaacaaattttgtttggcccttttttgtcaacagaaaaagcattattgaaaaatttgatgaatttggtaggtttttgtttctctttgtttaccattttcaattttgcttcgagaccggggttctcaagcattaaaaactttatgaggatttaagagtattagttttccattccgtactattttagtaaatacggtaggtaatttacaattcgatgaacaatatttaaatttatatatatttagtgtttttttaattaggacatgaggatgactcatgctgggtccattctgagtggatggatgcgcaagaaatgatggccaatttcattgagcaacattcggtcggttcagttctctcggcatttgctggtcatcatgtgccacaacatattgcaaatttgctcaatgagaatgaagaatccacgcagggtcaaatctttaaaattaatatttagtttattaaaatttgacattttacttttaatataaaaaaaa

SEQ ID NO: 59325 - DNA, 176 bp, Heterodera glycines
  Genomic contig location: Contig_ID=SeqID_28748; Location=1167..1342; Strand=-
  SCN-specific regions: Sequence locations=1-176
aactgacacttttttgagagctgattaatcactgagaaatagcttataaatatcttctaaacatctagggctttcgaatgataccatgattgtgaagtttggccaacaaagaaaaaagttatagctttttgaacattgctgagacggagttggccagacggagttgacccctaccg

SEQ ID NO: 59326 - DNA, 49 bp, Heterodera glycines; identical to SEQ ID NO: 51181
  Genomic contig location: Contig_ID=SeqID_28749; Location=440..488; Strand=-
  SCN-specific regions: Sequence locations=1-49

SEQ ID NO: 59327 - DNA, 4042 bp, Heterodera glycines
  Genomic contig location: Contig_ID=SeqID_5819; Location=346..4387; Strand=+
  SCN-specific regions: Sequence locations=1-162,184-273,295-514,537 -580,607-847,878-906,929-1341,1368-1868,1890-2257,2281-2473,2496 -2601,2643-2714,2750-2906,2941-2974,2996-2997,3232-3499,3521 -3524,3546-3784,3806-3918,3941-3972,4009-4042
cttaagccgtgccgaggacgggtcagagtcgtcgtcaacaaaaagtggtggtgactcatccttgccgtccccgccggcgcttgaccacgagaccaccattggttgcacattgtgccaacataaacagcaacaacatcaatccgtcgccggacaaggccgtgccagcagtgaagaaacactgaagcgcggggacagccgactgaccgtgccgagagtgagtaataatgccgtgggaagagggaggacccctcaggggatggatgacacgatttggggattttccaatggcatcgttttgctcaataagtgccaataaatacgttgactaatcttttgttatgctaagacaggggtagagccgtgcgtgcacctgagcaagatttctggtaattagtgacacaattaatggaaatatggcaaatttttgaaatttttggaatttcatttgaaaattgcgcaaatttttaattcttcaaaaaagggatgctgtttaaggattagatattggggtcttttttaaaagcttcttaaaatttggtgagcttctgatcgtttctagaataactgtgggtaattagtcaaattataaaaaataattattaaattcctgttaaattttgctaaaatttctgaattttgctccacggcgggaatcgcgtcgactctctctcggacgccaatttggaaatttttttttctcatccctatcaacagcgtattgagaaaaccgcaacccgagatactaatgtattaaaactctaaaaaaaaatacgcaaaacccagaagttaaggggtatcgaaaaatttctattaaaatttgacgtctcattgttagccccttctcttcaaattttcaaaaaattttcaaaaattttacagggctcagcgtcctcttctcagccttccccatccccaacaacagcacgttacacggaaacaattattcacagacaaactgcgacagcagctgtacagcaacagtttgtcgaggtgaacaggcagctgaacaccgttgtggcgacgacaaaaggcggcggcacgtgttgccaatgcgaggtgaattgtgtgataagtgtcggataattatcatggcacaatattggaccaaaagttttggcattttaatcaatgttacagcattgatcagagatgttaatgctttttccaattctactaatgaatatagcaaaaaaaaaaaatatcttttgggtcaatttagagatgaatcattatggctttggcatttcaatgcttttcctttttcattatggacttaggcatttataactctttttcgaattttctcggcacaaaaaaatcccacttttaattgccgttttaattgctttctaaaatttgccaaggaatgtgtgctggcgtgccgtcgtgagcagcaacaactgcagcacgagcaacagcaacaacttgccggcccgtccggaagcggcgccgggcgatcgtccggcaccggcgttgccagcggtgcgctgagcattgcactggcaaacgcgcaacttggcaccgccagcagcggtccgaccacgtcgagcagtgcgggcagcggtggcacaacgcagcagcaacaccaccatcatcagcagcaacaagcgcaacacatgatgatgtactgcaacagcactggtgccggaccatcgccgctgatcagcaccaatgcgcagaccattgaggaacagatcaagcagattgaccgcatttccaaggtgggctgggctgcttgctgctgatcgaagtgatcacacatatctttaatgctctgctggaatcttactggatttctgtaatccagtttcttggatatataaaattggacagccattaaagtgatcaattattgtaagaattaaatgaaaggggacatttgtccaaacaaaaatcaacggtcattttgctgttttttgatcagaattggctcaataagtcctgttttttttctcaatactgatgtgatcagtcttgaaaatttcggtaaagtacgatccagaaaaccattccatttaaagttcaagattaaaaaacaattttattatcaaattccattaaaatttccaaaaaatttcctcggcggcgcctattagcattgtcagacccgcattttatcatagtttattggtaattcaactcgaaaatggcaaaaatttagccattttttttttggcggaaaacggctaaaaatcccaaatttttcttcactactttttataaaaatttattgacagagttagcttttttttcttttaaaataaaagaggaaaaaattaagcagtcatttcgtgccaaatttgttaaattgcatcttcgcgtgaaacgagaaaattaaatttgtcaaaatgcaatttttcccccttttatttattgcacaaaaacaaattaagtcaattggcggtggcacccattgaaaaaaacaaaacaggaaaaatgcaatttgccctgagggcaaacgctaaatgccactaaaatgaaaaacatttatgaatgaaatttattgcctatttgagtgtattaaagaactaaaatagaaaatagaacaatattaaaaatccaaaatgaaataaaatttgttaatgaaatttcccaaaatatttgattaatttttaattaatggaaaaaccccaatttcttttgacaaaatgctaattttaaagtccactaattgcatttcaataaaaaaatatacattttttaaaactctaacgatttttattaattattaaaaaaataaatttattttggttttaatccatttaaggaatgtgataattcgcgcaaaactttggagcacatcaaccgtcggcttgacgatctgaacgacgaagtgcgacggtaccgcgaatttcttggccacgaaaaagtgaggccaaaaaatatattgacagaattgcagacactttgaaaacaaatggggagagagcctaattaactgattttgactaattaattagctattaattgagatttgtgaattaactaaaataattataattattaaaattattaattttaattaattaactaaaatattataatgatttaaatccgagttaattaatattcactttaattaattatttattaaataagttttattaattaactaaaataattgtaattatttaaatcctattcaattaattatttattttaattaatgatttgttaattaagatttattaataaccaaataatcatttaattattgatttgaaattattttaatgaatttttagtcataaaaactaaaattaattagccctaattaaaattggcttttaattttttgaaggcacgtcgtgatccgacactgtacaaaacaagcaccgcagaaccattaagctcgtacaatgacggcatttgtcggctaatcgactcattgacaacacaactcacaatggtgaggaaaaatgcggaggtccggctcgatttagttgaaattaaaaattctcgaactttccaaccgaataattcccgaaatttggtggcctgtgggcatttgattgaaatttcattttccaattatatttaaagcatgtgcacttagcattattttacatgaatcacaaatgtccctattttttcagattttacgctaaaaaatttcataaaataccaattttaccgcgacgatgcctaaataatagcatggaaattcatacaattgacatcttgtactacttttttaaattttcaatagaaaaattagcaaaattattttttagctttttctagaaaaaaaaaatcattctaattttgtggaaaaaaaattctgatttattaaaaaaaaattttacgaactgccattgattaatacgttaatttcccataaaaatttttaataattcgttttcaggaatggactgaaaaattgcgttccatacagaaccagacgattgccaaatcagtagctgaaaagggctgatcagagatgtaaaaacaaaaaaaattgacgaaaagaacaatcaactaattaattaattaattaagtaataattatgtgtattttatgggttgggaggccgcctcacaa

SEQ ID NO: 59328 - DNA, 504 bp, Heterodera glycines
  Genomic contig location: Contig_ID=SeqID_5819; Location=4489..4992; Strand=-
  SCN-specific regions: Sequence locations=1-95,118-159,225-279,301-460
atgaacgtggaaggcccaaccaaagacacagagtgttcccgaaaatgtgccaaagcatcgtttgccattggcacatccatcaaaaaacagctgagggacttgcggaggatgggctgtgccgcggcaaaaacacaatttgccgtaggtttcttagttctttttaattaaatttaatctaatttaattatttttttattaaaatttaaaattttcttaatttttaaggcattggaggattgcctaaagggcccagcacagtatttcaacgacataagccaaagaagcagcagcagaagtgccaacgacgacgacgagcaggacgaggaaatggcaaaaatgcgggcactgaagaagggcggaggagcagcagcaggaaaaatgaccaaaattctttgaaaattatacttttggcccataaaataattagggatggattaattatttgtattctttccatttgaaattaaaatttatttgtattttatattaaaatgtaaaaataaa

SEQ ID NO: 59329 - DNA, 409 bp, Heterodera glycines
  Genomic contig location: Contig_ID=SeqID_28754; Location=362..770; Strand=-
  SCN-specific regions: Sequence locations=1-409
atgcttccaaacaaatcagcaccccgcggagtgatttgcccgacacttcctcccatttgttgcgcaatgacactggactggcgtcagtgtgagcagcatcgaatcggtgaaggtaaattatggctaacaaacccaggaataaattcctaaagtagcgattttgatgaattttttaattgtaaatagaatgtcactaaaatttgaaacaaatccgctagagggcgactttgaacaacgtgttttcctaaacatgctcctgatttttttaaactaaaacaatactgcttctgtaattttaggtggtgtttacgtgccattccccggcggtgaacaatcgacgtgttcagaccgccaaaatcagtccgtcttcaccaactgttttgggaaccggaggacgggaaaattttga

SEQ ID NO: 59330 - DNA, 143 bp, Heterodera glycines
  Genomic contig location: Contig_ID=SeqID_28757; Location=773..915; Strand=+
  SCN-specific regions: Sequence locations=1-143
  Gene Ontology: Mol. function=zinc ion binding; Cellular component =nucleus; Biological process=regulation of transcription, DNA -dependent
atgggtaggaagaagaagaagccgcaaaagccatggtgttggtaagtcgaaatcaaattagttttgatgggcatcattccttttgtttaaggtattgcaaccgcgaatttgaggacgaaaaaatactcatccaacatcaaaag

SEQ ID NO: 59331 - DNA, 55 bp, Heterodera glycines
  Genomic contig location: Contig_ID=SeqID_28757; Location=78..132; Strand=-
  SCN-specific regions: Sequence locations=1-27,49-55
atggagagagaaagcgaaaagtgtccatttggtggtcaaaatgaaacaccaaagg

SEQ ID NO: 59332 - DNA, 1274 bp, Heterodera glycines
  Genomic contig location: Contig_ID=SeqID_28758; Location=30..1303; Strand=+
  SCN-specific regions: Sequence locations=1-47,75-172,213-297,329 -670,692-758,781-848,902-937,969-1053,1111-1190,1212-1274
atgacggcaagcggtggcgtcgcaaaattgggaggacggtaattagcaaaattaaattaatttttaataaatatgcattaatttgtggccaggcgtcaccgacggaggccctattcgtattacgggggaatgggcggcggtggtgcgagtccatttttggtgggttttcttgatttattttattttaaaaaaatatattttaaattttttatctctaatgattccatttgctcttgattttatcctggattcccctgggggtgtaaatttttttgagggagggtcgccggcgaagggaaaaaaattaatttaaaattcaaaaaattttcccggcggcgcctttcggcacctccgaatctcctcccccccccccctagttcaccaaaatttttttgaaaaaagcgcgccgcaaaaaaaggtttaaaagcaaaaatcgtttacattgccggaccccttcgcaaattggccggccacttaccctcgcccttcaattagaggctttaattagtcattaattttgtccctgattttgtgcccttctctcccctccatttgaactacccccaccaatttttaggcttcgtccgccggtggaggccaccgcggttggctgtgccgcgcgttgcactgccggaggttgaagtccgtgtgcttttttttgcttccattaaaccaattaattaatttaatgagtggcttaattaaccgtcataaaataggaagcggcggatgccacttagccaaaaaagcttttcaaattaataaaattactttaatataatcgatagtttaaaagctgcaaatacaatagaatagaatgcttattagcttttcctaatatagcatagaaaaattgattttaaaaaaattaaaataatttaataaaattaattttttttaaccattcacttcaaagcttcctaagaaaaagccaaacaattaaaatttataaaaaaacataaatttttctttttgttcagcccgtccaaaatcgacaggctttcccgctcatgtttccccattttgttcatcattttcaatttggtctattggtaaaaataaatttttttttaaatttaattataattatttattatgtttatatttttaggtccgctatgacaataatgagtcagcgcgagttggagaaggtcgaatttgtgccgttcaccagctgaccaaaatgccaccatttctttttctcattttctccacaattgctcactcatttttttttacatttttgtacattttgaagaattttatgatcaata

SEQ ID NO: 59333 - DNA, 336 bp, Heterodera glycines
  Genomic contig location: Contig_ID=SeqID_28761; Location=79..414; Strand=+
  SCN-specific regions: Sequence locations=1-336
atgaaatggatcaacggccaacgggacaaaaggccaaaatgcaatggatcaacgggcaatgggacaaaaggccaaaatgcaatggatcatcggccaatgggacaaaatacaatggaaacggccaatgggacaaaaggccaaaatgaaatggatcaacggccaataggacaaaaggccaaaatgcaatggatcaacggccaatgggacaaaaggccaaaatggaattggtcaacggccaatgggacaaaaggccaaaatgcaatggatcaacggcaaatgggacaaaaggccaaaaataacatggcaaaggccaatgtgacaaaaggccaaaaataa

SEQ ID NO: 59334 - DNA, 331 bp, Heterodera glycines
  Genomic contig location: Contig_ID=SeqID_28761; Location=627..957; Strand=+
  SCN-specific regions: Sequence locations=1-304,326-331
atgcaatggatcaacggccaatgggacaaaaggccaaaaagcaatggatcaacggccaatgggacaaaaggccgaaaagcaatggatcaacggccaacgggacaaaaggccaaaaagcaatggatcaacggccaatgggacaaaaggccaaaaagcaatggatcaacggccaatgggacaaaaggccaaaatgcaatggatcaacggccaatgggacaaaaggccaaaaagcaatggatcaacggccaatgggacaaaaggccaaaatgcaatggatcaaaggcaaataaagaataccaagaggattttgaaatttttattaattgagtta

SEQ ID NO: 59335 - DNA, 1588 bp, Heterodera glycines
  Genomic contig location: Contig_ID=SeqID_5821; Location=903..2490; Strand=+
  SCN-specific regions: Sequence locations=1-36,58-63,85-179,207 -335,358-561,587-834,861-1075,1097-1387,1488-1588
atgccccgacgactaccgaaagctgagaaatttgcgcaagaagcggcaactgctggaacaacaggtgaaagggggaggggcaagccaaatgagtgacttcctacgttttcagctcgattacgcctcaatcgcatgccgacagctttcccattcggaaagccaacagaatggaggcacttcggaggaggaggagggcgaggaattctccgagacggagtccgacatcaccaacccgtccctgctgggcctgtccatggaatgttctcccgccggcctgggtcgtaagcactcgttgcctcggggcgctcttcccccgggtgacttcgccgcccatccgtcgtccgcttcttccctcctgcccaacacttcctcggcacttttcaattccgcttatccttggctgcatggggaaatctttccttcgccgtcctcctcgtcaacttcgacgacaaacaacgaccatttgcagggggcacagaacggaacaacaaacgccggaggagaaatggggacgacggacagaacagaagggacgcagcagcaccacaacgaatacggagggggacaccaccacaaccaccatcacaaagtcattagcgattattagcaacaaatggtgggccatttcagattcgaagcgtagcgaacgcaaaaaaaggtgcacagccttcggccgatggtttcttccattgtcgcctttgtgagaagaggtcgcttttcttcgtccgttttcccccacaattccccccccaaagttcagatttgaaaaggtcaaatctctgaacgcgcatatgaaatcgcacgcgatgaaagcgcgggcggaggccgaagtgcaaatgcagcacaagcagcagcagcagtcgacgtcactgccctttccggtgcctaccaaaaaggaagcggcggacagcgcttgttggggtcgttgggccgcccccctcggccccgtcgcttcgctcaatctgacaagctcacaagcagctgttgcggctgctctgaacaacctcaacaggcagttccagcacagcagggccaagcggtgcaagaagcaatgggtggcataatggggagcaatttgctgctgaggaacatgctgcagtacggaccggcagccgcagcggccgctgcccaaggcgggggcgccgcaacgcctgggggcacggcatcgcagtggaccaccacgcagcacttcaacgcgtagcgaagcggctccgctgcacatgctggaacgggatgacccaccgactgacaaaacgcacttataatttaccacccttagggggattcccccctttggttttttactttccttttcccttctttttgctccaccggtgatttgccctccctttttagcacaatgttcgctattcacctctctcccccattttcctctctttcttgccctttcattcttttgttttctatttcttcctttttcccatttactgcttctgtccaacttcctctccctttcttttgtttctcatttatccatttacaatcactcagcagagccactcactatgtcaattaccatcccggttaattaatatacaaaataacgctaataatcaaagttcgttga

SEQ ID NO: 59336 - DNA, 1599 bp, Heterodera glycines
  misc_feature (1577)..(1577): n is a, c, g, or t
  misc_feature (1581)..(1581): n is a, c, g, or t
  misc_feature (1585)..(1585): n is a, c, g, or t
  misc_feature (1589)..(1589): n is a, c, g, or t
  Genomic contig location: Contig_ID=SeqID_28762; Location=157..1755; Strand=+
  SCN-specific regions: Sequence locations=1-85,109-1487,1509-1599
atgtggacagacagtcaatgctcagtcgaacgacttcgagaaaacaagcgccaagatcgatttgtggtaaatcgattacaaaaaatccgagaagcgaacttccaagtccgacacgtcagaaccgactcaaatccagcggacatggcatcaagaggagcggatcttcaatgccttcgatcatcactgctttggcactttggccccgtttggctttcgaaagcagacaaatggccaaaatcaaacgtcatctaccggcccggagatgaattcaaagaagtggaagagccaccaatcatcgaactgacaacacctgttcatgtcgaagaacagttcaaaccatcaatccacttcgaacgatttttgaattggaacaggctgaaagccaccgcagcacacgctatgcgcttcatcaaaaagcttcgcacaatcgaaaacggcacaattagtgaaccgcatcaaaacaacaaaccactgaccatggcacaactgcaacaagccgaaaattggatcttgagagaagcacagcggcttcattcaccatccaacgaccaaatccgagaattgcaactcttccaacaagaaggaatttggagatgcggtggacgactcgaggaagcaccggatctgccatacgacagtaaacacccaatctttctgccgccacacgcatggataaccaagctcatcatccggcattatgacaaacagctcaaacattgcggtccgagaatactcctgtcaacattaagagagaagttctggataccacgcggacgcaaaacagttcagcaactgctcaactccccgcaacacggatgtcttgaatgtcgtcgagaacgagtcaagccgtacacatatcctgaggcatcggatttgccaaagggaagagtcagcgaagcacgaccattcgacaaaacgggagtggactacttcggtccactcaaagtcaaacaaagcaatgacgtggtaaaaatctacgtcgcactcttcacctgcttggccatccgcgcccttcatttggaagtagccgaagactactcggctgaagcattcctccgagcctttcggagattcacggccagaagaggcataccatcacttatcatgtccgaccaaggcacaaacttcgtggcaggagcaaaagtcatcaaagaaaactggaccgacacgttaatgccggaggacatgcaacaacaaatggcgcaaagcggaattcgttggatttttaacacagcccacgccccttggaaaggcggtatttgggaaagactcgtcggcatcaccaaaaacgcactgcgaaggacagtcggcagaaaccttctcacattggacgagttcggcacaatgctctgcgaaattgaagcgatcatcaacaatcgaccactcacgttcgaatcggatcaggaaccgatcaaagtgctgcgaccaatcaacttcctgataccatacagcaaagcagacaacaacttcccaatcattgatgacgacacaaacgatccaacatacgagccaaacccaacaaatcgcgacaaaatggtggcaacactgagccacgttaatgctcggctgaacaattnctgngaantttnggaaaagtga

SEQ ID NO: 59337 - DNA, 519 bp, Heterodera glycines
  Genomic contig location: Contig_ID=SeqID_28763; Location=314..832; Strand=+
  SCN-specific regions: Sequence locations=1-255,277-347,369-420,447-519
atggtaatggcaacattaaaatttgtaaagcttttgacccgacgatttgatggccgaaggctttacggacgaaaaggaacactttctgctggagggattcgaaacggaaataagcgacatcgactcgaagtgaacatttaccatgtgatataaagggacaataaaaataattagctaattagccaactaattcatttcaagaattgtaacgacgaacatatccctgtctgcagaagttctccattgaggtgaatgaaatttgaatttgaagacatttaattcaataaacttttagatccccgacaattacataaccgaagaaaaacgatcaccacaaaagatttttgacattgggaaattgaatttggaaggcaaattctcgggccaacatcgagattgtattaatcggacattttgttgaatttattaaatacaaattaaattttagaagtaaaataatcgataggatctgtccgtatgtggcttcattcaacttaaaaaaactcaattattttcaaa

SEQ ID NO: 59338 - DNA, 330 bp, Heterodera glycines
  Genomic contig location: Contig_ID=SeqID_28765; Location=694..1023; Strand=+
  SCN-specific regions: Sequence locations=1-283,315-330
atggaggaggcgctcaccgtgtccctttcgcagggactcaaagtgcttgccctgcaggcattcggagtgctcactggtgagagaaaaaatggctaaaaaacgcaaatttttcaattcgttctccccccccccccacatttttcaggtctgagcgtgatgtttttcatggcattttatggcgaaagcattaaaaatgttgttgaattttagtcggtcgattttgcatttttgtggaggatttgttttgtttttctttgtgcataaatttatcagaaatttcttgttataaattgttatattttatttaatattaagcatttcgtggtaaaa

SEQ ID NO: 59339 - DNA, 695 bp, Heterodera glycines
  Genomic contig location: Contig_ID=SeqID_28767; Location=585..1279; Strand=-
  SCN-specific regions: Sequence locations=1-185,207-235,257-357,379 -440,462-539,562-695
atgcagccattcgctttgctttacgtggcctcaattttcgcgcagttccctctcttctttacgccgtttgaatgctttttgaaatgggcgttcacactttggcattttgctttttgccaatttttggccaattttgtgtggtgcattcgattggccgaatttgcgcagtttaccgtcgctaaatttgcactttttcaaatggtttcggctcaattttatgccgatttttgtcatcgggtaatcgttttttcaattaaaagtcattttttgtgtcttttcagctgatttttggctcaaattttgcgtttttgccgatgatggtcccttctgttgcctgtgctcttttcgtcttttttgcttatttccatttcattctcattgtttttgcggaatctgttcaaatccattttttcaaatttcgttgtcgccgcaaagaagtgatttttaaaaatttattaaaacaggcacgagaatatttattgtcagtttatttatttttgaatctgaaacttttatttttcgttgaattttattagtttggttatttttaaaattaaaaccttactaaattcaaagattaaatttggcaaatccccaatacattgttagccagtagtcagcctcagttttccgtcgtctctttggtggtgcaaacattccccgggcttaaggcaataatgatttgaacaaataaa

SEQ ID NO: 59340 - DNA, 741 bp, Heterodera glycines
  Genomic contig location: Contig_ID=SeqID_28769; Location=55..795; Strand=-
  SCN-specific regions: Sequence locations=1-319,341-623,645-741
atgcttcatttttggccaaaaattccgagtcccaaaccgattatttggcaaatttgaaaaacagtgcatttttgggcgaattttccggcctttggctgctcggcttggacatggtgccaatgacgggccaacaaacggttcatctgcacgtcaaccgaagctgtaactgcgccatggatgcatgggtaagtgagaaggagggagttaaattgcctaatagaaaaattatcaggggccacttttcatttaatttgtaatttttaaaatggattttcaattttttgttttagaaaagaaaattttctttctttttttaactgctttacgtattacttgagaaggagtcaattaaatccccatacttatctatggataaatacggccatttaattattgacaattttagtttatccaaccgatggactcgaataagccaattgatcccaaagtgccaacatttgggtcagaagcatgcccacccttgtcaacggatcaaacatttgccctaaccggccgcatttcgcttttcaacttttcctttacggcactgaccgatgctaacttatcaaacattacggtgatactgctcggtactgtataacatgaacatacaggttaaatataaacaagttgaattttgttaagatgaagccaaaaagatggtagcgagtttctacattggagaaaatgttatgaaagcgcgctttaaaggggtaaagcattgtttaaaaaagcaataaa

SEQ ID NO: 59341 - DNA, 1294 bp, Heterodera glycines
  Genomic contig location: Contig_ID=SeqID_5824; Location=196..1489; Strand=+
  SCN-specific regions: Sequence locations=1-567,589-596,618-1029,1051 -1294
  Gene Ontology: Cellular component=membrane; Biological process=lipid metabolism
gacaatgaattcctccacttcggacatcgacccccacttccgagttttggttcttgctttaacagcattttttcgcttcataccgaaactgggaacattttgacacatatgtacggtgagtatgaatgacatcgtttctccggcacttttattttttcaggtgcaatagcattcattggcattttcatttggtttttggtccaagccgaagatgtcgtcagttggcccgacaaattgatattctcttctttctttgttggagccattctctgcatgggaatgtcttttgcctttcacacggtccaatgtcattccgaagatatcggcagattgtttagcaagtaatccaaatccattttggacatggcatcatgagtcattgtcaagttcgtcccctgtgggcatttgcccatgtttaggttggactatgccggcatttccttgcttatcattggctcatttgtcccttggctctattacgcgttcttctgccgagttctcccgatgaccatttacatttcgatgatcttccttcttggaattgctgcgcttgtcgtttcattgttcgacaaattttcccaacccaaataccgtattttcttcgatttttctttgttccgatttctcatttgttttgcttcattaaggccctctccgtgcgattgtttttatggcgatgggattaagcagtgagttttttacattgttttattttcacttttcttttttatgcgttgttcccgctcttcatcttttggtcactgatggcattgtgtggatgtttgaaaaggcttctttacactggttgattttgatgggaatactgtaccttagcggagcgactgtaagtgatttcgctcatttccgaatccatttcttttagatttatatggtgcgcttccccgaaagatgcttccctgggaagtgcgacattttggtgtgttcattaattttaatgggcaaagtgcacaatttttgttatcgggtaattcttacactgaccatttttgatgtcttttacggcggaccttttttactgtattttctcctgatgccccccccccccgaaaattggcttctttccgttcggagttatcattttgttctgttccgtcatccgccaccattctttttccagtgtcaatcccaccaactgttccatcttttcgtcattttcgctgccgccgtccattaccacggagtgttagaactcgcgatgaagcggttgcaggacggttcctgctcggaacaactgatttcccacagcggaagtgacgaggcaaccattcagtgg

SEQ ID NO: 59342 - DNA, 377 bp, Heterodera glycines
  Genomic contig location: Contig_ID=SeqID_5824; Location=2037..2413; Strand=-
  SCN-specific regions: Sequence locations=1-377
cggtaggggtcaactccgtctggccaactccgtctcagcaatgttcaaaaagctataacttttttcgttgttgttcaaacttcacaatcatggtatcattcgaaagccctagatgtttagaagatatttataagctatttctcagtgattaatcagctctcaaaaaagttgtcagttgaaaaccgcaaaaaaggcagaatttttgaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggcccgttccgtcg

SEQ ID NO: 59343 - DNA, 1874 bp, Heterodera glycines
  Genomic contig location: Contig_ID=SeqID_5825; Location=1221..3094; Strand=-
  SCN-specific regions: Sequence locations=1-542,566-714,737-848,870 -1343,1366-1874
  Gene Ontology: Mol. function=protein serine/threonine kinase activity; Cellular component=nucleus; Biological process=signal transduction
atgattgatttttcaggttttccaagttcgaaaagtgactgggaaggacagtggcaaaatcttcgccatgaaagtgctcaaaaaggcgacggtcattcgcaatcagaaagacacggcgcacaccaaggccgagagaaatatactcgaagctgtcaaagtaacgaacaaatcgacaaatggtttcaaggggtgaagtggggggggggggggggctcgtgctcctgaaaaattgaaagggttcggtaattgattctgacattcgtttcgacccattcggaacccaaagcccaaaatgaatgtaagaattggactcgtcaacccctgaaaacgcctaacactattttatctcaaaacggattacgtttgcatttttgttttttttcagagtcccttcatttgtgacctccaatacgcctttcaaactggcggcaagctttatctgatcctcgagtatttgagcggcggcgaattgtttatgcatttggaaagggagggcacttttatggaggacactgcggcattttagtgagttttaatcgaaggaaaaacaacaacaaagaaaaacgcaattttatctttcagtctagcagagattgtaattgcacttgaacacctccatcgacaggttgtcatgtttaacttgtggtgactgttttaaaatttattcctttttttttttgattttacgagtgcgtcccattgaattatttaattaaaatttcaacaaaaaacacatgtaattttaaataggagaattacagcgcattttctcagaatgcatttaaaatatttttctgaatgaacacgacaaaatgcatactaataaaatttttttggcaataatacctgtggttccatacattccaatccttttttcattaagggcattatttaccgtgacctcaaaccggagaatattttgttggactgtaaaggtatttttggtttgccattggacaattaattgcccatttaaggccatgtaaaactgacggacttcggcctgtgtaaaggttgtcgtccaagtggtatttccgctgtccaattgtaataatcattcagaggccatcgaaggggaccaaaagacgcacactttttgtggtaccattgagtacatggcacccgaaattctgatgaggcaattaccattggtgcttcagaaataaactcctcttgtgttcagaactgggcatggcaaagcggtcgattggtggagtttgggggcgttgacttttgacatgctcaccgggggaccgcctttttcggcagagaatcgcaaaagggtgagtcatcgtcggcatccgataaatatatcttcgtgcgaataaaattgttttgcctttagacaattgacaaaatcctcaagggacgccttacacttccgccctatttaagtttcgaagcgaaagacttggtattttacgttcaaaagtttgttctgctgccaaccaattcattgtttcagataaaacggttgctgaagcgacacgtggacactcgccttggggccgggccgggggacgccgaagagataaagaaacacgcctttttcacccaccacgtcgagaattggacaaatgtttatcggcgagagttaagtcatgccaatttttagttacggttattcgacagatttaatgtttagatcgaagccccgtacaagccgaacatcaccagtgaggaggacgcctctctgttcgactccaaattcaccaaaatgactcccgtcgattctccgaccgccgaattgccaccaatgtccgtcaatcccttcgaaggattcacttatgtgagcagggacagacacccctaacaaaaaacggaaggtattctcagatagcgccttccgtcctcgaacaagtcagccaacccac

SEQ ID NO: 59344 - DNA, 302 bp, Heterodera glycines
  misc_feature (188)..(188): n is a, c, g, or t
  misc_feature (252)..(252): n is a, c, g, or t
  misc_feature (266)..(266): n is a, c, g, or t
  Genomic contig location: Contig_ID=SeqID_5826; Location=25..326; Strand=-
  SCN-specific regions: Sequence locations=1-18,40-56,78-302
atgaaattcccactctgtcaccctcttcttcgtatatgtaagagcaaaagttggactttcaaaaatcattgtcctttatttgagaaatgggccggaagtcgttgaaaccattgaattaggcgatatcccgagttggtgaatcgccgaaccaaaagtggggccggaggatttcaattgctcaagtgctncgtaagggagctatggaaaggtatgaatatcccgcaaatttgtactttcatgattgattttcangtttccagttcganagtgactgggaagacagtggcaaatcttcgccatga

SEQ ID NO: 59345 - DNA, 475 bp, Heterodera glycines
  misc_feature (279)..(279): n is a, c, g, or t
  Genomic contig location: Contig_ID=SeqID_5826; Location=666..1140; Strand=+
  SCN-specific regions: Sequence locations=1-475
atgtacctcaagtggtacatttgggtttgcggactcaaaaaattaacaggaaacgtgatcactgatcacactccaacgtatgagaccatccacagatttctcatgaggtatttttgccaaaaataatttgaatgcaaatttgaaatattcgttgggcgagggatgtgggaagacaccggcggaggacaaagcgccgtttaaccaattattaaaaactgtcataaataggaattcaaacaatcccgttttccagtattttaaaacgcagtttattatacncagtaaaattaggcgagataaacacgaatatggtgaatggatcagaggctgagttccggaccgagggattctgtaaatccaacagaaattgaaacagagtaaaaaaggcgcatttgtttattatcgaaatgaagttataataattaagctaattgtatttagaatacgaaaaaagcgtagcatcacgagggcatca

SEQ ID NO: 59346 - DNA, 1131 bp, Heterodera glycines
  Genomic contig location: Contig_ID=SeqID_5826; Location=1594..2724; Strand=-
  SCN-specific regions: Sequence locations=1-143,166-859,881-991,1013 -1041,1063-1131
  Gene Ontology: Mol. function=glycerone kinase activity; Cellular component=cytosol; Biological process=glycerol catabolism
tgacgaatggttacgatgtccaatgcttcatctcgggcacgcttatgacatcaattgatgcgcacgggttcagtgtgtcgattctgcgcatcgttgaccaaaaatggctacacgttttgactggtgccattctatcattcgactaatttaatatttaaaatttaagaatatgattctgctgtgtcatcgttttgggttgcctctcgtcttaacaaggagcccattgttggacaggattcagttcgttccattgaggatgaaaggccttgccaattgagtcttggcccacaactcccaaaaagtattcattttaagtcagggttaaataatttacatttttagttcaagagtcattgctaagaagctgtattgagaacgcttgtcaagccttaatcaacgctgagcacgatttgaacaggcttgactcctcagttggcgacggagactgtggcacatccatgaagataggagcatcaggtccattttgtttttgttttatccagtattcatcaaatttagcaattttaatagcagtggaaaatggtgaattagcgcttgaccatccgaagggtctttttctgcagttgtccaagttggtcgaatcgtcagtcggtggcacttccggagcagttagcaattatcacttgtttttgcttctaacagttgccttttagctatacgctttaatgcttaatgctgcggcgaatgcctttgaaagtcctctttgttccaatgttataaaaaaagcgcttaaacttgcattgaaaagcgtcgaatattatgccggtgcaaagccgggccatcgcactttggtgagtcgcttcaaaagctattattgtcctatttgtttgtttaaaggtggacccattgcatgcagctgtaagttttcgaggagagaattgggaagacattgtaaaggtatttcgtggcgtatataataaatgaggttaattggataagacggtggaagaacgagccaaagaaacggcaaaaatggaagcaaaggcaggccgtgccagttacaccgacaaaagcctgcagattgagcctgaccctggggcaatggcattttcaacttggtttaaagctgttttcgaaagttatgagaagaatcgtgtcacaaatcgatag

SEQ ID NO: 59347 - DNA, 292 bp, Heterodera glycines
  misc_feature (279)..(279): n is a, c, g, or t
  Genomic contig location: Contig_ID=SeqID_28772; Location=451..742; Strand=+
  SCN-specific regions: Sequence locations=1-152,174-292
atgaacaaaacttattgcataaacccagctaatgaatggtacggtaaaaaattctctgtcaaattcttccattaaatttcgttttttactcctcctaatcttaaagtgtcatttgctcgtttgaccattttcatgccaattgcagaaatatgttccattggtccagctgtaagtgatggcgacgatgagcttactgccgactcgcatccggcactcctgcagcaggcaaaagcagctcttatcacggatgcataaaaccaccaaaaataggggatgggngggggggggggga

SEQ ID NO: 59348 - DNA, 228 bp, Heterodera glycines
  Genomic contig location: Contig_ID=SeqID_28775; Location=148..375; Strand=-
  SCN-specific regions: Sequence locations=1-228
atgagtgatttccgagaaaagcaaactgtcggcaatggacggaatggcagcgatgtcagtgacgacgaggaacagacattcgacagagttttaaatgcgcgattaaaagtcgtgcccaaacgcaaaggaccgttaagcaatggaggcgcgtcgacgtccacggggaatggcaatggacaaaagacagacgaagcggaaatggtaaaaggactgaaactaactgtttaa

SEQ ID NO: 59349 - DNA, 592 bp, Heterodera glycines
  Genomic contig location: Contig_ID=SeqID_28775; Location=490..1081; Strand=-
  SCN-specific regions: Sequence locations=1-570
  Gene Ontology: Mol. function=phosphatase regulator activity; Cellular component=cytoplasm; Biological process=signal transduction
atggtcgaacaattcgaaacccggaattcgcatccgtcgtcacattccgattcggccagcacttcaaaagatgttcgatttgctgaacgttagtgcaattaccatttttcaatctttcgggttgtttttcagctacccgtttaaaacctctgattatcgcgcgttccgaggcgcaaaaacgcgttttcggccttggttatccgagtgtgcccacagtgacagtcgacgaatggtacaatgagatgcaaaaaagcggcacttttggcaaagggccaatgccatcgtcgtttaaaattgaccaacgcaaaacgcaagaatacgacgagacggaagagggagaagaggaggaagagaggaaaagacaggcgcaaatacagagagatgagtggaaggacgtgaacagaagggggtgtgggaatacgtacaacaaaggatgaacgaattggcaaagcaaccgaaaacggacaatgatttaaaaatgacaaccgaaaaacagaattgttgggtaagtaattgcaactttatttagctcaaaagagcaagcatcctgttcaaatatgtttaccgtgcatttcatttatttttaaataaa

SEQ ID NO: 59350 - DNA, 153 bp, Heterodera glycines
  Genomic contig location: Contig_ID=SeqID_28776; Location=29..181; Strand=-
  SCN-specific regions: Sequence locations=1-49,71-153
atgtggttggaattcatgtgagtgttgagcagaaaaagagatagacgttttttcaaaattttcagagccaaactcgcccagaaagaaaatccagaaaaattagggtcgtcgctactattccgaaaatgtggttggaattcaaaggagtgttga

SEQ ID NO: 59351 - DNA, 1838 bp, Heterodera glycines
  Genomic contig location: Contig_ID=SeqID_28776; Location=528..2365; Strand=-
  SCN-specific regions: Sequence locations=1-140,183-303,336-386,425 -441,469-535,580-602,634-644,665-681,722-756,795-806,927-945,971 -1052,1073-1099,1128-1146,1172-1202,1235-1250,1275-1331,1370 -1485,1507-1609,1631-1734,1756-1838
atgccaggaattgatttgaacaatccggcagacaaacttggtccaaaatgcgatacattggtttttcagtcgaaaaaaagccatctttttggaccaactcttggaccctttcgccctgccatggcaacggtggaagtgtcttaaatttaataatttattttttgaaaattttaatttttattcacccgaaaatttgtgtgcctttggcaaacaaattttcactgcaaattgataaaatggttcaagggaaaaggaatgggttgaatgaaagcaatttgaaaattggggggggaggagtctcccaaattttttaaaaaaattttttttaaatttttccacaaaaaaattgtttttgggtaaaagccgcaaaattttctttgcccccgtaaaaatttttgttttttaaaaaaaaatttttttttttggtttttaaggggggggaataaaaaaaaaaaaaaaatattatttggggttttctccgcgaaaaaaagggggggggccccctccccctctcttataaaaaaatggttttttgttttttttttttataaaaaaattttttttttttttaaaaaaaatctctcttcccccgccccgccaacaaaaaaaaataataatataaatattttttttcttttttcttcaaaaaaaaaaaaaaaaaaaataatagtggggggggagaaaaaaaaaaaaagtttttttttttttattattaaaaaaagagggggggggggttgtgggcccccccccccccccttttttttttttttttaaaaaaaaaaaaataaaaaaaagtggtgggggtgcccccccccccccccccccccacccaaaaaaaaaaaaaatatttttttttttttttaaaaaaaaaaaaataaatataaaaaaaaaaaaaaaaaattttttttttttttttttttttttttcccccccccccccccccccaaacaaaaaaaaaaaaaaaaaaaaagggggggtgggtgtttttcttttctaaaaagggggggtgggggtgtctttcttttggggggaaacaaaaaaaaaaaaaaaaattttttttttttttttttttattattacgacccccaccctcccccccaaaaaaagaaaaaaaaacaaaaaaaaaaggggggggggggcgcccctccttcttaaaaaaaaggggggggggtttttttttttgtgggggagaaaagaaaaagaaaaaaaaatttttttttttatattttttttagaccacccccccccccaaaaaaaaaaaaaaaaaaaaaaaaggggggggctctttttttttcaaaaaaaaggggggggatttttttgtggggggggccaaaaaaaaaaaaatattttttttttttaaaaattttttgaaaacaaaccctccccccaaaaaaaaaaaaccaaaaaaaattagggtcgtgctctttttttccaaaatgagggttggagttcatttgagtgttgagcagaaaaagagatagacgtttttcaaaattttcagagccaaactcgcccagaagaaaatccagaaaaattagggtcgtcgcttttattccgaaaatgtggttggaattcatttgagtgttgagcagaaaaagagatagacgttttttcaaaattttcagagccaaactcgcccagaaagaaaatccagaaaaattagggtcgtcgctattattccgaaaatgtggttggaattcatgtgagtgttgagcagaaaaagagatagacgttttttcaaaattttcagagccaaactcgcccagaaagaaaatccagaaaaattagggtcgtcgctattattccgaaaatgtggttggagttcatttgagtgttga

SEQ ID NO: 59352 - DNA, 48 bp, Heterodera glycines
  Genomic contig location: Contig_ID=SeqID_28779; Location=256..303; Strand=+
  SCN-specific regions: Sequence locations=1-48
atgaaatgggcgcgaagcgctcgtcctgaggccgcgaagcggccgaat

SEQ ID NO: 59353 - DNA, 541 bp, Heterodera glycines
  Genomic contig location: Contig_ID=SeqID_28780; Location=748..1288; Strand=-
  SCN-specific regions: Sequence locations=1-1,23-226,248-397,443-541
aattttatgatttatttattttctgttgactaaatagtcagttcttatagcaaatattaatttatatttgcgtagcttcaaataagcattctggcttcaatttcgaagggaattgaatttttttataataaattgatagagagcaaaaagcacgattgtataatattcaaaaaatttatctatgcatttgttgaacgtttctaaacccgatcgaattttttaaacctttatatgaaaacatttattgcaggaaatgacaaattccaatctgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttattttctgttgactaaatagtcagttcttatagcaaatattaatttatatttgcgtagcttcaaataagcattctggcttcaatttcgaagggaattgaatttt

SEQ ID NO: 59354 - DNA, 959 bp, Heterodera glycines
  Genomic contig location: Contig_ID=SeqID_5827; Location=873..1831; Strand=+
  SCN-specific regions: Sequence locations=1-22,45-102,124-321,357 -636,659-686,709-779,801-959
atgagggatattcaaaagggattttatgtggtttgtttttgtttaatcccatttttttaatctaagacattttcttacacagcaccttcttgccactttgacagttatttttaatgaaaatttccgattttttgcaatttgacgataaaaaaagatgaataattaatagggcttccttttttaggcaaatgcctaaaactttgcgcactaaatacgcaaagataagcacgaaaaacgcgtttcacacccctaagaaatgacccaaaaaaatttcagaaaatacacccttaagaattgaaaaattttcaaaaaaatgatcccaaaatttaatatattttttcttaataaaaatttttggtttaaaattttgtccttatttaataatttcatttgcaattgaaatatttaagttttacttgttttaataccaaaaaagcgttaataaaattttttttgcctatttttgtgcctattttaaggtttttgtgccaatttaatgcctattttgcgattttttgtgcctaaaaaaggaagccctaataattaatgattgctgtttatttgttagtttataaaaatgaagtttttttgaataaaaaaaattcttcgtatttcagagttcccaagtgtccttttttctaagatttgtcctttatttgtcacgacctccttattttgtgcttattcttggatttgaaaataaaattacaaaaacgaataactgttttgaattatttatgtatcattttttatggaagcaaatatttgaattaattcgattttgaaaaaattgcgtttttatttcgttttcttgagtgtaaaatgctctaaatttcagtgaaaattttgttaaaaattgtcaacatttctatttttcctccggcggcgtctatcggcaccgccgggccttccaaaacttattttttcataaaaattgaccaaaaattgtcatattttga

SEQ ID NO: 59355 - DNA, 505 bp, Heterodera glycines
  Genomic contig location: Contig_ID=SeqID_5827; Location=2502..3006; Strand=+
  SCN-specific regions: Sequence locations=1-92,126-137,159-324,346-505
atgtcaatggatcggatgaaacatttgttgagcacgggtgagcattcggatgtgcactttttggtgggggacggagacgcaaaagaggcgagtttaattaaaaataaaaatttaattttatttttcaattgcaatttcattaattatccacgttcccttttaaaggttttgccagcacatcagcttattttgaagagtgcttccgatgtttttgaggcgaatgttccgttttgacgccaaaaaagaaagaccggaaaatggtaaaaaaataataattttaagggaaaataccaattatgttatttgttcttcattttgtctctgctaatttccctaattaatttttcaattagtttctggtaattgtcctgatgttgtggagatccccgacgttgaagcagcagcattcaaagtgatgttgagcttcatttatacggaagagttgagtgatttgaatggagacaatgcaatggtagtgctttacgccggtggatttaatttttaa

SEQ ID NO: 59356 - DNA, 988 bp, Heterodera glycines
  Genomic contig location: Contig_ID=SeqID_5827; Location=3177..4164; Strand=+
  SCN-specific regions: Sequence locations=1-236,293-954,984-988
  Gene Ontology: Mol. function=protein binding
atgcttttgttcgaattcgggtttgttgagttcgaaacttgtcgaaattgtgtgagattcatgatccaagtgaaagcaatttttaaggatttttccatcaaatgtttgcgttacatttgtcaaaatgcggctgacttgttcggatcagatgattttttgcaaattgatcagaaaatattgtgcaatcttctcgagagtgatcgtttgttactcaacgatgaatttgaaatttggaaaattgtaatttcaatttaatttttaattgaatttaattttcgttttttttaatttaggcactccgttgggccgatgaaaaatgtcgtcagaatggcattgaatgctcctcgggaaatcgtcgttcagtacttggaccggcactgttcaaaattcgttttccaaatatccatgaggaggattttgccaaatgcgtcggtaaaatttttgaaatcgggaattaaattgaatttgttttggttgatatgaaattttacctttaatgcttgaatttcatacatggacaaggagggtcagaaatttttacataaaatttatgggaaaactggacaaagagaactgatgcctacagggtaataaattttgaaattttacagttcccttcggtgttttgtcaaaagatgaagtgatcgccgtttatcagttcaattcccatccgtttctgtatcttcgtggagtgcccgggctgtactcgttgaaattcccaagccatggacgaatttttaattggaacaaagccaggggcaaccgaagagggacactttcgatggaaattgaaaaaatgtcggaatttgcgggagagtctgtcgggagaagcagattcagtgatgccgtgtatataaatggatttccatggaaaattgaagcacaaattatgaattgcattgatgagaagaaatatttggggttttacttatggtgcgatgcaaaaaaaggtccaattttaattactattttaaaaatataatcatta

SEQ ID NO: 59357 - DNA, 331 bp, Heterodera glycines
  Genomic contig location: Contig_ID=SeqID_5828; Location=78..408; Strand=+
  SCN-specific regions: Sequence locations=1-23,45-117,141-331
atggacccatccaatggtttttacaacagagaagaagacaaagtgacattggccattgatgtcacagtgaaagatgaaaaaatagagaaatttgtttctgatcccgacaaatccaatggaacaatttcgatggaaattgaaaatttgtcgggatttgcacgagacaccaatcagagtgaacgtaaaagcgaaactgtgcacatcaaaggatttccatggaaagtatggacacgaataaaaacgaaaattggaagcactgacaatgagaaatgtttgggcattttccttttgagcgatgctccagaagaaggtgctaattagacgctaatta

SEQ ID NO: 59358 - DNA, 182 bp, Heterodera glycines
  Genomic contig location: Contig_ID=SeqID_5828; Location=545..726; Strand=+
  SCN-specific regions: Sequence locations=1-182
atgccctacaggggattcccgaatttcatttcatttgctgtgagtgacaataaactttccttaattgacccaattatgaacaattaaggaactgatggatccgagcaaaggcttttacgacaaaaacgaggacaaagtgacattggccattgatgtcagtgtgaaataagcataaatggaga

SEQ ID NO: 59359 - DNA, 452 bp, Heterodera glycines
  Genomic contig location: Contig_ID=SeqID_5829; Location=296..747; Strand=-
  SCN-specific regions: Sequence locations=1-2,24-270,306-389,417-452
atggaggtgggggagggggaagataagcaaatccaattcaaatgccaatgggtagttgagttcatttttcgacccatatcaatagctaaatgttgcttttaaaaaaaacgatgggaaaactggcagaaaaatggagagaaaagggagtattcctcccgaaatttacaacaacaaaaaaattcaaaaaatcaaattttattcacaaaatgtaaaaatttagacaaaaagcaaagaacgaactaatggaaaaaggcaacataaaatgaatgagcacagatactttttctgtttttgttcttgtttgtcaattggtcgcctcttccgaatcgatggcattgcaaagacaaaaagccacaattatgccgaacacttcacaatgcgaacagaagcaactaaattaaaacaaaaaattcaaattgatgttgttcgaagaatcgggatataaaaataaa

SEQ ID NO: 59360 - DNA, 1229 bp, Heterodera glycines
  Genomic contig location: Contig_ID=SeqID_5829; Location=1529..2757; Strand=-
  SCN-specific regions: Sequence locations=1-548,570-572,595-659,688 -852,874-1166,1207-1229
gcactccgttgggccgatgaaaaatgtcgtcagaatggcattgaatgctcctcgggaaatcgtcgttccgtacttggtcctgcactgttcaaaattcgttttcctaatatccatgagaaggattttgcaaaatgcgtcggtaaaaattttgaaatcggaaattaaatagaaattgttttggtcgatatgaaattttacctttaatgcttgaatttcatacatggacaaggaggggggtcagaaatttttcaaatttatgtgaaattggccgaaaaaaactgatgcctacagggtaataaattttgaaattttacagttccatccggtgtgttaacagtggaagaagtgctcggcgtttatcagttcaattcccatccgtttctgtatcttcgtggagtgcccgggctgtactcgttgaaattcccaagccatggacgaatttttaattggaacaaagccaggggcaaccgaagagggacactttcgatggaaattgaaaaaatgtcggaatttgcgggagagtctgtcgggagaagcagattcagtgatgccgtttatataaatggatttccatggaaaattaaagcaaaaattacgaaaggcattgatgagaagaaatatttggggttttacttatggtgcgatgcaaaagaaggtccaattttaattactattttaaaaatatatgctactgaaaaaggtgcaaattaactgttattaaatgctaattaacaacgatgagtaataatcattaagattcgaattggcgctgctacgttcgttcggcaacttttcgaattatctcgcaaaaaaatggcaccgagaattccattggcacacttcatgaccatgtttttgacaatgaattaaatggctggggattcggatttttcattacttttgctgtgagtaataatttaacatatttacttaattgatataattatggttaatcaaggaattgatggactcgaacaagagcttttacaacaaagcagaggacaaattggcattggcaattgatgtcataactgttgatgagccaaaaatggagaaattcatttccgatcccaacagatccaacggcacactttcaatggaaattgaaaaagtgtcggaatttgcgcgtgaaataattgggagtcaacgtaaaagcgaaactgtgcacatcaaaggattgccatggaaaattgtggcaaaatcttcgaattgtttcgcaaaagagcggc

SEQ ID NO: 59361 - DNA, 1321 bp, Heterodera glycines
  Genomic contig location: Contig_ID=SeqID_28783; Location=76..1396; Strand=+
  SCN-specific regions: Sequence locations=1-317,339-398,420-703,726 -783,805-1321
atggttcatgagcattttcttttaaccatcactgctcgtgatatagaaggaaaaacattcgccattgatgttcggaaagaacaaaatgacgattctgagattaggaaattaattgaatttgtaaattttggttcattccctgaggggaccacagaagttgaaaaggaagatattgcatcaagagcggaaaatttgagtctttcctcaggcatattataccaacacttaccagatcaaaatgctcgaatgtacattccgctttctcttcgtccactaatttttgaagcttttcatacttcacaaataaatggtggtcatatgaacatcaaaaagacattagggaaatgtagaaaattttattggccaatgatgcaccgcgacatcacaaattggacaagacaatgcatcacatgtcaactaagacattcacccaatccttcatatcgtgcagaaatgcaaatgccaccaaaaaatactctcttcgctcaaattgcacttgatttggcaggtcctcttcccctcacgcagaaaggtaacaaacacatccttaacataatttgcacatttaccaaatatgtaatctctgtacctatccctgatgctaaatcccaaacaatagcactagctagcattctttaaacactgttatttaaagtttggaggctgtacgagtcttctaactgataatgccacggcattcacctctgatttctttaagtccttctgttcgcttctctatattaataaatgttatgctattccccattggagccaaggcaatgcagtagttgagcgatcttttaggacatttcacaatatacttgcgaaatatatttcaagtgaagaaccagattttgatgaatttcttgaatgtgccaatttctgctacaacacatcaattcactcttccacaaaggagacccccttctttttggtctttgggcgagacccgatattttgcattgagcaaattctgaatcccaacaccgaacccgaaaacaccagtgaagttgacaatgtcaagcagaaattagttaagtctcttagaaaagcttgggaatccgctgcggcggtcattaaagaagctcagttacggtcaaaagtacaatatgacaagttagtacgaaatcaaactgttcaaataggagatagggtcctattacgcaattacgcaggaaaagtcaaaacatccaagaaatttcaattaccctggaagggactttatcgagtcattgagattaatgatgtccttatcacaatcgtcagctgcacatctcctcaaaggcgcaaaagcgcccccccagagccgcgaagaggccga

SEQ ID NO: 59362 - DNA, 488 bp, Heterodera glycines
  Genomic contig location: Contig_ID=SeqID_28783; Location=709..1196; Strand=-
  SCN-specific regions: Sequence locations=1-317,339-396,419-488
ctaacttgtcatattgtacttttgaccgtaactgagcttctttaatgaccgccgcagcggattcccaagcttttctaagagacttaactaatttctgcttgacattgtcaacttcactggtgttttcgggttcggtgttgggattcagaatttgctcaatgcaaaatatcgggtctcgcccaaagaccaaaaagaagggggtctcctttgtggaagagtgaattgatgtgttgtagcagaaattggcacattcaagaaattcatcaaaatctggttcttcacttgaaatatatttcgcaagtatattgtgaaatgtcctaaaagatcgctcaactactgcattgccttggctccaatggggaatagcataacatttattaatatagagaagcgaacagaaggacttaaagaaatcagaggtgaatgccgtggcattatcagttagaagactcgtacagcctccaaactttaaataacagtgtttaaag

SEQ ID NO: 59363 - DNA, 427 bp, Heterodera glycines
  Genomic contig location: Contig_ID=SeqID_28783; Location=1628..2054; Strand=-
  SCN-specific regions: Sequence locations=1-114,136-267,294-376,419-427
tccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 59364 - DNA, 1290 bp, Heterodera glycines
  Genomic contig location: Contig_ID=SeqID_28785; Location=217..1506; Strand=-
  SCN-specific regions: Sequence locations=1-55,77-297,320-389,449 -454,476-766,811-862,901-930,961-1004,1035-1290
atgctaataatgtaactctttcattgcttaggctaaaattgcacaaattctttgtataataaaactaaaaatagaagattctttgatactttaacattgagaaagttttttgaaaatttttgcataatttgttgccttttcaattaattaagtcattttgccttaaactttttttaaatttcattaaacactttttaacaaattcattcgaccttttatgccttttgatttggcatttttaagcggcatattttaagggcggcgccgggaattaattgcggaatctgtgcttctcccatattttgaagttgtgttttatgagacgaaaattataagaaagcaactaaatattgaaggaagctcgtaagtaatcgaaggaatcaaataacaattttatttaattttaatcgttttaaaataaatttaaaattttcatgatttataaaaacttttaagatcgatcggaattggactttttggaaaaagcctttacatgtatggggacaatggcttcatttttgggcacaatgtgaatggcttctggggatatccctcgtttgaagagggcgacacaatcggatgtggggccaatttaacatcgatggaaatcatttacaccaaaaatgggcagaaattgagtgagtaaaaataaaataaacttagtgaaaaaattcagagaatatcgtgaaaaattggaaagaaaaatgatgactctattcattaatttcgttttaaaagaaatcaagctatttaaaacacaattgtcacattaaatcttatttatttgatttccaagtttaattttttgagttaatttaaaagatagaaacacaccattacataataattattttttaggcactttttattcattaaatttatttattttttcatttttaagatccgctaatttgattttaccggtctctattttaaactcataaaatatatttattacatgacttctaaagtgttttaaatcagagacttagtagcgctgcaagatttttaaattttctattttttattttaaacagtattgtttttttttgatttttcatttttatagatacttcaaatttgttcgtaactgacactgatctgctccctgttgtcttcctgtatcttccaggagacataatcgaggcgaactttgggccgagatttgcttataatttcaacgccagcgaatcttttcttgatgattgatattcggcaattaaaattagtaccctgattttaaatttttgtggagaattccattgattgatttgttgtttaagaaataaa

SEQ ID NO: 59365 - DNA, 266 bp, Heterodera glycines
  Genomic contig location: Contig_ID=SeqID_28786; Location=186..451; Strand=-
  SCN-specific regions: Sequence locations=1-266
atggaggagtttattaatgtacgagtttgaatacaatagaaggccttttcatatgccagggctccaacccctggggcaataaacggcgaagcggcggcagaggtctgatggaccccgtggattttgtgtcacaactgaaacaatttgtggctttttgataggtcaatgaggatttttttggaaaatgaggatttttgtggctttttgagaaattttgaggatttttgaggcttttgggcctcagaatcttttaaaattttaataaa

SEQ ID NO: 59366 - DNA, 1209 bp, Heterodera glycines
  Genomic contig location: Contig_ID=SeqID_28787; Location=5..1213; Strand=-
  SCN-specific regions: Sequence locations=1-4,26-603,625-1209
atggtgttggttttccgtgaacttttccggcgaggattcaatccgagcatgttgaggaagggcaataagctgtatgaaatgaaagtgggcaagcagaagaaacgcaatccaaacgtggtgttccgagactcgtataatttgatgccctgctctttggctgaactcgtcacatccttcggcttggacgtcgaagacaaaccattcttcccgcacatggcaaaccaaccggataactacggaaagcagatataccccacgcctgaagactacttggccgatgggatgatgccggataaacgacaaaaattcaacgtctggtatgaacaacatcagcataaacccttcctccttgacgaagcattggccagctactgcacaaacgacgttgaaattttaacggcagcgctggtagcgtttcggatggaattctttgatgtgtctcggagggaagaaggcattgtagcggaaagggcacacgaaggaattgatgtattgagggagtgtatgacgatcgccggcgcctgtatgaagcatttccggatcaaccaccttccagctgaacacttggcaattgtcccggaacgaggctatgacaatgcacaaaatcaaagtagactggcccgccgtttcttacagtggtacacggaagaacataatgtggaagtgaggatggctaattcacccggaggagagaaaaagtttggtcaatattctgtggatggatgggtggaagcagagagaaaggcaatagaagttaacggatgtgtttggcatgcatgcagtgagtgttatccagacgataatatgatgatgccaaatggaaagacagctggtaaagtgcgggagaggaatgccaaacgattagaattcatacgaagtcaagttggccagctggaagtgtattgggagtgcgagatcgagaaaatgttaacgaaggacaaagaaatgagagagaaatttgaagactacatggatgatggtccgctgacaatacgcacatcatttatgggaggaaggacgggaccactgaaactactccataaagcgggaccgaatgaacaaatttcttacttcgacttcacttctctctaccccttcgttaattttactacacgctacccgattggtcacccaactgtgcatgtgttgaacgaagaagtcgaatggaaatgtccggaagatagccgctacccgttagcaattctcaaa

SEQ ID NO: 59367 - DNA, 85 bp, Heterodera glycines
  Genomic contig location: Contig_ID=SeqID_28788; Location=105..189; Strand=-
  SCN-specific regions: Sequence locations=1-85
aagacaatcactgacgccggctacgcgtactctgaccagcacaaagtgtgcgtgcacaaaaacgtggtgaccagccgtgggcctg

SEQ ID NO: 59368 - DNA, 192 bp, Heterodera glycines
  Genomic contig location: Contig_ID=SeqID_28790; Location=378..569; Strand=+
  SCN-specific regions: Sequence locations=1-93,131-192
atgataccaaatttgtctgaattatccgttttaaatggttaggagaccccttttttacctcaattttaaatttccacataacgaatttttaggaataaaatgatttttaaatataaaaatattttttattccatattatttttcagaaaatagaaattcagtattcacttcatagtttgatccgaattttta

SEQ ID NO: 59369 - DNA, 436 bp, Heterodera glycines
  Genomic contig location: Contig_ID=SeqID_5830; Location=188..623; Strand=+
  SCN-specific regions: Sequence locations=1-137,159-382,404-436
atggccacaaattttcagaccagctctttttccgtcacatttgctcgtcgtcgaacggattgggaggaacacaaaaaagggtaggaaatttatgtaaattttttgacaaaaatgccatggattttcgaattttttcgtttttttttttataaatttttcagcacttcttcgtcccccgtgttcaccaaactgttcagtttgggcgccaaaaatttgctgcttgcggtacaatgttctgcaattccgaccaaaactgttgccatcaggccgaaagtgtaaacaaaaaaatattttagggaaaatcgttttttttttaaatttttggactcgacctgtaccatggaaccaggcctggatttttcatggacatggacttttatccagaaaatccaagtcaaatatgaaaaactaaccaggtttaagttaggcacataca

SEQ ID NO: 59370 - DNA, 169 bp, Heterodera glycines
  Genomic contig location: Contig_ID=SeqID_5832; Location=278..446; Strand=-
  SCN-specific regions: Sequence locations=1-169
atgcaaagcttccgcgcgcttctcttcattctcgccggaacagcacgcgtttggagtattttgagtacggcgcgccgccgggaacgccagaaacgttttgccattccgtgtacaaaagcctggaagggatgggagagaaaaatttgtgaaatcgcaattatccaatttg

SEQ ID NO: 59371 - DNA, 976 bp, Heterodera glycines
  Genomic contig location: Contig_ID=SeqID_5832; Location=1726..2701; Strand=+
  SCN-specific regions: Sequence locations=1-65,87-174,205-211,235 -363,425-527,573-976
atgacaaagcccttaaactgtacaaatttgtacggtaatttatttgtgtgttaggaaattgctttttcaaactttgtcaatttttcgtcattaaaattaccagagccctatttaataccaattatccccaaattagtacagtcaaccggtcattcgtaaaatccttttattccgtatttttataatattaaattatcaaattttggttttcccaatgaataataataataatcaccaatcagccacaaaatttattcattcctttcattttcatcacaattaacccataaaaaagagagaattctctcaataaaccaaattctgtgcaaattcagtgattttattattagtgaaaattatgccatttttttaaaataaaaattgtaaataattttaaattaaaaaaaaagttttaaattattttcgaagagcaaaatgcaccttttctatgtgttaattgctgctgcttttttcaatttgcacagcttcacaaatgggcaacaaccatcgcatgggccgtaaatattttaaatttatttttattttttaaattatttaatttaatttattttttcaaggcttcaatcgacggacggcaaaaacggggaaaagccaccagcagcagttggactcacatttggctttcccccgaggggcggacattgtgacgaagggtgggcaaaaaaatgaaaattcaaaaaaaaatttcaacaaattttaggctttggatttgctaccagggcatttttcagcagcatattggcacctcaggcagcaattttcgtgcgaaacgaacatttgttgtcagagacgaaaatgtaaaaaatcaaaaatcataagtagggcttggatttttaagggcgaaaaggtccaaaataaggccgtaaatacgggcgagaaaatcgcgaaataagggcgaaacgccaaaataaggatttctaaggtcgaataagggcgttaaacacaaaattttcaa

SEQ ID NO: 59372 - DNA, 225 bp, Heterodera glycines; identical to SEQ ID NO: 59154
  Genomic contig location: Contig_ID=SeqID_28792; Location=746..970; Strand=-
  SCN-specific regions: Sequence locations=1-225

SEQ ID NO: 59373 - DNA, 698 bp, Heterodera glycines
  Genomic contig location: Contig_ID=SeqID_28794; Location=1..698; Strand=-
  SCN-specific regions: Sequence locations=1-80,102-698
aaattggtgcgcttagagcacttctgaaaaaatattatgaaacaaaaaaatcgatttttcaagtgtccgttggggtactcaaacatttatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatgaggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 59374 - DNA, 784 bp, Heterodera glycines
  Genomic contig location: Contig_ID=SeqID_28796; Location=63..846; Strand=+
  SCN-specific regions: Sequence locations=1-481,503-725,747-784
atgagtggggtctggtcatttttaaccattccagtcgccaatggacaagtcctaggttcggctggatcattggaccaataccctttcctttgttcaacaaattactttcaaacaataacgaaacaccgtccgataagctaatttccatggtgactattattcttagaggtgtaaacatatgcattttaagctttgtgatgttcttaaatcgaccgttcattcgctgtacactcaaagtgcccctcttttggataccattttggattttgtggacgtcatcgtttctgcacatcctcggcccgcctgtgaacttgccaaatctctctttttggcatgtcccaaattaaacttaattaaagcgaggttttcagactttccacaaaaatcgagacgaaacgacaacaaaattaattgcccatttggctaaatggttcgctgacgaatttgcttttctccaacaactgtccactttcgacgccattgatgcggaggaaagggacgaacaattattaactcttggctattacgtgctgaagaagttttgggacaatttgttgttcgtctcctccacgctgacgacgaccaaccaattggaagctggaactttgtgctgtgccttcgtccgccacttttgtcttatcatagcaacggcaattaaattttcttactaaactcatttttttcgccaataaattgacacttttcaggtgcttcaacacagcaaaaacccttcattagtacagcttggtctccgttcgcttttccatctgttgacaaagtgtaa

SEQ ID NO: 59375 - DNA, 549 bp, Heterodera glycines
  Genomic contig location: Contig_ID=SeqID_28797; Location=10..558; Strand=+
  SCN-specific regions: Sequence locations=1-86,118-135,161-169,203 -227,251-319,341-344,413-549
atgtataagttaatgagaaatattttcgtagtgattggcgaagcgttcagtttggatgactgtggacaaaaagaggaaagtgctgaacaagttggagatgagaagttgaggaaggaggccaaaagcaaacagcaggacgatgatgatgatgatgatgatgggattttggtaaaaaataaataaaaacaaaaatatttaaaatggaaataatcgaaattaatttaattctggaagaagtcagagaaactggaaatggaattgagggtggccaaacaaatgtgcgcgttcatcaaaatggaacttgaagaggcagggattccagaaaaagctaaaaatcaaataccataaatatttaaaaaataaaataaaattacaaaactttgaaaaataaatttcgtaaattttaatttttcacagaaggcacttcaagcagaattaaaacagcaaagactgattgaagaaaacattgagttgaaagtcaaaatttacagaatggagaaggaaaaggagcaaatggaaaaagacggtgaaaaagaaaataaattgtaa

SEQ ID NO: 59376 - DNA, 191 bp, Heterodera glycines
  Genomic contig location: Contig_ID=SeqID_28800; Location=1020..1210; Strand=+
  SCN-specific regions: Sequence locations=1-81
atggccaattggaaaacgacgagctttgccgaaacggaattcatcgcggtgacctcctatcagaacaacttggcaagtgacggagggaaaggagagaaaagagataaaaagagtagggaaagagaaaatgagaaggaaaagaaaagtaaaatgggggaggagcaaaagggaaagaaaaagagggaaaaaga

SEQ ID NO: 59377 - DNA, 675 bp, Heterodera glycines
  Genomic contig location: Contig_ID=SeqID_28801; Location=687..1361; Strand=+
  SCN-specific regions: Sequence locations=1-144,186-338,384-675
atgtgctggtgctgctcaaattgtccgactactttcaggtgggtgcccttacagatggaatattagacattacataaaattttattccgttttcaaaaaaatgatacttaaatttgaatatcctttatcaaagagagtttacccataattttcaataaaaaattaatttttactatttttaaattcattaggctaattattaggggcactaattgctccgttttgaggtggccgcgttgaagtcgcgttgcgaattgcatctgatcaattgcgtggaaattccactgatcgaccgtttccttctgattgaacgcttcggactcgacaatttgaaagtgatttaattttcaaatattttaaattattttttaaattaatttttagaattactttttgcatttgaatgttgacaaatttcgtgcctttttcaatgccaaccatgaacagttttttcctgttatcagcaaagaatttttgtgcgctttgtctgtccgaggaatggccgggctttgatcaaattgattttggcattttcatagaaattgatcaaactgattttggcattttcataagccgggctttgatcaaattgattttggcattttcataaaatgttttttagaaatttcctcattctcgatcagagagaaaattgttaattttttttgaactgta

SEQ ID NO: 59378 - DNA, 171 bp, Heterodera glycines
  Genomic contig location: Contig_ID=SeqID_28801; Location=18..188; Strand=+
  SCN-specific regions: Sequence locations=41-75,102-171
taattttttaattttttgaattttttgaatttttaaaattcccggttggtcccggttcccggtcccgaagaaaaatcgaggtcccggtcccggtcccggcttctcaggtcccggcaagtcccggtcccggttttgcccaaaattcccggtcccgctctactctagtgaaaa

SEQ ID NO: 59379 - DNA, 5039 bp, Heterodera glycines
  Genomic contig location: Contig_ID=SeqID_5834; Location=8..5046; Strand=+
  SCN-specific regions: Sequence locations=1-755,777-1038,1078 -1174,1196-1297,1324-1373,1408-1443,1465-1570,1592-1592,1616 -1914,1937-2065,2118-2239,2260-2599,2623-2632,2654-3026,3064 -3133,3155-3160,3182-3256,3278-3304,...
  SCN-specific regions: Sequence locations=...3326-3352,3374-3400,3422 -3426,3448-3828,3868-3889,3911-4040,4082-4106,4128-4342,4377 -4647,4692-4858,4881-4987,5009-5039
atgttgagattgacattgagctcggcctgcaggtcggacgcttttatgatacttcaggaaacctcaaatagggacaagtacacgcttgagattgtcgactgcaggctgatagtgaagacggttgatctgatggacggactcatccttgacattgcaaagaagttggaactggagcccgccagatacggcatccggaaaacgctgatgaagtcgctgttcattaacggtggacgatacgatttttctgccaatctgttcaccgaggaagtgcctcggagggtcatcattgggctggtccccacccaaatttacattgggcgcaatgagcagcaccccttttgtttcaatcatgagaatgtaagtgtcaatctgtcatgtatttctggcagaatataaatggccaggtgatggcatattataaaatgccaatttggcagggcatactcccggcttcagtgaatgaagttgaatcagatgattcaagtgaagaaaaaggtgatttttcactctggaacactttattctatgagaatttaaaaaaaaaggtattttcgttaaaaattttgtgtgaatcactaaccgatcggggttcccggcccccgacattttgccccccccccccccgaggggtcgtggagcaaccctaatttaaaccaattccaaatcactacaaaagtgtcccacttttttttttctgggtactaaacagcaaaagtgccaataattgtatataatctaaattatatgattgcactgcacaaatccaaaaagactgagtacacactccagaaggcaaacaaatgactcaaattcgagtcaaatcaaatgttaaactaggtaaaaaaagataaggacatacaaaaatgataaaaatatattgggaatgttacggtattttttggtgtgagacaagattatttggcaggttatggcattttggtgtcaaaacgaaatttcgaaaaaaaaaacaaacaactattataaaattgaattagaatttcgtttgaattttgaattaaggacggccaatgttcgatgtattttaaatgaaataattatttttgaattaattattaagtgaaatcgtttcacattttcttctgttataatgctcaaattttaagtgaattgaattcaaaagaagaatgaaaattgttcttactccaagcttcaaaaaatggaaaagtttcaaaagttaatttcttaaggatcttaaacgatgccgcctggagaaaataaaaattaaaaccaaaaacattcgaaaaatatgttaattattaaatggtggtaaatagcgtaaataataaaataattgaaaaaataccatatttactggcaaaaatcttattgaaaattctgaaacaattaaacagttttataattataaattataaattaaatttaattcatccatcctttgctaatctgacgcaattgaaacctgaagaaaacatgaagaaatcgcggaatttaagaaaaaaaaagattgtgattaagacttgaatatccctttgttgatcattcaccaataatttttcgaatcaggcaaaatctcgaaactcgaataatcgaacaaaatgaacaaacaaaactaattttttgagacggaagtttgaagtgtgagacaaaagcttgggatcttcggttttgcttattgttgaccgtgaaacaaaatatgaccattctcatctgagttggcattcgtgagaccaaagcccaaagatcataacaaaatgtcggcacttttcgccggtagaaaatttcgaattacggtcaaagtgcgaagcacacactgacaatgatcgaattttaaaatgccggaaagccgttcaagtacgagcagaggaattgttcttactgtatttcttatcgataatttacagtatagctaatccaatacattttcaaagtcacaaaggcacacaaattttccattattgtagtcttttacatttaattcattcagtcatttgcatcataatgtgtttccctcaatcttttacagtatctcttccatttccctttatataaaatgcttttaacacataatgcttattactttttgaaaataataatattaataatttactcaaaaaaaaaaaaaaaaatttatttttgctttttttttgatcatcacaaaaaactaattacaaattcatattcatttctgaccatcgtttagcaccaaccggcaccaaccaccccattgatggaatgcacgtcctaaagtgattcatccccaatccaatccaatccaatgaatttgactgttatcgctattagcgatcagcttacccgccatcccttggctaattgtgatacgaattttttttccgtcagcttccacgggtgcgggggacagcggtggacaatttttacgcgacgtgtcacagcgccacccaccgcgtgggatgtgtgcggtgcccgcccatttgccgcgctgcttctgccgcagggaccgcccatttgggcactgtcgaccaccgcatttaagcgctgtccgatcagcgaacaatcagtcagttccaaaatttcatccagctcctaaccaaaaagcattcaactgacaaataagctggggaaaggaaataggaaaagccaaataaaaacattttttgaaaatgggtcagcgattaaaaaatttttaaataaactttttgaaaaccctttcttttttttgtttttcattttaatttagaactcaaaaaatattttttggtttaatatccattaattttgtattttattgtaacattttaggaagagatttttcctctatttctgatcccgaatcccactcttcaaagcaaaccgtcccactctcgacgttcaatatgaacaagtggtctgcacttgtgtacgttttgtggggagtgggggcttaaaccctggccaaatattaattctctgtcctctttcagtctgttgatcgcgctgatcagcgcgctggacagcgctgttgtgcgacaacagcgcgccaccaacgcggacgcatcgaaaccggaaccgaataaccaaaagccaggtaaaaaaatgaatttattaaaaataaattaataatttggtctaggaactgtggactcggacaaaggaaacgcggacaaaagccagggagcggacacggatggaaagaacccggaaaagccaaaggaaagccaagaagtggaagaggatggaccaaatccaaaggagccaacgaaaagccagaaactggaagaagatggaccaaatccgaagggagcaacgaaaagccaagaagtggaagaggatggaccaaatccgaaggagccaacgaaaagccaagaagtggaagaggatggaccaaatccgaaggagccaacgaaaagccaagaagtggaagaggatggaccaaatccgaaagagccaacgaaaagccaagaagtggaagaggatggaccaaatccgaaggagccaacggaaagccaagaagtggaggaggatggaacaaattcggacgaggacgagctcactgaaagacaggaagcggaagttgatcggatgcgtgtccgtgccggtgccacctccatgcatgggcttgacaaacttgcgccaacgccaccgccgagtgccacttctacaaatgccatcgcaatacgagaaaagcgcgtcccatggctagcactcgctggattagcgatacccattggagaaattgtgataccattcgtcaccaacaaattatgcgagcatcgtacccaatattgtccttgtgggaggggaaggtgcgtgccggtaactacgtacaaggcggacgaatgttgtgagagcaactttgaatggaagtgttgccccgatgtaagtattaagttaaaaagaaattattatcaaaaattctacattaaaatagtccgggagtgagaaggcgccgtgaaattttcttgaaaatttgagtggaaatgccattgtctgttcttgagcccattagttttatggcaaaaaccttttcagttttttgaacattagcctttttatttatttttggtgcaaagaccaaaacctagttaactttttaataataaattcaaaagaccaaaaccaaaatttggacattttttgaacaaaatcctataagaagcatataacaattttcaaaaaatctctagcaactatttgcctttatcaaaattttaaaaataaacgtgcattgcatcacctccttttagtgtttttttttcatgaccaatatctttttaaatttctggtaatcattttggttttatgcaaaaacggttttaaggagccgactacgccagcacctcaactggtattaaatttaattggaacatttatcaagtcttttgattgtataaatatagggaggtaataattgtttttaaaaaaattaaaattattaaggaaaagtgcgtgcctgttagatattattgggactggatttgtatgggattctatgggcataatgaaattcttgcgagctcacctaaatgcaaaaagtggtacgagcaatcattcacgtgcatgtgcgattttaagagcgttgattggtttccagaaattgaaggaatttgtcgaaaggtatctaattatatgcataagcatgataatttacaaacgaaaaataaccctaagaatcgatccaaaaattttcaaataaaccccaaagaaatgaaaaattttttaataaataatctcaaatttttataaaaaaattactcacttttggaatttttgtgcatttaagacacaggttttttccaatttttgcacctatttttgcaacaattttggcattttcggtgtttttagaatctcttttggacttttttggcaactgttttagtacctatttcagcatttttgcacctcaaaatcccagatctaataataatataatttaatttgaaggattgtaaaacagctacacccggagcaatcgccgaaggactctgtgactgtgggtatggaaaccattgtgcagtaattgagtaagtcaagtttagaaaattattcaaaattaaaagatgaagataattcataatacatgttaatattcctaaaaa

SEQ ID NO: 59380 - DNA, 1236 bp, Heterodera glycines
  Genomic contig location: Contig_ID=SeqID_28802; Location=332..1567; Strand=-
  SCN-specific regions: Sequence locations=1-973,1003-1114,1136-1236
atgatcgacaatttttcggcagtgaagccgccaaacaaatcgatcaatgatgtgtcaacgcttaaagcggcactccaaaacgatttcccggaagtttttgaagaaggactaggacactgctcaaaggcaaaggcgcatctcattttgcggtctgatgcaaagcctgtattttgccgagctcgccccattccacacggcgccatggaagctgtgaatgccgaattggatcgtcttcttcaaattggcgcaattaagccgattgatttcagtcattgggccgcaccgatcttggccgtaaaaaagaaaaacggcaagacgagagtctgcatcgacttctcgaccggcctcaacaatgcattggaattgaaccgccacccactgccaaggccagacgacatttacgcctcactgaatggcgcgaaatttttctcaaatttggatttacgcgatgcgtatttgcaaatggaaatggatgaagaatccaagcaattgtgcgccatcaacacacatcgcggacttttccaatgccaacgcctgccgttcggagtcaaatcggcaccggcaatatttcagcatttgatggaccaaatttgtgctggcatccctggtgttttcgcgtatcttgacgatggattgatcgcaacgaaaaccctggagcaacacatcacggcattttacactctttttgggcgcataaaagagtacggtctccgaatccaactcgacaaatgcaaatttttgcagcccgaacttttgttccttgggcatattgtgtcagcaaacggcattcgtcctgacccgtcgcgttcagacgcaattcggaaaatgcccgctccgattgacaaaagcaccctccgatcgttcttgggagctttgaattattatggaagatttgtaaaatgcatgcgtgaactgcgtgcaccgctcgacaaacttctccaaaaggacgtagcttgggaatggacgtccgaacagcaaaatgcttttgaaaaagcaaaacaaataatgacgtccgatttattgctgacccactacgacccggcacgcccaatcgtcgtatcagcagacgcgtccaaagatggaatcggtgccacattaagccacacattccccgacaaaaaggaaaaagtggtggaacacgcagcctgcactctaacagcagcgcagcaaaattacagccaaattgaaaaagaagcattggccattgtgttcgccgttcagaaatttcaccgcatg

SEQ ID NO: 59381 - DNA, 76 bp, Heterodera glycines
  Genomic contig location: Contig_ID=SeqID_28803; Location=183..258; Strand=-
  SCN-specific regions: Sequence locations=1-76
atgtcccaaaaaatttttgatgatgcttgcagttggtggtactattttatccgaacggatgaaacccatgtcaaat

SEQ ID NO: 59382 - DNA, 1225 bp, Heterodera glycines
  Genomic contig location: Contig_ID=SeqID_28804; Location=402..1626; Strand=-
  SCN-specific regions: Sequence locations=1-113,135-513,549-642,664 -751,781-1146,1168-1225
  Gene Ontology: Mol. function=folylpolyglutamate synthase activity; Cellular component=cytosol; Biological process=nucleobase, nucleoside, nucleotide and nucleic acid metabolism
atgaaaatcttttttaattttccagaaagccgtcatccagctgaacgccttgcaaagcaacgcacaaacgttagtattggcacgaactcaacaggaaacgcggccagaatggaggctggaggagaccaaggaattcatggacattctcggaatttcggtcccattttattatttaatttggtttcaataattgacattttaaggagggaggctatttattttaataatccccatctccgctcccccaatctttgcgataactgctcttaatagatccctttttactgctttaattaattttcaattaaaagtaagcattttttgtatgaaaatttatcaaaattgcttttcacagattcgtaacttttggttacaaaaaattgctaaaatttttcttttctttttttttgcatttcttaaatcgttctctaacaatctgttcctcttctattcctattgtctctcagtttctctctttcactcgaatacgccacttgatattttatttttcgcaaaaaattatttttgtaaaaaaaataagattttttcagctggacgacattgaccgtctgaatgttgtacacatcaccggcacaaaaggaaaaggtgtttttttttgtttaaaaaatcaattaaaatccaaatttattttctttttacaggttcaaccgccgcttttctggagtccattttgcgttcccttggctacaaaactggcttttacaggtgtgggtgggtggcacccaattacaaaattttgaaaaattaatttttaatttagaattgctgaataatttcgattgacaaaaagtaaaaaagatttaaatatttttcatgaaatctgtataagaatcttacttttctgtaaatgtttttttatctataattggctcactctaagacatgaaaattttttattttaaggaaattttggtcaattttgaattttttgtagatgtcaattttaaatttcattttcattttttacagttctccccatttggtccatgtccgtgaacgcattcgcatcaatggacgaccaatttcaaagcaaattttcacccagcaattctttcacatttacaacacactttttgagcacaaaaaagaggtggcaaattaataatggtgctgctgttaaaaaaaggatttggcacttttggggccccatctttatttaaattaagcaacgttaacaaaaagcgcgctgaatagtcaaaataaa

SEQ ID NO: 59383 - DNA, 842 bp, Heterodera glycines
  Genomic contig location: Contig_ID=SeqID_28807; Location=300..1141; Strand=+
  SCN-specific regions: Sequence locations=1-606,628-650,687-842
gtcgaagcgttggatgacaaattgggcactcttttggcgaaggtggcacatgaacgtagaaatactttgtactgtgccattatacgtaagtttccgacatttcgatcacatcataattttcttatcgtatattctctaattatcgccccgtcttccggggacaaattttcctcagcctgtgccatattttaatagcatttagtgctctcaagcaaatttcgtgttcccaccaaatttggcttgtgcttggagaagcccaaccttactgaagcggcttccgaaaactataacattggcaaattccgtgcgcacctcgcagaaatccgtgctcatattgttacgagtggggacactcaattgatccaaaaagcgtcagtgtgtaagtttttattgcaaatttggcaatgtgtaattaaaaaatggcaaatttcaatcaacattttcaggtttgcagaagcttattgtttttttggatgaacaggattagctaagaaggataaagccggacggacaactgaattagcaacggaaattccaacaaaaaaggcaaaaagtttcttttatttgaatgatggcacaaaattacactaataattcctaagtgccatacatttaattttaattttacgtctgttactacaatttttgagaaaattttataataatttttgttaattcttaattatgctaaattttgaatgaactgatgcgaattaaactaatatgtattgtcaaacaattaccaaaataatgccattttttgcgcaaattattgccttttgacatttattagtgccgtttttgcattaattcgtgacattaaccgagttaattaatcgtta

SEQ ID NO: 59384 - DNA, 1159 bp, Heterodera glycines
  misc_feature (69)..(69): n is a, c, g, or t
  Genomic contig location: Contig_ID=SeqID_28808; Location=1..1159; Strand=+
  SCN-specific regions: Sequence locations=1-215,271-365,387-628,651 -1137
tgactacaacgaattggtggacgcacatcatctgcccctcaggtgcagcaacagctccaaacacgcggnctttctgcactcggaagcggatcggagcagggcagcagcgcatccgcggaccaaattccgtccacgcacttccaagtggaccaacactgctcaatcccggcggacggacagcagcacaaagtgagggggaagcaaaaaaacgaatggggaggggaagggaagagaaagggaatgaaaggagggggggggggaagggaggggtgagaagcgggccaactgatgagtttcaactgttgtttaaatcggcttcttctttcttccttccatttttgtcccatttgtctgtccctgttaagctgttccgtttgtctgcttctgatgttgccatttgtcctttcaggtggacattgcgcacatcgaattgacccccaccctttggcatgagtgtgtgccctcccgtctttgcagtgccttcgtttcgtgcgttcgtttgttggcattccgtcccatttctcctctttagtgcccaactcgtcaactcttcccaacttccgcttttgcccggccctctctccgttttcttcaacaacactttcacttcgacggtccccccttatccatttttaatatttaatattattctctctcagactcatctcaacttggtgttacccggtgaagagtttcggtgtcttttgggggtcgatccggcattgaaagttgagtacaaacgggcacaactgtctaatcagcaagtaaagcagccaaatttggcactctttgcacgcaattgaccccaaggtcggcttcatgtcccgctcgtgcctttgcacccatgagcaggtcatttcgcttcgaaatgcaaaagcgtcccaaagctgtcgcgttacggtgcgcgagcccatcccaaaggcggcggatgagaaaatcaaagtgagtgaaacgaattaagaaatttaattgcttttaatttcagatttctctgctgcatcccgacttaaaggcgcagagagcggaggcgcgacttttggccaaggaaagccaattggaatggaccgtcaaattggggccgggcgaacagagagaattgagcgtgaaatggacagcggaatatccggcacaagaggtaaagcgaaggcagaagcaaagt

SEQ ID NO: 59385 - DNA, 536 bp, Heterodera glycines
  misc_feature (438)..(438): n is a, c, g, or t
  Genomic contig location: Contig_ID=SeqID_28810; Location=542..1077; Strand=+
  SCN-specific regions: Sequence locations=1-180,204-395,417-536
atgcaaaatgtgaacttttttttctcacacatgtgagtgaaccagggctgggcgcaactggattttcaattacggaaatccgcaatccgcaattgcggagattttctcagttacggaaatccgcaattacgggggtccaaaaaccccgcaatttcccgcaatccgtaatccgcaagccgaatttttgtcagaatttttgaaaatttttttttcaatagtgtattaatgaaaatcaaaaaacagattttcgggatgtatcttcttatttttgatttcaattttacaaagaaattataatttttgtctctgaaaaaattcattctttttgaatttttgggttcatttttgaaaattttttgaaagtctgatcattataattggatttatgtatataaatatttcaatattgataagaatcaatagccaaaaaaaaaaatnttcggggggggaacccgaagaactgaactttttggccaaaatttttttagtgttacttaaaaaatttcagcgccggagagcaaaaacaggaattgtag

SEQ ID NO: 59386 - DNA, 3268 bp, Heterodera glycines
  Genomic contig location: Contig_ID=SeqID_5835; Location=632..3899; Strand=+
  SCN-specific regions: Sequence locations=1-601,640-759,781-1540,1574 -1737,1788-1790,1812-1958,1980-2607,2629-2886,2908-3057,3080-3268
atccccaggttgaattccgttcatgcgtgcacaacgcggttgaggatgctattcatgatgcacaaaacaccattggaggagcaaataaggtaggtgtcataatttcttcggagcttttagaccagggtgacatcatcatgcctataactccaattacatcaaatgtcgtcgatgctgtatttaatcaattttgcaaagtggagcagagcaaagctaaacacgtcaatttttacggtgccccattttttataaccgtcactgtcctgaacactgattgtctaccccgtcgacgaacgaccaaaggaagtgcccctccaattcactcttcccaatcacacatcttcaaaattaacaacaacgacaattattgcctttttttatgcactggaactgatgcgctactactcattatatatcaggggagtaatttcaaggaaacaatttagatggctcaaagataaccaaactactgttcttcgtcaaaaagtactacttttactccgcgatgccgggattccgacaactgaaacggaatacgatgccgaaatatacatccatcaagtgcaaggattatggagcataaaatatcccggtgattttgtaaatttatgtaattataataaatattttaaaaatttaggcgaatacaaaatttttattttcaacgactatcaaacccgacccatcacaaagtctgacgtcattgactaccaatttccaattttactttatcatcacgacaaacatttcgatggcatcaaaaccttgccaaaattttggaacaaacgctactattgcctctcctgtgaatcagcattcagcaataaaccacaacattcaatgaactgcacatcactctgtcatggatgtcgggaggtgggcgttgactacccatgcgagccacaacagggatacttcaaaaaatgtgatcaatgtaacaacaatttctacaacaaggattgctatgaacgccacctacacaaggatctatgcaccaaatttcagcgatgcgaggactgtggggtaatttataatgtaaagtatcacggtaaaacaggtcaccaatgcggggaaaagttttgtcgactttgcaagcaattccatgtaaaagaggatgatgaggataatccgtgcagtagctgttttatccaacccctaaaaccccataaacttaaaccatacaggatcatcgcttatgattttgaggcgaacaggataaaaaagtaggtaataaatttgaacacgaggtaaactttgtgtcggcaatcatcatttgtaccgattgcatcaatggaaattggaaggactcacttaaaggatcctcttgcaaaattcgtggaccccaccgcacaatcaccttcgcaccattcgacttctcaaacacgatagtggaccaaaaagtcaccactcaaaacccactgcgcgactttgtccaatggctactcttcgaccacaacaaaaaatttcccacggttgcctttgcacactttgggggccgctacgacatgaccatggttatcaaggaagtcgtttcgcaaggtaaaaatttattaaatatttaattaatttttatcaatcaaggtattcataaccctgatattatcaaacaaggaaaccggctctatgaactgagaatcaatcaaaatgaacacgggcctttgaccatacttcgcgacagctacaacctaatgcccatcaaattatctggactaatcaaatcatttggtctcaaaatacaagtaaataaaaattttaagtattttcgtaattttaatttttaggataaacaatattttccccacatgttcaacaaagcatcaaactacgacaactttctctcccatctacctccttgcgaatattattgtcccgatcaaatgaaagtcccagaccaacagaaatttaacgattggtacaataataattacaaccaaccttttaaccttaaggaaaaacttcctgaatattgttgtaatgacgtacaaatccttacccatgcacttgtggaattacgccgggaattcaagcaactgacacaacggaacggaaaacacgggggaatcgacattctttggcaagcaatgaccatcgccagcgcatgcgtcaagaactttgcactcaatcatttgaagcccaactcgctcgccatcgtaccggaaaaaggttatacacctcaacagaaccaaagtgcccttgccatcaaatacctggattggtacgcccacataaacaacatcaatatacagacggctcattcccgctacggtgaatatgtctttaagcgagaaggacaggtttatcaagtggacggttatataaaagggactaatgggaagagggataaaattattgaggtaaatggatgtttatggcatggatgtgaggagtgttttgaggacttggacgaagagacgaggatgccaaacggaaagacgctgcgggagattagggagagggaggtgagaaaacacgagatccttcgccggtacgtcgacttggaaattgtatgggaacatgaaatcaatgagcagttgaaaaaggacgcagcaatgaaggattactttgacaattggaaggaccgttcccccatcaaaatcagagacgcgtttcatggaggacggactggaccaatgaagctactccacacagcaaagccgggacaaaaaatcagctacaaggacttcaccagcctttatccatggaccaacttttctacaagttatccactcggtcacccaaaaattatcaactttagattaaatgagcaaactgtcaactggcgagctccatccgacaatccatacaagggacttttaaaagttttacttttacccccaaacaggaatatcaatgtgaccgtaatgcccgtaaaatttgatgagcgactcctcttccctctctatgagaagtgcgccaaacacatcaccaatgaacacccgaatggcctcaaagacgacaactactcgtgtccacacttcaatcccaatgaccgtgcctttgtctctacctgcactcaccttgaattgagtgctgccttggaggtcggctacaccgtcagaaaactcttccatgtcctgcaatacgaccaatggagcgacaacatcttcaaatcttacgttagcgaaatgatggccctgaagatccacgcaaccggcttcccttcatggtgcagcaacgaagaggagaagaaggaatacattgaggagaaccgtcagcgatttggaattttgttagacaacgaaaagatgaaggctgaaccagggaagcg

SEQ ID NO: 59387 - DNA, 1543 bp, Heterodera glycines
  Genomic contig location: Contig_ID=SeqID_5836; Location=101..1643; Strand=+
  SCN-specific regions: Sequence locations=1-312,335-355,399-451,473 -841,864-938,960-1218,1243-1310,1334-1543
atgcccgtaaaatttgatgagcgactcctcttccctctctgtgagaagtgcgccaaaaacatcaccaatgaacacccgaatggcctcaaagacgacaactactcctgcccacacttcaatcccaatgaccgtgcctttgtctctacctgcacccatcttgagttaaacgcagcattggaggccggctacaccgtccgcaaagtcttccatgtcctacaatacgaccaatggagcgacaacatcttcaaatcttacgttagcgaaatgatggccctgaaaatccatgccaccggcttcccttcatggtgcagcagcgaagaggagaagaaggaatacattgaggagaaccgtcagcgatttgggattctgttggacaaggaaaagatgaaagctgaaccagggaagcggtacatcgccaaactttgcctcaactcactctggggccgcttctccatgcggaacctcctctccaaagcaataatcaacaacgacgaaagcctgattcgccaatataccgacgacaagaaaatcgaattagtggacttggaaatgatggatgaggacaacgatgtttttatgctgacttaccgaccaaaagaagaatttgtcgacgaaaataaatactccaatgtcgtcatctccctcttcacgacatctgcagctcgcctctacctctacgaagctcttaaaaaagtagccgacacccccgactgcgaaatcctttattacgacaccgatagcgtcatttacgtgcaccccgaggaaaacgacccactaccaacaggaaagggacaccttggagaactaacagacgaaaaccccgaccacaatatcttggagttcattagtgctggctgcaagaattatgggatgaagctgcaacgcaaggacaccggtgaaatagaacatgaattaaaaataagagggttcacccttgatgcacaaacggttcaaagaattcattacgatactgtaaaagaccaaattttacgttatgggtccgatgaccccgcggaccccattattgtaacttacccccattttattcgccctaatcttatccaaggcaaagtgtatactcattccctcacaaaacattatcaacccatattcacaaaaggtattattaatgattcattccaagtcctcgaatttggttatcgcaaatgataagtatgcattctcaattaaattttctgtatattagttttcttattgttcccttcttttctttctctctgtttatatcactcatgtgggacggaatgacccctggttgatcctctccaacactccaggccatccatctgagatgaaggtggacgagctgttcattattgtaatgcgcagcctggtgcgtgagtgtttggattggggaccgaagggtgaagccgttccctgggtgtgtttactcacttttaagggaactctaagaattctgatatgccttcaaatctatcaaaagagttgcatactttctttttataatttcctttattctctattttacacttgtatttttcatttgaatgtttattcagaa

SEQ ID NO: 59388 - DNA, 1077 bp, Heterodera glycines
  Genomic contig location: Contig_ID=SeqID_28813; Location=253..1329; Strand=-
  SCN-specific regions: Sequence locations=1-263,285-358,380-1077
atggaaatgatcaacaccactcttgacaagctgtacaacgatccatcctctcctgctgcgtttgccggtgttagtgcactgtggaaggaggcgcggaaaaagctaaagaatttacgcaaaaaggatgtacaacactatttggagggacaccgcacgtacaccctgatgcgccccaggcgggtacgatttccgagagcaaaaactgttgcagcagggttcatgaccgacgtccaagtggatttggctgactttcaagcgctttctcgtcacaatcgcagtcaccgatacctgctggttgcggttgatgttctctcaaaacgcctgtttgtcgttccactcaaaaataagaaggccgaggagatgctggatgcattcaaagagcttgtcaagcaaatgccaatggtcccacaccgcattttctccgacaaaggcaccgaattcaaaaacaaattgctgaaggaattctttgaggagcaggagattgagaaacatgagcccgtgcattcgtcagtgaaagcttcagttgctgagcgggcaatccgaaatgtgaagcagcgactgtacagatactttgccgaaagggagacgctgaattgggttgatgttgtacaacaaatagtggatggaattaacagcactccgtcacgggttcacggaatgcgaccaattgatgtcaattttgaaaatgctcagaaggtgtggaagcgaatttatgaatcaccgcaaaaacgcaagaagccacgtttccgtaaagatgaatttgtacgcatgagcagagagaagggacagttcgagaaggggtatttgccaaactatggagacgaaatcttggaaattgacgaggtgctgaaggcggtgcgccccaacagatacaagctccgggatgatcgtggtgaaaaattccggggcaccttttatgagcaggagttggcccgcgtgagaaaagatgccgacaccagttacagaattgaaaaagtgtacagaaagcgaagaaaaccggatggaaccacagagatgctcgtaaagttcattgggtatcccgaacgagaatggattgatgagtctcagattgtataa

SEQ ID NO: 59389 - DNA, 1334 bp, Heterodera glycines
  Genomic contig location: Contig_ID=SeqID_28816; Location=5..1338; Strand=-
  SCN-specific regions: Sequence locations=1-128,170-212,234-380,402 -631,653-720,742-1334
aaatccgtttctggcaagaatacatggagcccattgaatcaatgcatcattccactggtaatttattggatttcaaaaataattgatttagtataatatatcataccaaaaaggggggagtgaagaggattttttttgaaatttaatatatttaacaaattattaaaatgcccaaactatgttcgatggcgcctattggcacaaaagaataattgtttttactttaatatatcatacaaaaaaggacgggtgaagatgagtttttttttgaaattgaaaatctaatagctgggattccttttagtttattgttagacatcaaccaatcagtattaatacattcctttcagctactttggctgagtccaatgccactattgtcgctggagggggtggtgggatgaatggcactgccaatgacttggattcgtcgccacttttgttgccgccggagaaagggattttagaggagaattgcggtgtcattctcatcgcagcaatcaacaagagcgacatgcacacggacctaagcgcagaacagctcgaccggctccaataccatgtgcgcaagttttgtcttcaacatggcgccgcattggtaggaaaatggaagaaaccccaaattaattattccattttatatttacacttcggctaacgacgacctgaacacacaacttttgcacaaatacattgctcaccgcattttctcactaccattcactgctcccgcttatattgtggaaagagaccgcattttcgttccgactgttagcaaaaagacagtaaaaatcctaacgaataagttcataaatgttaagggatgggactctgagcagaagctgtccatcatcaaggaagcgttggtcggttctgatcttttggatgtgccgatgttggcccagcagtccagcgatgcgtcacccttctccaattatcggtagtcatttttgacaatttttggggcttcctgatttgggtttagtagtaactttttctctaaaaatgtagggcgactggcgaaaaggaagttaaggcggaggacgagcagtcttttctcgcccggctttatacaatcgcattggacggaagtgtcagcggtcagtcctcaaccggcggtgggcaacaatcgccacggcggccgggcggagacgtcggcaaaggccacggcgacaacacaatgctcgccaactttttcagttctctacttaaagacaaagaccatcatcgtgagttagggggagacaagcgaaactttattctcgacattctgaattaatgttttcaagagcgaagtcaagcttcttcagtgaagtccgggcacagcggtactg

SEQ ID NO: 59390 - DNA, 565 bp, Heterodera glycines
  Genomic contig location: Contig_ID=SeqID_28817; Location=380..944; Strand=+
  SCN-specific regions: Sequence locations=1-465,487-565
  Gene Ontology: Mol. function=electron transporter activity; Cellular component=mitochondrion; Biological process=alcohol metabolism
atggacgccgcggcacgggggcgactgctgcacaaattggccgatttgatggaaagggacgccgtccatttggctgttcgtttcatttggtcattctccacaaacctattttaagagtttggaaactttggataacggaaagccctacaaagatgcgtttctggccgatgttccgctgtcaatcgctgtctatcgttattacgccggatgggcggacaaatgccatgggaaaaccattccaattgccggtgattatttctgctacacgcgacatgagccggtcggagttgtcgggcaaattgtaaggaggagacaaaccattattattatgaacatggcccaaatgttgcaatttgtcagtgggcactttaacggctaatttaccccaaattcgacaattaatgtgtattttcttgccttcgaccttcagatcccttggaactttcctcttctaatgcaagcgtggaaattggcccctgcccttgccttgggcaacacatgcgttcttaaacctgctgagcagaccccgttgacggcgctgtacgtagccgaactcatcagagag

SEQ ID NO: 59391 - DNA, 698 bp, Heterodera glycines
  Genomic contig location: Contig_ID=SeqID_28820; Location=57..754; Strand=+
  SCN-specific regions: Sequence locations=1-698
atgattggcatgatgaacaacgcctgcatggacggacccgcggagtttttcgcgggccgtcgcgatttgtgcgaattgcttgtgccggcctcgtcgttagcagcggtggacggccaagcgcagccccacgcgccaccgccgaaggtttttgagccgacgcagcagaaaaaactgagctacacgggcagtggccgacggttggtggacggaaagccagaagtgaacgaaacgccagaggaaatgtggcggaaagcgatgctcagggcaacctgcacaagagcagtgaaaggtggaggagaatagggggaaaagccaaaattagggggggggaatagggaaaaaaagccaaaagatgaaaattcagaaatgcttggtgagaaacgccgcaaaagctccaaactgagacaattgatcagcagccaaagcggatcaattcgaaacttttttggcacagccaaaaaccttcgccatcggaccaccggcgccaatcaaccgcagcaacaggttgaggccggtggcaaagtgatcagcagcagaacggaggggccgggaaagcccgatcggatgatcatctgatcagagtaaggagaggaggagaaagacagcgcaactgaaagccaatcagtgatcagtggagaaccaatcgccttcaccgaacaaccaaataacctcacatttctttcgcctttccctcaata

SEQ ID NO: 59392 - DNA, 939 bp, Heterodera glycines
  Genomic contig location: Contig_ID=SeqID_28821; Location=147..1085; Strand=+
  SCN-specific regions: Sequence locations=1-737,759-892,914-939
atgaacagacggtgaggaattcttttgaaaaattaaattttcgtttacccaattttttcccatgtttcagttggatttgtgcggatgtttggatggacattctgccatcttttgaccatgcccaactcggcctcaaaatggcattgctttccgaccgtttcgatgttttggtggacacgcattttgatggcaaaagcgaattcacaatttggagagcaatcgaaattgaaaaggaggaagggccaaaaccgaaaatgtttatacgaatcgatggcagttttgtggattttccgttgtctgttcgtcagatgcccaacaaaatttgctttaagaacctttggattgagtcagtcttaacttttgtgtacgctaaagcatttttatctttcttcagctacattgaccattccgtgatcaaatttctccgctccaagaagcgattctttgacaaaagtggcaccaaattggaagtgtttgtggatgcatttgatacggatgtccaaccgatttgggatatttttttccgtgaaatttggcccatttttgcgacaaacattcggcatttggcctttcacggtgccgatgctttggacaatttgcgtcgtcgcacatcgccgacacttctcactgatcttgttcaattgtattcaattacttcctatgaactgtgccccgatggaatttctgacgatgggccaaaagcaactgctggccaagcgttgtccaaatggttgcacacaaagagcaaaaatggaaaagcgaatgaattgtattgctgtgcttatttttgtgaaataacatggatcaacactttcaacgaggtgatcgagactacttaattgttcattaaacgattgactaattattgattgattgcatttgattcgtgaccggaaaatcggtcagtggaaaatgcgtcagtgatacaaatattttaaa

SEQ ID NO: 59393 - DNA, 143 bp, Heterodera glycines
  Genomic contig location: Contig_ID=SeqID_62; Location=603..745; Strand=-
  SCN-specific regions: Sequence locations=1-143
aattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaa

SEQ ID NO: 59394 - DNA, 543 bp, Heterodera glycines
  Genomic contig location: Contig_ID=SeqID_63; Location=1184..1726; Strand=-
  SCN-specific regions: Sequence locations=1-173,276-543
atgaagctcatccgcgactccatcctctcggggaactttgccgtgaacgaaatgggaaacaacaatatgatagtgtggacggtgccggtgccacgaaacgcggtaaaattttgcgaaacaaaaaaataatgaaatcttatgtgtctttcaacttcaggggcctcaatgggtcgcgccgccgcgccctttggcaccgtcttgcccgccgccgccaccacaattgccggttttcccgccgccgccaccacaattgccgtttttaccgccgccgccacaaatcggcatggcgccgttttgcccgcggccgccgcaaatgggcccagtacttgcgccactcgctcttccgccgctggcaccggcgccacttccgctgccatcatgctcaaccttcgcgaacccattcggtgtccgcgcaccgccaaacaaatgcgcggtgtgcggacgccgttttctggcgcctcgtcgacgtgcgacaacggaaaagctgccgagtgcaaaaaaggcgcgggttcacgggccagaagagccaatggacgaggaata

SEQ ID NO: 59395 - DNA, 2470 bp, Heterodera glycines
  Genomic contig location: Contig_ID=SeqID_64; Location=1753..4222; Strand=+
  SCN-specific regions: Sequence locations=1-62,94-275,302-340,378 -425,447-628,652-666,688-1204,1231-1453,1475-2470
atgaagaggggagtttctgcgtcagcaacggctaccgattccgcagacttacggacaccaaacgatgcttctgctgctgctgctactgcttttattggcgaaaacttaaacaaaaaacgagcgaaacggtcacgaagacaacagcgacgatgggactttcgcacagtcgccttctttgagcagcgctcctcctcctcatcagagtttgatgatgctgatcaggacagcaaaagcagcgcaaaagtcgaccattgtatgcaaataggctacggtagagcaccagcagcagcagcagcagcaggtaattcacagcggaacaacaacaacaacaatgttgacagcggcggcggcggcggcggcggcggcggcggcagtggtaatgaccgccgaagcgaagcagaaaacaacgccagcaatccggaagctgatgatgatgatgatgatgaaaaaggcggcgctactgctgaccaattgtatgaagagaagcagcactctgtgcatcggctggagcgtttcgcactgcagcggcacgtcaccgagtttgtgctgaacggtcagcatgagaggccggacgaggctctccgcgacgcatttgaacgcatcatcaaacgagcaatacgcaatgcggagcagcagcagcagcagcagcagaatgaacagcagtcggggaatcaggaggaggagcagccacaagacggtggcggcgccgctcaacaaagcccaagacgacgagtgacaaagattggaatttttctggatggaaacggtacttcttttttttgtttgttttggcaaatgtccccatcgaacatccatcatcatcatataggcctgactgaccctattgtgctaccgatacggccacctgagcagaacacagccgacactctgatgggtgaactggaaaagctgggacagtcggacggagacgaagacgtgcatggcggaggaatgagcaagcgatccctgttgctcagtgaaccggttcaaattgtcatcacctgcattgcaccgccggttggagcagctccgcgcttccaccattatcagcactggggttacaatgaaaggcagttgatccgaatacggaatgtcggtgaccatttctgcctgttccacgcgttgattgccgcccgttcttacactgatcatgacttgacaaaaatgattgcaccacagcaacaacaatgccatcaaggggacgtaagcagcagcagcagcaacagtgatcatcttattaacgtgccgtccgctgctgcaacagcagtgatgaggaggccggatttttgcgcaaatcatgaagtactgaatcgtcttctgtccagcccgggtcgaatgcaagaaacggtccgggggttgatgctgcatgccggcattgaccctgaagggcaagcgtacggggtggagcatgtcccgcatgttcaacagcattgggtcagtgccattttgaaaatgctttctgctgccgccacataataatttggaaaaaaacgcacacactttttaacaggatcggctctatccgggaatgtaccgcattgtgctgtttgaggaccgccctgaggaactgccgaggcctatctggaaggggccgatggggcgctgctttgtggtcgctttgttcatgtccggcggacatttcgacgcaatcaaaaaagtcaactgttttttcaagcttggccgtaaatattgtattgactgcgaatgcgtctacaccactgatgccaaacacaccatatcatgcaaaagccggtgtgctcagtgtacaagaggttattttgtgggccgtgtgcgcaaaattttgttcattgttgttgttgtacagtaggaccacagcagccatgtgcgagcgaaccaggcgtcagcatacattgctctcaatgcaatcgcttctttttttcacgcatttgttttgatgctcatcggagcggacaagcgtgcagactgctgaaacgatgcacaaaatgcagtcgaacattccaaaatgatgccaaaaacccgcaccagtgttacaccagtttttgtgggcgctgtaatgtacgttttttttttaagcggacggataaggacaacaaatttttcacaaaaatgcgcaggtataccacgaaaaagatgctgcttgtttcatcaaaaaaattcctgtcccgaaacaaaagcaaaactaccgcattttgtgctgggacacggaaacgcggctcgaacacctacaagaagcgggtcatcagcggcacaaagttaaccatttgtcggtcaacatcacgtgcacggaatgctgcgattctgcgacaggcgaatgcgtagaatgtgcgatatgcacaaccgaggagggaattttgtgcagaaagaaggactggtcggttcttcttcctttcttaatacatgcttgctcacatttttgccgacaggagtgaagcgaatggtgatgaaccgctcagggattttgtcgaatgggttctccgtgcttggagca

SEQ ID NO: 59396 - DNA, 405 bp, Heterodera glycines
  Genomic contig location: Contig_ID=SeqID_64; Location=4472..4876; Strand=-
  SCN-specific regions: Sequence locations=1-316,338-405
cgcatcaatatttttctgaactgcacaatcgccttcaccctcctctccgtatcattttggcaatatgattgaagctcgtccggcaaatagaagggtgttgttgttttattttcctcatacctatgggaaatggggaacccccaccactgaaataaccctttagttttgcttaccaactgacaaatttatcgtatttttctcgtttcattgagccagcacagtagtcttctattggcggtaaatgcggaagcctcacgtcatagttttcccttaaaagcattattttttttgacaaatgtcacagctttcggaaaaaccttcggttgaaagcatagggaaaaaaaggtttctctgcacagtccaaattgaaagtttttggcagttgatcgagacgaacaggcatca

SEQ ID NO: 59397 - DNA, 2767 bp, Heterodera glycines
  Genomic contig location: Contig_ID=SeqID_65; Location=22..2788; Strand=+
  SCN-specific regions: Sequence locations=1-114,136-178,201-953,976 -1292,1314-1328,1350-2192,2214-2615,2638-2767
catagccgtcaaaattctctgctcatctggagagattcttgccttctgatgcccgttcgtctcgatcaactgccaaaaactttcaatttggactgtgcagagaaacctttttttccctatgctttcaaccgaaggtttttttccgaaagctgtgacatttgtcaaaaaaaataatgcttttaagggagaactatgacgtgaggcttccgcatttgccgccaatagaagactactgtgctggctcaatgaaacgagaaaaatacgataaatttgtcagttggtaagcaaaactaaagggttatttcagtggtggggttccccatttcccataggtatgaggaaaataaaacaacaacacccttctatttgccggacgagcttcaatcatattgccaaaatgatacggagattcttctgaaggcgattgtgcagttcagaaaaatattgatgcgtgatataacagggggatacgatgtgctacccatctcgtgcactattgccaggtaaaaacattgattgtgtgatcatgtgaaaaaaggagaagaaatgttttaagcatctgtatgagcatcttccgggcccaattcctttgtgagaatcaacttgccattgtacccgaaagagggtatgagcggaacgacagagccagtgtgtttgctattaaatatttggattggcgtgctaaaactgatgcggttaaaattcaacatgcgggaaacgggatggaaaagcggtggagacagtttaaattggacggttggatagaagagcaaaaccgctgtattgaagtgcttggctgctactggcacggctgtgagcgctgttttgatcccggcgacaaactggtggacgccaaatcatgcagagaactgaatgaggagaccaacctgcgattgatgcagcttcgtgaaggcgatgtggacggacaaggcttgcaggtcgaagcagtttgggaatgcgaaataaatgcgcagttggcctgcaatgccgaaatgcgagcctttttctctgatttggggatggacagagggcctattgaacccagaggagcctattttggtggaagaacgggcccattgaagctatttgcagagccaaaggaggacgaaaaaatatcagtttttgatatcataagtctgtatccttttgtgaattatacgtgcgaatatccggttggcataccgaccatcatacggccaatggccgatgaaatgtgcgttaattggacacggccggagcagttgccataccgcggcattctgcgtgttcgagttgtccccccacggggtctgcgcgtcccggtgctgcctgtaaaaattgacgagcgacttttgttttgctgttgtcatcattgtgcaacgatgtttcgcaaaaaaagcacgcgccgcccacataaatgtccacacacggatgcacaaagatccttcaccggcagctacacgcatattgaactggaaagagcacttgaacacgggtacaaaattgatcgtctttggagagcttggcactatgatgaatggtaattgtctttctgtttaaaatttgtatgcgatattttttttctctataggagcgaccaaatttttaaagattatgttagactgctcatcaagttgaaggtttgtctgcagacttttgacccatctgtttaatcatgtgttttttttgttaagattgagtctagcggtttccccgagggagttagcagcgcggatcagaaacagcgctatgctgatgagtatcggcgcatttacgaagtaaacattgaattggagaatgtgaaaaaaaatccggggcttcgattcattgcgaagcttatgcttaacagtctctggtttgtatatatgtccagccgattaaggtgcagcctatttttaggggaaaattcagtatgagaaacgaacttggcgcaaacaaggtcatcaccagaccacaagagttctttagtctgctctttgatcataaaattgtaagttcataacgtatatatatttttattggcttaacaacaaaaatgtgtgtgtgtgtccaggaggtttctgcaatcgtaccattctctgatcaagcgctacgcgtgctgtacaagccaaagaaaaacttcgtttccgaacatacaacaagcaatattgtgataagtttgtggacaacaagctgtgctcgtctcaagcttcacgactacatggtacaagtcgaccaaagagaagattctgatttgctctatacagtaaacgggttttttgtgagcgcactatttttgtgattttaaggacacggacagtgtcattgttctacataagcgggacactactccacttgagactggagagtttttggggcaaatgagtgaggagtacttggattacgatataaaaacgttcatatgcggaggttagtcgtaaatagcttattcaaaatttttatgcattaaggtgccaagcaatatgcctttcgtatgcgccacaggcggacaaacgaactggaatttgtccaaaaaatacggggaattacttttgatgtcaacaacagcaaggctctgcaatttgacaattttgttgaaaaggtgctcaattatggtaaagttgatgataaagacaacgacgacgaccacgatagttctgtttcgcccgctgttttctcctatcaaaagataatgccaacgcgcgacagcaagatcataactcggaagcagttgaaaaagtatttgccagtgtgtcaaaaggggatcatcaacaacagctatgaagtgttcccttttgggtatgaatga

SEQ ID NO: 59398 - DNA, 523 bp, Heterodera glycines
  Genomic contig location: Contig_ID=SeqID_65; Location=68..590; Strand=-
  SCN-specific regions: Sequence locations=1-369,392-434,456-523
gctcatacagatgcttaaaacatttcttctccttttttcacatgatcacacaatcaatgtttttacctggcaatagtgcacgagatgggtagcacatcgtatccccctgttatatcacgcatcaatatttttctgaactgcacaatcgccttcagaagaatctccgtatcattttggcaatatgattgaagctcgtccggcaaatagaagggtgttgttgttttattttcctcatacctatgggaaatggggaaccccaccactgaaataaccctttagttttgcttaccaactgacaaatttatcgtatttttctcgtttcattgagccagcacagtagtcttctattggcggcaaatgcggaagcctcacgtcatagttctcccttaaaagcattattttttttgacaaatgtcacagctttcggaaaaaaaccttcggttgaaagcatagggaaaaaaaggtttctctgcacagtccaaattgaaagtttttggcagttgatcgagacgaacgggcatca

SEQ ID NO: 59399 - DNA, 417 bp, Heterodera glycines
  Genomic contig location: Contig_ID=SeqID_65; Location=3130..3546; Strand=+
  SCN-specific regions: Sequence locations=1-210,232-417
atggaggaaaagtacgccaaaatggaagaggaaatgtcgtcggaagacagcgatgatgccatcgattttttccaagacaccattgaggatattgtggaaaagtgggtccacgtggcaaacatgtttcgatttaattgttatattcctaataagaatcaaccgttccgaagaaaaaattaaaaaatgggaggagaaatgcagcagcagcagaagtaagatggacaccatgagcacaatgatcgaatggtaggcacaaatgctgctaatacatgttatttgtttgataaaatttccagcagtggtgtggtcaacggcgaaattgatgacatggatgatcagcaggacgatgatgatgctccaacgtcaactgtttatctgaatttgggcaaagacgagcgcaccgcggaaaattattaa

SEQ ID NO: 59400 - DNA, 675 bp, Heterodera glycines
  Genomic contig location: Contig_ID=SeqID_65; Location=3597..4271; Strand=-
  SCN-specific regions: Sequence locations=1-103,125-166,193-551,575 -579,612-675
atgctttcccaagaggaagacagagggcgtagtgtggtaaattaaaacatataccaaaaaaaacataaataaaatttacattcaggagcgaacctctgtatgtggaactgaaggatctgatgatttgtccgggcgactcgccggaatgtctctcacgttgcggacgagcgagcagcagcagcagttattaccagctagcagtggacgagttggatctgcacagcgcaagcaacagcgacgacgacaaagagaacgacgcgacttggtgagagtgctctgccgattcaaccgatgttcgccaacttggcttcacaaaatgcttcagaaaaggaaggaagaaaatgtgaaattcttgaacaaactgtcattagccacccatcacctgaaaaggaatgtagctgtttccgcagatgcgctgtcccgacatggagccaacatgatgtttgcctaccgtggattcatgggaataactgttcaacaacatttatatgtgcgtcatcgcattatgctgaaatatccccaattaccatgtgttgtacaatttggtggcaacagtcaccaggacaattttccaattgaattactccatgttgtttcagaagagcaaaagaccgattaatatgtttattctaactattactatttttctctaacataatcatgatgaagaataaa

SEQ ID NO: 59401 - DNA, 2435 bp, Heterodera glycines
  Genomic contig location: Contig_ID=SeqID_65; Location=8347..10781; Strand=-
  SCN-specific regions: Sequence locations=1-506,528-984,1006-1895,1917- 2435
  Gene Ontology: Cellular component=Golgi trans face; Biological process=vesicle-mediated transport
atggacgaattttatgtggtactaccatccaattcacctggaccagggaacacgacctcaaaattcactgtcaggcttccacatacgcttgagttggacgcaaactggatggttgcactttcatcaattatctacccctattcattcccatctgtcggaattgatgatgacgacttcatcagcattaaacttgtaaatccaaattttaaatttgcggatgacaaacgttttgtggatattgagctaaaaataccgagtatgcaattctctagtgttgggcatttaaggcaaacattaaatgatataattaatgatgcgtataaacagcggtttgggctctcatcacagaaagccgccaaagtgaaacgccaaattgacgttacggagctttttttttacgatcaccctgtcgattattgggaaaaaattgaagagttggaaaaaaggttggttgaattgagagaggagattgatacgaaggagagggaacatggtgccgaaggtacagagcagaaaagaaaaaatgaacttgaaggtgaattgaaaattttaaggcttcgcctcaagagaaaagatgatgagctggaggagcttaagcgggcagcgaagcgtcgtgatgacgacacccctgagaatcagcagaaaaaaatacgggaattcttccatcaccatccggatgatcatgaaaaaaaactgaacgagtctcgactgatcttcacaaaatatttgtccggtttgcaagaaaaaatgagtgaatatatcggtgaaagagatggagcaaaaattgtgcaacttaatgaacagacagggaagctgagagaaaaaatcaaatacttgctgcgcaatcttaatttgtttgagagcgctgtgctacagcgcgccaacagtgatgacccctcgcgaaaaactagagaggaatatgaaaagagcagccatgaacagaatagcgtatatgttcaggaattttttcaaagacacccgaccaattattggcaaataattcataacaactacgacggtctccgggaacagttcgacaagatagaagaactccaacaaaaaacggcacagaagcagctaaaggacgacgagcactcatcgttccagcagcaaattgaccgagcaaaacaactgctggaatacagacgcaagagatttgccgcattggaatttgaggcaaagaaacgtgacggacaacagcaacaatcctctccattctcttcaccaatttcatctgcattgaccgccggagaggcgttaaaggagcgattaggtgccgttcaagtgaagcagacagaaaagtcggatcaggataataataattcgatggaaaaaccaaaaacccacgctgaggttctcaaagagaaaatacaacaacaacaagatatagccacgtcgacaccaaatgagttgcaaaatgacggcaaagcagtagcagagccaaaaacccatgccgaggttctaaaagagaagctagaacaaaagaaaggcaccagcgcatcagctgagagggatggtgatcatgacagcgatgccgtcgatttactatcgcgaggtcataaattggtgagcatgattgccaaaaaaagggatggtgctcaaagtctcactggctcagcaattacaattgagcagacacatggagagctgcttaagaaaatgttgtcgttagcagataaagagcccattcgtgacgtgacgcaaaacagcggagaaggtcacacaagaggccagattctcaaagagttgctcgaaaatattgtaaaggaggacaagctgaggccgccgcctcatggttcatccgactcggatcggcaacttacaagaggtgaagctctgaaggagttgattgaaaagaaaaaggatgagaaacagcatcaatattattcttcagccaaaacgagaggagaaatttttaagctgattttagagcatcataaatataccggagaagctgaagcgagcttcaaaaggcttgttgaagaacagagaaagggaaaaactgccgcggaatttcatttcaatgagcttgctcaacgatttgtgctgaaaacaggatcaggcgtggtacaaattgatgtcagcaaacacctggcatatgttctaggatttaacagtattcgtctctatgatggagaacaagcacaatacatgcccgacctttccggcggcgttaaacaattgtatgtgtacgctcctaaactggttgatgaatccataattggcgataagatggctccattgctgagggttgttaatgtatctgcaacaccaggagggacggacgtgcccgaggttatatataccaatgaaattttccattctcttcaaaacaaacgaatttctgaaatccaaattgaaattcagaacgcatttggacgatacgtaaagtttaactggggtacttgcatcatcacgctacatttcaggcgtaa

SEQ ID NO: 59402 - DNA, 2795 bp, Heterodera glycines
  Genomic contig location: Contig_ID=SeqID_706; Location=2256..5050; Strand=+
  SCN-specific regions: Sequence locations=1-1179,1201-1247,1269 -1269,1291-1512,1534-1613,1635-2248,2270-2390,2419-2720,2742-2795
atgtgtgagcaaacacatgaaaatgtgccggattcagaagtttttccagatatggaaggcttatccatcactactaatgtgatggcaagcgtagtggcgaaaaagcctcacgcatatctaatgaccagaaaaatactggtcagaaccaaaaacaatagaagagtttggatgaaagttccatttctctttgacccagcgagtcaagctacctatatttccgaccctctcatcgagaagcttaagccacccaaagtatcttctgaagaattggaagtttatggctttggtggagagagaactggaccaataaggttccattctcccgtatactccatccaaatcaaaaggacggatggaaagtgggaagatatccttctcaataggacggaaagaatttccacaccatttaaaatggcagagtggaattctgaagaattcccattggtaggcaaggacgcggcacacgctttgagcttttctcgggaagagcccgaaatacttataggtgccagacatttctggcaattcttccaagcgaaggaagaagtttctcccgggttatttgtaattcaaacaaccttgggccctttggtaaacggagagtccgactttgggccggaaattccgaacccggaactatcaatgatggtcattgatgagtccaatcaagggcaaatgcctaccgttaaagaaattgaatatttctttaatttggagtctttgggaatcaaagacgatccaaatgaaaatgatgaccaaacagcaatgggtctatttaacaagtccatccgtcgagaaaaagacggaaggtactctgttaagtggccatggaaggaggaggtgcctgacctcccttccaattaccgcatggccttttcaaagctaatgtctacttttggtaagcttcgtaattctccagacttaatggagcaatacgatgctaccattagagaccaattgcaaaaggggataatcgaagaggccaggaaagcccctggcactcttgagcattatatccctcatcagggagtccttgccaaaggcaagaaattgcgcgtcgtttacgacgccagtgctcacaccagaggaacaaacagtctcaatgcctgtttgtatagaggcccggtaatactgccggacctggtcggaatgcttatgcgtttccgatgcccaaaattccctctcctctccgacatccaagctgcatttttgcaaattgctttggaaccggaggacagggaagtcaccaaattcctctgggtgaaggacgccagtaaaccactggcaccaacaaatttgagcacttacagattttgtcgtgtggcattcggagtgatcagttcccccttcattttggctgcgactttgcagcaccatttgaaggggtatgaatctccagtggccaaagaattggcccaatccttatatgtggataacacactccttgagtgtgaatccgcagaagaggctttgcataaatatgcagagtccaaagcaatccttaaagaaggattttttaatttaagggaatttgttacaaattccccggaggtaatgaaggcgattcctgaggaggatcgcctgaacaagcctaaggtaaaagtcctagggctcatttgggacacagacaaagacgaaattgtctttgagttcccaactaatggcttagaaaaggtggcaacacgccgtcttgttctaagcttccttgcctcattatttgaccctctcggtctaatggggccgtgcattcagcccctgaagcttttcttccaaactctttgggaagaaaagaagggctgggatgatgttctttctgagaaagaacaaactcaatgggaatccttccaagaaaattggaaggatcagaccattagaatcccacggagatcaatgctacaagggaacccatcccttcaattacatgcttttgtggatgcttcgatccacacatttgcagccgcaatttatctaagagcggcagaaggtaaccaaatttcagtttggcttattttctccaaaaatagactcaagcctaaaaatgcctcaaaagcattaacaattcctagaatggaactcatggccattctaatagggataaggggtcttaaatttatcgccgatcaaattcggcgaccaatttctaatctccatctttggggcgattcacaaatcgctctaaattgggttgcttcaaaagaagcacaaccgaaattcattgagagacgagttaaggaaattcgtactctcaatgaatgtgcctttcactttgtccgaacagccgagaatccggcggatatagcaacccgaggcgcaaaaccaggagagcttagggataagtctctctggtggaatgggccttcctggcttaaagaaggccataaccaatggcctaaagaaatagaatttaaaataaaagatcctccagaaaatctggaggaagtgtctctggataacgaagagaaagttttcttcgttaataccagaacaaaggaactgattgagagtcctctgattgaccccaaaagattcagctcttggacaaaaattgtccaagtgacactctatgtcttaaggtttctccgtctgaaacttattcagaggggaaatcctcatcagcttttcgagagtcatagaaaagaaatcgtgaaagtgtccgaaaagggaccattttcagcagaagatgttcacctagcagagaaccttctgatccgcatagaccaaataaaaaatgctgaagatttcctcagctatccttctcttaaggatagtgaagggattttgaggctaaaaaccag

SEQ ID NO: 59403 - DNA, 4681 bp, Heterodera glycines
  Genomic contig location: Contig_ID=SeqID_707; Location=67..4747; Strand=+
  SCN-specific regions: Sequence locations=1-98,120-363,385-464,486 -1096,1118-1418,1440-2166,2188-2443,2465-2923,2945-3714,3736 -3904,3928-4219,4243-4681
atgcttatgcgtttccgatgcccaaaattccctctcctctctgacatccaagcagcatttttgcaaattgctttggaaccggaggatagggaagtcaccaaattcctctgggtgaaggatgtcagtaaaccactgacaccagcaaatctgatcacttaccgattttgccgagtggcattcggagtgatcagttcccccttcattttggctgcgactttgcagcaccatttgaaggggtatgaatctccagtggccaaagaattggcccaatccttatatgtggataacacactccttgagtgtgaatccgcagaagaggctttgcataaatatgcagagtccaaagcaatccttaaagaaggattttttaatttaagggaatttgttacaaattccccggaggtaatgaaggcgattcctgaggaggatcgcctgaacaagcctaaggtaaaagtcctagggctcatttgggacacagacaaagacgaaattgtctttgagttcccaactaatggcttagaaaaggtggcaacacgccgtcttgttctaagcttccttgcctcattatttgaccctctcggtctaatggggccgtgcattcagcccctgaagcttttcttccaaactctttgggaagaaaagaagggctgggatgatgttctttctgagaaagaacaaactcaatgggaatccttccaagaaaattggaaggatcagaccattataatcccacggagatcaatgctacaagggaacccatcccttcaattacatgcttttgtggatgcttcgatccacacatttgcagccgcaatttatctaagagcggcagaaggtaaccaaatttcagtttggcttattttctccaaaaatagactcaagcctaaaaatacctcaaaagcattaacaattcctagaatggaactcatggccattctaatagggataaggggtcttaaatttatcgccgatcaaattcggcgaccaatttctaatctccatctttggggcgattcacaaatcgctctaaattgggttgcttcaaaagaagcacaaccgaaattcattgagagacgagttcaatggcctaaagaaatggaatttaaaataaaagatcctccagaaaatctggaggaagtgtctctggataacgaagagaaagttttcttcgttaataccagaacaaaggaactgattgagagtcctctgattgaccccaaaagattcagctcttggacaaaaattgtccaagtgacactctatgtcttaaggtttctccgtctgaaacttattcagaggggaaatcctcatcagcttttcgagagtcatagaaaagaaatcgtgaaagtgtccgaaaagggaccattttcagcagaagatgttcacctagcagagaaccttctgatccgcatagaccaaataaaaaatgctgaagatttcctcagctatccttctcttaaggatagtgaagggattttgaggctaaaaaccaggttgggacggtgtgaccaaccttttggttttagccatccaattattctcggaggacaatcctccatccgagacttaattatcttaaaatgccaccagaaaaggcatcattttggggtggaaggcaccctcactgagttcttactcgggtattggacacctcgagcaagaactaaggtcaaaaaagcactgaaaggatgccttcggtgcaaaaggatgcaggcataccagtttgcattgccaaaaatgcctcctttacctgacgagcgagtatgccgtcaggctcctttcaaaacaatcggcattgactttctcggtccaaccgaaacacggttggccggagagaaagtcaaggcatggatacttcttatgacttgcctcgtaacacgagcagttcatttggaggccatgcttgacacaactgccgagtcattcctcaatgttctccgacgtttcataagtcggagaggtaagcccgatttaatttggagtgacaatgccacttcatttaaattggctcaaaaaaccattgagcatttgaccactccaggagtggatcaaaacacgcaggaatttttcgcacttaataaaattaagtggcgattcattccacaaatcagcccgtgggcaggtggcgtttatgaacgccttgtccaattgtgcaaaaattgcttcaaaaggactttggggagaaaagtcctcagttatgatcaactcataacttttgtggctgaagttgaagccacattaaaccatcgccctattacttctgtgtcagaagggatggatgagttcctgccccttcgtccagtggacttccttcaaccggaagtccgaattcactgggacacgaatggtgaagaattcgatccatcggatcgaaatctttcatcccaccaaaaattagttgccctttttcaggcaactaaagaatcccatgaatttttctgggaaatgtggcaaaaagaatacctcctccttctgcgggagagaggtaaatgggaccacaagagtccccgtcttcaggacagaacagaaccaaaggagggaatgatcgtcctcattcatgaggagttcactccccgaaaccaatggtctttgggaaagatcattgagcttaatggccgaccaggggccattagaagcgttcagttggaactcccaattcatgggataaaatcaaagaggtatggaaccatgcctcggaaaatcattatcacccgtccggtgaataagattttcccattggaagtaggattagataatcctacagaaaatgaagaaaaatttgaagagagttcaaatggaactcctcaaataacaaatgagaaagaaatctctcatttggaagctccaatggatgaaaaggagactgaaactcttcaattggttgatcaaccaattgaccaaaaccggcatggcatgatcactcgcagcaaagcaaagatggggacagttttgaactgtctttccatcctttttgctatgtttgcgttggttggagcttatccaaccaatcattgcaatgaatgcaaacttctttgctttaacaaaggcgttaaagcaaagattccaaaagaaatcaacaaagttgagctctgctgtgcagagaactgttacattcatgcgaatgtaaagaagctcacttacgagctgcccaaggagatcctcctaaatgacttcaaatgcgaaggtcatttctggatggattcgaaacacatgttcaaaaaagacattttatgtccagcagttgatgagtgtgaactcatcgaatgctatttttgcattgaacagttagcgaatccaacctgttatccattgatttcatcaatgttagcagggggactttgcttatcattcataagcataagctttgtggctttttccatattaaaagtcctgttttcaggactttatatggtcatttggctgataattcaatttatcaggccaataatttatttagctggcccaaatcggcctccgaaagataggaggccaagggcaacagcttctcaaaattggacatcacgccgtgtttacagaacaatggcgtttgttgtccttatggctaactctctccagaatttgactggagcagagaccatagcagtcatggccaaatcggaaaaatgcattaaaaatgcgacaagcatgagatgcattgttgaaaactcagcaatgctgacgttgctgccagttggccaaacaaacactcttcttctgaaaacagaggaaggtgttctccttggctcaattaacgttgtgctgaaggctttagctttggaatgccaaagcttcactaaagcctggcaacgttcatacgcaattaatgtgttggccggtaaaaggtgccctaagatgggctcctgtgaaggaaagtattgtagcgaggttcgccacaatacttccattcctgagctaaaagatgccaacgatttaccaggcaattcattttgcctggacagcacagccttttggggcaacaaatgcctcttaggcggtagtgcgtgccttttttatcgttggtatgctcaggaaaagtccaagacagtctatgaaatcatgggctgtaattcctgggaatttattgtttatacaataattcgcctggaaactttgggcgaaaaacccaagtccactcaggtgttcctttatccaggaagaaccctgaaatggaacaacatcagtattactccgatcggagtaacttttccgcccgctcccgtcttaaactcagattttgtttttgacgggagcaatatggctctgacccgagagccattggcaattgacttcaactgtaaaaatcggcaagaagcaattgatttcaattgcagtcttggagttcaggcatgcactgattgcatacctgaccattcatcaggtttagtgaactgcaattgccgttcacataaccttgaaaagttaatggaaagtccagagaggagacttccattaaacatcaaaaattaccaactcagaaatactgggagaaaagtaattgccttgacaggattcagtcctgtccaattaaaccttcaaatcgaaggtcttcaaatggctttggaacttcaccaaagcctttgcaccattttgccgttgaacatatctggctgttacagatgttcaacgggagcacaattccgttatgtgtgctcgactaattttggcaattctcttgccgaaa

SEQ ID NO: 59404 - DNA, 633 bp, Heterodera glycines
  Genomic contig location: Contig_ID=SeqID_707; Location=4048..4680; Strand=-
  SCN-specific regions: Sequence locations=1-372,396-633
gtaacagccagatatgttcaacggcaaaatggtgcaaaggctttggtgaagttccaaagccatttgaagaccttcgatttgaaggtttaattggacaggactgaatcctgtcaaggcaattacttttctcccagtatttctgagttggtaatttttgatgtttaatggaagtctcctctctggactttccattaacttttcaaggttatgtgaacggcaattgcagttcactaaacctgatgaatggtcaggtatgcaatcagtgcatgcctgaactccaagactgcaattgaaatcaattgcttcttgccgatttttacagttgaagtcaattgccaatggctctcgggtcagagccatattgctcccgtcaaaaacaaaatctgagtttaagacgggagcgggcggaaaagttactccgatcggagtaatactgatgttgttccatttcagggttcttcctggataaaggaacacctgagtggacttgggtttttcgcccaaagtttccaggcgaattattgtataaacaataaattcccaggaattacagcccatgatttcatagactgtcttggacttttcctgagcataccaacgataaaaaaggcacgcactaccgcctaagaggca

SEQ ID NO: 59405 - DNA, 274 bp, Heterodera glycines
  Genomic contig location: Contig_ID=SeqID_5838; Location=86..359; Strand=-
  SCN-specific regions: Sequence locations=1-125,157-274
atgctttcaacgaaattccgtcaacaattgttggcactgaattcgattgtgcaatttgtctcgatccaattccgagtggcacaagtgtgaagcctttgccagcatgcaatgttaagccaatttagaattttaaaaaatttaaaatttcattttttagcatatttttcatgaagattgcctaagcacttggtattttttgaaaacccaattggattatattttcatattattaaattttgatgattcaaacgaacgaatgattcatattttttaa

SEQ ID NO: 59406 - DNA, 1456 bp, Heterodera glycines
  misc_feature (1404)..(1404): n is a, c, g, or t
  Genomic contig location: Contig_ID=SeqID_5838; Location=1699..3154; Strand=+
  SCN-specific regions: Sequence locations=1-170,227-239,264-419,461 -605,627-763,819-1416,1438-1456
  Gene Ontology: Cellular component=plasma membrane; Biological process= positive regulation of growth rate
cgtcaagcagtgccggaagtcgcaataatgaatcatcaaaaaggaatggcacttcacactccgcgagccaaaagaatgttggcactgtgccgcccaatgtgccgattgttctagtcatcggtagttttggactcaaaaccgaaaattttcgaaaagtgattttagcagggtttaatttgaaaaataaaatgcataattaaatttttttttaaataattataaatttgctttttctcagcaatttttttaaataaaatttaattggtttgaatcaaggtaaaaaataagcaagtgattgaaaaaaaaatcagtgacgtgtccaacagcgctcaaatggccaaactaagctttaaccaggctcttagcgccagttcagatttagttgtaggaccgtattacatttgtggaggattatggactttttttaaataaaaaattaacaattttgtttttaattattgttcatcaagaatcaatgtgttttcacaaggttcatttaaaatggcaatgaccaatgacggggaggctaattaacgaaaaagcattcaattagtaatttatttttgtctttaaggagcgccgggctccagcaaatcaaaatttgcgcaaaatatcgccaaaaaatatgatggattcgtgttcatcagcatgggcgaactgttgcgcagaaaagtgcagcaaaatggggagaatgaattgtgggcaaaaattggcaaaaagatggacgccggagaaatgattcccatggtgggcgaagtccaactttttttttaataaatatttattcaaatatattattaaaaattttatttattatactactcgtataaaatatggtgcgtttaatctgcaaaatttcattaaatttcaaaagttatgactaatgaaattcaaaaaattttggttttcaagtttggttgctttagcgtaaaattataagcaaaattttgtagtttttttaataacggcatagcacctaaaaatacgccttaaatggttgcaaaacaataaattttctattttttttttaaatcatcatattttaaggaaaacctcattttatttcgtaaagaaatttttcaaataccttttttaatctggcatattaaaaccaaaaaatgcactcactaatttactaattaatgccataatttgtaaattcactcactaatttattaattaatgccatcattagtgtgttttcgcctttgtcagagaatatgccgtgaattgatttacgcgtctgtccatgaacgctgtcccaacagttggggcttcgtcgtggagggctttccgcgcacgttggcccaggccgaggacatcgaggcacagctgggccacattgacttggcactgctcatcgactgcacggaacagttctgcaaggacgcgttgcgaaagcgntacacgcgggacaaggaggagggagcggagagggcgggtaatgggggaaaaa

SEQ ID NO: 59407 - DNA, 595 bp, Heterodera glycines
  Genomic contig location: Contig_ID=SeqID_28823; Location=313..907; Strand=-
  SCN-specific regions: Sequence locations=1-161,201-348,370-595
aaattttttgaatattatacaattgtgctttttgctctctatcaatttattataaaaaaattcacttcccttcgaaattgaaggcagaatgctcatttgaagctacgcaaatataaattaatatttgctataagaactgactatttagtcaacagaaaacaaataaatcataaaattagaacaaaaaatgattttattttagaatgcaaactgaagatgcataataagctaatatattcgaatttattttgaaataactgttcaacagattattagttgtttctaagaaataatgataggaagcttatctgaaatgtgtgctcacccaggttaatttgtcatttcctgcaataaatgttttcatataaaggtttaaaaaattcgatcgggtttagaaacgttcaacaaatgcatagataaattttttgaatattatacaatcgtgctttttgctctctatcaatttattataaaaaaattcacttcccttcgaaattgaaggcagaatgctcatttgaagctacgcaaatataaattaatatttgctataagaactgactatttagtcaacagaaaacaaataaatcataaaatt

SEQ ID NO: 59408 - DNA, 755 bp, Heterodera glycines
  Genomic contig location: Contig_ID=SeqID_28825; Location=1..755; Strand=+
  SCN-specific regions: Sequence locations=1-194,217-579,606-755
  Gene Ontology: Cellular component=peroxisome; Biological process =lipid metabolism
caccgatcaaactattactagaaatcgtacataatcggtacaatttgatcaattagtctaatgatctcagatcgtaaaagcgatacattggaagattaaattgtcatcttgcgttagatagatcagcaagattgggcaataatcagcgaaattgttgatgattggtgtctttccctaatattagacaaattaactaacaaataaatgttttaaatgagaatcgtcaaatgaatccttttagtgatcatcaagcagttgatcttttgggttcctcaagcaaatcagttcattattttatgaagctaatcacttcgaattcattcggtcccaaattctgcagaaatgccagccggcctccctccgccttgttgacaaccaacagttccaaatgggccaagcaatgcgcgtcgaatctgcttccctttggtacacttttgagcgtcagttggcccgtctgtacgtgacacggtggaagggctttcgagtcagtcgttccgaaaaatgccattttttattacgcaataaataaaattcattggtgccgaaatgcccgagggggtgcgatcttagctttctctatcctggtcaaatcgtttctttctttgtattttttttgctgtcagattgaccaaatggtggccgtcacttgtgtgttcgagggcaccgccgaggaagtggaaaggcagcagaaggcactgataaaattggctgatctgttcggcggaatggacgccggcgaggaaaatggactctat

SEQ ID NO: 59409 - DNA, 204 bp, Heterodera glycines
  Genomic contig location: Contig_ID=SeqID_28826; Location=1122..1325; Strand=+
  SCN-specific regions: Sequence locations=1-204
atgcccattaaaatttgctctcagttcgccccaattggccgtcctccgccgcccaccgcccctccggcgccgcacagccgaagcattgcgcagcagcaggcacagccgtggcgcattgcgccagaacatttgtcgcccaaggaatggaaagtgccgcgcgaggaagagacggaaaagacatcgatcagacacaaagacaaagtg

SEQ ID NO: 59410 - DNA, 54 bp, Heterodera glycines
  Genomic contig location: Contig_ID=SeqID_28827; Location=94..147; Strand=-
  SCN-specific regions: Sequence locations=1-54
atggctgctcgtaaattgagtggaaatgcaagaaaaggaaatggaaaatcgcga

SEQ ID NO: 59411 - DNA, 472 bp, Heterodera glycines
  misc_feature (338)..(338): n is a, c, g, or t
  misc_feature (356)..(356): n is a, c, g, or t
  misc_feature (403)..(403): n is a, c, g, or t
  misc_feature (410)..(410): n is a, c, g, or t
  misc_feature (466)..(466): n is a, c, g, or t
  Genomic contig location: Contig_ID=SeqID_28827; Location=410..881; Strand=+
  SCN-specific regions: Sequence locations=1-73,102-250,275-472
atgagtagtcagcaacaacagttggatgtgcttattgtcatagatggtaccaacattgataagccttgtgtattttttgatcttttcaaatttcaacatttaacttatttaatttaaaggttgatattttttcgagttctggctttgttgcttcttgtctcaattgggtttcaaagcttcattctcctaatgtaattgttgcgttatccaatcaaccgaatgatgtagcagccgaacttttaaagtcggtttatataaatgaaataaaaaatgtttcaataacttacagaaaatgggcttctaaattcaagcagcttcaggtactacttttattttanatttattaaatgttctanatgaacttaattttgcaggcatttggtgtttcaattgccaatctttnaacgatngtcttcgtgaaagtgattttcgacaaatcttagaaatgatttcatgctcatacaanatttag

SEQ ID NO: 59412 - DNA, 132 bp, Heterodera glycines
  Genomic contig location: Contig_ID=SeqID_5840; Location=69..200; Strand=+
  SCN-specific regions: Sequence locations=1-132
atggctgtgtccatcacccaaagcacggagagcggcacgctctactcattggcacagatccgtcgcattgcgaacattgcgcattcgcatggcattcccttgcacatggacggggcgcgattcgcaaacgca

SEQ ID NO: 59413 - DNA, 1888 bp, Heterodera glycines
  Genomic contig location: Contig_ID=SeqID_5841; Location=61..1948; Strand=-
  SCN-specific regions: Sequence locations=1-130,153-173,195-195,225 -275,321-346,368-496,528-931,994-1135,1201-1254,1279-1335,1362 -1415,1438-1523,1548-1807,1829-1888
atgattcaagccgacttgctttcttcattggatgggaaaattaaaataattgttaaaatcagcacatctgattacaaggtaattgtgttttcattatgttatcctaattaatattaaaatattgttgttgataagcatataataaaattattgtgagaaaatgaaattaacaattaatgaagaaataaaaattactaataataacaataataataataataatatgataagtttttttagaaagcctttaaaattttattttaaggtgccagcggtttttaaaaaattttactacataaaaatgtttgcaccaaatcaagagtcaataaaaagtgtaagttccaaaaattattttctatttataaaagaaatgggaggagtccttcgttgcaaataaacgccccagggaagactgaaaatttatggtgggatttttagaatcaaaaatttttttatgataaaacgtaaaatgccaaaaacgaaaatagctaaatacaaaaattaatgaattaattaaaaatttttttctaagttttaaatcacaattttttttaagattttggaaatttttgcacaaaaaattccgaaggcagatttaaattatgaaaaaatcgccaaattgtgcgaggaagaaggtctgaccggggccgatttgcgcgaagtctgcaattacgcctttctcgaagtcgtctcaaagcgaaaatcaaccgccattactgacgactttgagattgctgtcaaaacaataagcaatcaaaaaaaatttgtactaaaaaggcatgaaaaaaaacaaattttaaaaactttagattgacggaaagagtggtgaaatcggtctacaacaaattcaacatgaaaatgaccaaatcgttgaaattttgggaaagagggacattggagtccaaacagttggactccgacaagaatcgacaaaattaacaatttttgaaaaaaaattaatttgtaaattaaattaaataattcttatttattggacatattttataactaaaatttgtcgtttttctaaaaattaaggtacgcatgaagcgtgccatgccgtgttaatgtccaattcggattattgtgaccctgtcgaaatgaccgtcaattacgacgggagtggtttcgtgggttttaaaaaaattattgatcactattttttttaaagattagactttaaattttttttaaatatttcaccaatatctgacaaaaaattttcgggattgttgtccggacgtaattttatccggatgtgtttttgtctttttgtgtttgtatggacgtttttatgtactgttgtgatttttccgggcgtgatttccggaaaattctcaaaaaatacattaataaaatttgtaatattcagacagaaaaaaaaaggattaacacccattgcgtgtcaaaagaagaattcctgggagatattgaaattctactcgctggagccattggcgaagaagtcatttataaccgccgtttcaacggatcggaaaccgacataaaaaaagctacatcggtaataaaaatataaaaattaaaaagttatgaataagactcgttatgctacgaagtctttaaaaaatgagaaaatgtaattaaattaaaaatgataaagtagcattagacataaattgaggttttttaattttagctcgctgcagctatggtcaaagaatatgggttttatcccgaagaaattgggtaccaaaactttttggtaattaattatctcaaggaaaaaatttacaatattgttttgaaaaggtggaaaaaccgtcagaagaaacaggcgccatgattgaaaaattgattagaaaaattctgaaggaatgtgctgaaagggccgaaacaatgattagaaacaaaaaggtaaaacaataaa

SEQ ID NO: 59414 - DNA, 747 bp, Heterodera glycines
  Genomic contig location: Contig_ID=SeqID_28832; Location=141..887; Strand=+
  SCN-specific regions: Sequence locations=1-17,39-668,690-747
atgaacttccgtggtgcaacggaagcatatgccattgttcattcaatgccatttgccaaactttcacatcaggttgtcaaacttagcatccatatgcctaatcaacaaccgattgtgtacagggcttttcagctggtgagcaaagctcaacaaatccagcaaggcgaactgccagagacgcaatgttctgcctattggaaacaatggcaaaatgaatggaagcatgatccgaagctcaaagatatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctatcgcgctggcctgatcaaatgaggtggctcttcatgagcatcctcgtttatggccggcccagtaatgccgtcgaattatggaacaagtacaaagaccaaatgtactttcctcaaggcattaccacaccggcacaacgccaagcagcagagcttgaagccctagctgacattgattggcggctgcacagctgctttaacttaagctgtgcattttag

SEQ ID NO: 59415 - DNA, 147 bp, Heterodera glycines
  Genomic contig location: Contig_ID=SeqID_28833; Location=362..508; Strand=+
  SCN-specific regions: Sequence locations=1-147
cgattggcccttttctcacgcaaacgttcgatgctttttgttggtcctggggaactttgtccgattcccggccccgcctcaacgaaaagcggacacatggccaaaggaaggaaagcgaagtcggcccagaaccaaccatcgaattga

SEQ ID NO: 59416 - DNA, 443 bp, Heterodera glycines
  misc_feature (68)..(68): n is a, c, g, or t
  Genomic contig location: Contig_ID=SeqID_28833; Location=1017..1459; Strand=-
  SCN-specific regions: Sequence locations=1-201,224-303,325-443
cagcatcaacggggggatggttcggaggggaagccgaccaaaatggacaatttgcttcatctggaccncacgcgaagtcatttctgacgcgactcgattctgcgcattcgccggtctaacattttgccaattttgagtgtaatgaaacacaaagttctttcttcccaaatcccttcagggctctccgaattcgcggaattctttcatgcaaatgatggtgttggaccgaagcagacagccttcggccgatgtgatcatattctcatcatgatcagctgatcatccccatcccaattaggtcattgagactgtgtgccttcagaacggtgtgtgcacttgtgccgaaacgacctgcactttgcgctgctcttcgtgtgcgcgactcactttccgagagatttgcctgaatatttattcacctcatggtcaaatgcaaaagtttg

SEQ ID NO: 59417 - DNA, 224 bp, Heterodera glycines
  Genomic contig location: Contig_ID=SeqID_28835; Location=1434..1657; Strand=+
  SCN-specific regions: Sequence locations=1-49,79-224
aaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaat

SEQ ID NO: 59418 - DNA, 225 bp, Heterodera glycines
  Genomic contig location: Contig_ID=SeqID_28836; Location=1348..1572; Strand=+
  SCN-specific regions: Sequence locations=1-168,190-225
ttttaaaatttcgaaaattttcaaaatttttcgagctaggcctaaaaaacggttttcgggtttttgaattttaagattttttaacgatttttcccgggaaaacggagaccacttccaaaacatcgtttttcgagctctatcgactggtattttttccggaaaaatttcgattttttccaggaaatagaaaaaatttttggcctgagcgggacatttgagtcccgg

SEQ ID NO: 59419 - DNA, 213 bp, Heterodera glycines
  Genomic contig location: Contig_ID=SeqID_28837; Location=81..293; Strand=-
  SCN-specific regions: Sequence locations=1-20,102-120,142-213
atggaagggaacgaacaatgggaggaggaggaagacgaaaaagaggaggaagaaaagggaatggaagaagaaatgggggaggatgaaaaaggggaggatgaatgcatcgggggcaaagcgtttgtttttgttggtgttgtgcagatttatgctgatgcgagagagggaatcactgctgccgaatttactgcgatgcttcgatggacaatttga

SEQ ID NO: 59420 - DNA, 166 bp, Heterodera glycines
  Genomic contig location: Contig_ID=SeqID_28837; Location=709..874; Strand=+
  SCN-specific regions: Sequence locations=1-35
atgacgcagttcagcgcgagctttttagccgggcaaaacgaacaaaaattaaaagaaaatgagaaaacgaacagcacaagaaaaagaaaacgagaggaaaaggagggagaggaagaaagggagggacagaaaggagacgaagagtttgagagagaagaggaggaag

SEQ ID NO: 59421 - DNA, 1849 bp, Heterodera glycines
  Genomic contig location: Contig_ID=SeqID_5842; Location=145..1993; Strand=+
  SCN-specific regions: Sequence locations=1-27,49-622,644-1161,1220 -1234,1372-1697,1719-1849
atgcgttcagttgcaatttgtgccgactcgacgagaacacgcggaagacaaatgcgaaagtatgggggcacaattagtcgatgtaacggacggagaaggcgaattgaacgaggcgatggtggaggacctatcagaactgcttcaagtaatttagggaggggaatgagactgaaaatggctttttggaggaatcgctggaggcaggggtcaacgaactgatttgggtggtcggggcgggaaagtggcgatcggagtgggacgagtcgggggagagagtgcgcttcagccgcagagaggcgcaacagcagcggcaggagggggaggaggaggagggcatggagaatgtgttggcactacaaaggcgagtgaggggcggaggggacagcccaaaagggggccccgcagggagtcactttgaaatgtgagtcggaaggaattggcaatggcacaatgccgaacgcacttttcggtcagtgttctgctccatcctccctctgtgcaccctttcatttgccaactttggcccctttggcgccgtttgctgctctatgaacagtctctgctccccaaaggtttcgcttcccccccccccctcctccgtttcattcactttcttctcaatccgctgaaggtgcgcctctcctggaagagcagccgcgtccctcctatttcttcgaccccaattcctccgcctccaattcgtcctttctcagtttgccatgttccgcttcgggcgtgccctccccgacggtccgttggtttcgcaacggaggcgaagaggtcagctggcaattagcatttcgtacggttcggcaatttttgcctttctttcttcctcagattgacttccgcttctcctctttcattctctccgccggtgctttgctcgtccccgtttctcttctgtcccccgtttctccctcctccttccattgctccgtttccaattctttcggtattttcgacttttctttttctttcgacttttatttcttttcttttaggaacccttcgtggccattcgaccatcgttcggcccgcattcattgagccctttcaggagatgagattggatgcttatccgttgatggggcacggacgaagagcgggcggcacgcggttggaatgcaatgcaccggcacattacccaagtgggaaattgagagggggggagagggaagaaagagagggagagagagaaagaaagagaccgagagagcacgatgaaaacccaaaagagagagagagaatttaagaaaaaaagagaggggagggagagagaaagaaagatagctatagagcacgatgaaaacccaaaagagagagagagaatttaagaaaaaaaagagagagggggggggggagggagaggttatgaccaaaagttacaaaataacgaagaatggccgaaatttttgcctttttctattttaactagagttgtacgggaccgggaattttgagaaaaactgggatcgggacttctctggttgaaaaaccggtactttttggctggcaaaaccgggaaaaaccgggacttagatactcagttgtacgttttttcagtaccagtcccggtcccgtacaactctaatttttattttttgacgttgtatatttatcatccaacctttaaaacaaattatttgtgtaatgtcattcaatatttttgttcagtcatatttatttgtctgatttttgaatttgaaaatttttaagaaaataagtaaactttttacatcttttcctttctcgtcctttataaaaaaaatcttcaaaaaacggaaaaatttgaagggaatcgaaactcaaaaaccgagattctcgagcagtctattgctgaggaatg

SEQ ID NO: 59422 - DNA, 126 bp, Heterodera glycines
  Genomic contig location: Contig_ID=SeqID_5843; Location=42..167; Strand=-
  SCN-specific regions: Sequence locations=1-63,108-126
atgaaaaaatggatgcgggaggggaggaaggaggacgatgaaatggacagacggaagacgcatgaggaagaggaggaggaaatggaagaagaggcggagaaggaggaaagtggaagggagatggag

SEQ ID NO: 59423 - DNA, 174 bp, Heterodera glycines
  Genomic contig location: Contig_ID=SeqID_5844; Location=2170..2343; Strand=+
  SCN-specific regions: Sequence locations=1-78,113-174
atggcattttggggcaacggaacgtacgcacttttggtggattggaaggcggtggaactgacaatgagactgacggagggagaagcagaaggaggaggaggaggaggagaagtgaaagaggtggaagcaatgccatcaaaagaggaggaacggtcatgggacagagggtacaaa

SEQ ID NO: 59424 - DNA, 306 bp, Heterodera glycines
  Genomic contig location: Contig_ID=SeqID_5844; Location=902..1207; Strand=+
  SCN-specific regions: Sequence locations=1-306
atgacgtcgacggaccgtccgaattgggcggggcactttcgcatggacggattggaggcgaacgaacgctatcaggtgaattttgccaaaacggactttgatttggtaatggaatggtcgctccagttccgattgcgacccttcggcgaaggatcgcgtgccgtcgccctttcgcaatgggtgcgcacggagcaatcggtgcccgtggaagcagtccggcacattcgcttccgaatgttggacgacacgcatgtgctgctcgagtgggagccggtggagaaggtcgtgctgctatccttggcataa

SEQ ID NO: 59425 - DNA, 671 bp, Heterodera glycines
  Genomic contig location: Contig_ID=SeqID_28842; Location=103..773; Strand=-
  SCN-specific regions: Sequence locations=1-311,338-431,461-671
atgcgccagctggtcatcaaccattttggcaggtaaaggcgccgaaatcggtacgacacttgcacaagcaccaccaccaccaccccacactcatgcacagttttttttttcttaggcccgagcagcgcgccaaccatggtggtgggggcggaggcgacattgcggaggcggccaccgagcagcggaccattgccgtgccctgtcaacgctttgtgcgcactcgacaggcggacatcttcacgcgtcgctccacccgcgtgtaccgccccgtctacaccaaggggcgtgtcctgcgaccaccaccaacagcgggaggcgaggcagccgcggcggaggaagaagctgaagcggtcacgccgacgcctctgtccatccgcacgcgaccgtttggctggtgttcggcagaggcgcagcaaatggagacagatgatgaggaggaggagggggaagaggaggcggacgcgaacagtgatgacgctggcggcgagagcgatgggctggagcagccggtgcgcaagcgggccagggccgagccggtgcaagaaatgcttgtggaggtggaggaggcagcggtgccgccggcggaccccgatctggaggaagagccagtggccggctgttcaacatggaaccagcagagaaggctcaacgagcacatttttcgaaattga

SEQ ID NO: 59426 - DNA, 498 bp, Heterodera glycines
  Genomic contig location: Contig_ID=SeqID_28848; Location=644..1141; Strand=-
  SCN-specific regions: Sequence locations=1-363,385-498
caggccgaggccaacaatttggtcgtggccaagtctctttcccctcgtgttcagcaacaaccgctcgccactgtccagtcatttagcccaacaaatggtgccattggcaacgaacaattccgattttcatttttctcttcagtgtgccgtcctccgtggactcctcagacggaaaagcgtcggctgatcggtgtcaaagacttcgtcagtcaaaacactttcagcaaagaggcggcatcgaacacttgtcacgtggcagtgccctcagtgacaccaaatctgacgaaggtttcggcactttcttctgaggtggccaggcgttgttcaacttcggcactttgtgccaacggcagcaattttttgggaaaaaacgatggcattttggaagagtcgacgaaaagtgcgaaaacaccgcagaaattggagaagcaaagccatctgacgaaatatataccaccaaaaaggacagcggaggaacttttgttggacaaattggag

SEQ ID NO: 59427 - DNA, 618 bp, Heterodera glycines
  Genomic contig location: Contig_ID=SeqID_28849; Location=430..1047; Strand=-
  SCN-specific regions: Sequence locations=1-467,491-618
atggcagaaaaattgtgggaaaaggccaaattggggacaaagaccgccaatgaatgtgtaggagaagaaatggggcaaaaaatgatggaaatgtgcgcgggtggaacatcaaaagcgaaggaaattgcacaaaattgggggaaatcggcgctaattgccaccggacaatgcgttttggcacaaatgcaaacggaggaggagcaaattcaagaggaacaaaatgccgagggcatggcgaaacttgcggaatttgacgcatcgttcaaagagtgtgcgaaggcattggcacccgaacaaaaggcaaaaagtggcattgacatggaggccaaggccaaccagcagctgaagcccagcgacctggtcaatgcggttcttaaaaacaaggggaaagccgacgatggcaaaagcgaaggaaatgatgacaaaaaatcaaagaaaactcagaaaaatggaaaattaataacattggagaaggggaaaggcaaaggcaacttagagttctatccctacatgggaatgatcgttgtcctcttttttcttggccaacaaagtctaattgcctctcttttgcttctgtgtgcgctcccgtggatattgcgcccgaaaaattcagactga

SEQ ID NO: 59428 - DNA, 661 bp, Heterodera glycines
  Genomic contig location: Contig_ID=SeqID_28850; Location=195..855; Strand=+
  SCN-specific regions: Sequence locations=1-661
aaacaaaaaaatcgatttttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagtaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaattgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 59429 - DNA, 250 bp, Heterodera glycines
  Genomic contig location: Contig_ID=SeqID_28851; Location=1323..1572; Strand=+
  SCN-specific regions: Sequence locations=1-169,208-250
atgcttattaaaccattgtttactttctcaattttgttggcgttttttggccaaatattttgcgacattttgggccgtgaacaaagtgccggtgccaaaggtttgctgacatgtgagggaaaaccggcaaaaaatgtgaaggtgaaactgtacgatgatgaccgaggtgaaattaataataaattcaatttttaatttataaaatttgcagggattgatgcggacgatttaatggtgtgaaaaaaacaaa

SEQ ID NO: 59430 - DNA, 755 bp, Heterodera glycines
  Genomic contig location: Contig_ID=SeqID_5848; Location=494..1248; Strand=+
  SCN-specific regions: Sequence locations=1-55,79-212,234-312,334 -533,556-671,693-755
atgttaagcattgagccgcaaaagcgaatgactgccaaaggaatcattgactatttggaggggaaatgtaagccaaaggaatatgagaaaaacgcagaaaaaatggcattgtttggcgatgtgtcggctgaaaaattgagggaattgatggaaaaggaaggatttaagcgaacaacaatgaaaaaagtcaagaataatttaaaaagtgccgaagaaaatacaaaaatatttatgcaacagttggaagaacgaagcgaattttgtgagaattaatcgccgtcctttgggtcaattgaaagagaaacggcacaacaaacggaccaattaatttaatattgcaaatttcagtttcaatttggcaaaattttccaattttgtcattttctaatttattgacttgggtggtcatcccattccctaatccctttcgtcttttttctgagagcaactcgctcaaattatcctttcgaatcgtaagtagagttgcacggtaatcggtaattgtaaaaaaaccggtaccagtactgaccggtaatgcaaaaaccggtaccggtaccggtaccaactttttccaccggtaccggtaaaaaccggtaattttccaacgtaaaaactgaagatcggagaacaccaaacattgctcaattccatttttgataggcatattggattcctttgatacacaaaaagctaaaaattatcattttccttccccattttgttaaaatattgttacttttaatatttttcatcaa

SEQ ID NO: 59431 - DNA, 374 bp, Heterodera glycines
  Genomic contig location: Contig_ID=SeqID_28853; Location=411..784; Strand=-
  SCN-specific regions: Sequence locations=1-374
atggcggcggattacattcagcaaaatcccgaggatttccttccctttttggctaacgaaaacggagaaatgttcaaagatgaacagtttgacgactactgctccaaagtggcgcgaatgtgcgcaagcggcggaacttggggcggggagccagaagtgagcttttcttctgccaattgactttgaattcctaccattttcagcttcgtgcattgagttgcgttttgcgctgtcctattgaagtgcttcacgcggacggagcaacaatcaaatttggcgaagtgttttctggccatcctctcattgtgacctaccacaaatttgcctacactctcggggaacattataatagcactaaaccgaccggagaatga

SEQ ID NO: 59432 - DNA, 717 bp, Heterodera glycines
  Genomic contig location: Contig_ID=SeqID_28857; Location=206..922; Strand=-
  SCN-specific regions: Sequence locations=1-22,45-717
atggagcatcttaccgatgcgcctccatgggcttccgcaatgttgggactggtgaaccaaatggttggaatgtgccgcgagctgatcttcatggtacgcgagcaggacggaggaagcaacccgaacagtgtttttgacgaagaacgacgactgcacagcgttgtcatcgcgcaattgcaggaaagcaacagccaaacgccaactcaacgtgcaaccgatgacttggcgaatgtcaaagaactgatggaccattgtgacatcgaatgcctgccgacccaagtgtacagaatgggcaaaaaacaagccgacggacgtccaaggttgctcaaagttgaactcccgaccaaattccataccaatttatttttgcgcaacaaaaacaaaatcaaaaattttaacaaattttccaaagttttgttgcgcccctccctatctaaaagtgatctcattgaccgtgcccgactcattacactgtgtaaatctcaacgtgaaaatgacccatcctgtgattacattgtctatgcggggcatgtgcttgcccgcgacgacattcccgcctttaaatctgacctcaattttaaatgtatttgtcataacaaatcttaatgtgttttgggtgaccactcacgaggcaataaccttaatttatctcttttacaaactaaatataggaaaattgaacaccccatagaaaattcgaaaactttactaaataaa

SEQ ID NO: 59433 - DNA, 291 bp, Heterodera glycines
  Genomic contig location: Contig_ID=SeqID_28858; Location=167..457; Strand=+
  SCN-specific regions: Sequence locations=1-291
atggcgcaacattcggccatgcgatttgtgatggctttggaacaatctgatgtcatttgtaattaatactatcatatgtaaagggtttttacagatcttggggcatcagaattttcggcaatcattttattttcaatgctttcccagcggtccaacaatcgacgacggagacacccgatgacgtgcccgcccatggttatgcctgcaccaccggcatccatgatttcggctatcacaccattgatgtgtaacagctccgtcacattgtcacgaccctttgatagattttag

SEQ ID NO: 59434 - DNA, 580 bp, Heterodera glycines
  Genomic contig location: Contig_ID=SeqID_28858; Location=556..1135; Strand=-
  SCN-specific regions: Sequence locations=1-195,217-322,344-370,397-580
atgctggattttatgctgcaaaatttgacaaaagaccacttcaagataattattccacatctattcattatttgtgtcgttgtgagcttatttttgcaacgcttctcttcaaaatgaaatttctactatataaaataataatctacaattcccaaatattcattcatgcacctccaaattaaaacttcaaaatattaattactaaacacacaattattcttaataaagcaattaattagtcattaactaataaattttgatgacttcctgtatttgcaatttattagaaatcatttaatcgacactaaaatattttattaaaatacacataaatttattcccacaatttgttagtgaatttttgtttttgtttaattaatttaatttttataatttcagaaaactctaaatatcagctattcctccctttctatccccaaaaaaattcttcgccaagatgcgttatttgattgtccaaataactccaaagaagctcgtgatttgcggtcacaaactggatcttaagtgtgctgaagagtacgatctagaaattttgtcaaagcccattgaggttaataaa

SEQ ID NO: 59435 - DNA, 494 bp, Heterodera glycines
  Genomic contig location: Contig_ID=SeqID_28858; Location=1136..1629; Strand=+
  SCN-specific regions: Sequence locations=1-169,192-379,401-463
atgaccatatcaacatacgcttggaattcatgtcacaaaaaagtttttttccgtggaggtatctcactccagttcaatacaatgcgcattttgttcaagtattttggaataattttgataaatattggttttcaaaagggaaatttttttacggattttttttcaaattttataacaatgttttgtgaaatagtccatttgaaatcatttactggtcgatggaccataaaaagcggagtcgtcaccctcgtcaaacgaatcctaaatttatgttaactaattcattttaattggtaatttactctttggccacgcgaacgtttagaccaagatttgcattcgtattgaaattgaacttcgtcctaaatagtttattattttttacaggatttattgctattgcacctgctccttttggtcaattccaacgaacgcgctatcgtcgcactcatcgaatgaatcctatatttattttgttaataattattttttaa

SEQ ID NO: 59436 - DNA, 1277 bp, Heterodera glycines
  Genomic contig location: Contig_ID=SeqID_5849; Location=773..2049; Strand=+
  SCN-specific regions: Sequence locations=1-428,450-946,970-1091,1113 -1247
atgaccgaaaaaaacattcgtgggatgcgattgtgtgcggatactttctaccatttgcgacagttggccccgtcaattctcaacgattgtccattgttacgcgttatcaatttccaagtcaccgatctcttcacagaatttcctgcagatgacagtgccatggcatcggatggacaagcggtggccaaatggcttttcactccacgttcggacaatgtgccaaaggtggttgatctgctcgtttgacacagatgttgggaatttggcagtgcgaattgaagccttcaaaacggtaattttcaatgatcatttggctcttttacattgtttgggttcgtacattgatttcgacctagtcgaaccccgaacctgggttcgaagaaaaaacggaaacactaatttcgcatttttggtcttaaaatcattactgttgtaaacttttgctttttcgtgccatcccgccaaccgaaaagtgtcattcattcattgatcatttcgtattttcttaatcaatttttccaaattttaggcatttgcctcggcttcttctcccgtcaatttcttgtcgtcatttgggttttcccgccgtctttggccgactccgttttgccatttgatcagacgaacgaattgactcgggaacatttggcattgaaaagaagcgttaatagagacgactgttttctgttggtccgttgtccaattacgcgaaatgaaagcaaatggacaaaatgggaagaagaaacgattggaggggacttttttgatcagtggaatcgaattgacattaatatttgggaggacgaaatcggagatgggtaagcaaacgctttttcaaaaattcaattttattatgtatttttgttttaagccttctcgacgcaactcccggcccaaatgatcagcagcagtagtgaatgaatgaattgttgagaagtgatcgatcaatatgaattattgaattggaaattgtcgtgctcattaaatattctttttttgtgatcaacatggatttgtaatgcgtatgtcttaaggataaatttaatgatttccttaaaccgaaatccatcggtaaaatcaaagtaaaattgaaaaagtgcactgaaattgtgcagttttgaacgcattggtcaccaccaattttcctaaacaaagcaagccaacaatttcacctatttgagggaatgggtcgtttcggcgccaagccaaaattaaaaaatcatgaatcagtgggaaatttttgagcgatttaaattttcaaaaaattaaaaatttta

SEQ ID NO: 59437 - DNA, 286 bp, Heterodera glycines
  Genomic contig location: Contig_ID=SeqID_5849; Location=2234..2519; Strand=+
  SCN-specific regions: Sequence locations=1-227,262-286
atgccaaattggggagacaaaggccgcgttaaacgaaaattcggcaatttgaataatatcagctttacgttttatggaaaatgcattgggtgagtggcaacagcttttgctgctttaataatgaaattaaaattgcgcttaatttaggccattgtctccaccggcagaagaagaaaaagcgggacaaagcgtcgaaaaaggggccccttctgacaaatgagtgacggacaaaagaacaacaacaaaaacaacagtgatcagcagaagaaatgaattaattccagaa

SEQ ID NO: 59438 - DNA, 1573 bp, Heterodera glycines
  Genomic contig location: Contig_ID=SeqID_5850; Location=592..2164; Strand=-
  SCN-specific regions: Sequence locations=1-6,28-527,552-593,633 -1018,1040-1266,1316-1391,1426-1573
atgtttaacaaaaatgcaaataaaattcaaatcttagtaagaattcgagcccgggggttagggtgccggcagggcttttgccggcaactcaggcccggtaaatgttgaaaaaacacgggggcccgggccacgcagtaaaacgggctatttttggccggccgctcgggcccggtcattttgacagggctaaaatgggcttaaattcttcagttaaactgtcataaaaatacgaatcgtctgtataatcgtatttacttatatcgtcaataaatagggaccaattttattatattttttttgcaaatttggactaactaattgatccgaaaacgaatttctaacttggtttggtgcctctagcgtaaattttcttgcttaattttgctctaacgagatttttgtgcttaatacgaacatttaatttgtacgcttaattgaacatattattgtgcgtaatttggtgtttctgaaaatttcttaacaaaaattcagtaaaaatgaaaaatgaaccgcctaatgatctgcatatatttttcatgttttcaaaaatacactcatttactccccaagaatcagatttttaggcgaaatcgaaattatttattcattaataaaatttaagatttttttttgcattttcgaaaaaaaataattaaaactcttcgccttttttcttcaccaacactgtgataccaccacaaaaaaggagaggtagcgagggaaggaatggcaaacattatgtgtatgctatgtgtgccgaagattgagtcagtcgagacctcatttagcgccagccgcgggcaaaattctactgcggaacatccattcctccgtccgcctcagagaaacacaaaaaaagtgtgtggcacgaacgagtgagtgcagagaagcaaagaatatctcggggcttaacactcaccaatggttaaacaaacagcgaaaaaagtgaactttggctcctagagcaaaattgtgctccattgaaaaaagatacgtaatttgggaatcgctagcagcagctctgcctcggttcgctgctagctttttgtttctggcttttggccttccattcactttttatttcggcagaaatggggaagtgggagaataatagtttgtgttatttgaacaatttttaaattttttagttttcgatgggaagaaaacgagactattttttaatcataaaatactaattatcggcttaatttaaaaaattgtccgacccatttcagcaccggtttttggattgaccaaatgatctgaagggagagagagatgagagagagtgggtgagagagaggaacgagaaagatgatcagaaaaccaaataacagacagagagcatgcagagtcaatgagaattggcagtagtgagagatttggagacctaattaaaaatacaaaaaaaaaaaattaaaatatgccgggggaggcgggaggaaacacgcgttgtttgtgagagggtgcgggggagaataactcatcgctggcactttagttaaattcgagtatcacggtgatcatgcgggtttgaatgccatgggaaacaaaggttgttagccctaataaa

SEQ ID NO: 59439 - DNA, 817 bp, Heterodera glycines
  Genomic contig location: Contig_ID=SeqID_5851; Location=213..1029; Strand=+
  SCN-specific regions: Sequence locations=1-50,77-189,211-261,290 -704,726-817
atggcctcccttctgaacacctcctgttgtctggtaaaatagagaaaatgattttttaatttaattttatttttttgcagttattcatcaacatcattctcattggacgtgtattggcatcagcacaaagtgaaccgggcgaaaatgagtggttcagcaatgatgtaattgttttatgaaaaaaggcgtggggcggtgggggagggggcaagtttaactgatttgactaagtttaacctaaattaggacttattatttaggaataaaaataaattaaatttaaatatttctatcattgatactttgaaaatcgcccacattaatacacgtgtaacttcgtcacatagatatttttttaagttcggctcaccacgattttgaacgtgttgcttttcagctcgttttatagcgtagtcggttgaatcccggcatggttttggcacttctttccctgcactttttaagcctgaaaaggcaatttgagtttgataactatgatcattataagagattaaacggacgcaaacaatctttcttttaatttttctccaaaacaggttcaaggcttcttaagcatattatcacgtaaaaaaatttcttttacattttcgaattcttttcatcaatcgagaaaaaaaaattaatattccattgaacttgaagtccatgtccattagtgttatcttactccggttttatgcctttttcaaaataccattctatttccttcaattatataacattttagacaaacatgctggacaagagcgcatttactctacatgccgcagctacaggatcggtcgataatgatttg

SEQ ID NO: 59440 - DNA, 1465 bp, Heterodera glycines
  Genomic contig location: Contig_ID=SeqID_28862; Location=353..1817; Strand=-
  SCN-specific regions: Sequence locations=1-3,25-388,410-604,673 -695,719-757,779-850,874-925,987-1044,1067-1074,1099-1147,1170 -1241,1284-1300,1322-1465
atgtccaaaaatacaattaaatttaacattcttggcaaacccgaagtaaaatttttgctacataaaatgccataacgtgaaataaaaaccaattggatcaatttttagaataatagaattaatattttcaaaattaatcgccttatttataaaggaaagaaattaaaaatgatctgtaggcttttgagcaattttacaaaaaatatagagcacggtttatgaattgttgggtttataaatatccgaggtggcaaaatttacgaaacgaattagagttctaatatatggcacgctgttcatttttcacaggcatggttgagccgacgaagttgtgattttctagtcaatttcgcctggattaatgccaccatatcatacagaggagatgtttctgtcaggaatatttgtcagatgcagcccggatgcgaacgcaactcggcgtgccattttttgaaattgttaagcactcagcgaatgcatgaactgtgagccatagttatattaatgcagtacatttgagcgtctgggtcagggtcttgactcgagaaatttctgtgattcggatcccaatctcgactattgatcatttaacagactaaccgagtttttaaaattatttattttttaaattaattagagtaatttacatttattaattatagtataatttatctagcaattctattttaaacaattatttcgtttggtttttttttttgggggggggggggggagctgccaggaaatcaagaaattttggccctgttttttcatagggtttgcacaaaattttggctttttctggaagtttttttaaattagacaaaaatgcttacattctcagatttgaccccaaaaagatttcttaaaaaagcgacgacttttttctttttacattattttttccaattattgtgtctaattcaaaaattataaaaaaactaaaattttttgaagtattttataactgaaaatttttaaattttctcaaaatctcaaaaacaagcaaaaatcataaaaataataattctcacactggatcttcctggcgccgcttctctgccagtctctaagaatattaaaaatatttaattttatcgagaaactaaattaatgtgtaaaatgtatcagtctaataaagaagattaaaatttgaaaagctgtttaatcatgatccaaaaaagaatccgagacttttctttcgtcaagataatgtttacacaattaatagaatttatccgaatattttattatttattaatttaatgattaatattataattccagaaaagattattatctctttggaaacagtctgttcgataaggaaactctttatccgttaatagacaacccatgcatttgcaaggatggcttgcaaatgaacgtgcgcgttgtcggtgatttatatcggaggaatatggccatcattcagttggacggttcagtttttttcaataattga

SEQ ID NO: 59441 - DNA, 96 bp, Heterodera glycines
  Genomic contig location: Contig_ID=SeqID_28863; Location=182..277; Strand=-
  SCN-specific regions: Sequence locations=1-11,42-96
atgacgactgaaggaagagaggagaaggagaagaagacgaatgataataataataatagggacgggggaatggtgctgatggagtggaggaaaaag

SEQ ID NO: 59442 - DNA, 701 bp, Heterodera glycines
  Genomic contig location: Contig_ID=SeqID_28864; Location=790..1490; Strand=+
  SCN-specific regions: Sequence locations=1-232,254-660,689-701
atggacaacaccgcaccaaaaaaattcttaacttcccttgaccagcttcaaattccccccgaaattgacaacgacagcgccattcccgactacgcaaaactgcttattaagcagttgcactcgctgctggccaccgcttcgtctctagttcaatctcaagtgacggcgaatgacgcgattgaggaagactgcagacagcgaaccgttgttatcaccaatgtgccggagttccaatcctggaaagcgtcggagcgtggggaggcggacagagcactggtcaatttgattttggacacagtggacctcgaccaaacgccagtggtgttccgtgtcggcatgcgaacgcccaacagagcgagaccgctcaaaatggaatttcccacgcgacatgcggctcggcatgtgctcagaatgaagggcaaagctttggcgttgaatgctctacatggtgcgcgcatcagggaaagcatgaccaaggagcaattggccgaacgccggaaattaattgagcagtgcgcaaagaaaagaaaagaagacgcaggagattggattatctacgcgaatcaggtcatcctgcgcagtgacattgacacaattcgtaaaaatttttaaattttcatgtcaaatcaccaaaaaatcatataaatttttacaaaaaaagtttttgctttttccggttggtagaaaatttttataaaaaa

SEQ ID NO: 59443 - DNA, 1568 bp, Heterodera glycines
  Genomic contig location: Contig_ID=SeqID_28865; Location=226..1793; Strand=+
  SCN-specific regions: Sequence locations=1-273,295-320,343-455,497 -1426,1451-1534,1556-1568
atgcattctgcagctggaacatcgagttcaaacttcaattggtctaagtatttggaaggaatttttttatgtttaataatctttttggttgaatccgattgggttttggctggagacattgtgagtattctaatttaattttctctaaaaatttatccagatgtaacgttaaatattattaccatatacattgtatcacaagctttactgactcacattaaaccggacacgctaaagcatcttcacatttataacattttttttagatgaatgactcctaaggaatagaatttagcttaaatgggcagaagtttgagaaaaagcaaaattttttaaatttttcaccccgggaaccgttgtcggacccggaatttaataattccgttttggccggttttgaagaggccgaatgcggataatgtcagcccgatcaaacaaaaaaatttttcaagaagaaagaaataattttttggaatgaattttatggaaaaattttcagcataaaatcttaaaagcttcaaatcaagcgtaaagatcgttttactggtttatttcaacgtattaagtgtgcaaaaattcaggcatttgcctaaaattccatccctcaaaaatagaaatccactggctctattaataactagctttttcaataacgcctcattttgacaacaaacggggctagttgtgattggtctcttctgatccatttccagatcacttcctgtctcttcatataaaaaaattttattgaattggctaatatgcggcaaaaatcaagcaaggcggctatttgttctatcccagcttactgtttgcgtggaattggttgtcgacatattctaattggcgggggtggaggaagtgcaaaaactggagttcccaaccaaattcaggcaatttaaacaaattttcaaatcttttgcgatattagcaattgaaatgataccgaatttagctttttttgcttgggtatgatagcaatttcgaccttcaaaagggaatctatgaatcctctaatcaaatggttgcgcgactgagcgatgttgttgacacaggccaatccgccagcatgaacatggactgcattgcgttgtcggatgagccgtattatggccaattccttattgtagccggccaagatgaggtttttcggggtttttttttttttgctaaaagacacggagaatatggtgaaatttaacgaccgatcgagtccgcttggtcttatctatgactttttaagttctgcgcattgtatgaaacaaaacatttctcgttgtctgaaatggatggtgtggtgaatttcgaccgtcgttttgatgctccgtcgaatttgtcttttaatgtccaagaattggtaagagtacagactgacaagcacccgggcgacgattcttaccaggcaattttattttattagagtaaaaaatttttctatcaattcacaattttactaacaagcaaaacaatggttaggtaattacatgggtactttttaagtttacctaatagattttcttttttggttttaagaaattaatgaaaaataagttttaaggggatcacta

SEQ ID NO: 59444 - DNA, 74 bp, Heterodera glycines
  Genomic contig location: Contig_ID=SeqID_28868; Location=350..423; Strand=+
  SCN-specific regions: Sequence locations=55-74
tgccctaccgggaccgggaccgggacctgagcttttcaaaacccgggaccgggaaccgggacaaacacgcactg

SEQ ID NO: 59445 - DNA, 649 bp, Heterodera glycines
  Genomic contig location: Contig_ID=SeqID_28871; Location=642..1290; Strand=+
  SCN-specific regions: Sequence locations=1-70,107-190,219-226,249 -337,359-377,429-649
atgggagtttgtgccttggacctatttttattcacatgtaccatggagaatgttgaaccaaatgatgacattcagcagaacaatatgatgaacatgttcagtgttgaattcagcaacaaaaataacaacaacacatttgacatgaaaaggcaattgaatgtgcgcgatttgaatattaaaaaaattaccgtaattaaataatagaaaaattaattaatgatattcagctgagcccaatgcagcccagttataagccacgtgcgcttgttttatgtattagccggatttttctctttgaaaaatggcaattgctaattgcatgtctggaagcttatcgtatttttaaagtaattttattggattcatttgaacgcagcaaaaaataaaatgtttgaaaattaaaattcataatttttatttaaaattttgaaaattggaattacactttctgaattatttcaatcattttgcacaggttgacctggttgttgcctatgttcaaagtgccattttatcagttttcgagttgatgcgagcatatgaaaaggatggcatattgaaaattcggcctggcatccgtttcccgcaccatcgcggcatgaaatgggacccaaatgcggaaacggagttggaacaaactaaaaaataa

SEQ ID NO: 59446 - DNA, 1202 bp, Heterodera glycines
  Genomic contig location: Contig_ID=SeqID_5852; Location=1128..2329; Strand=+
  SCN-specific regions: Sequence locations=1-26,57-68,212-303,325 -837,865-1165
atggccgccgcgaccgcaatgcaatcgcaacaacaacagcagcagcaacagcagcaacttgctcaacaggcgaccaccgcggcggccgcgttgcggggcgaccgcgcgagtgcggcggcgattgctgccggcgcatacggtggagtggcggtgagcggcggctatggtggcgcgacgacaagcggcgcattcggcgccgggagcagtggtgccaatgtgaacggaccgccaatggcgacggcgaacgtagtcagtgagggaccatggcacaccttctcatgttcctccccttgtcgagattataattcaaattcattccattttgccaattttaggtcggccaaatggccatcggcaattccgcgctgtcccagctgaacttcttccagcggtccttccagcagcggtttggcaccgatgggctcggcaacggcatgcaaaacggcgtgagcggcactagcggaagggggtcagcaggaaaatgaatgcggaatttgaaacgagacagctgcacacgctaactcataaaacttttggggagatggacatggaaagactcggacttttaccactaattaacggggggtttaagattatatccccatttcaattttttcaaaaatgccgttagtgggattcccataaaacggtgttatattcccggcattgcttgtccccccccctaaatattcctacaattcaattaggtaatttagcagtttatttgtgtgtgttcgtgccacttgatcaattaatgagcactctgatgggtcgttctgttgcttttcagtttcaacatgatcactccgttggaatcaatcaaacacttcagccagaacagccagcagcaacagcagcagccgaacagttcgggcagtacaacagcctccggcaatttctgagtgtcgccggggggcaacactttgcctgaggcaaagtttaagagacgggaaacgaaaatgccaatggaaaatggcaaaaaaaaaaaaaaaagtaaacgacaaaaaaaatgagcagccaaattgtgggccgatctctccgccaatgttaaaaaaaaaaactaccgcactcttcgccatcagctgatgatggacaattgctactgtaatatgtacaaaataagtgaatttatttgcgagaaatttttgagttggaattattagtgaaattttatttaaaaaataattattttttataaatta

SEQ ID NO: 59447 - DNA, 1977 bp, Heterodera glycines
  Genomic contig location: Contig_ID=SeqID_5852; Location=3445..5421; Strand=-
  SCN-specific regions: Sequence locations=1-203,230-668,690-1077,1112 -1140,1163-1419,1443-1977
ctcagattttttgtcattttcatttaaacattttttttaattttattcatttccccatcatttatttgtcagctactcaatttgtctcttaattagggcttttaattcgttttaaccacttcttcgtcattttcctcaattcgcttcgcctcaccgcctaattcattgatgcgtttcttcacaccgtttttgccccgtccattgctcttcgtcctcgtcctcctccatttccgctgatgttttccctcatccttttcgtctccctctccctaccgtactttgtgtccaccaaataccgtagtatcagttcgctaccgttttccccgtttcttttctccgtcactgttctcctgccgttgatgcttctccaattcgccacactttcgttggcaaaattgcattattctggtcagtgttttgtttgtttcatttgcgtttgctccctaattgtgccggttctttgccagaacatttctcttctcggccccgtgccgaccatttgctgcaccccctccagcaacagggcggcggcgcctttcacggcgccggcgctgcccaaacgcaccggtgcttttcatgcatgtcgccaatgtacgcggaactgttcaaggacagcgacttgggcaagtcagtgccaacaattatcaacagctgcttaataatgatcaaaaccaaaggatttaattacatatttatggcaccgattgacaataaaatggagaacagatcatctgctttgctgaagatttcagtttttaggcatttctacgaaccgaaaaacttcagtgccaaatgcgacgatccaatggagcccacgggcattgggacggtgccatgccgtggcatttgcctgacactttcacaagaattcattataatgggtacggtagtgggagggataacaaacatgtaaatttatattggttgatttttgggtcgtaaaacgggtaaacgattgacaatgcgcggctgtgctagcactctttcgcggcatggctatcacaacagaaccatcgcattctttgccgagttcgacctgtgcagagaagtgggcatttaaaggggcaaaaacatttctaattttaattatctaaaaattattttaaaattacagcagctttaagctaattaaataatctcaaaaacatattttttgagaaaattaattagtgttaatcatttgcatttttgaaatgccaaatttgctttttggttaattttcactttgtttcccaggtcctcgcctccgaactgttccggctcaccagtgagtcgtccagtgaggagatttactacggcggcggcggatttatggccatgggcggcccaatgaatccgatggatggccaacccgtgcaggtgaattttgggcaaaaatgcaaccgggattggcacagaaaatatagtgccataaaaatgcaaatttccagagtaaaagttgattcaatccaaaagtaataattaattccccatctgtgtattggtcattccgcaacaaatgccacttaaaattatcctaacttttcttgaaaacaatcaaattaaacatctctctaatattcatctattaacgatagatttaaaatattaatgataaaacctcaaaaatgaaattttgttcccataaaaagtaggcacaaattaaaaattgtttttttatgatcatatttttcttgatgtatttcttaagttttatatatcaaactgaaacacttggacctgtcaaatgatccaagaagtttttaatatttcaagaaaagttatcacaattttatttttttgaaaaagttgagggttttacgaaaacaattcggcacgaccccttcaaacaaatctgtcctccaataaataccttctaaatttgcttaggtgtgcagctgtttgggcgacaaatgcaacaagcaaatgagcagcggaagtgccgtcgtcgtccgtcggcatttctttttcgtcggaatggcacccgtcctttacgcc

SEQ ID NO: 59448 - DNA, 1562 bp, Heterodera glycines
  Genomic contig location: Contig_ID=SeqID_5855; Location=119..1680; Strand=-
  SCN-specific regions: Sequence locations=1-87,110-124,146-388,410 -619,641-643,666-711,744-802,947-1341,1363-1404,1429-1562
atgaatccatcccttcggcattctttcagcatcgaaaacattttaacaaaaagcgtaaattttgaggccttttctgagtaagtccgaaatgaaattgtttacaaaattttgtctgaattattaggcaagaatttgccaacaaatctctccaacaattttcgccatcttttctattctcgtgagatttgtttaaaattattatgaaaattggccaaaatattaaggccattgcttccgcaccatttcctcggccgctgttttgacaaagtgccaacatttgtcttagaaccgccgccaaaagcatttccaactgaatttagcagcgcattttttgagcggaataatggagaacgagaaggtgttagaagttagaacactcaaataccgtaacataaatgcaaaaatcccacggtaaacccgtaaaatacggtaaagcacagtaatcgtaaggaataagctgactgctggacgcttaaaatgctgaaagcgataagatccataaaaagaaagagcggatgtgcctcgatagctcaatggtagagctgcccatgagtgggtggacgagtgggttctattcccacccgatgcctaacattttgccattccttatttaatatatcacctaaagaaatgtaaaatattaatagaaaagtacatttaaattttaatcgattcgtctctctttttgattcgtaattttagtcgaatttgaaataaaaatatttaattttttactttttttaggcatttcgttgtgctcctttttttttggttttctttgtttttttagttgacaggctactttaaaattaattatttttcttgagaaaataatttttttattattatttttttaattatttttttaaatttttttttaaaaatataaaaggaaaagaaaaaagaaaaaaaagataaactaaaaattaaaaatcaagaaaaataattaattttaaagtaaaacactcctcggcaatttaatggaaaaactgaatgaattaattggtcatcttaacaatttccattccatcactgctctgaagtcacattttgcaacacattgataaacaacaaaactggttgaaatcactaatcagcaattgataagccaaaaaatatttgttgaaattcacaaagattggaaaaataagccaacccctgaaaaagtaagagactctcggattaatgggacagtactgtagaaaacagaatgatgggatacggtatctgccaaaaacgggtttgaagataaaataataataaaccgtagttggccacttcacaaaaagggcaaatttggtatcgtgaaaacttattccctggcttatcgtggtcgaagatctcgaacctaacatcattcttataccaaatcctaatcactataagccgaactcaaacaagaagtacaaattcaaatttttagaacttgaatttttgctcaaatttaggttatggatttggaattgtgaactcgatgatgggtttgtgatcattgatcccgaaaaactccaggatcaagatttcatgacttaattttccaaccaccctttgactttaataaa

SEQ ID NO: 59449 - DNA, 1020 bp, Heterodera glycines
  Genomic contig location: Contig_ID=SeqID_28872; Location=718..1737; Strand=+
  SCN-specific regions: Sequence locations=1-131,153-355,384-406,430 -506,528-530,553-719,742-751,787-971,994-1020
atgatatacccgggtataacgaacttcttcaactctttaaacaagaatcccttttaaaacgcagaacaaaaatcgatttaaaacttttccatgatataattttgggaaagatccatattcagcataatgattctttttcaaaaatatattcaggactgaaaaacgattatattataaaaaccgcttattgttcaaccaatgttcggtttcattcgttttttattcgtacctctcgcctctataggagtttgcctaaagaggcgaggttacttaattctactgagtttgctaaacttcttgacacctatgatattgatgttttacttttgaaaccgccccatctcattcagtgaccaattttattttatttattttgttttaatgtcggtgtcacgcttttgcgtataaattgaattgaattgaatatattgcattacaaaaactacacttttccatttttcggtggaagctgacaccagcggaagggggggggaggacaatcgactggcacgagggaggagagaaggggggcgaagaccacccaaacaaacgtaaaaatagcagaaaaagaacgaggggggagacggttgggcagaacgccacgatatagaaaaaagacaagcgtttggattcaatccattggtgttgttgttggttgggtgcgtccgaccgagcaaaggccaaaatgcgatggggagacagaccattttgtggttatgtatttattatttaattttatttgtgctactactttaaattttttttaaattaaaaataaaatttatagctttttagtcgaaaatttggtaaatattattattaattcatagctcccaaactcaaagctcaaaaatggactgaatcaattccaacagttagagcagttttaagtttgggagctatgaatatgatgaatatttaccaaattggctcttgtccgttttctgtatccctgccataattaaagacggattttgagaaatatggcctttttctgcccactaatttccggatataaaa

SEQ ID NO: 59450 - DNA, 533 bp, Heterodera glycines
  Genomic contig location: Contig_ID=SeqID_28873; Location=161..693; Strand=-
  SCN-specific regions: Sequence locations=1-533
atttaccgcatttaatgattgaaccgatgaaagagatggcgggatttatcgtgatggtttttcccctcgcccaatttgtcgccatgtttaactggagcaacatggggaaattcatcgccgtggggctgaccgatatactggaaagttcagggcttagcggcatcccggcgtttgtcggtctggcgttgctttcctctttcttatgcatgtttattgccagcggttccgcaatctggtcgattctcgcccccattttcgtaccaatgtttatgctacttggctttcacccggcatttgcgcaaatcctctttcgtattgccgactcatccgtattgcctttagcgccggtatctccttttgttccactgtttcttggattcctgcaacgctacaaaccagacgcgaaactgggtacttactattcgttagtcttgccctatccacttatctttttggtggtatggctgctgatgttgctggcgtggtatcttgtcggtctgccgataggtccgggtatttacccacgtttgtct

SEQ ID NO: 59451 - DNA, 990 bp, Heterodera glycines
  Genomic contig location: Contig_ID=SeqID_28874; Location=104..1093; Strand=-
  SCN-specific regions: Sequence locations=1-920,942-990
  Gene Ontology: Mol. function=ATP binding; Cellular component =intracellular; Biological process=germ-cell development
gagcacaaaaatcgccgcctgtgcttcgccactctgtccttttgtgagcaactacctgcactatttggggagacgacgcatttgatcatcgacgaggctggacaggcgccatacgtccaaatcctcaacttggtaagccaactcccctgcctaaccaaggtactgatcaccggcgatcgccgccaactgcgtgtccatttgccctccctgccgatcgcaatccgtgagggcttcggcatggacacggtcatccagaacctggatgttgcgcaagggacggacgtcacaacattgtcggtctgttttcgctcacattctgctctggtccgctgcacggaggccggcttttacaaaccgcacggcgagctgttgacaccaggacgtgacgactccgagcgggcactcatgaccgaccaagcggccttcaaattgccgaaaaagggagtccctctaattttggtccatcagagcacgcctgcgcaacgcgacgaagtgtccacttcttcggccaatcctggacaaacagacacggcgatgagagcactgtggcgtttggcgcgggccttcccaggcacactcgtccgctgcatttgcttctacgccgcgcaagccctggagatcgaacggttggtggcccaacaagaaatcccggacattttagtgacaacagcggacgcaacacaggggcacgagtcgtcacttgccgtcgtcgtcacaacatgctccgtcctcgacagtggagccgactcgcagcccttctgggcttatgccgcgcgggtagacgtcgccatctcccgcgccagccatggaatgatcatcatcggcgatttgctgctgctcaaccggacggtgccgtggcggcgctacctggaccaagcgacgactgagacgacagtggtcggcccggagtacttcgacttcgagcagttcaacaaccccgacaactatcacgacaaggacggacagctgatctcggccaacggcggtgcg

SEQ ID NO: 59452 - DNA, 685 bp, Heterodera glycines
  Genomic contig location: Contig_ID=SeqID_28875; Location=1..685; Strand=+
  SCN-specific regions: Sequence locations=1-372,394-525,552-634,677-685
cgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 59453 - DNA, 312 bp, Heterodera glycines
  Genomic contig location: Contig_ID=SeqID_28876; Location=218..529; Strand=+
  SCN-specific regions: Sequence locations=1-195,217-312
atgacttaccaactaagctatgtacatcaagatcatgtgattaacaccacccttaaattggtcctactcatctttttccagaaaaattttcataatcccttataaatttctttcgaaaattttcccgattttcagtgtattttggggtgtgcaggtcaccatgaaggagtagtctgatcaagttggtgtaaaatatgttcttttttgatcaatatcaaaatttagcttattgttagcaggataaaattcagcagcagaagcggggaagcaaattgaaactttatttgttttttaccggcataaataattaca

SEQ ID NO: 59454 - DNA, 231 bp, Heterodera glycines
  Genomic contig location: Contig_ID=SeqID_5856; Location=222..452; Strand=-
  SCN-specific regions: Sequence locations=1-231
atgcaaaaatccacgagttttgaggttggttgtttaaatcttcgacagttatatatttaaatcataaaaatttaggattggtgccacgagcgcagagtaatgaatgaaagtggcaaagcaaacgcaaatatcgcgaaagagaatgcattgtgcgcggagacgatgaaaaacaaagaagtatctggcaaactcggaggctccagcaaaaagtctgcagttgctgcagaaaag

SEQ ID NO: 59455 - DNA, 64 bp, Heterodera glycines
  Genomic contig location: Contig_ID=SeqID_5856; Location=4488..4551; Strand=-
  SCN-specific regions: Sequence locations=1-64
gtctgaggccgcgaagcggccgaaaaggcccaactaaatttaaaaacgggcgcaaagcgcccgt

SEQ ID NO: 59456 - DNA, 1107 bp, Heterodera glycines
  Genomic contig location: Contig_ID=SeqID_28883; Location=324..1430; Strand=+
  SCN-specific regions: Sequence locations=1-1022,1044-1107
atgaaaaatctcgctcgtcagtatgtctactggcccggaattgacgatcaaattgaagaaatagtccgttcctgccaaacatgtgcttcggaggcaaaagcaccagtaaagactatccttcattcatggccaaaatccgatggcccatggaagcgtgttcacatggactatgcgggaccattctttgggaagatgttcctcgtcattgtagacgcatattccaagtggcccgaaatattcgagatgaattccaccggttcagccgccacgattggtaaattgcgctatctttgcgcacggcatggactgcctgaaacgttggtcaccgataacggtacccaattttcatcgaaggaattcaaggaattcacccgactcaacggcataaaccatttgttttcggcaccttattgtccgatgtcaaacggacaagccgaacggttcgttgacacattcaaacggacgtgtcgcaaattaaagaaggaaggaatcaccgaaatgttgaacacatttttagccacataccatgtcacgccgaatgagtctttgcctgaatgcaaaagcccagcggaactgttcctgcagaggaaactccgatcgacattggaccttttgaaaccaaaaaaccgtatcgtcatccgcgatgaagcaatggagcgtaagttcaatcgacgccatggcgcgaggccgagatcgttcgacttagacgatatggtctacgcccggcatcgactgtcgcaggattggcgacccgggcacatcacccaaaaaaaaggtgtaatgtacgacgtcacttttcaggacggatcagttggacgattccatgcgaaccaacttttggttcgacattctgatgttgatgaggaagatcccctcgacattttgaatgatgcctttggacttccattggcacaggccaatcaacaacttggcgatgttgtggcacaaccagctggaggagtgattgagatagcgccaccatctccgcgtcccgatcagccacagcagctaaacgaggtcaatgaagaacgtgccgttcaacagaatgttcaaaacgaacgaccccagcgaaaccgtcgtccgcctgatcgttattcgcccggatga

SEQ ID NO: 59457 - DNA, 477 bp, Heterodera glycines
  Genomic contig location: Contig_ID=SeqID_28885; Location=516..992; Strand=+
  SCN-specific regions: Sequence locations=1-3,25-245,270-314,337-477
atgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccgacataagcgaggacctcaaggcgaagagacatgattggctctataaagaaagacgtacggtaaaggggatacttgaaaatagaccacagaaggtagtgattgagaatcatgtaccaggtccaaatgttgcaccatatctgggcctcaataaccaatccaaaccacaggagaccgaagaaccacggaaaataattattcctaggaaaagacttgaagagcaaactcctgatcctgaatcagataatgatacacttgaggagttaactccggagccccaaacaacatccacattaaaaacacccattacgatcaaaactattatacacccgaccctttaa

SEQ ID NO: 59458 - DNA, 549 bp, Heterodera glycines
  Genomic contig location: Contig_ID=SeqID_28888; Location=14..562; Strand=+
  SCN-specific regions: Sequence locations=1-11,33-549
gagtcctcaatgtggtctttggaagtcccagacatagacaattttgaaaccttgagaaacatcatggactcctcaaaacggcaagactatttgccaacaattcaatgggtgaaagcgaatcgaggcgaagacaacgaccgacacgacttgctgtttcgccttcaatgccagcatgtcatccgattgttggaaacaagtaggaaagggcaaggaatggtctaaaaaagtcaaattgtattaactgactatttttggatgggtttctccgaatgttttttgatttgtttagatggtaaaagacaagctttgggttatgtgaaggaaatgcaagacgaagagaaggaaaagtacaaagaagaattggtaaatcgaaaaagaaatgagaaaacttagaaaacgaaaagtcttccagaaacatttgatgttcgtcgtgatgacccacccgcagaagggcccccacgactatttgttcaacgagggccgtcgctttgaattggaatggaaattggccaatgcgataacggactatcgctcttcactgtccacgat

SEQ ID NO: 59459 - DNA, 1323 bp, Heterodera glycines
  Genomic contig location: Contig_ID=SeqID_28889; Location=126..1448; Strand=+
  SCN-specific regions: Sequence locations=1-363,386-733,756-1083,1105 -1185,1207-1282,1313-1323
atgccgcagcgctcacttctcattcttttccatgacactgctggcataacggactttggcagcattgagttgagaaaaccgtaccttcaggttattatcgtaataaaaggatggggaaattcgaatttccttgccaaggactgagtcaccaaaagaattccgacccgtccggggtttagtcttcaatactccaataagaccgtgtaaacaatttagagaaaaataagattcaaaagaacagtccccccccccccacaatacactccctcgagctaagcaattgccattttgaggttgccgatgcctttctgctcgtttattccgttttggaccctttggctttaagtcaaatggaagcgttgaaaaaatatttggagagggaaaagaacggcacgagcaaagaacggaaggaagttgccctttctgtgccaatgccttcaaaaaaatatcccttcccttttcaggtaccaattgccgtggtcggaacaaattgcgaaatgtcgggcaaaaaagtgaacacggaaagtgcacttctctgggcgagtcgtgtgaaaaaggtgggaagatgaataccatttaaatttatgcaattgaattcgaaaaaacgctaaaagggtaaaaatggtttcaatgtgctgaagaattaggccgagaaattcgccaaaaagataaaaaacttattgctgcttcaattgtaggtaattgaaaacaaagcaagtaaaagcttagctaattaaagcttttacttatggtaagattggaaaagagaaacgtaacgttgtttagtcaaactgttcgaagtgtccgcgaatgaccgaaaatcagtcgccgaaattgcgcagcacctcagcgaaagactcatccattcattaagtgggccattaactttgccctttttctgtcggtctttttgcatctcattcacaaccagcgatcaaatttgcaggagagtttcaggcatataaattaacttttttttttttttacttttcatgtcattttctcagttttttcgaatgaaacggcatgaaatacaaaaattaaatgcttaaaaatgcaaaaattggttgcgataatctgttacttttaacagaagactcgaagttctcacttagccggaaactgaagccagagaagtcaaatgcacagattgtgatggacttttaatattaatacattgatttgaccaatgtattttattatttcattatattgagaaaaatggaaatcctgtaagcatttgctccaaataacaaattcggtcaccatattttgctaaatcattatttatttattcaaaattttaaaaaatgcattttcgaa

SEQ ID NO: 59460 - DNA, 1206 bp, Heterodera glycines
  Genomic contig location: Contig_ID=SeqID_28890; Location=460..1665; Strand=+
  SCN-specific regions: Sequence locations=1-113,194-552,574-789,846 -938,960-1176,1198-1206
gctttttcacgcccgtgttgcccaagccattgagaaaagtcagcagcagcacaaccaaaacaagttcaaccagtccagtgccaaaaagccatgtcacaacattaccaagacgtacaaaagcatggacaacaaaacgaacaacaacaattgcaacaactgagacgacaacaccattaacaacaacagctccaactgttggtgggtgatttgattttaatgattagcccagttttgcagtgcatttcaaaaggacaaattgatgaagcaaaataattggggagtaattaaaggaatgatcagaaggccaagagaggcccgtagccagaaaaaaaaaccggagggggaagccgaacctttttattgttgttcgttttcaggccagaaatttcaaaaaaaaatttttctccagttttgttttcaaaattccaacgccgggaagaaaaagcaggaatttttagccgttttcaccaaaaaatgacaatttttgctatttgcgagtcaaattttcaagaaaaatggtaaaatgagggcccgtcggtgttgataggtgtaaaattttgtaaatttaaagcaatttgtaataagcatgtgcgaattgttttggcaaaaagccaaatggtcttgaaaaatttggacccgatcagagcaattttggaattggcatagaaatctggcgaaatgcactgccatttttagcttttccatcaattttttttttgttgctcgcttttttatcaaaatgttttgtccattttctgttcttttttcttctcttttttgttatgcttcaatttttacataaaatttgttcattttttttcaataattttaaattttttaaaaaactttcgtggtggcactcttttcacgcacagtcgtccactcacattttcattattatttccacataataattgtagctacggaagcgccgaaaatttcaaaatttatttttcgtgttattaatagagcccctggattttgaaaaagtcgggatcggaattcgggattggcatcagattggtgtaggattagcgggattgaaatccttgttttgctcccgattttgtcgggatccagatcccggctcttttttcaaaaaagggccgggatcgagagcctgggaaaaccccggcggtatcccgattcgtgtctgggctctaattactatacaaatattcaaaatcaaaaaactgtgaacacata

SEQ ID NO: 59461 - DNA, 915 bp, Heterodera glycines
  Genomic contig location: Contig_ID=SeqID_5858; Location=1511..2425; Strand=+
  SCN-specific regions: Sequence locations=1-177,199-217,258-336,359 -370,404-436,458-580,602-720,743-818,840-915
atggacgacattaatggttcgaattctcaggccctttctgctgctgaccaacagtcaatcaatgatgatcactccgttaatcaagaacaggacgatggtaaaaaagatttattgcaatattgatttataacaattcttttaaattttgcatacagtattataccgtaccccctcttttcatgggaaaatccaattaaacatggaactaactcattgacaaattaagtttagtagtaaatttatttgcttttagtaatcattcaactctataaattcaggacattttcaatcttttaaattgcttatttttctgagaaattggacattttggagtacaatgaaaaaagaaaaccatgtggaaaatattcagaatttatttaaaataaattgaatatttttaaatggaattacattttcagacatcaacaatgtatacaagcacaaaggccaaattgaatttcggatgaccaatttcaaggcattttcggagggcaccgagccaaaggaagtgctcagtgagccggtggtgtacatgaacggattgccatggcgcattttggccaaacacaacgatgacgcatcatttggcctgttcttatgctgttttggcgacgagacgggttaaaattaatgaaattgacccgatgataattcatttaaaaagaatttgatagataaaatccaaaaatgcccattttgagtataatttgcaaacaagtcgcactaattatacattaattatgtttaatgttttcagacatggcttggaattgcttggccaccaagcagctaagcgttgtgtcatgcgcaaaaagtggacaaaaatgccaaaatgaaaagggaaataccaacgattatgacagatttgatgccaagaaactacgctggggctggggaaaaatttgcaaaatttga

SEQ ID NO: 59462 - DNA, 1563 bp, Heterodera glycines
  Genomic contig location: Contig_ID=SeqID_5858; Location=2509..4071; Strand=+
  SCN-specific regions: Sequence locations=1-162,184-189,213-295,345 -721,783-968,1025-1112,1134-1258,1305-1385,1410-1430,1452-1563
atgaatgaacaaaaaggcttttacgatgccaacgatgatgcagtcacattcaaagcgcaagtggtcactcaaccgcccaatgggatgccgtaagtgacaaatacagtataccaacttacaatattcggtgtctttgccaaaatttattgcttaacgttagcatttttgatagtttttaaattaataagtaactttttaattgaaacaaaatacaaaattttgcttttagtgggcttcgaactgttgacactttgcgggtcaacggtcaattggtttacgtgaacaaatttgtgagattttatacttaatatttgttttttaatctattctttaattatatatatgctgggtttgctggtgcgggggctttagcctcaatttttcgattttgagaggctattgatgattcttgtcaaaattcggcttttagtggccggacccttttgtattgcgcccctaaaaccctgcttttattttcattattttggtatcatttattcgtttttcatctttttagatgttggctgcctattccaatttttttcgcgaattgttttttggtgacaaaacggcagacattcaaatcgactcaatgaatggcaatgccgtgccgctttttgaacgtttaattgccacaatggaaccgactaatgcagctttggacggtaaaatatgctcaaaagcactttaaattggtgctagtgcgtttcctaaaagcgccattttaataaaaaaattcaaataaataaatgtgcatagaatttatttatttaaaaaaatttgtcgaaattccaaaatttttcaccaattttaattgtttttctagggatgcatttatttttatttcactctttcaagagaagtatttttgtgatttttatctattgtcatttaaaaaaaaaatacgaaaatcttggcacatttaggaaacgcacatggatggcacttttggaaatgcaccagcacgctttaaatttaaaattattactaaaatttcttgaaattttcaaaaattaaattttatgaatgaccacaaaaatttaaatttatgtagaaacctaaatctatgcaattttcagatgattgtgttgaaggcgttctgatgttggccagccaatttctgttggattgtgttaaaaatcgctgtgccagatttttgttggcaaacagccgaaagtcggcaattagcaaattccgattggcccatcagtgcggcatcaccgccatgaaagtccataaaccaattaaatttagtgccaaattaaaaattgattttaaaaattgtacttttttttattatatatcacttagtatctttggaattagcttttattcacagttgcgattctgtcaactttaggcaaaaaaaattgttaatttttccgaaaaaaataaaaattttatatttagaagcaagtgctggatgcgatgaacaaatcagattttgaaattaccggtcgaaattatatggtcgctctttttgatcacaacaaaatggatcgctacgcgttgaaggaattggacgaacggcacaagcaattgtttgccacttcgcctcagtga

SEQ ID NO: 59463 - DNA, 412 bp, Heterodera glycines
  Genomic contig location: Contig_ID=SeqID_5858; Location=4138..4549; Strand=-
  SCN-specific regions: Sequence locations=1-150,180-213,237-248,275-412
atggccactttgattaggagagccatcgaattgggacgcgaacgtacagctgagttggaagaaacgcacgcaacgacttcaatcgctgattggctgaatgttggccaagcagcaacgcaaatcagacagagaagggaaagagtgattggcagagaaatgaaaagaaaagagtgtgtggtagagataaaatgaaaaagaccgagtgtttaaacagaggaaaattaaaggaatttattttatcgataaattttctattttttagaattaaaaacaataaatttgctagcaaattattgtcacaatttaaatgtttatttagagcaaagaaatgctgaagatggttaagctaatgagaattgaaaccaatttaagtaatttaaatggaaatgaaattgaaaatgtcaaaaagtga

SEQ ID NO: 59464 - DNA, 726 bp, Heterodera glycines
  Genomic contig location: Contig_ID=SeqID_28892; Location=16..741; Strand=-
  SCN-specific regions: Sequence locations=1-111,139-294,316-726
gcgcatttgttggaacatttaatccgagtggtccaattaataaagagaaaaatactgttaaaattaattttattaatgcaattgaacaatttatgtacgattatacagtgctaaaggaaaataaaaaggaaagaaaagatgtggaatatttgaaagtagtttttgcaaaatttgcgaagctgtgggatttggctcgtgattttggactaggcaagtattaagacaaaaattattaaggatgaaaatttttaggcaaaaaataaattagaaagttttatcagagggatccactacaaattttcagtaattttcaaactttctgaattttatatggcttaaatttttaaccatactaattaaatgattatgaaaaaatagaatttgaaaaaattcaaatccaaattcaaacagtctatttttttaaaattggctacccgtttttcgcagcaagtgattttatcgtcatgcaagttttttttttcagatttcgcccaaatatgtgctgaaggaaaagaatatgagcaaacgtatgtaaacggaacgccatttgttcgaaatgttcgatatatttttgctaaatgggcagacataaagaaaatggcagttgatacagcaaataatcaagtctctgaacaaagccttgaatttgcatttggcccattgttttggaattacaaaaacaaatttcatggcccaacggcgaaaaaacacagcgtgttgaaggag

SEQ ID NO: 59465 - DNA, 955 bp, Heterodera glycines
  Genomic contig location: Contig_ID=SeqID_28895; Location=21..975; Strand=-
  SCN-specific regions: Sequence locations=1-35,57-955
  Gene Ontology: Mol. function=pre-mRNA splicing factor activity; Cellular component=nuclear matrix; Biological process=mRNA splicing
atgtcagaaatgggaaccccgaccccaaatgtcagaaatcggaccccgaccccaaatgtcagaaatcggaacccccgaccccaaatgtcagaaatcggaactccgaccccaaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcagaaatcggaaccccgaccccaaatgtcataaatcggaaccccgaccacaaatgtcaaatatcggaaccccgaccccaattgtcagaaatcgggaccccgaccccaaat

SEQ ID NO: 59466 - DNA, 516 bp, Heterodera glycines
  misc_feature (493)..(493): n is a, c, g, or t
  Genomic contig location: Contig_ID=SeqID_28898; Location=11..526; Strand=-
  SCN-specific regions: Sequence locations=1-123,145-150,192-343,377-516
atgtttatggaattaaggcttatttcccctaatgttagagaaggtttcccctgtaaggtctacttgttctttttccataaggtaaatatttctttttttttttggagtttctagggggggtttagttttttctttctttaataatatgggtttattaatttgtataatataaataatcaaataaattaaatccaatttatttgttttaagtcgtgctgggtcgtttcgtaaaaagtgccaacttgggaatgtttcgtaaaagtgccaacttgggaatgtttcgtaaaggtgccactgtggtcgttttgtaaaagtgccaactattttattcgattttgataacatataaaatgaatatataaaatatataatttatcaatggcaatttttattttttatctgtgcaaatacgtgtcatccgagtttaatgatggacattttgaactgattaaaacgccaatgaagataaattaaattttttgctaaattattngtgtgataacctttctaaataaa

SEQ ID NO: 59467 - DNA, 594 bp, Heterodera glycines
  Genomic contig location: Contig_ID=SeqID_28899; Location=856..1449; Strand=+
  SCN-specific regions: Sequence locations=1-334,356-405,435-594
atggatgttggtcgggtgcgccagctgagcagttacgcgtttaaactttttgtgattgcggtaattcaaatttatgaattttgaatttttcgttattttaaggatgtttttttggaacatgacactgtgttttgggtggacacatcaattgtttttcacaacaacaacactaagccaattttggcttcaattcaaacgggcaaaattggcccagtgcaaatgccgagcagtgagtgtgaacacatgcaaatattgtgctaaaatttttttaacttttagttacttggcatggtactaactttgcaactcatccgggtaaaattatattaatgaaactatgatcatacaacaaatatttattccatttaagaacttcgtataattcgttagttaaaaatcccactgaaaaaaatataatttatttaatatttattcttaaatccaattcaagatcaaatggttgctttaagaatttttcttatgttcggacaatccgtcagtgaaggacaatttgtcagtggacaattcctcatttgttttatcaatgatcaaaatttgcgaaaatcattgttaaatttataatgagaatttaca

SEQ ID NO: 59468 - DNA, 243 bp, Heterodera glycines
  Genomic contig location: Contig_ID=SeqID_28901; Location=184..426; Strand=-
  SCN-specific regions: Sequence locations=1-243
atgcatcagactggcgttgtggtggcattgccatttgccatctccatctttttgtccattgccgtgggccgactgttcgaccgtctcatcggcacaaaggcggcgttggttctgctcacatgcgtgttacaggcaagaatggttgatcaaagtttcgggaatgccgatcagtattcgactaatgccaagcccaggaaacgaattcgaacaaaaaaaatttctaaacttcaaactcccgattga

SEQ ID NO: 59469 - DNA, 2217 bp, Heterodera glycines; identical to SEQ ID NO: 5860
  Genomic contig location: Contig_ID=SeqID_5860; Location=1..2217; Strand=+
  SCN-specific regions: Sequence locations=1-159,231-702,728-988,1010 -1368,1390-1790,1812-2217
  Gene Ontology: Mol. function=potassium channel activity; Cellular component=membrane fraction; Biological process=potassium ion transport

SEQ ID NO: 59470 - DNA, 64 bp, Heterodera glycines
  Genomic contig location: Contig_ID=SeqID_5861; Location=30..93; Strand=+
  SCN-specific regions: Sequence locations=1-64
aattggcataagtatcggcggtggcattgaccaaaaccatcgacagtccgtctacagtgattcc

SEQ ID NO: 59471 - DNA, 363 bp, Heterodera glycines
  Genomic contig location: Contig_ID=SeqID_5862; Location=565..927; Strand=+
  SCN-specific regions: Sequence locations=1-363
atgaaaaatacattctattattttaccatttttaccgtctttagcaatttgcatgtaaaagcattgccgtcaaaagataaagcaggtaatctgtaaatatttattgaactttctctaagttcgtgccggaatgttcaacaattcaattatcattcaaccagggccgtaaatggcgttccaaaagaatttcctgaaatacgaaatccgctggctataccccttatccaatttcataaaagattactaatatccttctcttcaataaatttctaattttaaggcaccagaaatggacaaattgcagattcgttggcagaccaaatggagaaagtgttgaataaaagagaatattcggatgtataa

SEQ ID NO: 59472 - DNA, 748 bp, Heterodera glycines
  Genomic contig location: Contig_ID=SeqID_28904; Location=162..909; Strand=-
  SCN-specific regions: Sequence locations=1-584,607-748
atggccaaagttcaccatcaaatgccattcttgccgaacatcaagaacaacggaccaccactgattcatcagtcggccagcactgatgctaaacaacacaaacagcaacagaatataatcgccgtcatcgaaaagcacttggagcagtacaccagtgacagcaccaaggaagtgagccaattcgggaatgggccatgtcataggtcatatacggaacaggttttccctggatgggaatgtttcccccgactaaaatgaaacccaaaaatctgatcgaccaaaacgagtgttctgctcgtataatcccccctacaaaaaacaggagcagcacgaggccgagttgtttggtcttggccacattggcgacgacacaccgttggagaagaagcgactgaagcaagcggcgactgacaatgaccgcaacgctggagatgatgcacaggcattggcgagcagtgctgggactaagaatgaacactgtgaagcgctgcacggatggctgagcacttttctcccgctgttatatgtcaacaaactgaacagtttgtgtgccaaacagccgcagtcggagtcgacgcgtttgctcatggcgatgaaggcacaggacgacccgaaggacggaaacgacgacggaactgttgctccgcatgagtcgttgtggaccaagaagcgagcgaccgtggaggaagagatgtgcgagttcggcatccggatggggtgcgcaccttcgatctatgaaatcatatga

SEQ ID NO: 59473 - DNA, 1467 bp, Heterodera glycines
  Genomic contig location: Contig_ID=SeqID_28906; Location=505..1971; Strand=-
  SCN-specific regions: Sequence locations=1-491,513-691,898-952,974 -1017,1039-1382,1405-1467
atgaacaaaccgcagccgaactttcactgtcccctctgtggacgatatctttgcgcatcggtgttttccagtgacaatccgctggacccacgcgaacaacaccagccattagtaagtgtgttgattgacaaagttcgtaaccaaaccaagttggaaaggtataaaatttgcaatttaaataccgttggcatttttctttatattatagtacaatgaaacttggtttgtaaaaagtacattaatttgtcccccccccgtttaaaaattctagatttgaagaaattaaaatttttacggtggggggagcgggaacgtaatgaacccattaatttggcgaatgcaaattgagatcgctaatattttttgttctctatcgagttgcccggtggtggaggacgagtgtcgagcccattgtggcgcgaatgtcttcaaaatgtgcaccaactgaaggtcttctttcttctgtctgctaattgccctttaattcactgattattgtaatttatttttatttcgtttttcagaaaagggagtctctgattccgtcgatgcgcaacgtgaagagtatgctgaagcgactgtttggaggcggcggtgttgaaaacggtggcaaagcgagcgccacgaaattggtagtgacagcgcaaaacgacggaccgagcagaaaccatttgatggacattgtcggctcggaggaggaagaaacggtgaagaagaaaaagcggaagttgaacgaagacgaagggaataatgatcagcgggaggaggaagagagtgggaagaaagtgagagtggttgaagagagtgggaagaaagcgagagtggttgaagagagtgggaagggtatggagagagtggaagagagcggcgaaaaggaaggcagagatgtgggagagaatgggctgggcaacgagacgatgggagaatccttgggagaggagggaaaagaagtgaagaaaggagagactgtgggcgatgtgccagcgacgattgaaaacggaaatgggcacgatcagacggaagaggagcagcaaacgaaggctgactgatcgatccgaatagagcgagggaagaaaacagcgcacgcacttacaaataataattagtagtaattgtcctatggttcgttttttgctgtcaattttgggcttttggttacgatgatgattgatcatttttgcctttggttggattaccgtttgtctcttaaaatctcctcttattcgtcgttgattatcctcatttggaaaaacattccgttaattctttttgtttatctgccaacaatacaaatgaactcagttctctgctgtaccctcattctttatttctcatctgataaaataattgtgtgtgatttggtgttaaggaaattggaacacaaatttattgatgcttttcaattatgaaagcaagcacctaaatgccttttaaaaagtgacaaatgaattattggaggcgaataaa

SEQ ID NO: 59474 - DNA, 202 bp, Heterodera glycines
  Genomic contig location: Contig_ID=SeqID_28907; Location=667..868; Strand=+
  SCN-specific regions: Sequence locations=1-202
atgcatttctctcttcctctggcgctgctcttcgcccttattttgacgttgtgtaacaatttctgtgacggaatgcgaaggaataacaataaatcattattgaataatttgtcaaaaaatggcaatacggtgccgcgaacgcaaatatccggaataatgaatcgtcaagctggtcaagagcttacgcttggtcaaccagcag

SEQ ID NO: 59475 - DNA, 807 bp, Heterodera glycines
  Genomic contig location: Contig_ID=SeqID_28908; Location=406..1212; Strand=+
  SCN-specific regions: Sequence locations=1-233,265-539,566-807
atgcagtcgatggatttgttgcgcgaactcagcgaatattcaggcggaacgcgaagaacaaagcgatgggaagaaaaagcgagagaaattgatcaaacggaggaaggaaaagcgaaaaacgcagcaaatgatcagcaaagtgatcagaacgaagggataccaatcgaagtgatcgtttacccgggaacagcttcacaagaagaagcggagaaaggatatgaaggagaacaaatggaagaggaggaggaagaagaggaggaggagccgaccccggagcaaatggcgcggtggcgtcgacggcgactgctgccgaacgaagtaagcgtgtcaatgaagtgccatctgagcagggctaatcagtgggtcggactcgacaaagtcgtcattctcacttaggtggtcagtgacatttgcgaatttatgagttttgccgagggaagccgactttacacgtcaagcggattatttgttgcgctgttggagccaaatcggaagttgtgcttggcaatggtaagagaagagaagcggaacaaagcggaaaaggaaaaacattttcagtttctgaaaagggtggaagaaactcggcagaaattggacaaaacaattgaggtgaagcgggccaaatggggggagggggacaaatggcacattggcattaaaaggaccttatgaaggggggggggacccaaagggcgaattggcatcagccgatcggcacattgccaaggatggcaccctcaggaaactttaaaggaagtgaatgaacgtcgtcgccatgtcgtacaactgacagaaaacattgggaca

SEQ ID NO: 59476 - DNA, 154 bp, Heterodera glycines
  Genomic contig location: Contig_ID=SeqID_28909; Location=58..211; Strand=-
  SCN-specific regions: Sequence locations=1-154
tgccttctccgatgccacttctctgctccaaaccatccaagccaacagcggtggtggtgccgtcggcgtcgtgccattgtcctccccagcggtggacagtgccggcgcaaaatcggcgattctgcagcaacaacaacaggcgcatgcggcgccc

SEQ ID NO: 59477 - DNA, 64 bp, Heterodera glycines; identical to SEQ ID NO: 51065
  Genomic contig location: Contig_ID=SeqID_28910; Location=203..266; Strand=+
  SCN-specific regions: Sequence locations=55-64

SEQ ID NO: 59478 - DNA, 456 bp, Heterodera glycines
  Genomic contig location: Contig_ID=SeqID_5864; Location=604..1059; Strand=+
  SCN-specific regions: Sequence locations=1-42,80-137,161-192,229 -264,332-456
  Gene Ontology: Biological process=embryogenesis and morphogenesis
atgctcatcctcggcctgggacgcacaatgccatggtaagacaaaaaatattttttaatgtttttaatttatttttaaagatttgtttcaaatttttaatgattattcattgaacgggttttattgcataaaagctcaaaaacagcattgttacctgttttctttttaaacagagcgaattttcagtggaggttttttggtacatattttgacgattttttcattttttgcaaaaaaaaaaaaaacttttttggcactcaaattcttggcaaaatgtcactcatgattttattttttaatctaaaaattaagtgaattttttttttaatttgaaactttaacagggcacttggcattccgttgattgatgacaatgtgaaacggcacaaaatgccaatgtattttgccgccatcaacttcttcaaaatcatggggccgtcctgcggatttttgtga

SEQ ID NO: 59479 - DNA, 169 bp, Heterodera glycines
  Genomic contig location: Contig_ID=SeqID_5866; Location=342..510; Strand=+
  SCN-specific regions: Sequence locations=1-26,48-106,131-169
gaggatgatcaacaccaggacagtgccagcaattcaaacacagcaacaaaatcgtcaaaagttgacacaatttcattggagaatattcagcaaaaagaattggacaaacaaatttaatttaaaatttcatatttttgcttttttaatacggtttatttgaaaaaaaata

SEQ ID NO: 59480 - DNA, 933 bp, Heterodera glycines
  Genomic contig location: Contig_ID=SeqID_5866; Location=680..1612; Strand=-
  SCN-specific regions: Sequence locations=1-119,147-205,231-240,277 -331,409-479,638-674,697-882,904-933
atggcactcactcttgggcctatccccctgtggcagattcttaggggggcttggccggctgttttgtgtacgcgaaatgtgtgtgtgtttgtgttgattgactcccccgggggcctaaaaggcacacacagacatacacacagagatgaagcaaagcaactcattaggaaggaaggagaagtagaggaaaagcagtgttattggcagagaaagagagagagagggagagataatgcgattggaagaaaggaagggaaggaaagaaaaaatgttgaagcaaagagagtgaaaagcggcgatttacacttgaaaggcaggcaaagaagcatggaagtaagagacagagaaagaatgaaaagaaaaagagagagagagaaaggaggaaaaggagagggaatgggaagaaagtgagtgtgggaagagaggagtagagttgaaaagataacactttaaaggcagacaagcataggaaaagcttaagatatagagaaagagagagagagaaagcggtactttaagcgagagggagtggggaggagagaaaaagagaaaggaaaagaaaaagacaaattagatggaaaattgtgagaaaaggttagagaaacaaaaaggagagaaaaaaggaaacagagaaaaacaatttagcataattaaaaagcatttggttcatctgtctatcaaaagaaaaagtaatttcttccattaagaaggcgatgggagcgtaatttttttcagaaattagaattttttctttttagtgttggtcaagtggattaggtgttgagcaccggagaaatttgctttcgcgggttcaaagccgctttatatttttctgaattaaatttataaagtaattgatcacaaattacacctgtttgactttgtccaaagtgccaacaaaagcaaaatttgagtgagtggccaaacaataaa

SEQ ID NO: 59481 - DNA, 54 bp, Heterodera glycines
  Genomic contig location: Contig_ID=SeqID_28912; Location=205..258; Strand=-
  SCN-specific regions: Sequence locations=1-54
atgagaaattcgaaaactctgaaatttcgacttttgttcgaattcgggtccaag

SEQ ID NO: 59482 - DNA, 564 bp, Heterodera glycines
  Genomic contig location: Contig_ID=SeqID_28912; Location=1164..1727; Strand=-
  SCN-specific regions: Sequence locations=1-155,192-512,551-564
atggacaatgggtcgtatttgttgggggcccagttagaaggttctgacatggatttgatttgttttgtaccaaatgatataaatgtgtacaatttttatggagaaaataaggacagtttgttgagcgcgtttaaaatggttatttaaataagtggaaaaaaattaatttaaattaatttcattttatatttgagaaatccgctttagaatttgcatagtgccaatgtgacattcatttcgggtcgcgtcaaattgatcaaatttgagacaaaattgacggatgttgatctgtcatttgtacctgcaccaaagagttttgttaatttgttaaatgccgattttaaatccgatgaaattgtcaaagaaattaaatttgaatcggcactatactcattagcaggtagcttgaacatatcggataactggattttaaaattacggcgattttctgaattacggaaatctgaaacccgcaattactggggcccaaaatgcataatttccataattcgtaaattttaaatttttattaaaaatttcataaaaaaatcggtgaaaaataaa

SEQ ID NO: 59483 - DNA, 1060 bp, Heterodera glycines
  Genomic contig location: Contig_ID=SeqID_28914; Location=1..1060; Strand=-
  SCN-specific regions: Sequence locations=1-269,292-332,355-649,707 -918,940-1060
gtctgtgcgtcgtgagcgggtgtttgtgcagggcacatacaccactgactggagaatgtgtttcgttcccggtcttacgtgccgtaactagcggtgtgtttgtgcttgctgctacgtccgtggccgtgatgagacgacgtggtagggcccgtgcttggcctagcacgtggcttaagactcaatgagtgtcagctcgggcaccgccagctttttcttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgcttagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctgggttgcgaggtgtagcgtatagaccgtgagcttgggttggcccgcttgttcaagtttcccttgaccggggctccagagaaggtgcaagacctgtccaactggcggtgcctatccatctttacgtgtcttggagtcgggttgtttgggatcgcagcccaaatcaggtggtaaacttcatctaagactaaatacggccacgagtccgatagcgaacagtaccgttgaggggaaagttgcaaagcactttgaagagagagtaaaagaggacgtgaaaccgatgaggatggaacggacagagct

SEQ ID NO: 59484 - DNA, 118 bp, Heterodera glycines
  misc_feature (6)..(6): n is a, c, g, or t
  Genomic contig location: Contig_ID=SeqID_28917; Location=19..136; Strand=+
  SCN-specific regions: Sequence locations=1-118
atgccncagcatctggcccgatgtgcgtgcttattgctcgcacatgccaaagccgtagcactcgtgtgccatgtggaacgtcggggcgcaaaatcacttgtatacgacttgactactg

SEQ ID NO: 59485 - DNA, 430 bp, Heterodera glycines
  Genomic contig location: Contig_ID=SeqID_28917; Location=886..1315; Strand=-
  SCN-specific regions: Sequence locations=1-102,124-202,227-227,256-430
gattgaaataaatgaaaaaaaagcaaagtcaaagacaaaaccttaaagcactagccgatgaaaataaatggaaaaaaaagcaaagtcaaagacaaaataggaactttatacaaatttaaaaaagtaatatttgatatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatgg

SEQ ID NO: 59486 - DNA, 657 bp, Heterodera glycines
  Genomic contig location: Contig_ID=SeqID_28918; Location=604..1260; Strand=+
  SCN-specific regions: Sequence locations=1-303,325-574,596-657
  Gene Ontology: Mol. function=DNA primase activity; Cellular component= alpha DNA polymerase:primase complex; Biological process=DNA replication, priming
atggatctcaccaagcttgaaccctgtctcaaagaatattacttgaactgttacccgtacgatctcattttcaaatggctttcatattcgaatagtgagtgaatttggcatttacttttatggtttcgatgtaatgctttttgtacgtaatacccccaaaagtgtctgcatttattttcctctttcgtattgagtaaattttcagagaaccgtgactatttgtcgaagagggaatttgctttcatcaagggtcaatcccatctccgttttttttcctttgtcgaacccaaagaatttatggttcaattacgcaaaactcctccacaaaaaattgaccttggcgctgtgtacaatcgtccggtaaaaatgcgtacaaaatccggcaaaaaacgcttatttttatatcccaaatcagccgcgtgaccgcgagaaaattggtgatttttttcccgtggaacgggaactcgtctttgacatcgatttgaatgactacgacacaatacgacaatgttgcaagtacgtatttttttttcatggtttacctttgcacatacaacctaaaatgcaatagagccaaatttcttacaaatatttgttttttttcaggggcacaagtgtgtgcaaaaagtgttggcgttggatcacaattgcggttga

SEQ ID NO: 59487 - DNA, 513 bp, Heterodera glycines
  Genomic contig location: Contig_ID=SeqID_28920; Location=65..577; Strand=-
  SCN-specific regions: Sequence locations=1-89,111-475,497-513
atgcgggccaaggcaaaacgagcgaatcgactgagtgccatcagcgaaagactcagtcgcaacgcggcgatgcgaaacgcaaaaagagacgaaaatggggggcaaacagaacagagcaacggaaaaagggacgaggacaagacgaacaccactgaagaggaacagcataaaacagcggagagggggacaaacacgacggcattggcacaattggcaacggagagggggacaaacacgacggcattggcacaattggcaacggagagggggacaaacacgacggcattggcacaattggcaacggagagggggacaaacacgacggcattggcacaattggcaacggagagggggacaaacacgacggcattggcacaattggcaacggagagggggacaaacacgacggcattggcacaattggacccagaatttttccgacgattggtcaccaatgtaatcaaccgaggaggaggaaatgaggagaaaggagcagaggagaaggtcaaaaag

SEQ ID NO: 59488 - DNA, 318 bp, Heterodera glycines
  Genomic contig location: Contig_ID=SeqID_28921; Location=153..470; Strand=-
  SCN-specific regions: Sequence locations=1-318
acgggcgcttcgcgcccgttagaggtacaacagcgattagaacacgtacaaaagtgattagaagaggtacaacagtgatcagaagaggtacaacagtgattagaagaggtgcaacagtgattagtagaggtacaaaagtgattagaagaggtacaactgtgattaaaagaggtacaaaagcgattagaagaggttcaacagtgatcagaagaggtacaacagtgattagaagaggtgcaacagtgatgagaagaggtacaacagtgatcagaagaggtacaacagtgatcagaagaggtacaacagtgattagtagag

SEQ ID NO: 59489 - DNA, 2035 bp, Heterodera glycines
  Genomic contig location: Contig_ID=SeqID_708; Location=85..2119; Strand=-
  SCN-specific regions: Sequence locations=1-97,119-438,460-1018,1040 -1121,1143-1334,1356-1404,1426-1743,1766-1769,1791-2035
atgcctaataaagcgaaaaatttgagaaagaagatgaaagaggaccgaagaccggcggagaaatctgtcagtccaggttgctcacccgtccctgacgggagtgcagatgggaatggggcggcatcgcccaggggcttcaataccccaaacataagtgctctacaattgagcacgccggcttcttccattggaagtaaaagaaggggtagacccccgaaagccagagcggagcctatcacggcttcgcaaaatagtgtgtcaacaattgacattccaattgaatcgtcctctcaaaaggccgatttttcgccggccagcaaaaaagtgaagatcactgatgttggccgagccttggcagttaacgaagcaattgcttcgacgcccactaccacgcaaagaaatcgtggaggacgaccagccaaaaaaagaggtggccatgcaggctcaggcaggagcaaagctaatgactccatgagcgagagctcgtcaatggaccagagctctgaagctacaacatcagtggccgttttgccaactgtgcctgaaaagataaatttcagcacagtgccaattaatttcgccacatcgcgaaatatggcctgcaaaattcggagatgggccgatgttggcctttacgagcgtgatggcgaaacatcacaaggcccacgctctggcccaagattcattgagacctgttggaatgatctgacacagtttctaaatgatgcctttgttgtcgagtatttggcatacttggcaagtatatcacaacgaaaagtggtcgttgttgatccagttgtatggcaaatgggcattgaccgtgtcattcaatataaaaatatgacatttgggtatgacgctaatgttccggcagaagtcatacttttgccagtacatttccctggacattggactctaattgtccatgatgttcaatgtggtactcattttgccgactctttgcctaccccatatggcagattggatgtgcaactgacggacaaaattataaagatcatttctgacattttgccgtccacaatgttgaccgggattgttgatgtccaaaatcttacggcccaacacgatggaaatagctgcgggtactttgtgtgcctgtatgctgaatcatggcttatgaacaaccgcacatttgttctgccagatttatccatcaattatgaaaaaaagcgcattttgtggcacatcaatgagctgtatggctctgataatgtgccatatcatccaagggaaggggtgccaactccttgcccaattgtctaccgacatgcggatgaagcgcagtcgacatccaaggccgttgagtcaatggaagttgatgacaatgatgacataatgatcatcgaaccacagacaagtggacaggctgctaatgccattctcacccaagcccaagtggctggtgaaaaccaagttgactcgcttgggttggtgtcggagtcttgcgcaccgcaagagcctattgcgcaggctgacgatgtaatatttgtcagacctaagacgcctacaaggcgatcagtgcgcataggtagacggcagtctgcttcgattagccgttctccttcacctgcaccgaagcgtcgcacatcggaaaatgtacctggacaagttacacggttcactaaacggtgtcatcttgtgcacaagggttggtgctgtgctgccgcagcagcaaaacattttccggaatactccgattctggtaaacttggcgaaaaaaaatgcgctcattgtggggcactgctctttccgcatgaggacagcagccattgttgtcgacagggaagggttgttttgccaaagcttaacccgcacccaaaagagcttgaagagctcatcgtctgcgacaaacaaccccgcgaagggaaggagtttgttcggaatatgtcgcgttacaacaatttgctccagtttgcgagtgtttcggctggaaataagccatgccctgcaggcggaccgatggcagtaattctcaacggagaattccatcgccgcataagcagtatgcaggctg

SEQ ID NO: 59490 - DNA, 2496 bp, Heterodera glycines
  Genomic contig location: Contig_ID=SeqID_710; Location=468..2963; Strand=-
  SCN-specific regions: Sequence locations=1-44,70-92,115-417,446 -573,596-612,635-1222,1244-1871,1894-1904,1927-1936,1959-1968,1991 -2128,2151-2160,2183-2192,2215-2225,2248-2257,2280-2423,2445-2496
atgtcaaaatctgcgagttttgaggttatttaatcattcagtagatatatatttaaattataaaatataggaatggtgccatgagcgcagaacattgaatgatgggggcaagtcaaacgtaaagatcccgaatgagaatgcattaagcgaggagatgacaaaaacaaaaaaacattctggcaaattcggcgtttccagcaaaaagattgcagttactgcagaaaaggtgtacttatatgtacacttccttcaataaatttaaattaaggatcaagcaagcagacgaaacaagaatgccgagaaaaatgttgacgaaaatgttgttcttgaagtgttggatgcagcaaccatggagccgttgtcttcacagactgcagcagcgattgaagcagatgcgagaattatcatcacaaaggcgaagaaaggaaaaaagagagaacaaaagattgcaaatcggagtcaaaccaagaagcttagagcaacaacagaaaaaacacctaatgccgtgcctgaagaaaaccttggtacatccactgaattcgaaaagaaaaagactcgcagttatgaaagcggatggaaaaaatatccaaaaggtttgagtcgaaaatgttgtattttttaattaaaattattagaaaaagacgaaccagcgccaaggaaatcaggaacgcagccagcaaacttcaggatttggaaaaaataagactgcagttaacgtgaaaactgacggacaaaataaccaaaaggttagcattaactcaagaaaccgataaggcttcagaatctctgcgtataatgacgaatcccatcccactaagcactattatggggatgaatccatcctcctaagatttattggggggaatggataccatccccctaaacactcttatgggggatggggatccatccccctaaacactcttatggggatggatcccatccccctaaacgttggcattaaatttattaaatacttagaaatacaacaatcagcgtcgacgacgattcaataaggaacgccgacagcaaaaaattttgtcgcaagaaaatcgtggaaaaaggctgcagcaagaatctcacgatagccagattcagagccgagggcgtcagtggcagcgtggtggaagactgcagcctcacggcgttcctaatgagaacatgaatgctccatgttcggctaaatatgtgtttaatttgaatttgagctgattcggaaattttattttgaaattattttgatatacattaactttaaagcaaaacacatggaaaacttaaccgatgagcaaattattcgtgctacattgagccgaaccgttgcattggtcgtgttgcaggaaagaaacgagactgcaggctgtttaaaaaaggttcctcaatatgctaatggattccgttaccctaaacgctctcatgggatggttactatacctctaaacagttttaagaggaagattaccatccccctaaagaatcttaagggaaaaattctatccccataaacactctcatagggacggatcccatcaccctaaacgctctcatggagatggttactatcccgctaatcagttttaagaggatgatccctcccactataggaaatcaatgcagctaaatcaaagctcagtgatgaacaaattgtgcgcgcaactgttaatcgtttggtcgcgcacgtactttacgaggaaacaatgaagactgcagaagcgaagaaacgtaaaaaccaagaaactgctcaagattgcaatacgcaaaagatgcgaaaatcaaatatttaattgaaatttgttttgctatttatttgctgttaaaattttaatgatccagtatttatctagacacactcttatggggatggtcccatccccttaaacactcttatggggatggctcccatccccttaaacactcttatggggatggtccgatccccttaaacactcttatggggatggctccatccccttaaacactcttatggggatggtcccatccccttaaacactcatatggggatggtcccaggtattttaggacgctgatcacgaatctgtaatcagatttccgtttggatttcggtaaagcctcagaatccctgcgtatagtagtgatgaatcccatccccttaaacactcttatggggatggtcccatccccttaaacactcttatggggatggtcccatccccttaaacactcttatggggatagataccatccccttaaacactcttatggggatggtcccatccccttaaacactcttatggggatggctcgcatccaaaaataagactgcagttaacgtgaaagctgacggacaaaataccgaaaaggttagcattaatttaggacaccggtaagggctcagaatccctgcgtataatgacgattttggttgggtttactaagaaacattttagttatttagttttttcttataaaacgttcttaaaagtatcagtctttttaaatgtttttactaataaa

SEQ ID NO: 59491 - DNA, 300 bp, Heterodera glycines
  Genomic contig location: Contig_ID=SeqID_710; Location=4234..4533; Strand=-
  SCN-specific regions: Sequence locations=1-43,65-300
ctcttcgggaaagcctcagaatccctgcgtatagtgatgaatcctatgatggacaccatccccataccgtttgctatggggatggctaccatccccataccgtttgctagagggatggccaccatcccataccgtttgctaggaggatggacaacatccccataccgtttgctagggggatggccaccatccccataccgtttgctatggggatggctaccatccgcataccgtttgctagagggatggccaccatccccataccgtttgctaggaggatggacaacatccccatactaa

SEQ ID NO: 59492 - DNA, 1041 bp, Heterodera glycines
  Genomic contig location: Contig_ID=SeqID_5869; Location=32..1072; Strand=-
  SCN-specific regions: Sequence locations=1-494,517-554,576-978,1001 -1041
atgcatctgaacacgggattggaggaagaccttctgaaattggccaccaaaaatttgccaataaaatttcatgatttgattttggcaaccaaaaacgacgctttattgaaaaacgtcgttcaattcgtccaaaaaggttggccaaacgacaaagatttgggtcaagaagaggaaatcgtccgattgtttcaccgaagaaaggatgatttgtcaatcctcaaagattgcttgatgtatggcgaaagagtggtgataccgaagatttttcagagcaaaattcttcacctctttcataaaggccatccaggaatgaagagaatgaagcaattggcacgtcaatatgtattttggccaaagatggaccaaaacattgaagaatttgtccaaaaatgtgagccttgccaagcagctgcgaaggcgcacgtcaaagtgaaccttcattcgtggccgaagtcatccgagccctggcaaagaattcatatcgactatgccgggccattttacggaaaaatgttcctaattgtggtggattcattttcaaaatacccagaagtatttgaaatgacaacatcttcggccacggcaacgctcgacaaattgcgttatttgtttacgcgccacggcatccctgaaacgattgtttcagacaatggaactcagttttcgagttcagaatttgccaaattcacagcagccaatggcatcacccatctcttttctgcgccctacaacccaatgtcaaatgggcaggcagaaagatttgtggacacatttaagcgggctttccgaaaattgaagggggaaggaatgccgaatcaagagatcattgaaacgtttctgatcacctacagaacaacgccgaatgattcggttccaaattcaaagtccccagctgaaatgctgctcggacgaaagcccaggaccacatttgatttgttgaagccgccgccattcagaccattgattcgggatttggcgatggaagagaaattcaacaaaagatttggcacaaaaccacggaaatttggaattgatgataag

SEQ ID NO: 59493 - DNA, 1193 bp, Heterodera glycines
  Genomic contig location: Contig_ID=SeqID_5870; Location=524..1716; Strand=+
  SCN-specific regions: Sequence locations=1-85,109-129,152-188,210 -223,245-378,403-718,743-1077,1099-1193
atgaggggagggcaaatggtcacaaatacaatcaatagaatgtgtctgacagtgaaaggtcagacacaacaaataaatggaaatgaaacaaattaaataaataaatgtcttatcgggttccacccgaacaatttttaatatttattatattctttaaagaacattttcaagaattgttaccaaataaatttgggaaaattgtttggaaaactcgtaaatccttttttgacccccttttacaggagtggaaaatgcgattggtgactttcctttttattacacatttaaatatgaacgaaatagtggagaagatggaaatgaatgtaaatataaccatgtagacgcaaaagatgctgagttagaggaacatttgtcattttaccatgacaatggcaaagatgaaaagttggcgatacttttgaggtcgtattataatgagaagaaagagttggaggagcgcgaaaaaaattttgcgcaggtgaacagtttgaacgacttgagggcagtattgagggcgcatgataatcggcacaaaggattggctgagcaagaatattatgagcaggtgatcaatcaacaacatatgttcggtttcttgcaccccatttcggagggaaacttggagaggcaaaaagtgatttatgacgctgcgaaaaatgagttggacgcgtacatgacgaagatgaagggccaattagagggacagcacaaacaactcgaaaatgatgatgatgaatttagttcgaagattaagcaaattgagggacagccagagcagtccgaaaaggatgatgacgaattgaattcgaatatgaaacaaattgaggagaagcagcccgaacaatcagtgataatgaagtacatccgaaaaattgcgaagaaactgaagacttgtatgaaagggcatgtcaaaaatggaggagataacagtaatgagaaatgtgaggattagatgcaaaatatgagccatggagacaactattgtctcttgtctcgggggttcctgatcagtctcggcggcaatattgcatagagaggggaaatttcaaatttgcggtcccgctgcgggattagaactcctaaattttgcgggaagggatcccgcagttataaatcacgcaaaatcccgcatttaaaatttacgggaccccgagcgggattgcgggattttggaaatttgcaaaaatttaaaa

SEQ ID NO: 59494 - DNA, 102 bp, Heterodera glycines
  Genomic contig location: Contig_ID=SeqID_5870; Location=381..482; Strand=-
  SCN-specific regions: Sequence locations=1-31,53-102
ttgctctcctccgccgtcctccgacttatttatttgttattttaatttgtcatcaataaattatttatttgttcgtccattcgacatttcgaggaccgaaca

SEQ ID NO: 59495 - DNA, 174 bp, Heterodera glycines
  Genomic contig location: Contig_ID=SeqID_28924; Location=384..557; Strand=-
  SCN-specific regions: Sequence locations=1-174
atgcaacagaaaagcggagaagcaaacgatgggcacacacaacgccaatcggacggagcaaaagcaacgaaatcaaatgacggagtcaccgattgttgtcgcacgacaacaacaaacgcaacagagccaattcaacggggcacaattcgacacgcaatcattgcaaagtcgaag

SEQ ID NO: 59496 - DNA, 328 bp, Heterodera glycines
  Genomic contig location: Contig_ID=SeqID_28925; Location=324..651; Strand=-
  SCN-specific regions: Sequence locations=1-209
atggccagggccattcctcagttttgtcccgttattttctctcttttgctcggggattattttggtaagtctcgcggaaaacaaaaagcgaaagttaagcggacggaacggaacaaccaattgtttccggcccattcattcattcgcattcacgttcaattcattcattgttggtgatggtcgtgctgtgaaactttcagcgcaacaacaaaaagagagagagagggaagagaaaaagagcaatccgcttaatgtgcgagagagtgcatggggaagagaaggagagcaagaaaagaatgaggaagagagaaaaggagcagagaaatag

SEQ ID NO: 59497 - DNA, 56 bp, Heterodera glycines; identical to SEQ ID NO: 52733
  Genomic contig location: Contig_ID=SeqID_28929; Location=393..448; Strand=+
  SCN-specific regions: Sequence locations=1-56

SEQ ID NO: 59498 - DNA, 326 bp, Heterodera glycines
  Genomic contig location: Contig_ID=SeqID_28930; Location=425..750; Strand=+
  SCN-specific regions: Sequence locations=1-269,291-326
atggaccaagaaatgagtgcgggaattcaacaaagccgtccttctggaaagatcaatcatgaaatcttgatggaggagacgcgtcgaattccaattttaggcgaagtcgttggccaattacgaaatatttatggttcttcgttagccgagcagttcaaaaagtacagaaaaaatatgaataaattatgattaccaacctatttagcgaactcattatcgccagccaacttaatcgtggaccgatgaataatgggatcagcaacccgcacatggacatgcttcttggtgttgatgagaaaattagcgatcttttgcaccaattgtaa

SEQ ID NO: 59499 - DNA, 69 bp, Heterodera glycines
  Genomic contig location: Contig_ID=SeqID_28930; Location=908..976; Strand=+
  SCN-specific regions: Sequence locations=1-69
atggttttggacccgaaatcgaaagacaaggcgcgggaactcggttcctaccgcgatatgcggttcgag

SEQ ID NO: 59500 - DNA, 472 bp, Heterodera glycines
  Genomic contig location: Contig_ID=SeqID_28931; Location=383..854; Strand=-
  SCN-specific regions: Sequence locations=1-29,51-210,264-472
atggacaccgccaaattttgtgcgactgatcagtttgaaaagtttttggcaacgggacgtcaacgattgcaaagagaatgtgccgaattgaaaagccaaaagctggtcagtgcactttttgaacggaagcgcaagcgcgacaatgagatggcactgctcgctgacgaagtggatcagctcaagttcgaactggtcattaaggtagatgggaaaaaattaattaattgttatttgctatttaaaataattaaaacaaaattaatcatagaaaaagttgaccacaaaatgaatatagcacaagcaaattaggaaaattaaagcaagtgcctgaataattgaaaatttgggcatagttaattgtctcaggtgcaaatgacttgtacacggattagaataattgttttccgtaaatttttgtagataatgatttgaagtttaagaattttttttttaagtaaaatttgtaaataaa

SEQ ID NO: 59501 - DNA, 146 bp, Heterodera glycines; identical to SEQ ID NO: 56264
  Genomic contig location: Contig_ID=SeqID_5871; Location=49..194; Strand=-
  SCN-specific regions: Sequence locations=1-79,113-146

SEQ ID NO: 59502 - DNA, 146 bp, Heterodera glycines; identical to SEQ ID NO: 56264
  Genomic contig location: Contig_ID=SeqID_5871; Location=301..446; Strand=-
  SCN-specific regions: Sequence locations=1-79,113-146

SEQ ID NO: 59503 - DNA, 146 bp, Heterodera glycines; identical to SEQ ID NO: 56264
  Genomic contig location: Contig_ID=SeqID_5871; Location=553..698; Strand=-
  SCN-specific regions: Sequence locations=1-79,113-146

SEQ ID NO: 59504 - DNA, 146 bp, Heterodera glycines; identical to SEQ ID NO: 56264
  Genomic contig location: Contig_ID=SeqID_5871; Location=805..950; Strand=-
  SCN-specific regions: Sequence locations=1-79,113-146

SEQ ID NO: 59505 - DNA, 61 bp, Heterodera glycines
  Genomic contig location: Contig_ID=SeqID_5872; Location=82..142; Strand=-
  SCN-specific regions: Sequence locations=1-61
atggctatctctttttttgagaaattttctatgcaacaaacgctctcgaacatgaaacgaa

SEQ ID NO: 59506 - DNA, 146 bp, Heterodera glycines; identical to SEQ ID NO: 56264
  Genomic contig location: Contig_ID=SeqID_5872; Location=249..394; Strand=-
  SCN-specific regions: Sequence locations=1-79,113-146

SEQ ID NO: 59507 - DNA, 146 bp, Heterodera glycines; identical to SEQ ID NO: 56264
  Genomic contig location: Contig_ID=SeqID_5872; Location=501..646; Strand=-
  SCN-specific regions: Sequence locations=1-79,113-146

SEQ ID NO: 59508 - DNA, 146 bp, Heterodera glycines; identical to SEQ ID NO: 56264
  Genomic contig location: Contig_ID=SeqID_5872; Location=753..898; Strand=-
  SCN-specific regions: Sequence locations=1-79,113-146

SEQ ID NO: 59509 - DNA, 144 bp, Heterodera glycines
  Genomic contig location: Contig_ID=SeqID_5873; Location=15..158; Strand=-
  SCN-specific regions: Sequence locations=1-78,111-144
atggctatctctttttttgagaaatttctatgcaacaaacgctctcgaaacatgaacgaagtgcggtgcgccatggccattttatttttcaaataattttatatttaatagatattccagaaaaatggctatctctttttttga

SEQ ID NO: 59510 - DNA, 146 bp, Heterodera glycines; identical to SEQ ID NO: 56264
  Genomic contig location: Contig_ID=SeqID_5873; Location=265..410; Strand=-
  SCN-specific regions: Sequence locations=1-79,113-146

SEQ ID NO: 59511 - DNA, 146 bp, Heterodera glycines; identical to SEQ ID NO: 56264
  Genomic contig location: Contig_ID=SeqID_5873; Location=517..662; Strand=-
  SCN-specific regions: Sequence locations=1-79,113-146

SEQ ID NO: 59512 - DNA, 146 bp, Heterodera glycines; identical to SEQ ID NO: 56264
  Genomic contig location: Contig_ID=SeqID_5873; Location=769..914; Strand=-
  SCN-specific regions: Sequence locations=1-79,113-146

SEQ ID NO: 59513 - DNA, 272 bp, Heterodera glycines
  Genomic contig location: Contig_ID=SeqID_28936; Location=345..616; Strand=-
  SCN-specific regions: Sequence locations=1-135,165-185,207-215,237-272
atgaatatgctgcatccttttcatttacatggcacaaaattttatgtgttaaaagttggcacaatggaacccgaatatggattaaattcggatgtgcaatgtgccggtgtaaaataaattttattaattggcgccaatatttttttttaatatacaaatattaaggacgattgtttggagatgaaatggtcaaatataagctactccaacggaaacataccacatttgaagaaggtattactattcttataaaatttacgatgaataaataa

SEQ ID NO: 59514 - DNA, 549 bp, Heterodera glycines
  Genomic contig location: Contig_ID=SeqID_28938; Location=456..1004; Strand=-
  SCN-specific regions: Sequence locations=1-103,141-158,180-549
  Gene Ontology: Cellular component=nucleus; Biological process =regulation of CDK activity
atgaactcgacaaaaagaccacttgagaaaaataaaaaagattcaattaaaagcataacaaaggaaaggaagttggaactgagaaatatagctgagaatggacaaattgaaaatgaaaataaagaggaggaagaaagtgaccaattgagtgaagaaggagaagaatctgacgatggagaagtgatgccagaaattgaggacggaaatgaccaatctgaggaaatggccaagttggacttcgaattcgaggctttgcccccggcggaggacgacttggatgacattgaaaggcttctaattcaagtggacacgcaaaagactcatttccgacattgtttaaattttagatatttctacaagcggaggtcgacgaaagggaaatggcaaaagcggtggtcggccagtcgcccatgggctgtgtgttcagaccgaccgaagaaagtgaggacgacgaaagcgaagcgatcacttacggcgtcctttccattgtgccattgaacggaactcaggcaaatttgggaaggcaattcgaaaaaaaaatcaaattat

SEQ ID NO: 59515 - DNA, 728 bp, Heterodera glycines
  Genomic contig location: Contig_ID=SeqID_28941; Location=439..1166; Strand=+
  SCN-specific regions: Sequence locations=1-69,91-193,275-311,333 -389,411-414,438-451,474-475,497-728
atgttagcacagaataatgaggacaaaaagggaactgggtaaaaaatggataaaaaaattaaagtgattaaattaaattgttattttagtgtttttcctttccaaattattcaaatcgacggaaaagggaagcatttgtgggttgaattattaaaccaaatcaaatttcgaacaaaagaaatatattggttagtatataatttgaattgttttaataaatgaattaaatttattctattaattctttatatcttcagaaaattttaattttattctcaaattctccgaactcacattgacatatgaacaaatttacaaagtgcttgaaataattatgggcaaaagcaaagaaaaaacgaattcgcctccaatttacgaatttataaagaaagaattaaaatattttttaactaaatcggattcatcttcatcatcattaaggcatgtaattgcaagcatataaaaacaaaatatgagtttaatttgatgcttttcagccactaatttacgaaataaatctttgtctattaatttttaaaaattccagtacaaaattggactgcgcataaatcaattttggacgagagttgtcaaaacgtttaccatttaattttgaggaatataatgaatatgtcgagaaaaatagagaacattgcggcacagatgagcatgttgaaaattactattcaatagaaaatacaccggcaattgggtacggtaattataca

SEQ ID NO: 59516 - DNA, 833 bp, Heterodera glycines
  Genomic contig location: Contig_ID=SeqID_5874; Location=2667..3499; Strand=+
  SCN-specific regions: Sequence locations=1-620,643-833
atgggcaacaatgttttgatgatgaccacatttgcgaacagcagtgtgtgggacagagtgacgtgagttgtggcaatgaatgatttatcacacctttttaattggcacaattaattaattatattttcgtttaatttttcacttttttattgctcaaatttattggtgatttttcattacatattattttgctttttagagtaacagttgtggccaattcttcccaacatcgccaaattagcaatctctccaatttgttcggcgcttccctctctttggcaccaaatcctccgcaaatgtgcgcatttgatggaaaactcctctagtagcgtttttaaattaatttgtgaattgccatttagggtcgaagtgaacaaagtccaaccctggtactacggccttatgaacatccgacccggacttaccggcaaagacgggaatgagcttcaaagtgaatatattatgccttacaaaaatggagtgccggcaattaaagcggtgagaaaaatttaattgattagtttaattggaattttttacaattaattaaatgaaagttaaatgaaatgtcattccaaatttaggtctcatcacttcaccaacaaatccaacctctgctcaatggctttgtgatcagaacagtgaaaggggacgacctttggctgtccatgagcaacggagacggaccaatggtcgcccttcacttcagttgggcggagagcagaccaaccaaagtgaacgccgtacttgcccaaattgagagggtaagcgaacgaatcagccgacggacagaagagtttctgatcagacaagtggagaaaggggcacactga

SEQ ID NO: 59517 - DNA, 365 bp, Heterodera glycines
  Genomic contig location: Contig_ID=SeqID_5875; Location=29..393; Strand=-
  SCN-specific regions: Sequence locations=1-71,96-186,208-312,335-340
atgtcgaaggaaaataccctcaccggggaggaaattttatagtaagaaaaaaatagaaattttcttaaaaatttagaaattcatttaaagacaatccgtaatttccagcatcagaagtttgttcgtggttgacaatgaaaaacaatttataatttcaaattttatgctttcaaattcatgtgactttaaattttaaatctgtaaaatattcttttaataattttgttgtatcaatttctgccgcttaaaaatgctccgattcgaatatattttcatttataaaattgttcctgaatttgtgcgtaggatccaatttctcagccaattttctaaatttacgaattttataaattaattttaataaa

SEQ ID NO: 59518 - DNA, 1677 bp, Heterodera glycines
  Genomic contig location: Contig_ID=SeqID_5875; Location=1387..3063; Strand=+
  SCN-specific regions: Sequence locations=1-426,448-563,585-1008,1033 -1158,1180-1677
  Gene Ontology: Cellular component=Cajal body; Biological process =nucleolus organization and biogenesis
atggtcaggatttcgtgcctttttgtggttgcgacttattgtctcaatgggctgcttctcagcacgacaattatggcaaatagcgatgaggaaacggagacgaaaatgccagcaaaaagaccacgaaagcaaaaagaaaccccggattattatttaagtagttatttgccaactgattattcccgtagctcatcttcggcagagccagacaattcatcggacgaagattggaacgcaaaagaagaagcggacacgaaggacgaagaatcacccaatgtttcgttggccaattcatcgtcatcagctgctgatgagaagcaattgctgggccacaaagtgacggttcaaaatcgaccaaaaacgggacaatcggttcaaaataagccaaaaaagcaaaaatcggttgaaagttctccggaggacaatgaaaacattgaaagattaaaagcggaagtgcaagaattgatgagaaaatccaaagcaaaagcagcagcaggggtcggcagcagcaaaacaaaaacgaatcttcaaacgtcgaaaagtttcaaagaaagtggggacagaggcaaagggaaaggcaaaacaacagaagaaacaggcgaaccatcgaaaaaaatgaaaaaagcgacgaaaggcaaagtgccaaaaaaacaaacatcgtttgatgatcttaatatttcggaaattttggcaaatttggataactcatcatcggacgaagtggtctcgaagagtaattggcacaatgctaattaatcaataattaattaattggccatttcagaaagtaaagccccagcaaattcaagcaaaagtttgaaattgagttcgccgtctaaaaataaacagaaacagaagcaaaattcaagcgacgaaagtgtggaaataatcacacctgtgaaaaaggaacggatgcaaaagagtaaatgctcaattaaaaagtataattagtgattaattgtcattttaagaaggcaaaggagtgaaagtggagaagccaacagcgagtgaaaatgcaaaagcaatggaaacgttgaacattaacgccggtaggataagcggtgctatgacgttagtcaaaaaccatcataatgggcgttagtcaaaaaaccatcaaatgaaaatattttttgatataattttgctcaaaagcatctaaatttttaattcttgatatcattcgataggcctaagggttttctattagcctacaaaatttcaaaaaatttcgttaagtttcaagaaagttatgactaaaatcaaaaaaacttggttttttgagcttctcaggtcataacttttttaaacttaaagaatttttttttaaatttgcaggataatagaaaacacttaggattatcgaaaaatatcaatattataaaatttgatccattttagacgaaattatgaataattttctgtcaaaaattattcatttgatgtttttttgactaacgcccattttgatggtttttgactaacgtcccagcaccggataagcgccataataattcaaagacttctttcttgagagcgaatacgatgccaaatccgaattattatgattgctagcaaaggcacagccaaagccttggttttttttgggggggggggggctaattgcaagcccattaacaaaggataggtaacccaagtgactatgggactttcgaacta

SEQ ID NO: 59519 - DNA, 690 bp, Heterodera glycines
  Genomic contig location: Contig_ID=SeqID_28946; Location=98..787; Strand=-
  SCN-specific regions: Sequence locations=1-173,195-690
atgcatgacttgttcaactcgttcatcattggccaattgtctgctgccaatggcactgatggttccatgtcccaaccatcagacccaatgacgcataatcaaaatcgactggtggaaacgaactttgccaagttcagcagggagacaaatcaagcaaataatcaccgtggcggcacctcaaaacaacaaacaaaatccatgtcgtcaaaatctgaggaaaaaatgctgtggccctccactaatcagccgaacggtgtgccattggacatggacaaagtgcgactgttcagcaacgcaattgccttcattgccatggaatttgttgcttcttcttcggagagtcgggcggaactctacacgtgcaaatgcttatcggataatgagatggagaagaaaattttcggccccaacggcgccattctttcgcatttaaacgcgtcgtttttaaattcggcacaaaaaaagcgccaatttctgaaactgttgttttcgttcggctcaattttgagcactgaaacagcccaaattagaggtgcaaaacaaaaagtgaaggtcaacgcaattgtaaaggcatatgaatgtgcgggaataaataggtaaaaagcgaaacaattaaagtaaaatgaatttaataggggaaattggtacttttctgttttgagacccccccccctgaaattttcaaataaa

SEQ ID NO: 59520 - DNA, 77 bp, Heterodera glycines
  Genomic contig location: Contig_ID=SeqID_28947; Location=35..111; Strand=-
  SCN-specific regions: Sequence locations=1-77
atgcggagccctccggctattccgcgctcattttgttcagcggcaaaggccaaagtccgattccaatgtcccggcag

SEQ ID NO: 59521 - DNA, 182 bp, Heterodera glycines
  misc_feature (76)..(76): n is a, c, g, or t
  Genomic contig location: Contig_ID=SeqID_28949; Location=1..182; Strand=-
  SCN-specific regions: Sequence locations=1-60,87-182
gctaggttcgatgaaactttttaaaatataagcctaaactttttggcctgtttaaaaaggaattaaaaatttttanaatatttattcatctcccttttgatagaaaaagcatcagagagccttatttaacttttaattaacatttggtgcgtttcagagcactttctgaaaaaatacttatg

SEQ ID NO: 59522 - DNA, 801 bp, Heterodera glycines
  Genomic contig location: Contig_ID=SeqID_28950; Location=272..1072; Strand=-
  SCN-specific regions: Sequence locations=1-801
atgaattttaaaaccgccgggggattgggaaataaaattaacgaagcattcagccatcattacaaaatcaaaaaacaacgtggaaagagagaagccaaggctgaagataccaaagactcaaaaattgatgtcgcaaagagggccgcagaacgcgccgggagagacgtagaaagacattttaatcagatcaacaatatctcgaattccatccaaacccaactaaacacactaagagaaacaaatcctcacattttagaagagcctgatataaaaatttggtttgacaaaatggttgagatgggaaccgaaattcaaacatctcgaaatgaacttaagtcttttcaagaagaagtagataaagccaaaaacacaacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggcgctcggtgagcatattaaacgtaaagatattgaaaatagacaagtatctgaagctgagaaaggaccacaaaaaagagagagactagccaatgaggatgttcaatttcaatatgacagcattgatcaaaaatttattgtctatctttccgctgctgtctcccacatagatttgtcaaaacacctcgcctatgtgcttggttttaagaacacaaggctatttcacgcggaagaggcgaattatatgccagatttgacgggaggt

SEQ ID NO: 59523 - DNA, 1131 bp, Heterodera glycines
  Genomic contig location: Contig_ID=SeqID_28951; Location=143..1273; Strand=+
  SCN-specific regions: Sequence locations=1-250,280-656,793-1131
  Gene Ontology: Mol. function=chymotrypsin activity; Cellular component=extracellular space; Biological process=cytoskeleton organization and biogenesis
gccttccccaccgcgtgcataacattagcatccatccgctttaccaaattgtgcacagcgcttacgacgccgcactgattaggtgatttggcattgaatctttttttcgttttaccgaaatgattttaggatttcgcccgtctcaaaattcggggacagtgtttggccaatttgcttgccaacttttcccgcatctgtgaaccgtacggaatgcaaatttaaaaaaatgcatttgatttgtattttttgcatttatttttttatttaaaatgattttttgcctttttatcggcacagaaattaaaatttgctgaaaataaaccctaatcactgctcaaattagggatgtgtgtggtcaccgggtggggtcgactggcggagggcggcaaaagaccccaaaatctgcgcgaaattcacgtgccaataatgcgatcgacgacatgcaacggagttagtcattatgcgggtactgtaacacagcaattgaactaatttgattacccctaattgatacggtaataggccgattgcactacccatcgatgctttgtgccggtttcaatgccggaaaggccgacgcgtgccaaggggacagcggcggtccgctgcaatgccaaaatgcaaaaaatatttgggaacttcaggcattttttgagaaaaaaattaattaattattcaaaatattatttttgcaaaaatgttaatttaattttaatatatttctaaagaatcacatgggttttatattattcaattaaaatttttaaaaataattttcatcatttaattttagtgataattatctgaaaagtgttcattccttccttctctttggcagggcatcgtcagttggggcatcggttgcgcaaatccgaaattccccggcgtttacacaaagtgaaccatttacaaataagtagagtgccacgggaccgggaattttgggcaaacccgggaccttttcgggttgaaaacccgggaatttttggctgggaaaaccgggaaaaaaccgggactaggtccggtccaaaccgggaccttggtactcagtaaacaattcacgagcatatttttcacagaacgtttgtcatttccccgtggattcgggcggaaatgctccgtctgaaaacg

SEQ ID NO: 59524 - DNA, 1388 bp, Heterodera glycines
  Genomic contig location: Contig_ID=SeqID_5878; Location=717..2104; Strand=-
  SCN-specific regions: Sequence locations=1-361,401-502,524-751,773 -1075,1097-1185,1222-1269,1291-1388
  Gene Ontology: Mol. function=DNA binding; Cellular component=nucleus; Biological process=development
atgcgtccattcgattccgttgacaccgaattcggtccccgggcgggcgacgacgacacttcgctggtcatttcccgctgggctttgcagtgcattcggatgattgcgggcgacgatgccaaaatgacgacgatgaaaacggtgaatgccgattcgccggagcaaatttcgccaacggatgctgcgaattccatctttctgaatccgtgtgagtcttttctttcgggtgggtgcgtaatttattttttgtttttgacttttcgacggtacttttcggttttgggatttcgctttcaattattgcaattatgcccccaaccttgtttatcttttaaaatttcgagaaataggcccaaaatcgaaaaaaaaaatttttgtttttttttcatttaattttattcgcctttcagcgattgctcttggcaatggcaatgccttcccactttttcaacaaatgcaaaaggccaaacgaattcggtatgcttttagttgtttcattgaatgcctttcctttcttctttagcactgcgttcagtccgtctcaactcgtcaaactcgagcaggcattcaatggaagtcaatatttggtgggaagtgagcggaaagtgttggccaaacaattggcactgtccgaaacgcaggtgaaaaaaagggataggcaaaacgaattaattgcaaactttggcatttattgtttcttaaatggcattgctttgtttccttacaaaagtgaaattcgaccccttgtttcatttcgtttcattttcaccgtttccttccaatgtcggcacaatttaattacccatttactatggtaatgatatttgctgtatgggcgtgccattcccagcggcactatcatttgggaaatggagtgacgaaaatgggctcaattagtgctctgccacgcggcacacaaacaaaatatgcacacactgcgccaaattggcccgcacagattcagtttcggtggctaagtaaaggaaacggacggcacggacattttggggactaataaatgcaaatgtttgtgttaccttaatggctcttatgagctcattcattgtcagtaattgaacccgctttcgttgtcaaaacattaaataaaatgccatcttttggctgcaaaaatacgacggaatgagcgaatttatgggaagaaaccaaaattgaatttcatttgttcaggtgaaggtttggttccagaacagacggaccaaaagcaaaagggtgagagacttggtttgagttgcacaaaaaagttgcattttggggcaatttgcagttggacaacggggagatgatgccatcgaaaagaggtgccgaagaagaaagcgaacgcggcacaaaacggaaggaaacggcgcaaaacacatcgaatgaaacga

SEQ ID NO: 59525 - DNA, 432 bp, Heterodera glycines
  Genomic contig location: Contig_ID=SeqID_5878; Location=2934..3365; Strand=-
  SCN-specific regions: Sequence locations=1-109,131-373,395-410
atgactttggttggcagcattgcgcttctgctcattctgttcatcgtcttcctggcagttttgcttcgaatgaatttgaacaaaaaagaaaatcgtggtcattgtaagttaatttgagacaaaaaataaatttaaacagttaaatttgattgttcttcaaaattcaggtgtgaagaacgaggaagtgagaatggcactttttattactttaattaattaattactcatctgttttagcacaataataccatcgaattgccaaacattgaacaacatcgccacccgttgcagagttatacgaacgtcccctttttcaattgagaagattattcttgcccttgatttttatttttgtcagaccaatattcgaaaatttttgaatttcaagataaatctgaatagacaatcaaatgtttataatttttaattaaa

SEQ ID NO: 59526 - DNA, 187 bp, Heterodera glycines
  Genomic contig location: Contig_ID=SeqID_5878; Location=3761..3947; Strand=-
  SCN-specific regions: Sequence locations=1-61,98-187
atgggaaaacggcacggtgtacacttatgcccgcttgacattcagacaggggtaaatgaacaaaaaaaattattttaaaaagtaagaaaattaatttcagagaaatcaaccgcaaaacagtgatttcctgcgaagtgcaacacccggaaacgaacacaaatttacgcaactcaatcactttgggtga

SEQ ID NO: 59527 - DNA, 3239 bp, Heterodera glycines
  Genomic contig location: Contig_ID=SeqID_5879; Location=248..3486; Strand=+
  SCN-specific regions: Sequence locations=1-205,228-504,526-764,786 -1653,1675-1717,1741-1741,1763-2029,2062-2973,3023-3239
atgcaggcaattctaacacaaaagaaccgtacaaagcttcaacacaacgggcattcatacatttttcacaagctgagtgctgaaggtgaagttcgcttttggtcgtgtgaacaccatcacgcaaaagacatccgttgcaaagggcgccttcacactaacctcaacaacaacgttttgcgtgaagttggaaaccaccaatgtgaaccaagtgcagctcgaatggaagcgcaacgagtgatcactaaaatcaaacgccgggcggaacagacaatggaaccaccagcgacaattcgctctttgtcactgcagaatgtggccacgccagtacttccgcaactccctaccaagaatgcgatcaaaaaagttttttctcttttttttgttatgagatttttgtgcttaggtaatcaagcgtgtacgtcatgaaataaacgcaccaccgccaattccaaacacgctcacagacttaatcatcccagacgcatacaaaatgtatgggcgcaccgaagaacaaactgaacaatttttgttagccgattcgggagtttaccaagagaacgggagagaacagcggtaaaacacatgcgcactttttattatttaaatcgaaatttagaatactgatatttggacgtgagtcgaatggtcggtgggcgaatgaaatgaaagagtgtttcgccgacggcaccttcagcatcacaccgatgcctttccaacaagtgtacgcaattttggcacggtaagaaatttaaacaatttaacaattttgaacttattatttaagtcggaatcgctggtcatcccagtgtgctactgcatgctgtccaacaaaacgcacactacatacgagcgtatgtttcgtatgctcgttgctgtgtggccagacttcaacccggacagcgtgtcgatagacttcgagacagcggcaatcactgcgctgaatgtagtcttcccattcactgaagtgcgcggatgtctgttccacctcgtccaaaattttcacaaaaaaatttctgaatttgggctgaaacaggttgaattcatgacaaaaaaaaatcgaattttcgaaaattttagcgctatcaaaatgacccgacattcgcagaaatggcacgatgtgtcacgtcgctcgcgtttctcccaattggagatttgacccctggaatcattgctctggacatggctcttcccgacgaacttactcccgtccttgactggtaaattgacgatctcacaaattgtttactatttattgttctttaattatatattaggttcatcatgaactacacgggtcgtcttaagcatgatggaaaccgaacacgcccgcgatttgacccaaacatttggagtgtttacactcgaacattgcaaggcgatgaccggacgaataaccattcagaagccgcgaacagacgcctacaatgcgcatttgcctgttcacatccatcgatttggcatttcattgaccttctgcgaaaggatcaaaagttatcagatgatgacttcgcgaagtgttcaactggacaagaaccaccgcaaaaggcaaagaaatatcgtgaagcagaccgccgaattctcacgatggttcaaaattatttgccacttaacaacgcagacaccaacattttcccaattcatcaccctttcaatcatcattttattattacatttttgatcggaatttctcgaaattatgaaatgagaccgtgatttgaaaaataaattttttaaaattttcttggatttttaatttcactgtctttttaaacttttggtatggaaatggcccaaatgcattgggtagggaattggcggtagggaatcggccggtagggaattggctggtagggaattggcggtagggaattgggtcgatcccccaaaattcattttttgatttacgagatgaggtcagcccagcacggcagatttggaaaatccgatctctaagaaaaaccaaaaatatgcaaacatataagtgccaacttttgttggcaatcacaaaaaaatttcctcttattttttgagatatttatttgaattaaaattttactatttagtacaatgcatcgctcgtatttaatgcgaagaccgaatgacgaagatgacagttatgattatggagaacaggatctcgttcgagccaaacccatcgatgctcggttttcgagaaatttgggtccaacatatgcgggaggaaaggatttcgttcgtgcaagcgaacattcgcaaaaacaattttatggcagtcaaatggttgtgggaagtgagagccaacagcacaatgaggaatttggagaaggaacttcaaaagaggccgacgacaaaagcagccgaccgatgacacacgacgaacggaacaaaatcagcgccagcattttgaaggcggaacttcgaggagacattgtaacggaaaaaaaacattttttttgaatacttggcaacaaagcaaactttaggagcgcgtcaaaaagttgaaaagaaaactcgaggaaggcattgtggaaaatgaaaatggaggaaatgggaaggacgaagagggagaaggaagagaacggaggagagaagtactgttgcttagcatggacaaacggagcggtgtggtgatgccggccaaaggaccgcaaaaggtaagcgaagcaattggttgggagagtataatggcgacattcgtcgggataaaatgaataaacgtttaggagaaaaattgttttaggcattggtttcagtcgtttcgatattgtggcgaaaaaaattgagataatatactggaattgtaagaaataatcgaaagcttcattctatttaaagaatcgcaatgagccctcagagaaacgacggattgggaccgttgacgaggaattcggcaaacacatggaactcagccaaatggtcgcagaagagaagacaaccacggcggagcaacaaattgcaatgtttaaccgttctgcaaaggtaaattgccaaatgtataaaaaatattataaatattttaatatcagtaatttaaaatttaaaagattttcattgaaactcggcttatggcaaagcggagttcatgcaaatttcatttttttcctttctgttaatgttttcatgatctctaggtttgttccgatagtaaaactgatgacgattgggttgtggacgacaacatgatgagtcatcccaaaaagcggcgtcatgaagagaaggaaatagtcaggaagaagcgcaacatggtggaaggtgggtaa

SEQ ID NO: 59528 - DNA, 905 bp, Heterodera glycines
  Genomic contig location: Contig_ID=SeqID_5879; Location=3716..4620; Strand=-
  SCN-specific regions: Sequence locations=1-157,179-463,486-712,735-905
caattttacattctgcttaacgtgttagcttcaactggctttgttttctgtacaacagaatggttcggagacctcagagcccatatgaatcctccgaaatttcctccgttttatgacatcgtatacgacgaaccaggcattgttcatttaggatatcataaaaaggaaaaagaataatctattgcagattgtccatttgggcttgaaagtgtggccatccccgagtttgtgtactttggggaaatgattgcaactaaatttgttcaagagcattcacaatgtctgcagttttgcttggaaacctcaaagtgcaaagctgtgaatttctttgaatcgatcgaaggaaaagtcagttgttcctgtgttctatcaaaaacattttaacaattcagaatcccgaagtcggtttctgtgaactgttggtcgaaggccagtatgacaacccacgactgatgcgacctttcaaaaaagcaacttaccatgaaaaaattcactgccgagctgaaaacgaagaggaaaaacagccattcatttttgatgagaaggagggcaagcaattgctaattggaaacgaaagtaacgaacgcaaaaacacgtcgtcgacagcgaaacaaaccgaaaaagggacaaatgaaaacggacaaaagacaaccgcggaaaatcggcaaagtgaaggaagaatgaacgagcaacggagccaaaaaacaacggaaaaacagccgagaagagaagaacaaagtggaggtcgaaaaacggagacaaaggaagaaacggcacaaaaatcggaaacgcaggaaaaggcaacggaaccaccgacagcacaattaaattcactgattctcaaaagacttgcggaaagaattcaagaactcaaaaagcggttcagaaattgacaaatgaggaac

SEQ ID NO: 59529 - DNA, 1295 bp, Heterodera glycines
  Genomic contig location: Contig_ID=SeqID_28952; Location=1..1295; Strand=-
  SCN-specific regions: Sequence locations=1-187,220-1151,1173-1295
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctgtcagtatccctgcaaagtttggtgcgcttctgatcagggggagaaaaaaaagttaagcctaaactttttggcctgt

SEQ ID NO: 59530 - DNA, 156 bp, Heterodera glycines
  Genomic contig location: Contig_ID=SeqID_28954; Location=1339..1494; Strand=-
  SCN-specific regions: Sequence locations=1-156
accgtcgccgggtcaatgtccgagcggacgaagtgcaaattggccatccattcttcgtcctcctccaaagttttgcagtgactgctcatcaaaatgggctttgcttctgtctcgtcgccttccttttatttattaagcttggattttgactaaaag

SEQ ID NO: 59531 - DNA, 769 bp, Heterodera glycines
  Genomic contig location: Contig_ID=SeqID_28955; Location=1..769; Strand=+
  SCN-specific regions: Sequence locations=1-769
  Gene Ontology: Mol. function=chaperone activity; Cellular component =nucleolus; Biological process=nucleocytoplasmic transport
tgaagagtcgtctgcttcggctaatgaagaagtatcaacatccgatgacccagcatcaaccactgaagagtcgtcagcatcggctaatgaagaagcatcaacatccgatgacccagcatcaaccactgaagagtcgtctgcttcggctaatgaggatgacccagcatcaaccactgaagagtcgtcagcatcggctaatgaagaagtgtcaatatccgatgacccagcatcaaccactgaagagtcgtctgcttcggctaatgaagaagcatcaacatccgatgaagagtcgtctgcttcggctaatgaagaagcatcaacatccgatgaagagtcgtctgcttcggctaatgaagaagtatcaacatccgatgacccagcatcaaccactgaagagtcgtcagcatcggctaatgaagaagcatcaacatccgatgacccagcatcaaccactgaagagtcgtctgcttcggctaatgaggatgacccagcatcaaccactgaagagtcgtcagcatcggctaatgaagaagtgtcaatatccgatgacccagcatcaaccactgaagagtcgtcagcatcggctaatgaagaagcatcaacatccgatgacccagcatcaaccactgaagagtcgtctgcttcggctaatgaggatgacccagcatcaaccactgaagagtcgtcagcatcggctaatgaagaagtgtcaatatccgatgacccagcatcaaccactgaagagtcgtcagcatcggctaatgaagaa

SEQ ID NO: 59532 - DNA, 772 bp, Heterodera glycines
  Genomic contig location: Contig_ID=SeqID_28960; Location=846..1617; Strand=+
  SCN-specific regions: Sequence locations=1-72,95-111,133-216,238-772
ctatgaaaattttgaaaaatttgccgtttcttctctttcaactgttattactgacttgtttaggatctcattagacattggttcacttccagacatctggaaagaatcaattgtttttccgctttttaaaaagggtgacaaaaataatcccgaaaactataggccaatttcattaacctgctcactctgcagggtaatggaaagaattttaagcaaaaatatttacaattttctattaaaaaacaaaaaaatttcggaatttcaatttggttttgttagaaataggtctacaacgagtcaactaataacagttgtggaagattggtacgaggcaataataaatggaaaaaatgttgtgtatttatattgattttcaaaaagcatttgactcagtgccccatgaattacttttatacaaattggaaaaaataggtataaggggcaaacttttgatgtggataaaggactttttgagtaataggacttttcgtgttaaaattgtggaggatttatcctccagtaaaaaagttggctctggcgtcccccagggctctgtccttggacctttattatttttgatttatattaacgatcttcctgatgctttgtcatcaggagtaagaattaaattatatgctgatgatgttaaattgtatatttgttataaagcaagaaccgaaacagaaattatgcataaagcattgcataatttatcagaataggcaaataaatggcagatcataatctcaattaaaaaaacttttgtacttca

SEQ ID NO: 59533 - DNA, 1937 bp, Heterodera glycines
  Genomic contig location: Contig_ID=SeqID_5880; Location=319..2255; Strand=-
  SCN-specific regions: Sequence locations=1-499,521-643,665-1071,1093 -1145,1168-1249,1271-1310,1332-1540,1562-1588,1610-1845,1878-1937
atgactttggtcaagactacagtggaagcattgaaacaactccagacctcttttacctccgaccaaatgccaatttttaataccctaattaccactttgtcctctcaaattgacctgcttaatggatcgatttcccaactccgctccactgctctctccactgaaggcatgccaatttcagcggaggaattggaaagacagagaagtgtcgtcattattggcatgccagagcacaacgacagttcaccagcaaagcgggcagagatggaccggtcaaaaatcaattgcttattcgattcgctggggatcgaatgcggtaccattgcctatcgcatgggtcgttcctttaacccagcccaaaaaagtcctcgcccattgaaaattctcttgccttcccgtggcttccaaaaacaggctctcgctgcatggcaaaaaaaacaaaacaccattcgggctgctgattcgtctctgcaccatgtccgtctccgtgaatcgctgacaaaggcacaattggaggaacgccgtcgcctgcatttgcaatgcgttgaaaaacgacagaaagatgggcaagattggattgtgtatgctgggaacgttattttgagagatgaagtgcacatcttccggagtcagtcaattcgtgaatcaaatttttaaattttacaccaaatcacaaaaaaaaacaaaacacttttacaaaaagagtagattacactttccggtcggaagaagaaaattcttaccaaaatataaataattctaattcactaccactaaacaaaggggatattaattctttagaaggttttatctgttgcttaactaatattcgctctataatgaacaaaactgatgaaatttcactggctttaataaataaaaaaattagcatattattactcacagagacatggacaaaagacaatgagggaattcctcttagcccatggattaaggagaattataattatatttttgcatcaagaaaatccgaaaacagttcacgtggaggtggttgtggtattttaatcaaaaatgagatagccttttttgtaaaattttctggtacaaaatttaattgtgaaattttaattattcaattacaaaatctgaaatcaataagatttgcattgatttaccggcctcccaaaaccactttaaaacatacaaaagaactttttaaatttatacaaacattttagtgtgaaaattatataatcttaggagatctaaatttgtcaaatcgagaattggtatggaggcaaggccaaccacacgctataaatcatattggtgaaatattttgcgacttttttaataaatttacatttataaatgccacgaatgagcccactaggggtaaatcatggttggatttgatcttatcagcaaatgataaaattgtaaaacattgtactgttgaaggtggcatattttcatcagatcatttagcacagctttttgtgctgagtgttccagaaataagagcaaagcctaaagaaatttgcctaagacggtttactccgtctaatgtatcacatttaaatgctgtaatttctgctagattaagttctctttctctttcacattttagtataaatgaaaaatgccgtgccttcaatagcgccttgttgaatgccttgaacgagtgtattccaataaaaaaattactaaaaaaagatttagctccaaaatatccacaacatttattggcatccattaaagaagaggcaaaattatatagacagtgtaaaattgatccaacaaaaaaagcactttatgatagcattactttacatataaaaatccaaaccaaaaaaatacataatttaattgaacataaggctatttaaaagggaaaaaattcaatttttaaatacattcaaaaacacaatgtcaatccctttgaaataccaaatttagtttttgaaaataaa

SEQ ID NO: 59534 - DNA, 1004 bp, Heterodera glycines
  Genomic contig location: Contig_ID=SeqID_5880; Location=3703..4706; Strand=-
  SCN-specific regions: Sequence locations=1-102,126-135,186-298,325 -421,443-567,638-675,715-751,775-1004
atgccggattgtgcgcaaagttttgccgggcaaaatgaggcgctgaaaaagcattacaacgatcatggtcgctatgagcctgatcaacacaaattgttttcaatggcaccagtcattgttcatggggatttttggtaaattaaatttaattatttaactttttaatttatattttttcaaattatgcaatttgtaggtcaaataacatgtttttcaagacgtgcaatggacaaagtgttgctgatcaactgagtgctgtgttcgactggcaaatttgtcacactggtcaattaggaataaattagtgcttttaaattaaaatagaaaatacaataatctttctggctgtaataaaatacagtgatcctttctgactgtaggcaccggtgtcaacgatttgttgcgcatcatttacgtcagtgtcgatgcaccgctgagacgagttcattttgacgattggttggcattgtactgttccgaactgcactctgtcctggcacagcttggcaaagtggtgacataatttaaataagcggggttaacgaatttttttttgtgggttagatgataaaattttaaaaatttattttattttatttttgatttttgcaacaaatttattttttcttattttaatgaacaaaaatattcctttctccatttatgtaaaattactttaccaattaataaaattttcatttttacttctctgatcatttttaacagctatgataaaaattaaatctcactcaattttttaaattaattttattaccctgcaattaaccaattaaatttttgagttttctcttgcccagattcatcctgatcaacatcgatcactggaattgatcagacaaatggtggcccatcaaaatggctacgagctgtgctttcaattgtttttgatcaccaacattctcggcactgttcaacaacagaacgaacagaaaagggcgaaactgatcaaacggatgagagaattatatgatgatatctgttaa

SEQ ID NO: 59535 - DNA, 298 bp, Heterodera glycines
  misc_feature (160)..(160): n is a, c, g, or t
  misc_feature (167)..(167): n is a, c, g, or t
  misc_feature (182)..(182): n is a, c, g, or t
  misc_feature (208)..(208): n is a, c, g, or t
  Genomic contig location: Contig_ID=SeqID_5880; Location=4905..5202; Strand=+
  SCN-specific regions: Sequence locations=1-298
atgactagatcaggacagactcaaaaaccatttaagaccagagcattaattgcattagttagttcaaccacttttgctaattatagagactttctagttaaggatgtggaagaaaggttcgaataaaatattatggtttataaaattggcattcactttntcgtcanagtcaagttcggctntaagcgtgaacgagtccaccaattcncctgggcaagcacaggcataatgcgtggaaatgtgcaaggccacggatggcacttccgacctagaaaaaaaaatgctggcattttgtaaa

SEQ ID NO: 59536 - DNA, 1526 bp, Heterodera glycines
  misc_feature (1500)..(1500): n is a, c, g, or t
  misc_feature (1526)..(1526): n is a, c, g, or t
  Genomic contig location: Contig_ID=SeqID_5880; Location=5086..6611; Strand=-
  SCN-specific regions: Sequence locations=1-180,203-269,311-435,479 -737,759-912,934-1080,1102-1223,1245-1284,1306-1364,1387-1526
atgcctttggacaatttggacagtgccattgatcagtcccatgccgattttaccgttggctatgtgttggataaattagccactgttggcaaactgggcccatccgccggcttggccaatgtcgaaaatgcacaatttgtccagctgagcaccggcggctttttgtccgacatttatcgcattcaaattcaattcaaacaagcggatgacaccgaagaagccacaacgccaacggcattttcatgcattttcaaagttggccaattgtcaaattatttaaacaaaaaattattttgaaaaaaaaatttttcaggtgcctacatcacgacgtttggatatgcatactggaagcgagaaggctaaggtgaagcgaatgttttttaatttttatatgatctacagggctgggctttaactccgttattacggttcgggttttaaaaaaaacaaaaaaattaattaacaaaattcttaaaatcatggcatgggaagaggaggagtcggtcacaattagggccaggagagatcgtttcgattttccagagatcctgatcccaatcccggcctttttgaaaaaaattgcatgattatgatcccgataagaaccaaatttgaatcctgatatcctatctcggcctgatccccaattccggtcttgatctcgacttttttttttaaaactttcccaattaatttgcatgcaaaaattactggataatcaatcagttatttttggccattaaataattaaaacaaatttgttggttgaaaatatttcatgaaaatgagactcagttgttaaaaaatcaaatttttcatgtcaaaatttgtaggaagacatgaagatgtggatgtacacggtgcacaattcggagtgccacttttacgccacggttgtgccgttgttgcgtgccatgcccgtgccgttgccctttcacattcccgagctgtacgcgtgccgaaacgcggcatcgccggactgtttggcgggcggctatttgttgatggaagacgttgccggggatggcatcatcgaaactgatctgagtgaaggtctaaccaaagaacaggtggtgacaaaactattttttgttgtttttacggtaacatgcccaagtaattaatttggataccgtatttactgaattaaagctccgggggctctgtttttaaccccctatttcagagggcagttcctatgtaattcattaaattcggtaatatatttattttttgtccattttcacatattttaggttaattttccagacaaaaaagtttaggttggttttccaggacaaaaaagattttggttgattttccaggacaaaaactaatcgatactattggatcaataaaatattcaagatttgaatctcatttacaaactggacaaaaaaacaatttaatttacaaaatgccagcatttttttttctaggtcggaagtgccatccgtggccttgcacatttccacgcattatgcctgtgcttgcccaggngaattggtggactcgttcacgcttan

SEQ ID NO: 59537 - DNA, 782 bp, Heterodera glycines
  Genomic contig location: Contig_ID=SeqID_28962; Location=312..1093; Strand=-
  SCN-specific regions: Sequence locations=1-262,302-400,422-473,496-782
atggcaatgctaatggacaataatgaagaatgccgcagcatcattttttataaactgtatgtatgataatagaatttttaatcaattaagtaattaaggcaaaaattgggttttatttgccagaattttagtggcgggcgcgcgaggcgtacataaagggcgagaaaacattcattttgagcattgtgtaaatgctagagtaggtcggaaccgcgaatttcattttttttttggcaattttacaaaaaaaatttttcagaaatttgtgggaaaaaatccatttggcttttattgcagttgcgagctatatgtatacctaactgtatattctatataaatcaagcccagcagcaggaggatctatttttcaatccccctcgaaaggggaattttatttcgtgggaggggggggggctctaatttaggaggggggggggggggggaggttaggaaatacggcaattgttaaactaatttttataaatttgctatcagactttgaaagcgcctgacaagtgttttttagcctataaaattcgtaaaaaattttttttttctaaattctcgtaaaaaacctacaaattacgccttttcgaacttttttgcagacgcatgcatttttttttttgtcaagacttgatgactggatcgcttttggtttttgcatacatataaatgcgcatcacacacagatgcgtttgtgttaaaccctttttgcttccgcgtgggtggtggtggcggattatcgcaaaaagtgcggcgacagcggcgaagcaaataaa

SEQ ID NO: 59538 - DNA, 1216 bp, Heterodera glycines
  Genomic contig location: Contig_ID=SeqID_28964; Location=105..1320; Strand=-
  SCN-specific regions: Sequence locations=1-1019,1041-1113,1135-1216
atgagcgacggggagagacggaagctgcaccaggcgatgggcgagctgaagaggagcggagagtttgacagattcaacgaccagcacagacaggcaaacaatggaattgagtgactgaactgatccaaacattcactgagaaattgccatccataggccaaaagttgaccaatcgataattggccaaaagttgatcaatcgataactctaagcactaacaattaatcgttatataggctcctatctgaagcaaagtgtgtgcatttgctaattggtctgtcatttctcaggtcggcgtttcctccggcgctcattcgggccccggctttttgccgttccatcgcgagttcatcaaacggtttgaaattgcgcttcgtctggtcgacccgtcgttgtcactgccttattgggattctgtgctcgactcgtatttgcccaacccggccgattcggtcattttcactccacagtttatgggggaaactgatcagctgggaaacgttgtgagcggaccttttgcgggatggcgcactttggaggggcgggcgaatattttgcggttggaattggcaaaaattgaaaaaattgagcaatcatttgaagatggcccggggcggaaggacgtgtgatcgacggagaacgacgtgaacagcgtgttcgggacagacccaaatcgaacaagtgttggcttatacggcaccacaacaaagtgaaagcatcgggccggggggagggcaccgccggacgaatcgaacggcaaagaatggccgaccgatcagtggaaaaccgaaaaaaaccattgatccgttcgttccctttcaccattctcccgatcaccacccgcttctccctcaaccgattgatcacttcctcagattgtccctaccagcccaacttcggtgcgcttgaatattcacattcccaagtccatttgttcgtcggcggcgatatgaaaccgccaactttggcagcgaacgaccccattttctacgtccatcgtaatttaatattttatggacgaaaagccattgataaaaaacgactaaacccattgattaagactcattcattgacttggtctgggaacagtggcggcagctacgacagacgagatggacaagagaacaggtggaacagacagaaaacaatggaaaagcaatccaagctgatgaccaatccaatcactgatcccaataaatcaatgttaagagactga

SEQ ID NO: 59539 - DNA, 1588 bp, Heterodera glycines
  Genomic contig location: Contig_ID=SeqID_28965; Location=1..1588; Strand=-
  SCN-specific regions: Sequence locations=1-38,60-892,914-990,1049 -1056,1078-1118,1141-1322,1345-1427,1449-1463,1485-1486,1542-1588
  Gene Ontology: Mol. function=GABA-A receptor activity; Cellular component=integral to membrane; Biological process=synaptic transmission
aggtcaagaaaagcagagcgtgttcggacaatcaggcgttttataatttcagatttatactttctagatgccaaatttgcctatcttcaggaagtgacaatgccaaactttgtgcgttcgtttctttgctaattacccttaatgagttcctcccttacagatgctcgtaatttacccggatggccttgtatttaaaacgttaaggtgtttattaatccatttttgcttcttttattaccctaataattaaggatcgacgtgactctctcctgcaacatggacttgcaggttgggagcaaaaggcaagcaccaaaactgaacggcacattccgccgccattcagctgttcccattcgatcgtcaggagtgtccaatggtcatccaaccgttcgcttacatcgaaaatttggtgaacctcagttggcacgtggacccaccgtactacccggtacggtggctttgctttcagttttggatttcctacgtaacatttaatcataagaacagatcacgaccaatccggagctgaaacttaacgacatggtcatcacggggatgcgcttcgagcggtgcacgagtccgtacactcttttcaggggcattggtcagtcagtgcgcgtcgttcgtcggcatttcatccccccccctttccctcccctcaaggggtttggtcgtgcctgcgcggttacatcgtaatgaaacggctcgtcctcttccacctcatccaaacgtacatcccaagcggtacagtaccaccgtattcccatgctcgcattacggtgtccgtccccttttgttggttgtcctcttcatgttcagccatgttagtctccgtttcgtggatgactttttggttggacccccgggcatcgcccgcgcgcattacccttacaatcacaaggcattcattgttctatttttaatgatatttattacataataaagcatttttagtctgctgactttgaccacaatgtctaacggagtgccttttttttattttatttttaaatattttgtaaaataaattaattaattttttaaattaggccagacaagacttgccacaagtcagttacatcaaagcaatggacatttggcaaacgttctcccaagtgactgcctttgaagtgccaattctccccaatttgccctttttaggcactgattttccttgtactgctcgaatattcgttcgtctcttatttcttctcacgacggtcctttgactgtgctcaccgaattttacgcagcgaaagtgccgggaaaatgaaaaagcaaaaggaggaaaggattacagcagaagatgaggaaaagcagatggaagaaggggagaaagaggatcattattattatcataatcaacaaaatgatggaacaaaaacaatggaaatggtaagagaaatgatgggaacagaaagagagtgggagaggaagaaagagacagattgggaaaagagacgaacatttaaagagtaaattgatcagagagagagagagagagagtggggtagagagagaaagacaaagagagagagagaaattgagatgcaaattttagagagaattgatcagagagtgtgaagag

SEQ ID NO: 59540 - DNA, 563 bp, Heterodera glycines
  Genomic contig location: Contig_ID=SeqID_28966; Location=1209..1771; Strand=-
  SCN-specific regions: Sequence locations=1-151,186-253,342-511
atggaaattcatgctcattttaagtcatttaaaatcacagtctacgtagatcttgctgggtttgatcacgattttacaaaaatcttgatcattcaaataaaaaatgattttttttaaatcattttccattttttaccaaaaaaattcgttgtttttaaaaatatttttcataatttttttttatagacaattgaacgtgaaattgacggatggtgaaagcaactttgcctacaatgttttgttgatggaacggtaaatttgaatttttattttttgaaaataccaaaaagaaaatttaatttaatgattaactattttttcaaattatatttcatttatttgccaataatttttcataaaatttaatgtccattttccagtctttgtccaatggtcaataaaatgggagtagctgcaaacaaaagcaacctgatcatgcagccacttgagtaaatcttatttaaaatctaaatccttaaatattgcttagagaatactttagtgtgtgtggtttaaaacaatttttgatatatttttaattaaatttagtataagataataaa

SEQ ID NO: 59541 - DNA, 588 bp, Heterodera glycines
  Genomic contig location: Contig_ID=SeqID_28968; Location=529..1116; Strand=+
  SCN-specific regions: Sequence locations=1-77,99-149,195-396,419 -448,470-588
atgtcatttcctaccaaagaagctgcaattaatgaaattggccaactgtcgactgaccagcagaaaagttagaaaacaattaattaaataatttaaatgaaatggggggatttgacttttgccatttcggttctgctcatttgaaactgaattttttttttctttttttaaattattttgaaaattttatttttcgatgctattcaattatgtttcagcttctgcatcaaaacgtccccgaagccaaaacgacgccggggccgagacggcggtgccgaaacgtcctcggggccaaaacgatttggccgaaaactcagttgctacagaaacagaaacaaataatggagttgaccatttgctggcgactgatcagcaccaaagttggaaattaattcaaaatttgaggattaattttaaattatctgtgccaatttggcgttgaaaatggcattttaaacaaatcctaagtttcaaaaattgtaactacaaaagcccacaaaaagtctaattgttcaaatgttgtgaaaattactaaaaaaatcaattaagttttgcatgctaatagagagcaaccaaggctttcgaaca

SEQ ID NO: 59542 - DNA, 1057 bp, Heterodera glycines
  Genomic contig location: Contig_ID=SeqID_28969; Location=118..1174; Strand=+
  SCN-specific regions: Sequence locations=1-992,1015-1057
atggaatcgaattttgttgcatttaacaacaatattactgatcagaacaacgaagataacgatgataaagctgacaatcatgcaaagcaatcaaaggaaatgctgaaagagagccaaagtgaagcagaaacatcgtcgaaagaagaagcgaaaaatgaattggaggaaacggagaaggaagaaagaaagcaaaagtcagttggaagtgaatgtgagcagcaaaaagcgatgagtgactcctccgaagagtccggccgtgaacactttcctctggtcgaacatttggactgttccccgctttaccgcgacccgaccttcgctgaactgtgttccttcttcaacatgttcactccgatgttcggctttaagcccctttccttttcaaaattagagaatatgttctgcactttggtagaaggcgatggtttgttgtaattgcatttttttatttgttaaaacattgcttcagcaactcgcgagctgattgatcttcacataacgctaatgcgaaaaatctatttgaagtcggctcgggcggataaatgggaacaatcgctgctgaaattttgtgcaattgccccgggattggacgcagaattccggcagctgcagcgaaacacttacggaaacattccgatgggctcaaaactcgctgtaatgaaagccctttgtgacagccaattcgattacaatctgaagttcaaagaaaatgtgcggccattcattcagttgttgctgcttttctacaacattttttcagattgccaattcttttcggcacaacgaacttcgtctggcgccgattggcactgacaaacgcggccaaatgtactattttcaggtcgattatgacctcgagttccgagtttactctgaggaaaccgatgacatggctggtgtcagttggtcattgagagcgcgtactgaagctgaactggccgaactcattgagaccctccgaaatccggattatgggctggtcacaaaggaacagcaggaagaagaggaggcggacatcgacgaggaacagcttttggaccagccgaatgaaggttaa

SEQ ID NO: 59543 - DNA, 794 bp, Heterodera glycines
  Genomic contig location: Contig_ID=SeqID_28970; Location=325..1118; Strand=+
  SCN-specific regions: Sequence locations=1-141,182-794
atgccttatttgcttaccaattcaaatggtattttttgctggtctttaaactttatttcttatgtatgtgaatgaataataccttttggtcttcgccaattcgaggaacggcaaaaaatgtttttttccaaccaataaaccaattaattaattaattaattccagaaattaattaatcaatccccaccatttaatgcggcagccagaattaattgcgttttgtgttcacgcggaaacattgtgatggtgaccttcaaaaatgatggtgctgcaatttttcgctttaaaaacgcgcgtcacagtcactgatcaaattgggatgtgcgcggcgccgaatgatcacgcattgtgatcagtcagtcatttacggcaattgcatgcacgcccactgcgcgcttttttggggggcctttgatcaatgacaatcatttttggccctccgatcactgcctgctgttgtaagaaaatttttcatctaacatcattgctgtcggtttagcagcatgtagtgaatatctctcagaaatttttgtccggtcaccacgaccagcgattaggagatatttttttttttgtagagaatttaatctgatcattcaatgatcaattgaagagcaattttattgcgatccatcatttacaaatgctaaatttagtggttattttgaagaatttagatggattcaattcgcttctttataaataacaaataattagctccgaccaataagtccaaaacatcgtttcctgtgttccttgaagtaaccagtatttaatagccaatcaaagtctga

SEQ ID NO: 59544 - DNA, 53 bp, Heterodera glycines
  Genomic contig location: Contig_ID=SeqID_5881; Location=4306..4358; Strand=+
  SCN-specific regions: Sequence locations=1-53
atgattatagataaagtgaaagggtatacttataaaattctattctacgcata

SEQ ID NO: 59545 - DNA, 703 bp, Heterodera glycines
  Genomic contig location: Contig_ID=SeqID_28972; Location=400..1102; Strand=+
  SCN-specific regions: Sequence locations=1-121,143-398,420-424,446 -485,528-639,662-703
atgagtcttttgtttgccagaattggtgagccgaatcgagcgaaaacaatggaatcatcaatcgcaagcagctcaggtgtgtttggacaaggtggaaacggtagtaaaatatttaatttttgggatactgtatatatcaaaattaaatttaaacattcagaagtggatgatgatgggaccagcagcagcttttctgacggtaatagcagaaaatcagcaatcgctggtgagaaatttctttttttgcataattttccaatttctgaattacaacaaaatacacttttgaggaagactgatattgcttcataaattatagcttttaaaaagacaaaacgatctgataaagaaaggagaaatcttttgatttatgttaaatttagacttctttttattttcagacagaagaaaaataaataagttgttcattttgactgtagtgaacattacggtaacagtggcagtgatcattttctttacggtggtttaaatttaaaatattattataaattatttttttaaatttacggttattttcgattgtcagattgagaatgcgcggatcacttctgagttggaatttttgaagaaatttgttggaaaaatggaacaacaatattggaatggttggaattaatattaacttttgtaatttcggaaatcggaattccgtgccatccctgtctctgactataaatttgga

SEQ ID NO: 59546 - DNA, 330 bp, Heterodera glycines
  Genomic contig location: Contig_ID=SeqID_28973; Location=612..941; Strand=+
  SCN-specific regions: Sequence locations=1-262,285-330
ccgggactcaaatgtcccgctcaggccaaaatttttttctatttccgggaaaaaatcgaaatttttccgaaaaaaataccagtcgatagagctcgaaaaactatgttttggaagtggtctccgtttttctgggaaaattcgttaaaaaatcataaaattaaaaaacccgaaaaccgttttttaggcctaactcgaaaaattttgaaaattttcgaaattttaaaatctggaaaaatcgagcttattgaactctacaataagtctgctggccaccctgcgctcaggtcaaaccctaatgagttattcggctggtactgaagtgggaaaaaa

SEQ ID NO: 59547 - DNA, 631 bp, Heterodera glycines
  Genomic contig location: Contig_ID=SeqID_28976; Location=33..663; Strand=-
  SCN-specific regions: Sequence locations=1-55,104-142,186-197,230 -269,307-388,558-631
atggtaaaaaaaataaatctatgataatacttaagtcaaaattaatgaaagaaacaaattattaaaattaaatgtataattcataaaaaaaattattaattttgatggttaattgactttattgacaaatgtgaacataaagaattgaagtcagaaagaaatagttttaataaattaaaaaatctggtaatacattgtttttaataattataagtaatttaaaattattggattgtccattcattgagttttaattttatttctttacgaaaaaatatttttaaaaacaatttaaattatataaatgtgataagacaacaaaatcacaaaaaaaacaaatcaaaactatcaaagaaattctaatgtttgtcattgcgagaacgaaaagttatttattactttaagattttttttttgaaattgtagaaatttttaataatatttaaaaatgataaataatttaaaaaatctgcaaaaatattatctaaataaaaaataataataattaattaaacagaaaaaacggataaataattaaagaatattattatttttttgccagcgcgttttaataactttccgaaaatatgcaccattttacaactggtagtaaaataatgcatttaataaa

SEQ ID NO: 59548 - DNA, 542 bp, Heterodera glycines
  misc_feature (428)..(428): n is a, c, g, or t
  misc_feature (431)..(431): n is a, c, g, or t
  misc_feature (434)..(434): n is a, c, g, or t
  misc_feature (522)..(522): n is a, c, g, or t
  misc_feature (536)..(537): n is a, c, g, or t
  Genomic contig location: Contig_ID=SeqID_28978; Location=38..579; Strand=-
  SCN-specific regions: Sequence locations=1-267,289-542
atggcagccaaaaatgaaaatggaatccaattgccacgtaagtctaacaataagcaaacacctcgagtttgaatacaatatgctttttcctttcagagaaactcaacaacgaccatggagttcgtggcatcgcgccggttgacgtgctcatcaatgcatttgaacttaatctgaagggcgcacctgacatggtgtaccagcacgaacttcgttttgtgggagaatatcaaatgaaaaagggcagagaaggccaactagaaacgcgtgaattggcacaaggaccacagaatgagtgagtgttttgaaaaaagagaaattcgaattttcaaactttgttcgaaaatggtttcatttcagcgagtgtaaagagacgcgtcgtgagttgcattggtcgctctggcgattttgctcgatcagaatgccgactnttntgngggcgagaagaacagttcagctacgactgcgctcttctcctttattctgtgcgtcgtcttatggtaaacggagagatgcgcgaatttngtgatcatgccgannagttg

SEQ ID NO: 59549 - DNA, 937 bp, Heterodera glycines
  Genomic contig location: Contig_ID=SeqID_28980; Location=169..1105; Strand=-
  SCN-specific regions: Sequence locations=1-236,265-286,308-556,584 -637,684-825,865-907,929-937
atgaaagccgaaatccaagcacgtaaactcggcatccaagtacgaatccgagccctgattaataactttttaaaaacttgctatttttttttgttccaacatatatattaacaaagcattgatgagtttttcgttaaaatggttacagttgtgttaaatttgtcacaatcataaaagctgtttcgactagaaacttcctgtcgcctcgaaaagacagcgccgtcctccgttttagcttaattttcaatttaattatttttaaaactaactcaaatttaatcacaatgtccattttttaaaaattgttattccgacatttttattcacaattcaaattgaataaattatttttttcagaaaaaaataagcaaaagaaaataatgccaaaaagtaattccaaacgtaaaaaattggacgggggagtacagaactttttgatgaagcaaaatgacggcacaaaggtgaaaaaaagaaaattaatgaaaacaaatgtctattttaatatttttttcaaatagctggacattcgcggcgaacgcgagaagcaaattccgagccaaaaattggaaaaatttttcacttttgatggaacaaaagcgaatatccaacagcaaaaggcgcatttggtaatttagtgaaataatttttataatttttatttaaattaattatttaatatttttccaaattttaggcaacggaaccgacaaatttaacacttccaaacactgtgacgccgaaccaattttcgatgggaaaccttttgaatggcacggcagctgcttctcttccattcgctcacaatttttggaatggtaaattgagttaaatttaaaatttaaaaaaattaaattttattttaatgattaaggttcttttccgctatgccctccccgagtagttttaggcactgatttagtatattgcatcaaataaa

SEQ ID NO: 59550 - DNA, 656 bp, Heterodera glycines
  Genomic contig location: Contig_ID=SeqID_5884; Location=2681..3336; Strand=-
  SCN-specific regions: Sequence locations=1-30,52-166,189-656
atgtccggtcctccaaattgcttacgccacaaaaaatcagaaatgtatgtggaaaaaagtgatctttgcgtgccaaatctcgttttgtgttgctgcttgaacttctgccacgtcgattcaattgtgtttgtatgctgcccagtgacaggatccttgaagtgctccgagaaaaagttttgaaaaaatttgacccaaaatgtggatacaaactagcggagtaccgagtggtttatgtgtccgatcatcagtcttttagctctaacttttttatcacttggtcgatgccttcattcttgttattgaccgaaagcttaaggtctcaagaatttgtaaatgcaagaaaagagcaaaatgtgaccttgcgaaaaacagaatttgattgttttaaaatagtttcaagtgccaaaatctctccattttttgagttttgaaccggttcaaaaaccgtttttttttgccatttccgtaaatggagatatattttttcgtacttagcccctcgagacgaatcgattgatatatcattaacccttttttttacagggcgttctacagttcaacaattccagcgacaaatgatttagctgcctgaaaatttttgatatcgtatttcctaaaatacagcacctccccccttgaaagggttgaaaaataaa

SEQ ID NO: 59551 - DNA, 426 bp, Heterodera glycines
  Genomic contig location: Contig_ID=SeqID_28982; Location=194..619; Strand=-
  SCN-specific regions: Sequence locations=1-426
tcaaagatccgtgctgtcctccgactgcgacgacttcgacttggtcaattcgaccgcctcccctctcttcgcttacccttgcgttcgcctgattcccattggccaaatcaaacaaattttgcatgacaaaatcacttcgctgaatgaggaagaatttcaatgcaaagttgagggcgatctttttcgctccgaggacgggttgctcaattctctgctcagttttgagcattttgctcgcaaattacgaattgtcgagaggggatggcccagcggattccgaatgtggtgggacaattgaacgaaattcttttcaaatgacgaactaacaaaggtttcgcgagaaaagcggatggatatacgaacggtgttcgctcgttgcaaggataaaggcggggtttgcgcaaaacgacgcacactttgacatgg

SEQ ID NO: 59552 - DNA, 571 bp, Heterodera glycines
  Genomic contig location: Contig_ID=SeqID_28985; Location=521..1091; Strand=-
  SCN-specific regions: Sequence locations=1-25,47-232,265-439,461 -487,533-538,560-571
atgtgccataatcgaagagtgagtgtgccagccagccatcagccaaataaatgcctcctaattagcgtcaccatcactcccatccgcacgctcggtccaacacgtgacgtgacgccatatggtgtcaaagtttcaacttttccgcaactgctgcaatcagtgcggcacctttgacgctgccctcgtcggcgggcaccaattcccactgtaaacggtgcaaattttcagaaaattggcaatttgttttaaaaaatgaaaatttttgtgcctcaatgttgagcggggccaacgagtgcagctgcgactccaacagctcgtggtatgtgggatggaattggatgagtgcaccgccgacgcccaccttcaccttccgtttgccgacatggcgcaggagggcggtgattgctggaaatggtaaacaaataggggacatgaagtgtgcactttccactcctcctccctcggcgttcctccccccccccccccgaaaaatttaaattatgaaaattttcaaaaaaaaaagaaaaattttcagcgatttttggataaatttttgaaaaaacgtacctag

SEQ ID NO: 59553 - DNA, 461 bp, Heterodera glycines
  Genomic contig location: Contig_ID=SeqID_28985; Location=341..801; Strand=+
  SCN-specific regions: Sequence locations=1-192,214-219,265-291,313-461
  Gene Ontology: Mol. function=hexokinase activity
cgacaacagcggggtgttcaaaaattgtcgtcgcatttgtgacgagttggaggtgccaagccacgggagcaacgactacctgatcatgcgcgaggtgtgccacgtggtctcattacgttcagcagccattgttgccgcaggtatcagagagtcgaatttttccaaaaatttgatgaattactaggtacgttttttcaaaaatttatccaaaaatcgctgaaaatttttcttttttttttgaaaattttcataatttaaatttttcggggggggggggggaggaacgccgagggaggaggagtggaaagtgcacacttcatgtcccctatttgtttaccatttccagcaatcaccgccctcctgcgccatgtcggcaaacggaaggtgaaggtgggcgtcggcggtgcactcatccaattccatcccacataccacgagctgttggagtcgcagctgcactc

SEQ ID NO: 59554 - DNA, 244 bp, Heterodera glycines
  Genomic contig location: Contig_ID=SeqID_28985; Location=1329..1572; Strand=+
  SCN-specific regions: Sequence locations=25-125,150-244
tttttcttctccttttgtttctctgatcagaccgttgatctgcggcatcaaattgtacacgacgaaaatggtcatttgtttggtccatttttgcgagtggcctcctccacgttgtgttgttaactcctcctcattctccgcctcctcccaccatatatttaattataattatcacaatcgtttttttttatcacactcttaacatgttttttgtggttgaccagcaaataaatttttaatctgc

SEQ ID NO: 59555 - DNA, 599 bp, Heterodera glycines
  Genomic contig location: Contig_ID=SeqID_28986; Location=828..1426; Strand=+
  SCN-specific regions: Sequence locations=1-118,193-309,336-339,379 -507,533-599
atgtcgccaaacacactttgtagcattgtttgcctgcttttggtctgcaacttcatctgggctgatgatgaacacagaagcttcgcagaggaattagtgaggtatcaatttaccatccaatttaattttttttaatttttaaataattaaataaatttacctttttaatttataatgaaatttttaataattgattgcctttaattaatagacgcctgcgacgttcccatggttactcagttggttatggaggcaattgtgcttggtaaatttttgaaaatttcttttttttttttttgcatttttttaccacaaaaataatttggaaaaatttacgactaaatttaaaatttattattaattttaaatttttaaaatcaagttcttcctccgcctacccggcgaccgcttcacacacttcatacacggcacctaaacaaaccagttactcatcttactcttgctccggttccggctgtggtcatcaagtaagcaattttgaaattctaattttaaaattttaaaaaatttaggcctaccagccaccccaaaaaaacagctaccattggtgcactgggactgccctgcacaaagcgcag

SEQ ID NO: 59556 - DNA, 268 bp, Heterodera glycines
  Genomic contig location: Contig_ID=SeqID_28988; Location=749..1016; Strand=+
  SCN-specific regions: Sequence locations=1-268
atgacagctccaacttcggcagttgtgcgtgagcaacatttggcccttcggggtctgtcaatgtatattacaaaatgttaccgaaatatttttgttttaagtgatgcgactgtccaatcccaaatttcatgagaccatttgcttgggccgcgatccggccgatcctttctcaatggctatttgtgattcgattggcaaattgagtggtcaaagttctgtcgatttgccgcttgattcctacttaattgcaccacatgcgatgagatga

SEQ ID NO: 59557 - DNA, 667 bp, Heterodera glycines
  Genomic contig location: Contig_ID=SeqID_28990; Location=491..1157; Strand=-
  SCN-specific regions: Sequence locations=1-10,32-667
gcaaaggcacaaacaaaaggcaaaaagtactcttggcagcatttatttgcaacgagaatttgaccaattatcacagtcttcgcttagtgatcaaaatgatcacttttcatacgaaagcccaagaagctatcaaattgggacagaaattgtcgaagttgcaaatgatcatagcaacgaaggcaatgcaacggatcatttcaatcgccgccaattcaatgaaacaaacaatgaaattgttcctatcgagaaaagccaaaatgatggttctgtttctgcccatttttcacataacgaaaatggtcaaatgcattacggtagagcaattactgtggtttctgatcgaatcaatgatagccgtgcggacggactggacagatcacactcatcatcagccgactatactactcaaaaatgtggcataatgccaaaattgccaaatttgggcgaaaaattccgacattggcagttaaaaatgaagatggacatgcaattgcggatgcattgtgttaagaacacaaaattgcccaggaatttggttgatgaccacaaaaataacaatttttttctgcatgaacatcccggaaatggtgaagaaaatccctactcaaaattaggatgggatgaaaatccgttttatggcaaaacaccatcattcaagagcaattaa

SEQ ID NO: 59558 - DNA, 54 bp, Heterodera glycines; identical to SEQ ID NO: 53113
  Genomic contig location: Contig_ID=SeqID_28991; Location=696..749; Strand=+
  SCN-specific regions: Sequence locations=1-54

SEQ ID NO: 59559 - DNA, 394 bp, Heterodera glycines
  Genomic contig location: Contig_ID=SeqID_5886; Location=386..779; Strand=+
  SCN-specific regions: Sequence locations=1-149,174-394
atgtgctgccttctgcttgcattggcctcacgaagccgcagctacactgtcaacgggcgtcgttccatttcgcgcaggtcgcgccgccgcacgacattggctgcctttcaggcacactcttcggatggtgggttctttgaactttagctcttttttattttacaatttgcattttattccaatttcagccggtgctcgcacagctgctgagcctttggcggttcccaaccgtcctgtggaggagaaggagtctacttctcgtcgtgtgccgggtatttgaaaactctcccattaaaaaagttaaaaaatatttttgttttgtttaggctgatgcgtctgagctggagccaaaaagtggccaacgagggaaaaggatgaaagaatgaaggaagga

SEQ ID NO: 59560 - DNA, 439 bp, Heterodera glycines
  Genomic contig location: Contig_ID=SeqID_5886; Location=1015..1453; Strand=-
  SCN-specific regions: Sequence locations=1-236,279-439
atgtcctccccgatcaaattttctccgtcaaagagctccgacgccaaaaatgagaccaatattaaagccgctgtcctcacaccgaattccctaaaactccccaatcgtaagcaccaattgaacagtgcgggaaataatggggagcagccgccgacgaaagtgcgaaaagtcgaggaccgcgaactatggaaactcgccaagggaaagtacatgttgggcttctacctctgctcaggttataaaacttttattttttattttagaaattttaaaaaattcagatgattggaacagactttacaacaacaacgcaaaagtggtgcgcactgaggatggacgcttcgccgtcaactttgaactgtgtgcagagtgcacactgaaaaacgcccgagcgacagacttattggcgccgccaaagcaaaagaaaagcgccgaatga

SEQ ID NO: 59561 - DNA, 850 bp, Heterodera glycines
  Genomic contig location: Contig_ID=SeqID_5886; Location=1629..2478; Strand=+
  SCN-specific regions: Sequence locations=1-691,718-850
atggccatcaacatgaacgacaagaagggattgctcaagcagctcctcggcgagtccgacatcaccgtaacaacgtctggcctgacgatcagccggccgcgtctcaccaacccgcgttttctgccgtttgaggagagcggtcgctgccgctcctgcaaggcaaccgaagtggaggtcgatacgatggtcaccaaagagggcataaccctttggtgtacgcgaattgacaaagtgcagttcgtgccgtttgatgtggtctacgatttgccgggccactgctttttccgagtgaagaacaaggcgagagtcttcaacattccgtacggcgacctgccctcggacaacacctgtgatcaaattcaactcacgcttcacgctgatgaagaacggcgtctcaagcgaaaggcgaaagctgcgctcgacttggttgagcagggtcttatggcagatgcaatgcatgatggggccagctggaagaaagccaagactgccatcggggtgctgaacaaactccctgctcgtaggaacacatggcgacaacgaaaacaaagaaacggctgctttgacaacatcggaaaaccagcacaaagaacagcaaccgccgacggcacctccgtcggaagaaatcgtttccatcgtgccatctgatgttggatctcaagcactgcccagcggtgaagtgaagctggaagaggagaagcaggcagatctcggtgacattgataagacacttgacgaattttttgcaagtctcaaggcgtcaaccaccagcatgtaaagatatttaaatcccacaattttttaaagtttcctcacatggtaaaaatgttgaattcacaagcattttcaa

SEQ ID NO: 59562 - DNA, 1103 bp, Heterodera glycines
  Genomic contig location: Contig_ID=SeqID_5886; Location=3538..4640; Strand=+
  SCN-specific regions: Sequence locations=1-5,27-201,224-309,365 -503,525-569,591-745,771-895,925-1010,1041-1051,1073-1103
atggctaataaatttttgcttgttccacaagaaatttatcgagggttaacctcagcggcggatacgggagtcatcaatttggatgcagtaagacatgacttggaccgtgcaaggggtgaacggacgaatccgtcaacaaagaatgtccgatacaatcaacagcttaggcgctatctgcaaatgagaagggagctgacagatagaccaaccaaagtggagttgaccaagggattgagtgttttgttgaagcgagatgggggtgctgatgaggacgacgaagtcgtcaacactcagccacggcctcccgctccaccaccacctccaccaccacctcatcactcatctcaacaacaccaccgtcgccctcccagccttcccgatcagcaatcttcctcatctgacgatagtcatccgcctcgtccaccacgtcctcagagaacaaagaaaaaccatcaatcttctctgaaacatggtcgtttgaaccaatggcagcaaaggcgtcgtgacttacaacaacaacaaccggtagtacgtgatctcctcgctgaagcagcagctgctccgttacctgaaagtgacgatgacgatgaacaaatgctggaaggtgggtatctgctgccagcaccatcacaaaattatggagacataccagtattgcctgactatgcagatgaaattgaggaaatggacaccgcccaacaaagacttgcaagcagaagaaaattaaaagaggagcagagactagataaaaataaaaaatataaaatttactattcccctccaccatctcccacactaccacccgtgtacaaacgactagatcatcctcctccgcctcgttctatacccaaagttgaactgaaaagggatccacaaccaacaaagttgaaaaaatccgcctcgccaccgcctccaccattgcctccacatcgcgcaaagagagaaccaaaaatagagctcgcccctcctccacctcctcgcaatgtctccaaaagggaaccgaaaattgaactagctcctcctccccttcctcctcgtcacttcaccaaaaaggaaccaaaatttgaagttgacccacgaccatccacatcgaagcaagccgg

SEQ ID NO: 59563 - DNA, 642 bp, Heterodera glycines
  Genomic contig location: Contig_ID=SeqID_28996; Location=341..982; Strand=-
  SCN-specific regions: Sequence locations=1-112,136-529,551-642
ggaatgacgtcatcagctgcaaaaattggtggtggtggtggtgcatctgttgaagagttgaatcaactgttaagcaaagtgaagaaaatgcataaattaaaaaaataaatgaacaaacatgttcaggacgaagaatggctttccagtttccagggcattttggaaaaaagtgccacattgaccggctcagtttgctcactgatggacaattttcaggtaaacaaaatgacactcaaatcggggcaaaatgaaacttcgagaatttgcatttcagtttatggattctttgcatatgtgtacaatcccataccgtcccacttttttttagcgcgatgggacgtttataaaccgttgcaaaagccttttagtaattggccattttcatttcattacaacctgtgtttttactcgacctgaatttttttcaagaacattttttccaaatgccgtgcttaagtctcataactttcctcagaaggaatcaaaaaagtaaattagggatcattcaaagttctcgagtttggctctattttcctttaaaaaacagaaattcgaacctttcgcaggaaagaattgattcattgtccacgaatgtgcagacgttagtggccaaatcaagcgtcattcaaaaggaacaacaga

SEQ ID NO: 59564 - DNA, 170 bp, Heterodera glycines
  Genomic contig location: Contig_ID=SeqID_28999; Location=663..832; Strand=-
  SCN-specific regions: Sequence locations=1-66,162-170
acacgtcatggccagactacgcgacaagcacgtgtacaagccaaatgacggtggagtataggtggcccgctccagcgccatccattttcagggctagttgattcggcaggtgagttgttacacactccttagcggattccgacttccatggtcatcgtccttctgtctat

SEQ ID NO: 59565 - DNA, 237 bp, Heterodera glycines
  Genomic contig location: Contig_ID=SeqID_29001; Location=889..1125; Strand=+
  SCN-specific regions: Sequence locations=1-130,169-237
atggacttctttgaaaccaatgcaacaactcaggtaattaagccaaatttaatgttttaattaaacaattttttcaaggcattcaataagtccattttcacaatttcatcaccaacaatggaggaagtcaaaaattcagtgtttctcaaaatgattttcataattaatttgttcatcaatctgattggtggcataatgcacttcaccgttgtgtacatcagcattaaaaatcggtga

SEQ ID NO: 59566 - DNA, 295 bp, Heterodera glycines
  Genomic contig location: Contig_ID=SeqID_5887; Location=815..1109; Strand=-
  SCN-specific regions: Sequence locations=1-93,117-295
  Gene Ontology: Mol. function=structural constituent of cytoskeleton; Cellular component=microtubule; Biological process=microtubule cytoskeleton organization and biogenesis
gtccatcgtgccgtttgtatgctttctaatacgacggcaattgccgaggcgtgggcacggctaaaccacaaattcgatttgatgtatgcaaaaagggcctttgtgcattggtacgtcggcgagggaatggaggagggcgaattttcggaggcgcgcgaggatttggcggcacttgaaaaagactatgaggaggtggggaaccaatgaaaagttaatcaaaagcaaattgatcggctgtaaataattgcaggttgctgaggataatgagccggatgctgacaacgaggaattttaa

SEQ ID NO: 59567 - DNA, 302 bp, Heterodera glycines
  misc_feature (264)..(264): n is a, c, g, or t
  Genomic contig location: Contig_ID=SeqID_5888; Location=5356..5657; Strand=+
  SCN-specific regions: Sequence locations=1-302
taaattcaatggattttataaaagaaaaaagaaacaaacaaaattatcttttatcatttcaaatgcaaatacttttttggaaatgcaacgaaaattgaatgaacaataattttattatggaattagcaggaacataaaaataaacacaaaaaatagaattaaattgaaaattaaagacattcccatgaaaagaagaattaattccaatgcgaaaagaggcagaaagtggtgggacgaactgcttgccgttctgctgtctgttgngtttgcatcagtaaaaagtgagatcggggaccgtacaa

SEQ ID NO: 59568 - DNA, 1570 bp, Heterodera glycines
  Genomic contig location: Contig_ID=SeqID_5888; Location=2509..4078; Strand=-
  SCN-specific regions: Sequence locations=1-1570
atgccaaacccatcgccacagaatgttttggatttaaaggaacaattgcaaaatttgagcgcaaaagtttccgagctcgtcgcacttgtcaataccgagcccatccaatacccagcaaatttctacaccatttttaagaaaattaagcaacgaatggcaaatccgcttgaagcggcaattgcttactgtgagcaactgcaaaagggagccgacagttttggccaaatgacggaccgaacttatttggagggcattgtgccaaaagttgtgcacattgtggagcgattgtcgatcgaattcggcacattggccaccgaaattggcattgacccggtggaaaaatttgtggattcaaagtgcaaagatggggaagataaattgaaggaattaagcgaaacaatcgctaaaatcaggagagaaattaaggaaaacaattatttcaacgaggcgccatttgaaaatgcaatggcacaattaaatggaacgcagacggcggatgattggcaatcaatgagacgcaaatctgtcagacgccacagcactggggacgcgcatatttcaaattgggacaaaaatagtggagaaaatgggacaaatgttgaaaagaaaatgccaagacgacacagcgagaacaatttgataatgccgagaaaaatattgggggacctaaaaatgaatgatgggcagagagtgagaaggaaacgaaatgccacgatagggcgaaaagcgggcgagaaaatgtgccaaattctgacggaaatgattttggaagcgaaaacggacgcattggagagggaaacggcggcaaagatcaaagccatcgcggaaccgccgatcaaaggcgacgaactgatgcaattgatcgacacattcgactgggagtggcgccagatcagtgacagaattgacagatggacgaagacggacggagaaaaagtttggaaagagagcggggggaggggggtaataattaatggttttcaatgcttaacacttttaaggataactaccgcattaaattggttgaaacttcgatggctgcgtatgaaatatcgaaaccgctgaaattggcaatggtttcggcgttggatgggcttaatagcgcagcgaaaacggagatgaagcgatgggaagaggagctgcacaaactgttgcatgaacgcatcgaaatttgcacacgtgccaaagacactttggccaaactgtcaacggacctccaaacggcgattgggctgccacggcaaattgtcaacgcacaaattgggccggtcattgatttattgaggggcaatggggcggaacaaagcgcgttgagttattatgtgatcgaaaattcactctatgcggccaagcagaaagtccaatcggcttttcaggtgttaatcaatgaatcattttataagtatgtccgattagggataattataattaatttaagattccgtccaatgccttcaaatggtccatttttgttgatgaacaaaatgagcaagacgataagccagcggcagagattgaagaagcaaatcagccgcaaatagaaactgctgccgaagacaccgaaatatag

SEQ ID NO: 59569 - DNA, 819 bp, Heterodera glycines
  Genomic contig location: Contig_ID=SeqID_5889; Location=307..1125; Strand=-
  SCN-specific regions: Sequence locations=1-249,280-536,566-791,814-819
aactatcgtatcgatttgcgtcaacgtcacccagtacggtgccaccaccgttttcctgctgctctgtgccaaaaacattcgcgacttcatccgtgcctttctcgacaaggagatcagcttctgctatttgatcgtggtcattgcgcttgtgcttttgcccgtcactttgctcaaatcgcccaacgatttttggccggtcattgtgggcggaatgcttagcacaatcgttgccagtaattacaaaattgggggcctttttaaaatttaaattttgaaaatcgcttcttctcagttgtgttcatttgcattggtgccatgatggattggcgcagctgtgccccctccaggcaattgccttcgtttgacctcaccaattatttgtccgctctcggcaccatgttgttcacctacggaggccacagcgcttttcccaccattcaacatgacatgaaaaagccatccgagttcaacaaatcggcaattctcggatttttcagtgagttaaattttaaaattaacgggggtataaatatgcgaataattattaaattatttaaaaaatattctacatatacttatatgcatttgttatcgtgttgttcagttatttctgtgttcaacttcaccaccgtaatcgtgtgcggcactgtgtacggtaacagcatccgcgagtcggtgatcaattccatccagacagtgtggatccagcaggcgatcaacctgatgatcacggcgcattgtctgctcactgttacgctgctgatcaacccactgaaccaggaaatggaggaagtgttctccgtcccccatggtcattaa

SEQ ID NO: 59570 - DNA, 629 bp, Heterodera glycines
  Genomic contig location: Contig_ID=SeqID_29002; Location=347..975; Strand=+
  SCN-specific regions: Sequence locations=1-97,130-276,298-395,417 -439,461-629
atgcacgtcatacgcgtgagaacaagcgggaggagaaaagctcagacggccaaggcgatgaaagcccggtgggctaagaaaagtgagttttttcaccaaattttatttaaaaaaatatctttttaatttcagcctctccagagccgaatcccaatgccgaaatgccaccgcaagacgaagcagggccgtcgtcgacatctgctgtaccggccgaagaactgatggagccgccgccaccagctccagcaccagtgccaacgccggagatggacgaggaaattttggaatttggcttttcgttgccatcgacatctgtcacggcattgaaatttaggttgtccacggcaaaggacaacctgatccctgcccgtgacctgccactgaagatcagtggcgattgctgcttcaccactttgttccatttgcgcgccaacaccgatttttggggcttttggatgagcagggtgggaccatatcattttttgggttcaattttaaatgttgtgatttttcaggagatgaggcattgcattccgtgtggcggcgacttgagcaactttggaagacgatgccggacgctgaacaaatgcgccaacagctggagcatcatttcgtctcaaattggttga

SEQ ID NO: 59571 - DNA, 77 bp, Heterodera glycines
  Genomic contig location: Contig_ID=SeqID_29002; Location=1..77; Strand=-
  SCN-specific regions: Sequence locations=1-77
tagagaaaaaaagataatgtttttctctggcactctctatttattggtacacatctcgttttttcggacggtgtgtg

SEQ ID NO: 59572 - DNA, 1614 bp, Heterodera glycines
  Genomic contig location: Contig_ID=SeqID_29003; Location=52..1665; Strand=-
  SCN-specific regions: Sequence locations=1-132,155-224,247-409,461 -462,484-999,1041-1383,1411-1614
  Gene Ontology: Mol. function=transcription factor activity; Biological process=regulation of transcription, DNA-dependent
atgggcgagccgattttcccctattttgattgggttggcggcacttccaccggtgccatggtcacggccgggctcgcaatgggccaaacactgcaccaaattcagcgggtgaactttttgaatcaatatttatttatccaagcagagaagtatatccgttgattccatccatcataccgaaattttttttttttgcaatttttaaaaagtataacaacgcaaggaaaattattaaaaaaataaaaacttgccaaaattatgttaaaaatgactaaaactgaggtccctaaacagcgacaatacatttccagattttttctgcttgggtgggacggattaaccacaaacagaatttttcctgcggtaattttagaaattttttttgcatttaaaaaaaacaaattttgggaatttttaaaacaaatttttaaaaaatttcgattttattttactaatttttgtgtgcatgcttttgcagctgtacttgcgcttcaaagacatggtgttcgactaccgaaggccgcacaacacgcgggtgctcgagaagttcatttgccaggagatgggggccgagacaatgttcagcgacctcaagtggccaaggttgcttcggtgttcccaaaatgtgtcagggacataacatcgccgaaaaaaatctcggaaaaaaattcttgattttttttttgaaaaatgtgtcgttgaaagcaaaaaaattttttgtaaaatttcttgaaaatatctttcctttttttaatttcggggacgttgctgaaaaatatttatatgggaagataaaatttgaaaattgaaattatttcctcatttaaaaaaaaattccagacttatgttcaccaccacgcgggccgagttcttcccggttcagctggaactgatgcgcaattacaaactgccgacaaatgacgaggagaatgaggagctcggctaccggacgcccgacgatttgttgctttggaaagtgttgaggcgttcatcggcgggtaataaaaaaaatttttttttaaatttacaaaaaaaattttcagcccctacctattttgccagtgtggacaacaaatacattgatggaggtgggtgagcagtggtgctttggttgttgttgttgttgtattaatcggtgggcaatcaaaatgcatttggtggcaagaaaaatgcggtttttcgaaatttaaatgatgaatttctgttttttgatttttgcttgattttaatgaaattccatcccattataatatgtgttttttctgtccataaccttatttttgtcaggcattattgcgaacaacccgtcattggaactgctccaggaaatccaattttggaacagcttcaacaagtacaaggtaaaacaccaataacaacagcaaaatatttttttaaaaatttttttttcgttttttcagaattttcccaattccgtgaacgttggatgctttctcagcatttgcaccggtgtcattccgcccactccattggaggtttttttaaaaacaaagtgtcattaattcgaatgcaatttccagcccacttatatcgaagtttcgcaaaactggatcgcccaaccgaacacctcaataaacgccttttggaccatcg

SEQ ID NO: 59573 - DNA, 670 bp, Heterodera glycines
  Genomic contig location: Contig_ID=SeqID_29003; Location=146..815; Strand=+
  SCN-specific regions: Sequence locations=1-110,138-480,522-670
atgacactttgtttttaaaaaaacctccaatggagtgggcggaatgacaccggtgcaaatgctgagaaagcatccaacgttcacggaattgggaaaattctgaaaaaacgaaaaaaaaatttttaaaaaaatattttgctgttgttattggtgttttaccttgtacttgttgaagctgttccaaaattggatttcctggagcagttccaatgacgggttgttcgcaataatgcctgacaaaaataaggttatggacagaaaaaacacatattataatgggatggaatttcattaaaatcaagcaaaaatcaaaaaacagaaattcatcatttaaatttcgaaaaaccgcatttttcttgccaccaaatgcattttgattgcccaccgattaatacaacaacaacaacaaccaaagcaccactgctcacccacctccatcaatgtatttgttgtccacactggcaaaataggtaggggctgaaaattttttttgtaaatttaaaaaaaaattttttttattacccgccgatgaacgcctcaacactttccaaagcaacaaatcgtcgggcgtccggtagccgagctcctcattctcctcgtcatttgtcggcagtttgtaattgcgcatcagttccagctgaaccgggaagaactcggcccgcgtggtggt

SEQ ID NO: 59574 - DNA, 1035 bp, Heterodera glycines
  misc_feature (898)..(898): n is a, c, g, or t
  Genomic contig location: Contig_ID=SeqID_29006; Location=399..1433; Strand=-
  SCN-specific regions: Sequence locations=1-123,149-204,226-749,771 -1035
atggacggtcgtactgctgaggcgattggcagtgaaaaagtcatcacaacgagtggtcaaaattgcgaccaaattgctctcgggttggtaagcaagtcgatgaacagcttggtaacgagtgaaattataaaaataacaattgaaaaagggttggaccataagattgaatattacattgcaattttatgaaaatttgaatcttactttttgaacaaattatgctaaatttccgttatcacacattacaaataaaataataattttggaaatccaacatttgcattcgattccacccgaaataaactcactttcgcccaatggaaccgttcgaatgtgcagcttttgaatgtcgtcaattgttccgatgaccaaattttcgccgtccgacagcgcaaggcaatcacgatagaattccgagttcaatggacagatttgcgtcaccgatcgcaaattgacattggaaaaggacaatttgtggttggacgaataaatgacagtcggccgatcggaacaggcgaaaacattaagcgcattctttttgggcgattggaaaagacacagcgaagtgggctgagtgcccagtgtaaatttcttttgcgccgacaaagcgccggtgagcgaatcgacgcggaaatgaatcactgtgccatcgcccaaagcgacgaaaagaaagtgagagccctccatggtcacctgaatgaaaggggacaaatgagaaatggaagaaaagcaaggagggacgcgtgccataagcatggaacggggcacaaattcactggacaaacgctcctccgcgaccaatgctggcacagtgccaggtttaagtgcgtagacagcgaccgaatgctcagaccaaaagccaatggagaagaagtcggacagagtttggccatcttanacagccaaacacgatgaaaagggtgcaaacaccgctgaacagcacaccgagtggggaaatgtcgagacaggcgacctcatcagcacattccaggcggtggagcagcataatttggtccgaatcgacgcgcaaataaa

SEQ ID NO: 59575 - DNA, 85 bp, Heterodera glycines
  Genomic contig location: Contig_ID=SeqID_29007; Location=85..169; Strand=-
  SCN-specific regions: Sequence locations=1-85
atgcaactcatttcaactgacatcttcataatcctgtcgttagttgccgctttttctcattctgctccaataactcaagggaaac

SEQ ID NO: 59576 - DNA, 453 bp, Heterodera glycines
  Genomic contig location: Contig_ID=SeqID_29008; Location=114..566; Strand=-
  SCN-specific regions: Sequence locations=1-314,336-453
atgagtgtgctgctgcgcgaagcggtggttgaacggctggtcgagccggtcagtttttttaattccaaaaatagaattgcaaattgtttttatggcaaaggtctagtttactggtcccgtttttttttatttgaaaagcctggaaaaatttttctagggctattttatggtgctgagcacgaatccggcattataaacgggacctcgaaaaaagtctacgtccttaaatgaacagatattgcccaaaaatctgcattttagtctcaaattttgagtttgacctgcccggccttgacaaacctgaattttatcagggttttgtccagaaaatatatccaagtccatcaaatccgttttcttctaaatcattactcttcttttcaggcttgggctgccatgtccatgtcaccgaaagagttgctctcgcgccaattgatgcccaaaattggcaag

SEQ ID NO: 59577 - DNA, 1067 bp, Heterodera glycines
  Genomic contig location: Contig_ID=SeqID_5890; Location=123..1189; Strand=+
  SCN-specific regions: Sequence locations=1-149,171-657,711-821,843 -1067
atgaaattgttgcttcacaatttcttttcatccaactttttgaagggtgtcaccaatggttacccacttttgcttcgtgcaaccaaaattgaggtaaaataatgaacaacagttaattctcccatatgataaactcatttggttgggtgttgacttttttataaatttttgaaattaatttgccttcaatttcctattttttttttgactccgaaaatcgaaaaacgaatgggctcactttttgctatataacaacaaatttttaactataagcaagacgacaattaacataaatttccgagttttctgcttttttgtgcaaaaaacgaaggacaccgcctcattttttagtctcctaacggcgcctctcttttttgtatatgcccaaataaattgacacaattttctgtaacatttttttacattttcagcgaatcgacggcacggaattcaatggcgattttgtgaagaaaatgatgccccggcttgactacccggcgctgatccaagcagcaaaagcggtggacgaaagggcggcggacgaattgcccaaggaattgggcaccgattgggaaaaggacgacgacttcctcaaaaaggttggccattcctgtttttgtcagccagcaatggcatattacaaattttacggaaatgtccaaaaattggggcccaaataaaagaaaaattccatttgggactcggttggcccggaaatttgccctaaattgcaaagggatggttaataatccttaaaaaacatccataagcgaaggatttgaaaaagtaggtccaattttttaaaaaatcccccccccccctcaaaatttagattttttctgacaaatgagtttcgtccatgaattatgcttggtttcaggtccactctctgctggtcagttacgaaattgtggagggcgaattggagtgtccggagagccatcgaattttcaacatcaaagaaggcatcccaaactttttggtcggtgccgacgaagtcgaatgaatgaatgatcatcagtttatttgtacaccatttctcgaatttcaaatatttgtttttttca

SEQ ID NO: 59578 - DNA, 1572 bp, Heterodera glycines
  Genomic contig location: Contig_ID=SeqID_5890; Location=1360..2931; Strand=-
  SCN-specific regions: Sequence locations=1-448,470-652,674-697,719 -727,754-824,846-1058,1080-1297,1319-1329,1352-1449,1471-1572
atgctgacgcggacccaattggatgccgccgccgcgaagcggctttttcgggacatgcgtgaggtgcagccgcaaacagctggagtttccaggtctgtttttataaatcaaatcccgaatataattttttggtttccatgtagagcaacaaagattgtcgttttttacttttaccttggttgtgactggattctctgttctttttcttcatttatatgcttttttttgtaaaatgtcgggtggttgggaccaacatccacaatccgggcatgtgaagggtaacaattttttcgaattaagactcgtggccacaacatcgccgacctggattacatctacgggttcaccgaacaggacatgacacgcgaattcttgttgcgacccactacattcatcgggggcgaagaacccgtcaggctgtcgttgcgtgaaatttacagacggcttaaggtgggcagcagcaggctggtcaactagttttagagggaaaatgtgacattttggttcacccttaaaaatttcgatccagtaagcattgaaatccgtaaacaatttgtgcctttaaatgattttcagcttcttcgaaagatgcgacggagtcgacaatgggtgaacaattttaaaaatccaaacactttttacatctttactttgtttttgttttcagtctcttcgacagttcccctaggccaagtgatcactgatcagcaacaaacagaagaaatgaattgattggttgactgattgattgatgcgattatgtgatcaaatattggattaggtattatgccatttgaatgtggttgtattgatttttgctcattcacaaatgaataaataggacttgtttaatttcttgctgcaggtgcatatgcattacacaggcttaattggtaattctgtagtttgccccccccacattttggaaaaaaaattcgacaatcctggagaatgggtgtcccttaactttttttttaaatttgggctcaaaatcagttttcgagggtgctgattacgaatctgaactcggatttgcgtaattccggacctgaattcgaacaaaaagttgaaattttttccaatgattcatttttctggggtaaaagcttctaattcatttaacaactatttatttggatggaaaacaatacgtctattattaattggattttttggttgtttatcttatgttttaagtttaattaagcaaatattgaatatatcaatttttaggaatttttgagggcttacacatatattttgtcagtttacagtccatatttggccattttgagctttttagtccatataatttacaaccctattcatgagatatagaaagacatttattttccatggtttgccattgcgatttatttgaatttactcattcttggcataaagtatttgtgacaagttttcagcgcactcacatctcttgaacaactgtacgcattagcttttgcagaaggggataagcaaggtcatgaagaacacaaagatgagcaaaagtcgctggatattagcttaatgaaaggttgtctaatcatcgggcctttaactcagtggtag

SEQ ID NO: 59579 - DNA, 1791 bp, Heterodera glycines
  Genomic contig location: Contig_ID=SeqID_5890; Location=3118..4908; Strand=-
  SCN-specific regions: Sequence locations=1-702,724-1155,1177-1791
atgtcggaccatccagatgctgcgctggccgacctgtaagccgctcgaatttaaaatttcacaaaaaatcggattttaaatttttgcaattttcagcagctgcgtggcaaacgacgtttggctggacactctgttttggattgaccgcgctgaagttggcacgaagtttgcactgatcgacgcacgtttcggcaagctggtagccacgcatttcaacctgcgcaagtggaggctgggcgagctgggcgttcatcgtgcaccaagcggatgggacaggggcggcacggcggctgtcaccgttatggacgacaacgcgttgatcaatcgactgccgctcgccacgtgtcctgcaccgggcggcgtgattagcttcagtgccatctacatttggtcttagcgaacaaaatttttttgcaaattttcaaaaattccctaattttccaggtacgtcgacctggaagtgatcgcatttctgcagtgcctgcaacgtgtcatcaatcgcggcatcgctgtgcagttcaccatccattcgacggacctccgctgctgggcggtgatggcgcaacgcatttggccactcatttcgcacgccgtcctcgcactgaacgacatgaaagccgtcaacttcgcgctgttgcgtcgccatgtgtcgccgaatgtgctgttcgactgtgctaaccttcgtgccatcaccaacacgcacatgttccccatccgaccgccgcccagcgctgtgcacatcaatgccctgctcaacccgccggacgagttcgatgagaagccgaagcacaacctgttccgctggctgcacacaccgcgcaaggatggccgtccgaaaattgtgacaattcgcaagtggcgcaaaccgcaatgggcttcgttcatgccaagcttaatcacggtccgaaagattttacagcattttttgcttccatttttttcatttttctaatcgattttacgcgtcccatgccatccacagtttcttaggccataacttttttcttaattggtcaatgcttatattcttggtaccaatcaaaagcttgaactctcgggatcttataaatccaagaaaacagcaattacttgcattagaaaagaaattacaatgagaaaacatgaaattcaaggtttttcgagtattttcaagaataattttttgtctattgcttttagccgagaatttagttatacaaaagcttctgtagactttaagctttcgtttgataccaagaatataggcattgaccaagtatgaaaaaagatatgcccaaagaaactgaggatgatagtcattcatgggacgcgtaaaaccgtatatttgcattttttgattccaattttttttcaataatttcaatcattttacagtttttcatcgctccgagtgccgtccctgtcaacttcctcgtcatttgtcacattgcatgccataccaacttccagaagatggaacgggagaatgaagagacggacgagcggctgacgctgaattcgcgagtgcctgctgatgccgtgattgtacgatgccggaacggcactgatcagtgcacagtgaacgcgtgggagaaggaggcaaaccaaatgttggacaatttgctgtgcttcaccatcaaggacagcgacattgggtggagtttttgaggaatttttttttgaaattttaattttcaacaattttctaggcccaaactgctcgccgaactgatggccaacgaatgaggagggatgagaaggaagtgtgcgcaatccaagcggaagatgaaaatatattgtggatgaaataaa

SEQ ID NO: 59580 - DNA, 1144 bp, Heterodera glycines
  Genomic contig location: Contig_ID=SeqID_5890; Location=5241..6384; Strand=+
  SCN-specific regions: Sequence locations=1-25,47-125,152-428,450 -515,537-646,668-707,729-1037,1059-1083,1105-1144
atggccaacgcaatgtacgcggcacgggcgcgcgcggccaaggcggaaaagcgtcaagcgcagctgcgcaaggcggccagagcaagggcaggaaacgtaagtttagattaaaaaaatttaaaaccgaaaataattttccccaattgttttcccacagaccgccaaatcgcgacgagccgagcgctgttcaatttgctggggccgactgagccgaatcacgcgtaccacgatgggctgccaccatccgctgcaccgacgctgcctctacaattgggtgcgcgtcaacttgttttgtccgatgtgcggctacaactacacgcgcgggaggccccgtgatcgccatggacgacgcaccaggggactccatcgtatgacgccggatcaggtgcgacgtgaaatggaccgcatgcgtcatatcaggcgctgatggaggaggaggagaggtgggttttgttgaggtgtgggacgggggcagcagggaggacgagtgtaatttttggtctgtttcagtttggtgttttgtgggggagggagggtaatgccaccaccgatggtatcccaccccccttttcgaaaaaaaaattttcaaaattttttagagcggttttcaaggtcggggaatacgattctaacatccatttgggccgtgtgttgggggagggggcggaggacgtgcaatttttggtcctgtttcagtttggtgtgttgtgggggagggagaaattgaaaaattcagaattcattggactcaatttatttttaattatcatttttttgaattttcaggcccggaaacgagaagtcgtcgcaatcgcatggcaaacggcggaaggatggaaagaacggacgacggatcacacaatgaatgattggccgagtgtatttattgatgtatttgtgatggatattcactcatttgttgtctcatataaccatgtcagaacacacgcattgtttgtatcacttaccattatatttgtactgaattgaatgcataaaaattctgtttgctattgctgtttctccatttgcgccaaatttgaatttcaaaaatagaatttttcttttttcgactaaaagtctaaaagtgaaaattttgattttcgggtctaaacgcacagaaacggaatggaaaatcatcaaa

SEQ ID NO: 59581 - DNA, 104 bp, Heterodera glycines
  Genomic contig location: Contig_ID=SeqID_29013; Location=811..914; Strand=+
  SCN-specific regions: Sequence locations=1-104
atgaataaaggaacgaaaatgcggaagaaacaatggaagagaaaagaaaaagaagacaattatggtgaagagaagaggaaaaaaagagtgaatgataaacaagt

SEQ ID NO: 59582 - DNA, 91 bp, Heterodera glycines; identical to SEQ ID NO: 53030
  Genomic contig location: Contig_ID=SeqID_29013; Location=74..164; Strand=+
  SCN-specific regions: Sequence locations=1-91

SEQ ID NO: 59583 - DNA, 618 bp, Heterodera glycines
  Genomic contig location: Contig_ID=SeqID_29014; Location=293..910; Strand=+
  SCN-specific regions: Sequence locations=1-618
atgaatttgagaaagagcgattttgcgagttggataaatagagtgggctcaatgcggagggtgggcaaagaagtggagaaaagggcggccattttctgttttacaaaagcaaaggaaaaagaagagaaaaagacggtgagagaaacataggattagacaaaaggcagtgaaattgtttatccatgtactatttctccaaatcttgtttcttttccttgcatgagaaaaaattttccgacacgaattcaattgacctacgctattttgtcagtttctaagtatctgtccaagattaattgtgaggttagaaaggaagatagtagtgaaaaatatcgtaaaatattaaattgttatgcaaatccgaattctaacaaaattgatcggtatttttaattaaaaattctgttgctttttgtgccaaaaattttcgcttaaaatttttgctttagcgatggaaattgaaaaattcagggtcgttgtcccgtaaatcgttttttatttagcctttgcatttttaaatggtattcaatcgtatcaaccccattttccttgcggccggcacttcttcggcagtcgcatttttcatcggttctcaatgctcaaccaaagaatggttga

SEQ ID NO: 59584 - DNA, 49 bp, Heterodera glycines; identical to SEQ ID NO: 51181
  Genomic contig location: Contig_ID=SeqID_29016; Location=813..861; Strand=-
  SCN-specific regions: Sequence locations=1-49

SEQ ID NO: 59585 - DNA, 493 bp, Heterodera glycines
  Genomic contig location: Contig_ID=SeqID_29017; Location=362..854; Strand=+
  SCN-specific regions: Sequence locations=1-28,53-216,250-338,375-493
atgcatgaaaaagtgatgattactaccaaaataaaatcaaatcaaatcaaatttataaggtacaatatttaataccctacaatatttaatacccacaaaatgtgaaagcacaataggtatcaccacataataaaatatctatattaaaatcaattgaaaatagtattaggcctaaattacatatactaattatttcaatgtaatcaattacagtagttttattaaattaataatatctaaaaatataatgcgtgtgtttaacataccaataaaaataagcatgacaacacctcagcatagattgttcaaagaactttgcaaagggaaataattaaagcatttaaaattaaaatattaaaatcaattattattaacataatacttgaaaagtacaaaatgcagacaatacataaatttttgtaagatataatttttataaattggaacattctcagaagtgccatcatggtcatgcatggtctaatattttcca

SEQ ID NO: 59586 - DNA, 432 bp, Heterodera glycines
  Genomic contig location: Contig_ID=SeqID_29019; Location=32..463; Strand=-
  SCN-specific regions: Sequence locations=1-162,184-378,400-432
atggtccaagcgaacgaacgctttcaagaggagggcgaaccaacaaacaatgggacggacacaatgccaacggaagagcagctgcagagcgaagcggaggacgaggcggagacgcagcagctcagagagacgtgcaaccgaaggcccagcgaaaagatcgaagtgcccgaggggctgctggccgaggaaagtgtcaggtgacgacggcaaatcgtcgcttttggcagtggcaattaaaatttaattgttcagtgagttctccacgctgagtggctgggcacggcttggccttggcttggaaatcgcccttttgtgcggcatttgtctgaacacgaccgttctctccgtgctgctccaccacactcgccatcacttgtccaccgtcaccattctgttcattttcaacattctcttctcaaatgtcaaaatgtg

SEQ ID NO: 59587 - DNA, 2365 bp, Heterodera glycines
  Genomic contig location: Contig_ID=SeqID_713; Location=1637..4001; Strand=-
  SCN-specific regions: Sequence locations=1-33,166-171,195-291,320 -1204,1256-2012,2046-2079,2226-2252,2274-2311,2333-2365
atgagaagtggcgcatggcagaataggacattgaaggcaaaagaaaaaaatgcaaggcaaaagaaggcatgggataagaagttggcaaggcaaaagacggcaggggatgaggctagggaaaagaaggcaggggatgagaaattggctagggaaaagaaggcaggggatgagaaattggctaggaaaagaaggaagtgagaaagaagccttggggaaaaagcctgcggttgcgagaatggcaaaggttgaagagtagagagtggcaaaggcagatgaaaaagtacaattaatgtgacacattttcatttatttgtttttccccaaacttaatgacgaaaaacggctcgaaaagggtttggacagtttctcaaatgtgggcgaaaaaactcagcgaaggttagaatgaagtaaaaaatcagcgagcagtccgtcatttttctgtctaacgatggttgtccccaaggcctcgttggtgttgacaaagtggtgtcggttcttctcgcgcagggccccaagctacgcgatggggtcaagaaagtggacgccctggaaaatttgaggaaaatataattaaatagcaagggtacgaataaatgaaatatagtcaaaccgtggggtttgttggacaacaaaccggaacagcttacccaattttacatgcattattattcactgttaggtgaaaaaaaaattttgtgtgggtgggaagattcagcctttttaggccggaagcaaaaacgcgcaacggaaagcaaaatttttttgtagtgcctgttaaggacgaaatttttaaaaaaaaggccggcccgggctgattattttagaagtaaaacaacatggtcgacgaatgagcgtgaaatgcgatccatgaccgcctcgggcattcggaacgtgtccacaaacagctcgggcaaccgcagcgaacatgcgtacgcaaacgcagccaaatggagggatacggcggcaacaacggaaggtgggatgtgggccagcgcgtagcagaccatgacaacttcgctgacgaattcgcaaatgcccacacactctttgacggcgaagtgtagaagcgatatcgatgccgaaactgcacagcgtacggcatgctgaggttgaacttgagcccggacaacacctttataatgcgcacacaaagttatgactaattttttgaattttcaagaaaaatcgtgaaaaacatttcaactttattttttgaaaaaattttataatataagtttaattatttaaaaaaattcgccggtgagatttggggtgtacacataaaaatccggtaattcaaaattatgtttcctattcacccgcggttccatgcgcatgatgtactcccccttgaacatgtttgctgctacatagacaaagtcgtcaacatttggcttcaccaactcctcgagttttttcgatgtcagctttaagcgaacttgtacctgaattaataccgtttcaccgagttttcaacatttttaaaatggacataaacaagccaagcgacaagaatttgtcgcattcgtccatctacggttttgtgcctggacaaaaagtcggagtccagcgggctgcgtctttcgagttgtcgcaagtagaggtcaacgtcgttggcgtattcagtggggaacaatgttgtgccaccaacgaatttcaaagagtacaccggcttctcaatgttttgctgttgaggttataagactgggaaatgactcattttaatttgctcttttatcattaatattctaaaaatcatatttttcaaattcttttacaaacatcggctttagggttcaacaccggaatttttgattcatttctgctgtgtactgtcaatgcttttcgaattcggttcatttgttttggtgggttaagtgttgatgatcatccgaaaatggcaaagaataaagaaccttattgatttgaaaaaaatagggaaatgaataaggttgttagatgagaacgacggaccgccaatgaaaacaaggaaaaatcgaataaacaatgagaaattttttcaaaatatatatatataataaaatcgtacaaaagtaatcatgtagataaataaaactgttataaaaaaaagattttatgagaaaaataaataatttatttgtaaatttaaaataaaaaatataattattatttcagaaataacaataatttgataaatctttttaattacttaatttaatttataaatattattttaattatttggtccaccatttcctttaactttaaagtttggaaaattccgttaattatttgtttattgggctcccttcccttttgataatttatttaaaatcaaaagttaaacaggaggcagtaaactaaattatgtattaaaaataaa

SEQ ID NO: 59588 - DNA, 736 bp, Heterodera glycines
  Genomic contig location: Contig_ID=SeqID_713; Location=4328..5063; Strand=-
  SCN-specific regions: Sequence locations=1-34,56-485,507-554,577-736
atggatgagtcgaaacgggaaaatttttcccctcaaaatgatgatgacgtcatcacaattggagacaacaacaacactcaaacactgcttgacctgcaaccggggccctcaaaaaggggacgcaagcctcgtttggacaaaatccataaggaaattgcttccgcaatgaagaaagcaaaagccatgaagctgaaggtttggctttttctgcaaatttctttaaattagccaaattttagtggatgaatcgcccaaaaaacaaccgaccaatgtgtttgagtacccgaccatattttggaaattggcccgcccaaaggttttggctaatatttaatttgaaaaaaatagaaaaatttcttaagtacggagtgttcacgttcatgtgcaaagagtgtcgtgatgacaatttccggcaggggaacagccgattcaaactcatcaatcagaatggcgagcagcaacgccttgagttcacccaatcgttttgccaagactgtgcaaagctgaactttgattgcaccgatctgatcatgaagcacctaaagaaggatgaaccggcaacgacgacgacgacgatggcaaagagtttccgctggaccaaggatgaagaaaaatgaaccgacttggcacaccccatataaggacttttttttgaaaaattatatttgttggtcaaatgacaaactttttctttgtaattctgccgagcaatacgccaggctttgttggaaataaa

SEQ ID NO: 59589 - DNA, 369 bp, Heterodera glycines
  Genomic contig location: Contig_ID=SeqID_713; Location=7685..8053; Strand=+
  SCN-specific regions: Sequence locations=1-170,198-369
atgtacaaccagcacctgcgccggtacctgaagatgcgcaaggaacataaggagcggcccgtcctggtacagctcagcaacggcgctcaactgctaaataaaacagtggagacgggtgtgcaggtacggcctggtccggacgaaccgaaggacaagtccgtgatggttaccgacgaagatgaagatgaagaaattgaagtgccaaagtttttaaccccaacaagccagacgcagggaagcaatcgatcacccaggaccaataagaaagcagcaaaacagcaaaaattgatcgagaagaaggaccacctgttggccatcattatgtctgatccgcagagattcggcgcaaatgaaaatgtgtcacattaa

SEQ ID NO: 59590 - DNA, 1054 bp, Heterodera glycines
  Genomic contig location: Contig_ID=SeqID_713; Location=6468..7521; Strand=+
  SCN-specific regions: Sequence locations=1-632,655-857,879-1054
atggattacccaagaataatcgaaagtgaactcgcttttctcatcccttcggggattattgtcagcgggccttcctcatcaggcaagacccagctggtccttcgcctgttacggcacgccaacgtattgtttgatccaccgccaaaggcaataggcgtgtgtaaaagggttttatgtgcagtgggctgttgctatttagtatgggcatacggtgagtactcgacgcagattcccgatctggagcggcagggagttgtcccccacgcaggtgccccgtctgacgagatgctgaaaaagctgccaaagccttgtctgattgtttacgacgatttgatgggtgacattgaggccaagaagttggccgatctgtacaccaaaaagtcccaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcagggattcctgatggatgcctaccgacagacatgtgccctaccgtacggctacctgttggtgactctccacgcgaacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgcgccatttgcaaaagacatcagacagttggcacgtgtgcgaagcgaaaggggtgcgcgaaaactagtgcagcagtcaggcggatcactttttgcccctttgttggcccccattctgattgaggctgcccgatacctgctttcgcgcagcaataatggccaataa

SEQ ID NO: 59591 - DNA, 259 bp, Heterodera glycines
  Genomic contig location: Contig_ID=SeqID_714; Location=1006..1264; Strand=+
  SCN-specific regions: Sequence locations=1-259
atgaagcgtgcgagacaatcggaaaagttgggcgccttccctgagattgagttcgccgtcaacacaatgggcgtcacggtgtattgcccacggcacctgcaaacgcctcggtttgtaccatgggaccagcccgggcggtgcccgagctgcagaagcggaactgttgagctggactacatcatccagcccgagggggtgaccatcttttcgaatcggctaaagacggacggcgagaactttgtgccatttgacgcaattg

SEQ ID NO: 59592 - DNA, 818 bp, Heterodera glycines
  Genomic contig location: Contig_ID=SeqID_5892; Location=2078..2895; Strand=+
  SCN-specific regions: Sequence locations=1-163,186-701,728-818
atgcctggggaggggatcagcaaaagtgcgagaaaaaacggctggcagattgatcagtgacgaaaaacgcaaatgtggtgtcagaggctctcggtcggttaaaaaatgaccaatggtcgacatttcttacactaattgtataaattatggtgtaaaaagcgtgaaattgaaataatttaaattgttaataaccaaaaaattatttgggataaacaacaaaacttacaacaacaaaaaatgataattcgttcaaaaataagaaatttcacaactaattaagacggttagatagcctcggagcccaatgaaaaaaacgaaattgactcccccctggtccacttgaaaatatgaattgaccccccccccccccttttccatctcaatgatcaatgtcccgagatgagagaatttgggatttttcgggatttgaaaccattctcgagagagagctaaagaaaatcgcatctcaagcaaccaaaacataaactcttaggaaaacgagaaacatcgtcctcaacccaacaatttggagcccaaattcatgggtttacatggaaatttgttgggtggttctgttctgtgctgatcgatttgtgcgcgaaatgcaaaatgcgtaacttaaataaatattttttttggagacggtggacaacaaatccgaagacaatttgcgcagggaattggaggagaagcgagcggagagcgcaagaagaaaaagaagaagccattcattattcattgtgcaacatcagcagcagaaaatgggaaaaaattgcaggattaaaagcattttatgaacaatttttgtttgaaaaaca

SEQ ID NO: 59593 - DNA, 347 bp, Heterodera glycines
  Genomic contig location: Contig_ID=SeqID_29022; Location=354..700; Strand=-
  SCN-specific regions: Sequence locations=1-184,207-265,287-347
atgaatgtatttttggacgagttaaacgccagttttgaacaacaccaaaataatcctgaaatacggcaagtgatcagtgggcttatcgattatgcccaatcgctaatcgatgaacagcctggagcagaccaaattgggctagattttgactctgatcaggaggacgacttatacgacgacgaatcagaaaacaacactgatcaggaggaaaataatcatgacccaacccaatccaaatatccatttgaaacccaaatacaaatagtgaatatgctaaatgatggcaaaacttataaatccattcgtcaccaattcaaaaaattaaaaagcgacattgaaattattcg

SEQ ID NO: 59594 - DNA, 534 bp, Heterodera glycines
  Genomic contig location: Contig_ID=SeqID_29023; Location=225..758; Strand=-
  SCN-specific regions: Sequence locations=1-61,84-244,266-302,334 -345,368-534
acacaattctttgtcctggccattctccgtcatgccatcaatcaagccaaatcacaaaaggcaattggctgtccatttaaccaaagggatgccattgccctcggcattttttcaaatgcgctgatcaaggcgagcacaaatgatgccatgttaagcaatatctgccgttatggagacaaagtttttggctttgttgacggactctgtgaaattcaaaatgctgaacaacagtctttattggacgacataaaatttaaagaacaattagagaaacaattagagattcgggtcacttttaaaacagatcaaataaaaatacaaaataaaattttacaggtaaatgaattaagagcattttgtcagcgatggaagttgtacccaaagaacaatgctcaaacatccgccgggcacgaaagcgaacaacatttgaaagctaaaatgaaaaattacatcgaaaagccccagattgatcaaacaaataaacagtcaacgtcagattctgaacacatctgtgttatttgcctgacagaggaa

SEQ ID NO: 59595 - DNA, 154 bp, Heterodera glycines
  Genomic contig location: Contig_ID=SeqID_29024; Location=584..737; Strand=+
  SCN-specific regions: Sequence locations=1-154
atgggtagtcttgtggcggcacatctgagttcgtccaatgagaaagcaatgccgtattcggcttactactatcgtcagaggaagatgaacgtaatcgaggcatattctagaattacgctgaaaaagcaattgtgggcgctatactttttcgtca

SEQ ID NO: 59596 - DNA, 635 bp, Heterodera glycines
  Genomic contig location: Contig_ID=SeqID_29025; Location=417..1051; Strand=+
  SCN-specific regions: Sequence locations=1-35,59-335,365-556,578-635
atgggcaccaatttggaattgaatctgtgttcaagcgataatgatgatgatgaagagccgatttgggatgttttggcgcgtgaaatttggccaatttttgcaccaagcattcgccacttgggttttgccaattttgacgctttgtgccgtcgcatttcaccgacaattctcgccgatcttcatcaattgatttcaatcgatttcggacatctgtttcttcatggaattgatgacgacgatgaaccaaatgcaacttctcctggccaagtgttgtccgaatggttgcacactccgaaaaaagacgggcaaccgaagcgactgtttcataacttatgttaaatttgataattttatttaaaattttgcaagctaacagagaaaaagcttggctattttatggtactaagaatgtaaaatatgattgcctttaagcaaagttatgccatgttttgtcgaaaaaattgccaaaaattttgaattaacgggatttctggcgtaatgatgacaagttctgcttttgaaagtcaggtttctgcggtcagacgctaactgcatgaacctgtcaaaaatgacaggttttttccggtcggggtcgttttcgcgtgagggccattttcgcgcacccccccccccta

SEQ ID NO: 59597 - DNA, 304 bp, Heterodera glycines
  Genomic contig location: Contig_ID=SeqID_29027; Location=638..941; Strand=+
  SCN-specific regions: Sequence locations=1-304
atgaatcagcggcgtttaaagaaaatgtgaggcattttttaattgaagctttatcggtaatttaattaatgttttcacgtatttcagctggatttgccacgatgtttggatggatattttgccattttttcgtcgtcgtaaactcggcctcaatttggcactgatttccgatcgtttcgatgttttggtggacgcgcatttcgatggcaaatcagaattgacgatttggaaagctatcaggattcacaaagacgctttcacagaagtgccgaaattaagtgtgctaatcgataatgccaatcct

SEQ ID NO: 59598 - DNA, 282 bp, Heterodera glycines
  misc_feature (237)..(237): n is a, c, g, or t
  Genomic contig location: Contig_ID=SeqID_29028; Location=13..294; Strand=-
  SCN-specific regions: Sequence locations=1-41,64-282
atgtactcgtttcaaaaatattttgaggaggctctcgaaaaagaagattttttctggcagaaaaacagagcagaagtggaggcattgttaattgaggcttcaaattataaaattataacacacagggactacgaaagccgctattctgattatattgccacctatcaccgcaccccactcttctgtttctgcatgattgagagaaatttaagatttttttacgacacaggaaaccgngacgcctataggaaggggtacaactgtgctacatgttaccgttga

SEQ ID NO: 59599 - DNA, 345 bp, Heterodera glycines
  Genomic contig location: Contig_ID=SeqID_29028; Location=936..1280; Strand=-
  SCN-specific regions: Sequence locations=1-65,87-317,339-345
atgactcgagagtatgctgacagcgaaattttggagtttgtgtccgcgggtccgaagcagtacgccttgaaacttagaagaaagaaggacggggtgatttggcacaaaaccaaaatcagagggatgacattggatagacgaaacgaatttaaatatgaattgttcaaagagatggtgctagaccacaaggaaggagtcaaaaaagtttttcactacccggagaagatcgggccgacaaacgacttccgggttctctcaaaagatgtacaaaaagaatatacgccggtgcagaaaaaaggaattatcgacgatcattttaatgttttgccctttggacattattaa

SEQ ID NO: 59600 - DNA, 1167 bp, Heterodera glycines
  Genomic contig location: Contig_ID=SeqID_29030; Location=40..1206; Strand=-
  SCN-specific regions: Sequence locations=1-663,697-1167
atgccgaatgggcaaaccgtcacacgaccaatcagccgtctttgccccttggagaccgaaaaccaggccctggaacccgaatcggacgccaccgaaccgaacccgactaatcaaagtcgcagagactccaaaaacgccgaacttgttggacaggacatgacgcctgtcccgtcacttcccgaagaaccgatgacccgtgggcacgacggcatggtaacgcgacgaaaatcgcggcttctcggaatcccccccaccacgacaatgatcatggccatcctcgtcactttcctgggcgtccaagcctccccagcacaaggaatttggccattcgcctcagaccatcccgagccacccccaacatcccattgcatcggaaaccacgtcaattgcaccagaagaggcgtccgagtctcctccactcccgccgtccagaaggtcacgatttgttgcgccaattcgtgccttgatcggttgggcgctgccaccattgaatatgagttgtccgctgaccttctcgtcaacaattacggctgttccgcaacgttcagcctctcatcgacccgtagttgcgccgccgaaaccgtctgctcagccatcgacgaatgcgagctgattgactgctccgtttgcattgaccaactcgccaattggcggtgcaacccccgcctctctgtcttccttttcctaattatcgggtcgctgatcagctgtctgatcgggtgggtagtctgtttctgctcatccgcccgagttgtgctcaatttcggctatcaaatcaccgcgttccttctctcctggcccctccgactagcattctccctcgccggtcgtccctggacacgggaagatcgagaacgtgttgcggaacgtctcgaagttggaattcaacgggtccgacggcagccacggcaccacgggcggcgagctcagcgagcagctactcgactgatcggcatcctattggccactcccgtcatcttcggcaacgccgagaccatctcggtgaccactcggaccgaatcttgcctcaagagtcactctggactcacctgccgcgtcaacaccgccaccactctgactctgcttccggcaggccaacagagctcattaattctgcgcgacgacaccggcaacacaatcggcacggttcaaatgcaccttcactaa

SEQ ID NO: 59601 - DNA, 443 bp, Heterodera glycines
  Genomic contig location: Contig_ID=SeqID_5893; Location=1698..2140; Strand=-
  SCN-specific regions: Sequence locations=1-122,151-183,205-421
agagcaactctaggcagttcacgctgctcagtttatgagggaccaggcttttgtcatcttgtccgcacgtatggcgcgtcggcctaccgcgcgtcggccccgtaagtggtgttaattatagcaattaaatttaattaattcaaattaatacactccccccattttcttgcagcccgttttggagcagttgtggcactgtgttgaacagcgcgaaatatttgggatgtccttgcggcacgtacaaaacatgggaacgctgcggttttctgtatatgggctaccgttacctgtgctatgcgtgctgatgaatttttttttaattgaatttggcatattttcagttatggcggaatgattcaattttcattatatgcttagataattttgtgggcttttttctatatattcatagtatatgcatatttcttatattctaaaataaa

SEQ ID NO: 59602 - DNA, 716 bp, Heterodera glycines
  Genomic contig location: Contig_ID=SeqID_5894; Location=458..1173; Strand=-
  SCN-specific regions: Sequence locations=1-280,323-368,390-412,436 -501,555-566,588-669
atggcactgacaattttggcaattttttgtttggcatttgttcaccttggcatttctggcaaatacgataagtcggatgagcacgatggcaaatatggtgccggtccacctggtggctactcacatgagaacaacaacaacaacaattatggtggcgattcttcgggcgaaaaatatgagacaatggaacatatgtggtcatgtgccaccaaatggcaatgggaaaagcccggcgtgtcaatgaaatgggaaattaccgacgtaaaaaaattaattggccaaattaaaataatcaaaatttaaattttcaaaattaatatttcagacactcaccgaagcggcggtggacacggattgcccatcacggaaaagtaaataaatgattaaatgtaattaattattcaatgcattatttaattgtttttaaaaattaagatcggatgaacaattgttgctacgtgcagactgagtaaggaattggattaaacacatataaatttttacaaaattatccccaaaaataattagcgacattttttaggtaaatttcaattaaattaatcgaaaacaaaatttcttcaattttggtatcaactttaaaatatagatgctacaacaagcaaataggacaaaagagctgtgacaaccaattctgtgaatgtatggaggtaaatttatttttaaaattaaattaaaaattcaaattttaaaataaa

SEQ ID NO: 59603 - DNA, 261 bp, Heterodera glycines
  Genomic contig location: Contig_ID=SeqID_5895; Location=349..609; Strand=-
  SCN-specific regions: Sequence locations=1-58,81-143,165-165,188-261
atgatattgcaaaatgaggaagaattgaattatggaattaaagaggagaaaagtggagaaaatccatcaaaaacagaaatacaaacaaacattgccaaacttcgaaaggaatttgaacgaaaaatgaaaaatttatgcgaaaatgccaatgaaaaggccaaggcagaaaaggcaaaattggaaaaaacaattgaaaatgcagaagattatcttatcaaaacaccttgggaactacccgcaagattcgggctcttctgctga

SEQ ID NO: 59604 - DNA, 629 bp, Heterodera glycines
  Genomic contig location: Contig_ID=SeqID_5896; Location=2088..2716; Strand=-
  SCN-specific regions: Sequence locations=1-12,35-244,266-377,399 -485,508-554
atgaaatttacacttttggcaattcttttcttggcacttgttcacattggcatttctggcaaatacgataagtcggacgagcacgatggcaaatatggtgctcgtccgcctgcttctggtggctatcatcatgacaacaacaattatggtggtggcaaccattatggtggtggcggcaaccattatggtggcggcggttcttcatacgacaaatatagaccaacagagcaccaaaggtcaattaagggcaattaattttaattaattgccaattaatcctccccccatttgcagcacatattggagcagttgtggcagtttattagccaccgcaagatcgttgggatgtcgttgtggcacctacaaaacatcggagacctgcggttttctgtatttgggccgccgttatttgtgctattgttaatcagaaagattttcattaaaaattgccgtcaaaataattattgtattggtattttagttataaacatattatgatgttattattgctttcactttgaattcggaaaaatatgaagctaaaaatcataggcatattttaattaaatgttcaaaattaaaattttattaaacgaataatagatttaattttaatttattaaaataaa

SEQ ID NO: 59605 - DNA, 123 bp, Heterodera glycines
  Genomic contig location: Contig_ID=SeqID_29034; Location=167..289; Strand=-
  SCN-specific regions: Sequence locations=1-123
atgggtgacttcgtgccaaaatttgagcgtaatttggacaacaaacctttgggcccgcgaccattgcccacggcaggcgcaattccagtaaaagatgagaaaggcagaattgtgatgaaaaag

SEQ ID NO: 59606 - DNA, 543 bp, Heterodera glycines
  Genomic contig location: Contig_ID=SeqID_29038; Location=107..649; Strand=-
  SCN-specific regions: Sequence locations=1-71,93-95,117-137,159 -188,242-267,289-350,372-543
atggattcaccaaaagcgcctgaagtggtgccattcgacgatgaacagttaagtgcagaggaaaaacgacttttgaatgaatttgaaatgatgaaaatgaaattggaagagacaaacaagcgaaaaattgaactggaaaagcgaaataaggaaaaagagaagttaaaacaagtggacgaagtcatattagaagatgatgaagaggaggaggaagaggagcaaatacccaaaatgagtaaaaaaccgggtttggacccggttgtggcaaaatatgtggtggaaaaagttataaacgaagagtgggacggaaatgatttggtggtaattgatccaagaggaaagcgatcaatggaagagcaaaatgatgaagaaagccggaggaaggaagatttggtgcgaattggccgaagaaatgatcacaatgagccatggcgagaatttctggccacaaccacttccttggacagagaaaaggaagagcgattaaaagtgatgggcaaaattggcctggggcaaagcagccgaagaatggcgaagaaaagt

SEQ ID NO: 59607 - DNA, 664 bp, Heterodera glycines
  Genomic contig location: Contig_ID=SeqID_29040; Location=45..708; Strand=-
  SCN-specific regions: Sequence locations=1-594,616-664
gtttcggggcagtccccccgagccgatgcgcccagatttatgggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccctcaaacggacacttgaaaaaatcgatttttttgtttcataa

SEQ ID NO: 59608 - DNA, 473 bp, Heterodera glycines
  Genomic contig location: Contig_ID=SeqID_29041; Location=398..870; Strand=+
  SCN-specific regions: Sequence locations=1-64,129-203,251-406,442-473
atgcgagtgtgggcgtacattttaccaagtcagtctgacaatgaacatgggatttatttttcagtatttaatttgaaaaaataataaggaattttattaaaaaaaactattttaaatttattaaattacacttccaaataaatttgtattatgtgaacatataaattataaaggaaaacccatgaaattttatgggcatttagaaaataaaaaaaatttttgaaattctatttttattattaaaatttatctgaaaaatcctagagaaaataacaataggtgctaaaatcaaacaattcttataaatgtaaggacagatgacagaaatcattgataatttaaatgattttccatttgtacttcgccaaaagcggattttgttgaaatcagcttaagtctttatcccaatattttaaattaattttattaataacaaaaaatgctttttagtacacagatttgctctaccataa

SEQ ID NO: 59609 - DNA, 195 bp, Heterodera glycines
  Genomic contig location: Contig_ID=SeqID_29041; Location=32..226; Strand=-
  SCN-specific regions: Sequence locations=1-34,67-129,182-195
tacgcctaaatttacggaaaaataaataatacgcttaaattaaaatataaaattaagtttaaaatacctgcgttatgtcatgcactcgctcatgtgcctttaatgtcgtctaaattttaacaccaaaaaaattaattaattaatgcaattatttggctaatttttttattaattattaaatatacacctaaaaaa

SEQ ID NO: 59610 - DNA, 1581 bp, Heterodera glycines
  Genomic contig location: Contig_ID=SeqID_5898; Location=962..2542; Strand=-
  SCN-specific regions: Sequence locations=1-271,293-442,464-1301,1323 -1346,1372-1440,1484-1553,1575-1581
  Gene Ontology: Mol. function=transposase activity; Cellular component= nuclear chromosome
gcctttaaagaagttgacgaaaatggcagtgcaattctcccttttttgaatgcaaattgtgccgcccatttactaaatttggttgtgaaagaagggctaagtgccgaccttgatattgaaaagctgtttgtgaaatgccgtaaaatcgttggccattttaaaaagagcaacaaagcactcggaaaattgcacgaaattcaagagtttcttgaaattcccgagcattgcttgttacaggtatgtataatgttattagatattggtaattcttaaagagtatttttaaggaagtttcgacccgttggaattctggcctgatgatgattgaacgactttacgagcaaaaaaaggcaatcaatgaatatgcctaccaaaattgtgactttggtctcactttaacaagcgaagaatggtccattttggaggaacttattgcgagtattgttttaaagcaaatgttgtaaaaaacaatcatcttagttttgaaacctgccgaagtgatgaccaaaggattatcaaagtcgcctatttcggtggtgattccatacgcaggagttatgcatgacgagctttacgaaatgaaacttttttcaaaaaaagtggaccaagttcgaacaattatgtacaattcgttaaaaagacgttttttcggacttcaaaatcaaaagtgatagtcaatttttttttgaaaattaattttgttttaagagtgtacgcagtttcgacattccttgatccacgttttaaggaccgcgttcttttggcagaaatgacaagcaatgtgtttagagcgaacgtaattgcttggatcaaagcgatgtctgagccgctacaaccagaaatttttgatttcgatgatcaacattttaccatgccacccgatcagtctctctctcccccaccaaaacggaatgactctttttttgatcgattaaaaaacatcgtcaaaagcaacattgacaggaggtaatacaacttcaattcttacagtttccctaataatttccaaggacgcctactgaacaacacgagaatattgaactggaattccaagaatatttggagtgcggcctcgaagaaacaaactcaaccccgattgattgtcggcggaaattgtcaaatcaattcccaaaacttgctaaactggccaacaaatttctttcgactcccgccacaagtgtaccaagcgaacggactttcaaaacggcacgtgatgtttttgattaccggcgatcattattgaaaccgaaaactgcggaaatgctcatcttccttaataaatctctcccacaaatcaattataaatattagcttttgttatttgaagtgatcatttttcgaatcgaataaattatttccaaatttcataaactgatttaaatggacatttcattattattaattagatatttttagatgtttctaagcacaaataattgattttttcatttgtttgcttttcaaaacaaatttcaaaaaatccaggtccaggcctggatccaggtctcgaggagcctggatttttcctggacctggatttttgtccaggaaatccaggtccaggtccaacatggaatccag

SEQ ID NO: 59611 - DNA, 3644 bp, Heterodera glycines
  Genomic contig location: Contig_ID=SeqID_5899; Location=1272..4915; Strand=+
  SCN-specific regions: Sequence locations=1-77,103-260,293-354,409 -479,503-984,1006-1188,1344-1365,1387-2034,2056-2679,2708-3110,3133 -3644
  Gene Ontology: Mol. function=protein binding; Cellular component =cytoplasm; Biological process=BMP receptor signaling pathway
ttcactggtcattccaagaaaatgaatttgttcacttcgttggacccttctgttaagaaattgttgggctggaaaatgggcgacgaagaagagaaatgggcactgaaagcggtcgaatctttggtgaaaaagatgcaaaaacgaaagcaccatggatacggtaagaggctctaccgtataaaaatgggaggaaccggtgtttttaggtactgtggaggatttggtgcgttactgcaaaatgacattttgttaatcaattgataataatttaattgaaaaaaaaatatttttacggttaaaattaccataaaaaatttaaaaagaaggcaaaaagtaaaaaaacatttattttcgttaaaaatattaaagaaatttttcaatatattttttgatttttaaaatattttacattatgaattttacttaggaatacgcactttcccaccccggctcaagcagcaagtaatcttataaatgtcaattaattaaataattaattgattcatcaatctctcccccctttcattgctttttcctttcttttttcagttgcgtgacaattccccgctctttggacggacgccttcaggtcaaatgaatggctaattacaaaattagcgccggaaaaagccaaaaaatgctaatgggatttttgtaactcctcgtttaatcccttttctgctgaatgagttttgcttatgctattacaaaatccgcttgtccctttgaggtgtcccatcggaagggtcttccccatgtgatttattgccgcgtttggcgttggccgaatttgcagtcccatcagatacgcattttgtcctttgtttacttaacatggatacttcctttacgagttaaggtccaccaccgattgtatgttcccatacgacgggcgaagtgaacaggtggcaaaatcaccaaactaattagggcttaattgattaatttttgttacattatttattatactaaatgataatgttaacattggtcagatatgcatcaatccttatcattaccatcgaattgaaatgctcggacagtcggtatgttcttctttccagcaatattggtcagcaatgtgatttgatcagttgattttccgatttttgcctacaaatgttttcgacattcattaaaatacattttgattttattcaactttttgtctcttttgagaagcctgtgcctcctcctccctcttcttcctccgttgtgccgtcctcctccttttccccctcttccgcttccattggcactttttccactccttccccctctgccgccgcctcttttccgtccgcctccccttccgcttcatccgtctcttccgcttctccctcagtgccatcgttccgccacgtgcacagttatcctcagaccacaaaacaacagttcatgtccaccaatgtcatctccgatcagtccgctctctcctccgcctctcccaccgccgctttgttcacccaatcgccgtcggcactaagcgacgacgacgattttatggcacaacagcagcaacggcacaatgccgcactccaacaacaattgtgccaccatagtcagccatgttgctggtgttcagtttgctattacgaactcaactcgcgggttggcgagccgttcaaggcacgcattttttgttgattgatttgtcattttgagctcaacccataaaaagttagcactgattgataaatgctatgctaagctgatttgatctgattaaatctattagtgtccgatcattaattgtgaaatgttctctctgactgatttgtctgattaactcagatcaattaaatacagtccaattgggagaatattgaattgccaatcaatcgtccgtttttccctttttaggtgctcgaaagtattgtcgtcattgatggtatggcacaaataacaatttgttttgccaatgtaaatgttcccccccccttttttgaaaggttttacgaatccgtccggcgcggggagtgcgtttttaattttccatttaattgcattttaatattttaaggaatttgtcttggcctcctctccaacgtcaacagaaacgtgagaaagcataaaagcgaaaatatcaaagaatttactttttttaaggtgacaattgaaaacactcgcagacacatcggaatgggtgaataatttgtaaaaatattcataattaaagtgcctggtcatggctatcatttttttgcctggttttgaatataaaatgccattaattccctaaaattggtgaccaacaagagtctcgacccaaactcgaataattatttgccattctcaattaaatattttgccctttcccttttcaggcatccgattgatgtgcactgataacaatgttttgcttgtaccgttctttttccatttttggcattatttttggtgctgtccgagagtctcgaaaaaagttcactttttgggttgctaccggcacatatatttttttactctcgagcggcacgtttttattggttttcccgttatgtttattttccatgttccgcagttgaaccaatccgaggctgctgtgttcgttcagtcgagaaatgccaacttcaaatacagccttcagccaacggcggtcaaaaaatgaataattaatgtgccgacaaaatgatcaattaggtagcacaatcttgttgtaaaaaatctgtctgatccattttaaaaaaaaatgtttttatttaatggtttttagaggttcagacattttattgaaagcaattttggggtggtcattttcgcgcgcatattaattgcctaattggctaacattgtcataatgctttcaattttaggtttgtcgtgtccctccgggcgcaacaatggtcagttctttcgttgatctgtttttaatttaatcttcagcagttaatctcggcgtttattaagctaatcttcgatttccatctcttcgccggggtttgtccgtttgtcccccattttgtcatttgtccattttcgttcatttgtccttttttctgcgccagatgcttgaaaaggcgaaggagaatggttaccaacatgtctatgaaattgtgtgagttaatcgcacaaacattggcattttttatacaaatttctcaatccaaattaaacaatttttaaaatgcagcaaaatgtgctttgttcgtctgtcctttgtcaagggatggggagcggactacccgaggtcagtaagtgccaaacagtgcaataatccccggcagggttaagtcgagaccctccgcggcacaaaatcgggaataataatcgacgcatataaaatgccataattcccacgtttattcgcgccatgggttctcaggggaacccattttagttcgaaaattggcgtaatgtttaggtaagttcatttaaggcaggtcagtcactcttccgtttgtttgtgtcgtgctgtttggacgtgcgatgcttcccatcgcttttttaggacgtcacttcgacgccgtgttggctcgaaattcagcttcaccagccaatggcggtacttcccaaagaattgccaatttaattaccccaatattaattgattgattgggttttgctttaatcattttaagtggaccgatgcggcactttcccaattggacccgcccgatcacaacggagttacttcagtgtca

SEQ ID NO: 59612 - DNA, 445 bp, Heterodera glycines
  Genomic contig location: Contig_ID=SeqID_29043; Location=337..781; Strand=+
  SCN-specific regions: Sequence locations=1-445
atggccgctgatatcactgtgttcgtccggctgatcgaagcggtgccccggggggcaaaatttgacaaaatttggaaagaaaaaaaggaaaaccaaatcatcgatttgtacgacagctttttcgagatggactatagcaacgaatatcgaacacaaatgcattttacgtggaaattgtttgacgctgtccgatcagagctggccgatcttagttttttgatcaacgagaaaaagctgagacagaaatgggacggcatggaaaagcgggcacagcgcgacgccgcggaccaaacagcgagcgacgatggtacagtgccaaccgcgccaattttggtggccaaattacatgcgcaaacgctgcaaaagttggcatttgaaaatgccgaaacggcgaaacggaagacggcagaaatggccaaacatttcagggaaaagctgaagacag

SEQ ID NO: 59613 - DNA, 72 bp, Heterodera glycines
  Genomic contig location: Contig_ID=SeqID_29049; Location=116..187; Strand=-
  SCN-specific regions: Sequence locations=1-72
gcttatgacgacgcgacttccgatgcgcagacaacgggcgagagtatttgcgcggagtccgtcacgatcatg

SEQ ID NO: 59614 - DNA, 2199 bp, Heterodera glycines
  Genomic contig location: Contig_ID=SeqID_5900; Location=224..2422; Strand=+
  SCN-specific regions: Sequence locations=1-303,325-973,996-1048,1070 -1131,1153-1217,1252-1719,1742-2199
atgatggatgtgccaaactcttccaacacttcaccaggatttttcgagaacttggcccagtcgttacttgacctcaaaattcaggacaatcgcaattacaaaaatgaggaaccaagatctggggcaatgaatgcgctcacacacatcaaacccaaaacaacagcaatggattgtcaggtcgaaaatgaattagcaaaagaatcctctagtgaatccccagcctgtgggccggaaacaaagacaaacattcccaaaacgtcaaattgggaacggccaagcgtacgatcgaaagtcgcttctttaatgttcattacactaatgcttattggaatgactttgccctttactactgctaatatgccccatctgccaatgcatccccttgtctgtcaaacccaaaacggaggaaaaatttggcaattgccggcagttactggctgttcaaagctgtcaattgatcattcaaaagcacctgttgttcgaactttcgatgtcttttcgccaaatttatttgagcactcggctgatgcttgggcttgccgaaaagtgagaaaatccgtgcgcaagtacacttcaatcactaatgttccgatccaagagactcttgagccacttatgttgcaaattactccgagtgaatgtaagcaaatggccgaaaatggaaagtgcagtttaggcttgctaattaatgactcgggactctcgcatactgacaagaaattggatttgtcaccccgaatgtggctaattggctcatttagctggtcgactgtctcaactgaaaattgttatctttttaagactaaaattatgtcacaacacggtagcacagttatgcaaagtcccctcgggtcagtgaacaattgccaattcaaggcaggccaatgtgagatggaagacaagacattgctcatgtgggacaccaacactacccgtgcctgtgaattttcgaaaattggcacatggaaaggactacaacttgacaatatttggatttcggatgaggtcagttttcgtttgacatttttgaacaacacaaagaaagtcaactcatgtggtctgaatctgataaaatcggaggaaggatttgctgtacaagacttgccttccgacgatagcaacgaatcctcaaagagaagcagaaagacgagatcacttgaaagttgggtcaccgaatcggaaatgaactccaaattgggctatttggatgaacaagtaagagaaatgctgactctttccttttctcagacaattaaatcgatttgtgattatatgttggagacgagaagatgggcagcgacggcacttctctcagatccaacaacttttgccagaaaattattccaatctggtaaactggtggcaaaggtggccgggcccgaattgattaaagtgtggccatgcatcgaattgcaagcacatgactacgaatttgccaaaattgggaactcagcggactccgaattcgaatgctttgacaaaattccaattaaattccgagtgaaggacaacaaaagaatggcatttattgacccaaggacaatgattttgagctccgacgcgagactggcaccatgctctgaataccgcaagcagctcatttttgtgcgtggttctctttatgaagttgatcaaatcgatgctcaggtcaaacaggtgaatgccaatcgcattgacggtttcagccttaatctgtcattggcaccgacttatgctcgccattcctttctccaccttgcccttgtgaatgtgtctgactttattggccaattttacgacgccaatttggcaagagaaagcgaactcacattccaaatcaaaagtgaggacgctatagtcacaaagactttgtctgaacaatgggagcaggtgagtgagtccattcgcaacaaaatgtttgggaattgggaacaaattggaaaaattgtcatgtccatgatgataattattgtttttacagactttttgatccggtttagattaatgattagagacgaatacgttggcagaggaacaacacgacgcatgacttttggtggaaataaaacgcagaaaattgtgaaatctccagcacacctcaacatgatggatctgaatgcatctgtagaatttggtaacgaaattgagctcagtcccgttaagctcattgaacccgcccaaacccaggcacacaaaatcgcaggaaaacgaaagagaccg

SEQ ID NO: 59615 - DNA, 655 bp, Heterodera glycines
  Genomic contig location: Contig_ID=SeqID_5900; Location=798..1452; Strand=-
  SCN-specific regions: Sequence locations=1-77,99-160,182-234,257-655
agcatttctcttacttgttcatccaaatagcccaatttggagttcatttccgattcggtgacccaactttcaagtgatctcgtctttctgcttctctttgaggattcgttgctatcgtcggaaggcaagtcttgtacagcaaatccttcctccgattttatcagattcagaccacatgagttgactttctttgtgttgttcaaaaatgtcaaacgaaaactgacctcatccgaaatccaaatattgtcaagttgtagtcctttccatgtgccaattttcgaaaattcacaggcacgggtagtgttggtgtcccacatgagcaatgtcttgtcttccatctcacattggcctgccttgaattggcaattgttcactgacccgaggggactttgcataactgtgctaccgtgttgtgacataattttagtcttaaaaagataacaattttcagttgagacagtcgaccagctaaatgagccaattagccacattcggggtgacaaatccaatttcttgtcagtatgcgagagtcccgagtcattaattagcaagcctaaactgcactttccattttcggccatttgcttacattcactcggagtaatttgcaacataagtggctcaagagtctcttggatcggaacattagtgattg

SEQ ID NO: 59616 - DNA, 2310 bp, Heterodera glycines
  Genomic contig location: Contig_ID=SeqID_5901; Location=32..2341; Strand=+
  SCN-specific regions: Sequence locations=1-840,862-1409,1431 -1798,1821-2310
atgcctgtgcctttaaatgttaaggaagtaaaaagagtgctaggacaggcaggcttttacagacggcacattgagaactttgcaatggtcgtagagccattgctgaagcttacgaggcaaggcaataaattcgaatggggcagggaacagcaaaagtctttcgacaagataaaagaactacttactcaagccccgagtctaatttttccagattacgacaaagcatttcacattttcactgacgcctcatcgactggacaaggaggagttttaatgcaaaaggatgacgtgacgggcacattttctgccatttcctattgcagcagaaccctctctgctgctgaaaggaaatggccggcagttcaaattgaaatgagtgccattatttatgctttaagggaattcagaccattcatcttcatgtcggacattgaacttcacacagatcacaaacccctcgcgtttttgctaaaaaaatccgaaaccaatcagcaattggcacgatggcttattgaactacaaaattatcaggtcaaaattgtccacgtggcaggaaaaagcaacactttggctgatgcactttctcgtgccgctgaggacaagcccttgtcggaaatatacaatgtggatgaactcgaggacattatcgaatttccggtctgtctcgctttggcagcacattccagggtggtcgcggacccatttttgcatactttgaccatccgacacgaggatggaaacacttacgaaattaatttgttggaagagcaggcaggagatcctgaagccgcagcctacattgcgtttgtcagggatggggaatttccagctgatttggatgaaaaagaaaaagagttattcgctataggcactgccaattacaaattgatttcgggaattctttattttgaggacaagggactccctccgaggatatatgtcccaatttcgttacgtggactcatttttgaatcatttcactcgtctcttttgggtggtggtcatttgaattacaggaaaacaattgccaagtgcaaaaaatatttttggcccaaaatgtactctgacgttttaacttgggtcaaattgtgtgtcacctgccaattgagacacaatccaacacccgcgtaccgggaagagatgctcatggtgccagccaacacactttttgccaaagttgggctggacttggccggcccctttccagtcactcaaaaagggaataaacacattttaaatatcgtttgttggttcaccaaatacgtgatttctgtcccggtccccgacacaaaagcacaaacaattgcccacgcttttcttaccaattgttacttaaaatacggtggttgcgttgaattaatcaccgataatgcctctgcctttacttccgaatttttcagggaattttgctccatgctttacattgacaaaaagtatgcctgtccacattggagtcaaggcaatgcgtcaactgaacgcacctttcggacatttcacaacatcttggccaaatacatttcgaagactcagcccgacttcgatgaatttttggatgctgccaatttttgctacaacacgtcagtgcatgcttcaacgggtgagactccattttttcttatgtttgggcgtgacccaattttctgtgttgatcagatcattgatccgaaagttcgtgatccgatagccatttcggaccgtaatgaatttaaacagaagctggtcgttgccataagacacgcgtggcacgctgcagctgatgaatatgcaaaagcccagcgaaaaatgaaggaacaatatgacagaaaggcaaggccacagcaaatcacaattggtgaccgagtgctgatcagaaactacgacggacgggtaggaacatccaaaaagtttcaattaccatggcgcggaatttttcgggttatcaaaattgagggcatttatgttactgtgatcagttgcacttcgccaaattcgaacccaaaaagacttcacttaaaccagattaaaaagtgtttcgaaattttgggccctccctgcactatgccaactcaaccagttgaagaggaaaagtgccttgaaaatactgataatgccgataaagcaatttcgaaagggtatgaaattcgaaatgaaatggaccccgaatcccgggaaggcgaaaatttggagcaaatccacgcccgagggccggaaacaagaccagaaattgaagccgatgaggagaaaaatgtcaataaaaaaacggatacggaaccaagaaagtatgaccttaggaagaggacgagaacttggaaagatcttgtgaattattag

SEQ ID NO: 59617 - DNA, 1381 bp, Heterodera glycines
  Genomic contig location: Contig_ID=SeqID_5902; Location=297..1677; Strand=+
  SCN-specific regions: Sequence locations=1-40,62-113,135-288,310 -414,436-521,545-699,721-867,889-1007,1043-1350,1372-1381
atgccaacacaaccagttgaagagaaaaagtgccttgaaaagacacaaaatgtggaagaagtcagttcggaaaggtccggaatccgaaatgaaatggacctcgaatcccgggaaggcgaaaatttagaggaaatccacgcccgagggccggaaacaagaccagaaattgaagccgatgaggagaaaaatgtcaatgaaaaaacggatacggaaccaagaaagtatgaccttaggaagaggacgagaacttggaaagatcttgtgaattattagcacagtaaccattaacatcaaaaatttatttaacaaaatcaatgaaattattcgagatcgatctcgtctaaattgatgaccgaagaggtgcccttctttttcgggatgggcactcgcccctccgccttctgtttctccctctgagcacggcgctgggctgccaacacttcgttgtccgcccgcacgcgctttccgctttgctcatatttcaggcgataatccttggccctggcctcgctttccatggctctttaaaaatttgacttagttgtgaatgagacaattcatctcacttaattccaccaagatactcctcggtttgcttttcggtgaatttataggcttcccgccctttgcagtcacaacgagtgtgttcccccacttctaaatcattaaaattgttgaaaagtcattgtcggagcccattttttactcttaaattgttttgctgccctcgggctacacaactccttcacaaggcaaaccgaagctccgacattgatcccgcaatgcaggccaacggtgagcacgacatcaccgggccgctggatgtggaattcaaagggaattcccgcctgacgcagttgcgcaggggagaaaaagaaactattgtgtccaagcggattcgaacaattgggccaacgatcggtgaacagcacctggcccaattgggaaacctgctgttcgaattccccgccaatgaagagccacaactgaatttttcatggattttcaaaatttttttttatttaactaaaagaaaaaaaaacctttaaacccggtcccaagttgtaattcatatggtggacatgctcgtcctcacggtggagggcgaacaggctggtctcgggcggtgcgcagatcccacgaatgagcgtggcatccttgtcgagtccctaattttttttttctactcaaaataccaaaattttcagcccaaaccatttttccatatgccccattacaggaatagagagctcagttatcagccgatagctttcggtggttttagcgtctggcacaaaccagcgtgtgccatatcgccactcctgcggcaaggggccattcacaatttcgttaaaaaaccttatttttggaccatcttaca

SEQ ID NO: 59618 - DNA, 659 bp, Heterodera glycines
  Genomic contig location: Contig_ID=SeqID_29052; Location=47..705; Strand=+
  SCN-specific regions: Sequence locations=1-482,530-568,644-659
atctattccgactttctcaaggacaaatgtgccaaaacttgtggccattgcttatccgaagaagacaaagttcggcttgagaatgattacggcagtgacagcagcaatagcgaagattatgaccaaccctttgaatctgttcgacgcattcgaaatcgtccttcagctgctccccccgccggcgggcagaaaaattcagcggacaatggcactaccgttgcccaaagggccaagggtacggtatttcaataataaaaaaaaagtcaaaatcatttgcaattaattgtgattttttggttcaatttatcatttttcagaaggctcttcaaagcgaagcaaatcaagtggaaaattttccgagcgaattatcatagaaattgggggcggtgatcaaaaagaacacatcgaattgcgggggaaactcggcgaagcattacggtactaaaaacaaaaagatttaaaatcgaaaaacaaaattttaaaaaataaattaaattatatcaaattaacaaaaaaaaaatttaattaattgagcaaaattttaaagaatttcgcgagagattttgttggagaatgacgaagaaaatgatgatgaacaagcggagaagaagaagagaaagcggcagaagaaaaagcaaaggaatttgagtccgcttttg

SEQ ID NO: 59619 - DNA, 988 bp, Heterodera glycines
  Genomic contig location: Contig_ID=SeqID_29055; Location=130..1117; Strand=+
  SCN-specific regions: Sequence locations=1-5,27-208,297-351,373 -456,506-516,539-669,694-937
atgcaaagaaaaacatttaaagatattcatttacaattttttttgaattttttcacgaattacgccaataatgagttcgggttggcaatgattttgcgcaaaaaccgggcgcaatttcacgccttcgccatttgttaggcgcagaaatagacaatttttggtggaaaaatgaatacatttttcgtcaacaattgataaattggaactgtaatttttattaaaaaaattatttaaattttaatttattaattagacatttatatatccataataatattaaaattaattaataatttcccttattttatttttccacgacaaaacacgtctattggaacattaccacagtactctgatatcaaatgaccttcctggtgatcagatacggttgaagcatcgtttatcagcagatcttacggtattttgctttttcctaagtcagagtggtccattttcaaataaaaaaaagaatttaattaaaatttgaaataaaaattttttatttgcaattaaaaagtttgaaatttttgttacaaatgtcgaaaaaaaactcttcctcaagtattttggtgaaatttttgaacaatttaacaaaaattaatcagacggtccatttttgaaaaattgaggaaaacttgaaaattcaaaaaaattttttgtattatttgcaatggaaaaaatttgaaatttttagataaaatgcctaaaataacatcatgcattttagtcatattttgggatataattttgattgatccacccaaatttcaggtgtggatgtgccgttttgaacatctgttgagcctccaattgcccgcagttaggcaggaaatagagaaaatttggctgttcttccggtgttactatgacatcatcagcgattttgagccgccgattagcacggaaattgattggcctttagcggctgccacaaaggaattaattttgagtaattaattagtgaatttattactttataaattaatca

SEQ ID NO: 59620 - DNA, 774 bp, Heterodera glycines; identical to SEQ ID NO: 29056
  Genomic contig location: Contig_ID=SeqID_29056; Location=1..774; Strand=+
  SCN-specific regions: Sequence locations=1-77,103-220,243-774
  Gene Ontology: Mol. function=oxidoreductase activity; Cellular component=membrane; Biological process=synaptic transmission

SEQ ID NO: 59621 - DNA, 99 bp, Heterodera glycines
  Genomic contig location: Contig_ID=SeqID_29057; Location=74..172; Strand=+
  SCN-specific regions: Sequence locations=1-99
gaacaactacaaaaccaagaagagctgcagaatgatgagaatgtggacccgcaactgcatcagcaacgtgcagcacagcaggcgcaatatgaacgtctc

SEQ ID NO: 59622 - DNA, 343 bp, Heterodera glycines
  Genomic contig location: Contig_ID=SeqID_29057; Location=816..1158; Strand=+
  SCN-specific regions: Sequence locations=23-126,148-179,200-219,241 -343
aaaaaatttttgtgccattttttgttgttgttcgccatctgcttcctccgcacttttcctcctttttctactcttcgttcaatccttctcgcactttgaacgcttcaaacaatgcatttgcctgaatttttaaatatttttggtcaggcttatcaaaacacagaaacgaggaaatgtgtgagagagagagagagagagaaatgagatgcaaaaaacaatagggggaccaacacggaggaaggcctgcctaccgcttttcacagctccgaaataagcattgaagggggggaccaacacgagggaaaggctacccatcaacacccagactttatgaaatgtgaga

SEQ ID NO: 59623 - DNA, 418 bp, Heterodera glycines
  Genomic contig location: Contig_ID=SeqID_5903; Location=2060..2477; Strand=-
  SCN-specific regions: Sequence locations=1-72,117-175,205-209,250 -316,338-418
atgagctcagcaatgccactgatcaaagcaattaaaagggacctgttcaattatggcactggaaagcacttgaaaataaatgtaaaatttaattttgtaaactaaaaaaataaattcttaaggttgaattagaaaatcaaaagcattgggaaatggttgtctttttggttgaaaatctgaagaatgaacaattaaatgaattaattaatgaattgaaaattccaacaacaaaaaatgttgaaaaatttgatgctttaatggcaacaaatttttcgttaaatgatttaaatgacagagaacgttttgaccaaaaaacattgtctaataaaaaatgaaagagtttgcttatgaattttttttattctaaattattcttctaactttgctttttcaggaaaatattgtttagtcaaataaa

SEQ ID NO: 59624 - DNA, 2549 bp, Heterodera glycines
  Genomic contig location: Contig_ID=SeqID_5904; Location=69..2617; Strand=-
  SCN-specific regions: Sequence locations=1-1,25-33,57-79,147-204,226 -243,288-295,317-414,445-714,736-934,957-1142,1164-1482,1508 -1533,1558-1858,1930-2113,2136-2296,2377-2549
atgaaaagcattcattttagaaaatacgcgatgataattttatattatttttttatctcatatactggtaaattcattcattattatcatattctattaatattgttaaaagtaaaaaataaacaattataattcttttttatttagtgttgctttgtatgggattatcaacaaaggaattgaaagatttgaacacacaaattgataaaattaagcataaaataactgaaacaattgggagggtaattttgaaaaaatattttttttaatttaaaaaataatttttaggaaaatgaaggaaaagaaacgatggatgacaaagtgatcaaaaagttggaagacattgccaatgccaaaattttcattgaaacgctgagtacctttgccataaatatgacagcacaagattatgcaaatttaatgttttttgagaaaaaatttacaattcccgaaatccaagaggagtataatgccagaaaagaattgcaaattttgaaaaagaaattggatgacaaaattgaagaagccaaaaaattctggaagaaaaatggaaaaggatgcaaaaatcaaagccaaacagaaattattgaaatgaaagtgaaacttgagttgatggatgtgatgaaggaaagcaatttgctaatgacccgacaatacgaaaacttagcgaaagaatgcgcaaaatttggagaaatggaaaaaaatgagtggggcaaaaaattggtggaaatgtttctcaaaagtttaaaagaaaagatggacaaattgaaagaaaaattaaacgaaaatgattggatgagaatcgacaaactcgaaaaaagtttgagcaaaatcataaagggggaaaagccacccgaagaagcggcgaaaagcaattcggaagaattgagcaaagagctaagaagcacttctgaagaagcgagcaaagccatggaaaagcatttgaagttggattggaaaaagattggcatttacacccaagaagagatgtccaattggcgtctcgcaatgcacggctattgggcactgattagttttcataaaattggcattgtgtcaaatgccaagaaaatcgttgagcttcttaccccaaaacggaagaagaacggggatcagcaggagcagcaccaagaaagcaacaatgacaaggaaaaatatcaaaaatggcttgaagaaaatgcaaaattatacaagacagtctacgcacgattgtttcctcaaaatgatgacggtaatttacagggctaggattttaggtgctaaaaccgaaaaataggttgtaaccctaatagatgctaaattcgattgcaaaattgtattcaaacaaatttcaagattttcaggagtaaaaagttttcgattgtccgcaaaatcatgaccaggatttttgatttttgaaaaatcgattcttacaaaacctaagcatagtcctagttatttgttttaaaatgactaaggcgagggacttacacccactgtgatagtgcataaaaataaattttaattagcagttttggtggtaattagtagaggaaattcattcatttttcttttaatggcatatgctgtattcttaaaacattgcttaaattttttgctttttaacccatcagatgcaaaaaagggacggcgtcggcgtaagcgcggattcggaggaggatcagaaacttccggctgttccagaagccgtgtgaattggagcgcatggctccaatgcatcagcctgattctgttgatcatcattctcatttggctgatcattgccgcactaatcgccatttgctcgtgcattttggctacagctgacaacggcgggcgacggggtggaggagacattttcattttcaactccggaggaagcagtagcagaaatagcagcagtagtgactgttgttgctgcttcggcaccagcagcagcagcagccgcgggtacagctacggacgccctgaactgacatattttgactcgtgcgcagttgtgtggtgggatttgtggaattagagacagaggaaagaaacggatgcacatttatggataagaaggaaacaaccgataagggcattttgaacgcaatttttatgggaattgtaagcgctcgttccgatgtggtgtcttttgaaaatttttaaaaaacaaagcgagaacaatttgaatttgcaaccgaaaagcaatttgagcagcggtgagcaaaaaaaaaaggaaattttagccgcctttcgccaaaaaataggactaatttttgccatttttgggtttaaatttcaaaaagaaaagtggtgccgataggcgcggccgaaaatttattttttgattttaatatattttctaagaaaaattgattagaaattttttacggatattatattttattttttcagaagcatcactttggaaccaccgcggaatttttatgttccccttatttttttttgggttttcggtgttacaagtcggaatttttcatcttcatttttcattttatcacttgaacataaaaggacctatctttttcccaatttgagtgttggaggaagtaaattagaataaa

SEQ ID NO: 59625 - DNA, 1346 bp, Heterodera glycines
  Genomic contig location: Contig_ID=SeqID_29062; Location=6..1351; Strand=+
  SCN-specific regions: Sequence locations=1-69,91-270,292-632,655 -800,824-836,943-1160,1186-1267,1291-1307,1345-1346
  Gene Ontology: Mol. function=transcription factor activity; Cellular component=extracellular space; Biological process=embryogenesis and morphogenesis
atggccaacggaaaaaattcaaattcgacatcacctccgtattccatcgataaaacgactacggtagcgaaggatgataatgtaaataatgccgaagcagatgatgtcaatgaactacaaaattcaatgagcaaaaccacttcggtagagatggataaagacgatgatggaaatagtgcggcatcggacactgacaatgtagtacagcaaatttcaaactcgtcaccatcgtattccatggaaaaaacgaatactgtagagacggatgctgttgagaatgatgatgacgaaagtaatgcggcagcggaaactgacgatgtagtaccgtattccatggacaaaacgacgacggtagcgacggatgataatgagagttacgccgaagcgaatgatgctaatgaaccaccatactcaatgaacaaaaccattacggtagagatggataaagacgatgatggaaatagtacggcatcggacactgacaatgtagtacagcaaatttcaaactcgtcaccaccgtattccatggaaaaaacgaatactgtagagacggatgatgatgaaaatgggcagcaagagaatggtggaaatgcaaatggtggtagaaaacagaacacatcatccataagcatcagcagcagcagaagaattacaacacacaatgaatttgatgatgaattacagaacatccaaaagtcgaatggttgcgataccaatgagaatggagataataatgatggaatacggtatgaaaaaaagagttggatgacaactgagaaaaaatcttccaatattggtggaacaaatgataatgatgatgacggaaatgatggacggaagaggaagagcaaatggacaaaaaaggcatggaaatggaggaatgaagatgatgatgaagaggaggaagatgatgacgaaaatgaacaggaggaagaagaagaaattgttcagcgcaaaacaggtattagaaaaaagtgaaaatttaaattttcgaaatttagtaagccaagaaaaatgaaaaaatgggataaccgggattagaaattttttaaatcttcaaatgtgtataggattagaaaaattagaaaattgggaaaaagtgaaaaactttatactgaaagttagaattttaattgtgaattagcagggaatagatgttgaaatttataaaaaaaatttttttttgtcagaaatttccgaaaaaaatgatggaagaaaatggaagaaatcatggcaaatgtcttgggaagaagaaaatgatgaagatgaagaggaggaggaggaggaggaaaattataatgggaagaaggaggaagatgatgaagaagaaatgtttgaagagaacg

SEQ ID NO: 59626 - DNA, 541 bp, Heterodera glycines
  Genomic contig location: Contig_ID=SeqID_29063; Location=379..919; Strand=+
  SCN-specific regions: Sequence locations=1-11,33-348,373-384,406-541
atggcctccgacttccatttcctcctctttctgttcaccaaccatcacgtggaattcagcgtggccgagttgaagtcgctggtggcgtcggtgcgcaaaagcgacgcccaaggggcgaaagaatgggcagagcgaagtgaaaattggggcacgttgcttttgctgagtcaaagcggaggtaagtgaccgacagaggccgacgcggttaatagtgccgatggtacccccccccctttttgaaaaaagaaatttttttcgagaaaagattgtatcaggggttttaagggctgcagaatccaaatctgacattattttcgacctattcgaaccccgaacccgggttcgggcaaaaagtcgaaaattcaaattttcgatttcgcattttttgtctaaaaatggtttaaatgatctttaaccctgaaactatctttaagggatcggcggacattcgccgaccgcaccagtcagcgaaagtgacgccggcagttggaactgtcaacactgcacaatgctaaacccacggcagagaaacgattgttcg

SEQ ID NO: 59627 - DNA, 1398 bp, Heterodera glycines
  Genomic contig location: Contig_ID=SeqID_29064; Location=1..1398; Strand=-
  SCN-specific regions: Sequence locations=1-55,109-157,179-280,302 -499,521-810,833-1160,1182-1293,1332-1398
tcttcaccgttcatttccgcattgtcactacagcctatgcattgcactccaagtgatatattttaattacaaaagaattttaaattcattttttttttaataaaaaaagagtttaattacaaaattcaactttcaacttgtttttcatttttagttcaatcattaaaaagaatttttaattgtattttgtccaaaaatctcaaaatttttgttgctttttccaagtttttgaagaattttttaagaggtcggacataatcggtgcattttttaattgaattttggtaattaattcttcaaaaatgccggaataagggcgaaatgcccagaatttgaacataggtatgtgcacatatttatttgcctcttctgaagcattaaaaataattggtattaattaaaatgtcagagaatttaatttcgctcaaaacaataaaatcgcagtcttatgcgaaacaaaatgaaatgtttttctgatagacgtggatggctcttgtcctggaaatttcttctgttggttttccactacaacgtcatcagtgaacgcgttttattgttgccgttcgccggaaagcagcatcgacacgggatgtatggaaaaatgtggtgctaggtcgtttgataaatccgccaatttagtttttcgacgaaaaatgacataacttttgcttaaaggtaatcaaattttacattcttggtatcattcgatagccaagttttttctctattagcctgcataattcaaaaaaaaattggtcaactttggaaaagttgcatgaaaaaaagtactatttctgccataactatgttaaatttggtaattttatttgaacttaagcaagctaatagagaaaaagatgggctatcgaaaggtaccaagaatgtaaaatttgattgcctttaatcaaagttatgccatgttttgtaagcatagacaaaaacagtaaataggtgacatataggaaaatgattatatcaatgttaattaagtgaatgaattttagaataattatcaatttcaaataccctaattcattttcctaatatattaaatagagatttttttaaatagaaatcgttataacgttctttttaatatcataaattgaaaaaaacatttatagtgccatacattcattttcattatgaaattatttcattttcagtaaatattaggaaaaaattaacttagattgtcctccacaacttgtgccggtgcctggcgaaggcgctataccctacagatattgctctccgtcggcaccaattaacgatggcattcaggtccgagacatattatatttataatagtatttttttaatgttaaattgtataaggaatagtataatcacatataataatacatatgaattagaagatgcggtataaacacacat

SEQ ID NO: 59628 - DNA, 963 bp, Heterodera glycines
  Genomic contig location: Contig_ID=SeqID_29065; Location=123..1085; Strand=+
  SCN-specific regions: Sequence locations=1-373,396-827,849-963
atggcacggacgatgctattggcacggcatcgacggcgaagcaaaaggaatagggacgaagttgcgagagaggagccgaaggaggaggaaaaagccgaaggggaggacgaaatgaccgagtttggccagaatctgctactgacggacaatgaagaagaagaagggcacacgacgacggcgaaaacgaagcaaaaaaagacggcccaaaggacggaggaacagccgccgcaggggggacggacggtgctgcgaagttggcacaattgggtgggccgataccgaaacagactgaccggcatttcacagtcgggcaagtttttgttgagggggcggggggggcgagtcggaactaggggtaagtaacccgcaagcgaaaaaattgaggaaatgcagaatgatgtcccatttatgatcaagaccaatgcaaaaacagatttaaaatacgacagattaagtcaaaaaatggatttaccaattcagaagtgttttcgacgagaaatcaacgcttcgctgcttcgtatttaaagcccggccagcgctccacgctgaccggccgccttttgagcggggacagggccaccgtccgtttcaaagcttgggaagcgaccaggcaattaatcaattgtttgattggcatcattaaatgcctgaatgcttattaggtctctccaattgcgagtgtgctgtgatcggactgatcgagaagagaattgtgtgtttgccaccgaattgggcgtgaagcgttcgagccgaaaatggacggactatttggccacgtgtccccagggcacaaaaaaggtcaaatttcttttgcatttttctaaggcatcagctgggtgtttgccattattcattcatttgataattaatttcagatcattttcgagtgtagcaaccagggacccttcccaggggcgtgcggagtggacaacattcagctggtcaatgcttactggccatccg

SEQ ID NO: 59629 - DNA, 1705 bp, Heterodera glycines
  Genomic contig location: Contig_ID=SeqID_29066; Location=110..1814; Strand=+
  SCN-specific regions: Sequence locations=1-270,310-433,458-471,494 -592,620-649,687-1203,1386-1413,1607-1705
  Gene Ontology: Mol. function=oxidoreductase activity; Cellular component=extracellular space; Biological process=lung development
ttgtccttgcccgcatccgattgaaagcaacaattttgctacctcatgtgtcgtttctgagcgaggtagccttgtaaagattttttttttgagaatttcttatcccctatcgcacgctttaggcattctgcaacactgcgcgtgccgtgagggctacgcgggcgaacgctgcgagctgtgcgcgcctggattttttggcgacccattggtgccaaacggcgagtgtaaacgctgtgattgtaacaacaacaacgacctgagcaatcctggtaaaatttttattttttaaaagaattttttaaattttttcaaccctcaggcgcttgcaatccgcggactggcgactgcgcgctgtgcgaaggcaacacggacgggcgccactgcgagtactgtaaagcatggtaagtacggtggataaagtacggtcgatgtgaaaatttattaaaatttttaaaatcaagactaagttttcataaaaaataatttatgctcaagagctttcgaattttcctagaaatttttctgcaaaacttttagtcattaattttaaaatcgtaaatttctccataaaaaacgaaaaaaatttcaggaattttcaaattaaaaaatatttcaatttctttttagctaacttcaaaatttcttacccttaataaaaaatctaaaaaaatttaatgtaattttttcaataggtattggggagacgcggtgcatgcaaagaattgttcgttgtgcgcgtgcaaccaatgcggcgccgcgtactgcgatgggcaaaacgcgcactgcgagtgccagccccgtgtgaccggtccattgtgcgatcgctgtgaagaaaatgcatggggctttgactcgtgcaagggctgcacgccgtgccagtgcgggttggccgcgtccaactcgcagtgcgacctgaagaacggccaatgcgcgtgcatgcctggtgcaggtgcagccaacaaaaaaaaaactatttttggaaattttttttttatacgaaaattttcaaaagctggccaattttgtgatcaatgtgcgcatggcttttggaaatatggggcccatgggtgccaaaaatgtgactgtgaagcggacttgtccatgggcacggtgtgcgatgtgcagacgggccaatgccattgccaggagggggcaaccggtgggcgaatgttgttgaaaaaattgaaaataaatatttaaaaataattaattttattttttatttttttctgtttttgggcaaacattttctataattaaatattttttattggattttatattcaaattattttattaaatatttttgtcatattattttattaatttaaatgttaataaaatattgttttataagttactataactatatatttttttaaaatgcaaaacttttttaaatggttgggcaagtattattttaaataatttttaaacaaataattatttttaaattaattctacactaaaatatttttgcgttaataatttttaatttttgaaaatatatttatttatttatttttttttaatgttgaataaaactaaaaaaaacattttctattcttttaaaagaaaaaatatgtagtaaaataatttattttttggtgttaaggtcctcgctgtgacaaatgtctaccagggtatttgcgtgtgccaaactttgggtgccgtttctgcgacgaatgcgtttatgctttggtaa

SEQ ID NO: 59630 - DNA, 184 bp, Heterodera glycines
  Genomic contig location: Contig_ID=SeqID_29067; Location=1089..1272; Strand=+
  SCN-specific regions: Sequence locations=1-184
atgcttaataattttattttctgcgcttttttcctctgctttttgcatcgttttccacttggttctgctgctaatgatgaaattgatgaagcaatgcccgggtttggtgaagaaaatgctgaagaaccaaaggcaagcggagcaattccgacggacaaaaaagccgaaaaagaaacatttgcaa

SEQ ID NO: 59631 - DNA, 110 bp, Heterodera glycines
  Genomic contig location: Contig_ID=SeqID_29067; Location=378..487; Strand=+
  SCN-specific regions: Sequence locations=1-56,78-110
attttctaagaaaaaataggagttttgggggcgcggcggtgccgataggcgccgccggggaaaaaattggaaattttgatcatttataaacaggttttcactgaaaatta

SEQ ID NO: 59632 - DNA, 381 bp, Heterodera glycines
  Genomic contig location: Contig_ID=SeqID_29068; Location=396..776; Strand=+
  SCN-specific regions: Sequence locations=1-64,86-323
atgcctttggaagaggctcgagagtttcgttctcgacttgagacaattttagttttttcattacttttttatttaatttttttttgctcacaatttttcggaatggcaaatgcgccacgaaacgtttttgatcaagcagtaaaactatttgtatggaaacgaagccattatcgttgggctgcacaaagaaatgggcgagtaaaaattcatcggggcctttttgatagtttcgaggaccaagtggcaatttgtaaagaggcatactcttgttgaacttgcaataacgaccttcgaggttctaggaaaagttgaacacatttaactattaattttaaaaataacaaataattaagcatttaattttgaaaaaaaaattataaa

SEQ ID NO: 59633 - DNA, 1406 bp, Heterodera glycines
  Genomic contig location: Contig_ID=SeqID_5906; Location=318..1723; Strand=+
  SCN-specific regions: Sequence locations=1-64,91-631,654-927,949 -1256,1278-1406
atggctatgcatttgggcgaaaccgtgccaaaagcccggttctcaacagagacacgggtaattccctttttctttttcttgcttttgtttacaattatattcgatttgttcattcagtgaccgttttgaactatcccttcgagccggtcactattccgccgggcatcgattcggacgaatttcgacgagcattcagcgcagcgcaattgtatttggttggaacggcacatttcaggtttcttgccatatcttttcgccgaaattactttttttttgattatacaaaccctcattagatggtcaggatgaattatgggttgacgggcatttctaaaacatttcttggtatcgtccgacaatcttaacaaaataagtcccgactatccatggagtttcgggattgaatcgtagtggccaatagccatcacgcgcttttcgatgccattttcaaccactttttcagcaaggaaagctgccgtgatgtgatgcaaacggtgctggagacccagcccgactttgtgatggtcgaactgtgctcttcgcgcattcaaattctgtccatggacgagcaaacactgctgagagaggcgcaggcactcacacgccagaaaatactgacaatcatcagagaggtggaagaagtttcagaaactaacaatcacagttaaagtcgaatttagcattttttttagtttaatcgacgaattaacagtaaatactaatgacaattggcatgcatattcacgacttttgttagacaagcttcgcattgaattcagttttaacaaccaaattttagtcaaaaaatagtctggccgtacaaaaatattttagttgtgcacattggacgtgacttactacccattcgtactgcacagctaactaattgctttccccgtccgctttcagaatggactggcccagggtctgctgcaagtgcttctgttgtccctgtccgcccacatcacccaacagttgggcatggcgcctggcggcgaattccgcgccgcgcacgccgcctccaaattggtgcccggttgcggtgtcattctcggcgaccgaccgctcaatgtgacgctgcaacgcgcgctcagcgctttgaacatcttccaacgcatgaaatttttcttccacttgaccgtctcgctgggcatggaaattgagtgagtgaacggtggggaaatgatggaacaaattaactgatagaatgcaatattgtggagttttggaattcattgaatcaaaaatagctttaattatttaaaaaaggcctcccaattccctttcattgacagtgaggccgaagttgaacgctgcaagaacatggacatgctggaagagatgctccaacagatggccggcgaatttccgcaagtgtcgcgcattttggtggacgaaagagacca

SEQ ID NO: 59634 - DNA, 2232 bp, Heterodera glycines
  Genomic contig location: Contig_ID=SeqID_5907; Location=600..2831; Strand=-
  SCN-specific regions: Sequence locations=1-419,459-508,530-720,742 -750,772-1706,1729-2001,2028-2201,2223-2232
  Gene Ontology: Biological process=phosphate metabolism
atgccgtctttcactttgccgatgcctcgccatcttgacgccaacagtttccagcaaatgttgctccacaacatcgacacgttcatctttgacgctgatggtaattttttgggtatttgtatttgagcaacaagtcaaaatctaattttgaatttgttatcttggttgctggattggccaccaatttctgtggaatagataaaaaaaaattattttgtttccccacgaatcttaaatttcaggtgttctctggctcggcgagcagtctatccccggttcatcggatttcgtcaactttttggccaaaaacgggaagcgcatcatcgtgttgaccaacaacgcgaccaaatctcgcgcggtgtacgctcgaaagcttggccaactcggcttcggacgctgtgtgaacgaggtatttaccgaagagcaaaatggagggaaaataaaatgaattcaatttaatcaaatacctttcccaaatttaaaatcattgcgattgatggcatttcccctccaaaattcagcataacatcgtcaacccggccgccgttgttgccgatttgctgcaccgtgctggcctgggccaaggctcggacaagaaagtgtacctgatcggtggccaaggcgtcaaggatgagatggaccaattgggcattgactacttcggcgacgggtttgacccggtggacgagcagccggcctccaaagggtctgccttcctttacgacttggaattggaggagaaattggagcgggtcggtgcggtggtggtcggttacgagaagtacttcaactacctaaagctgatgaaggcctccaactacttgcgggtgcgtttgtcagtgttaaagtaaggggatgggtagcgaaaaccttacgattagttttttttaactttcattgccaactattatggagttttttgggctctattgctctttatgggtccaatcaattgacaatacctgttttttatataataactttgtccataaagcccaaagtctgaataatgtaataatacgagaaaacaagagaattttagcatttaaagaaagttacaaacgaaaataatcaaatagggtttgttcgaacatgaacaaagtattgtacgtgtcaattgattagacttataacaactacctttggactcataaaagtgcaatatagccgttttttgaacgggagggatgacttacgcagtttaccaagaataccgaattttatatgtattaaaaacagtccatttcaagaatgaggactgtatgttcgtggccaccaacgaggacgagacgtgccccggcccgatcccgaacatggtgatcccggacgcgggaccgctggtggcagccgtcaaaacggcatcaggcatgtttcccacccatttgttgtacgtacgtgtatgccttcgtttcaggacgcgacccgcaagtggttggcaagccgaacacgcccgccttcgactacatctgccgccgatggaccatcgacccgcgccgtactttgatggtgggcgaccgtctgaacaccgatgtcaaatttggcaacgatcacggactgcgctccatgctcgtcctgtccggctgtcacggggtgaaactgctcgaaaatttttagcgattttgcatgaatcaaaatggtggaaaaggctcagaccccgaaaatcccccctctcgaaatggcatttgtttggattcttttgtcctcggcatttaaaattttggaaatttgttttaaggtggacgacatcatggaaagtcaaatgcaaggccgtgacgacctgatgcccgacttctacgcgaacagcttgggcgctttgatgctcaagagccacggctgtgccaccaaaaaggaggctgcggccgccaagagcgcttgcacgcctcgggccaccgcttttgtgtgaggcaaagggtgagagaagaacactcagggaaatgaccagtggaggaggagagagacagtctttccgatgagagaaacagagacaaattaatttaaatattacttttttgttgtatctttattctctgggatttcatctgtccgcaacataatttctccttttaccataatttggaggtatcctccattcataaataattttgctcttcattttctcctttgtaacatccatcaaaatttatctctcgttctctcatttataatctcatttcttttgtaactataaaaattttgttttgagtaatacaaagaaaatgttttttaaataaa

SEQ ID NO: 59635 - DNA, 776 bp, Heterodera glycines
  Genomic contig location: Contig_ID=SeqID_29073; Location=189..964; Strand=-
  SCN-specific regions: Sequence locations=1-82,104-156,178-313,335 -591,616-776
atgtttcttgcgactgatccaattttgatggatctgcaaaaagcaaacaaaaaaagtgaaaagcgaaaattaaatgacgaagaacaagacaacacacgacaaatgaagaaattaaaaaaaagcggaacaaagaagaccgattgtgaccagaacgcaatgtcaggcaaaaagatggaacattctgttttgaccgggcacaaaagtgacaattcaaacgcacaaagaccgaatggaaacacttcaaattgcaacaaaagtgacaagaaaagtgacgctacatcaaattctgtgcaccctcaagtaattaattgaacaaaatgaaatttcaattttaaacttatgtcaggttgcatcggacacaaaatttcccattccatttactataccaaaagtatcggcgtctttttcggatgcttccaaatctccacttccatcagcactcacaaaggaagctaaaaatgagctgtccaattttgaagccgaaaccaacagccaacggactctgcggtacaattgttttccctttattcagcttctgttatttattaatctgtaaattctataaattatttcataacattgcaaaagaaataatgaaaatttcaaaaattcttttgccttcatatttttatatttatagagataacgaagaattcccactgaacgacacaaacattccaatttgcaatgaagcgaagcactcagaaacagaatgttcaaaaaaccaaggcagaagaaagcgggaaacaaacaaattgccaaaaatttccgaaagg

SEQ ID NO: 59636 - DNA, 131 bp, Heterodera glycines
  Genomic contig location: Contig_ID=SeqID_29073; Location=1..131; Strand=-
  SCN-specific regions: Sequence locations=1-131
tacacattgaaacgcactcaaacggaggcgcgagtgttttgcgctgcgattggcgtcgcttgaaacacgacctgagctctcaagaactcaagaagtttgctgaggaatttattgatttgggcctttctgaa

SEQ ID NO: 59637 - DNA, 620 bp, Heterodera glycines
  Genomic contig location: Contig_ID=SeqID_29075; Location=17..636; Strand=-
  SCN-specific regions: Sequence locations=1-103,125-373,395-479,501-620
atgaatttgcgaatattacttttctttgctgtatttattccttcagcgaggtctttctatttgccaggtttagcgcctgtgaacttttgtgagggaaaggataaaaagcccacttgcctggtaagttttacccatccattgacaatctgcctccatcttttacagaataaagtgactttgttcgtaaacaaacttgacagtgatcaatccgtcatcccatatgaataccacaggcaaattaattccaatggatattctttatagcgatttggttacagcttcgacttttgtattggtagtgagcaagagtcgcctgtcgaaaacttgggtcaggttttgttcggtgaacggattaggccaagtccctatgaggttttctgttttaaaaaacaatttaaccattgccattatttcagataaatttcaaagaaaacaaacagtgttcgtacctttgtgagaaggattacaaaagttcggacaaatcacaccaagaaaaattgcggttgcttcagcgtggaatgaagctcaactaccaacaccattggttatttcgtcgggttttctttctaaattggaattcaggatcattgacaacaaacctgtcactttctgcttcataa

SEQ ID NO: 59638 - DNA, 191 bp, Heterodera glycines
  Genomic contig location: Contig_ID=SeqID_29077; Location=199..389; Strand=-
  SCN-specific regions: Sequence locations=1-191
atgacggattgtccggacactaatttgaatgagaatgggaatcaattagtaactccatctactaatgccgacgaatgcaagcgcaaatctactaagcagacagaagcatccaaatgtttaaaaggagaggaggatgacactggtggattgggatgggatataaaattgaatcgattcccgcgggggatttg

SEQ ID NO: 59639 - DNA, 393 bp, Heterodera glycines
  Genomic contig location: Contig_ID=SeqID_29078; Location=408..800; Strand=-
  SCN-specific regions: Sequence locations=1-142,164-276,298-393
atgttcagtgatcagaaccgcatcatcttcaacttgcgatcgcagttgatagatcaaatggctgtgtgttacagaatcgcgcacatcgaacattggaatgcttcacatcgaatgtaatttttattctaaacctctgagcagtttaaatttttatatgaaaaatacttattttgttaagaaccatgctggacgcggaaatttccacctccgctatattccgatggcagctgctactctactcgggcaacgtttcgaggagagagctcgtcgccatcgaatggctataggcgcaacagcatcaacttccgcttcgaatggagccaatggagtcaagggttcagttgagggaggagcagcaatcaatgagaacggttagttgttaaccaaaataaa

SEQ ID NO: 59640 - DNA, 705 bp, Heterodera glycines
  Genomic contig location: Contig_ID=SeqID_29079; Location=13..717; Strand=-
  SCN-specific regions: Sequence locations=1-37,70-252,281-343,365 -404,431-683
atgttgttcactgccattgaccgactaattgtcatattttttgatgaaatgtaaaaaatagacaaaaaatcaccatttatattaaattttacaggcaaaataaacgcaaaatccgactgtatttgactacgataacattgatttgctctattttctgtatagatttatgtttcactttttatcagaatattgaattgtatggtgatcagatggtcactggacattacatcgattttttcatggtttttttaaaaaacaatcttttattataaaatgaaagcagcaatattcctttaagcatcctaatcatcaaatcgcaatttacttttgcttcactttaatgactatgattatttatttgtttgttggaatagtgataaaaattaaatcagcaggtggccagcaaattaataaaaaattaattaattaaggaatattttaggtttaccctcagttgatcagattaattatcgtacttttcgtgcactttcatgcattatcatcgttaacattggtggatattttatttcggcactttatgccatgttaattaggccctcaatctcttctccgatcactgcttggttcggacaagcgatcactggaattcctttgctcattggtgcggcatcaaatgggggaattttatactttacgaggtgttataaatatttgaaaaaaggattatttttaaataaattttag

SEQ ID NO: 59641 - DNA, 773 bp, Heterodera glycines
  Genomic contig location: Contig_ID=SeqID_29081; Location=44..816; Strand=-
  SCN-specific regions: Sequence locations=1-45,67-104,131-152,188 -252,274-286,310-323,345-584,617-657,679-773
gcccttgctgcccaattgtcttcatcgtcttcgtcgtcagcgcttgcggcggcggcggtgccgttggaggagccgtgtcccccgcggcgtcagtcggacatgttcgacgaggacgacgacgaggcggacgtgttcggcagtgaacgacggcggaacgatgaggacgacgaggaggaggaggagttggacctgttgctggagaaaggggccaaattttcggtaaattttcagcaatttttgttgggaatgatgaaaaattttcatttgaaatttcccaacatgtcctcctcaatttttgggcaaattttgtaccatttaatgggaaattttttacttacctttgacaacgactgcaattagcataatgatgatgctttcgttgacattttggctcaaataacgacttttatgccacataaacaattgtgcgcgctaccattggcgcctttttttttcttttttaaaatttggaggggtgtggccgcataaccgaaaagtacccaaaaaaatttcagatttttttttgtgttcttgaaattttgcaaatttttttttcagtaacaccatttaggttttggattatgaaattattaaagaaatttttttatttttttttgtggcgacattttgttccgctccctttgccaccaatccgaataaaacaataaaatacatttttctcaatttaaattgtttttcaaggactccgccatgctcgacgtcggcggcagcagtaggggcggcggttcaacaccgggccccggctacaccta

SEQ ID NO: 59642 - DNA, 843 bp, Heterodera glycines
  Genomic contig location: Contig_ID=SeqID_5909; Location=58..900; Strand=-
  SCN-specific regions: Sequence locations=1-843
atgtacaaaattgttagaagaggtacaaaagtgattagaagaggtacaacagtgatcagaagaggtacaacagtgcttaggagaggtacaacagtgattaaaagaggtaaacagtgattagaagaggtacaactgtgattgattagaagaggtacaactgtgattagaagaggtacaacagtgattagaagaggtacaatagtgattaaaagaggaagaacagtgattagaagaggtacaaaagtgatgagaagaggtacaacagtgatgagaagaggtacaaaagtgattaaaagaggtacaatagtgattaagtctgctggtaactccccgcccagatcaaaccctaatgagttattcaaccgggactgaactggacaaagttggtactgaataagtccacgaacctacagcctttcctattgcagatagaggcttggaattttttttgttttttagaaaacacttcaacttagccccctcacagcagacattttttgatttgggttttagaaaaaaagttacgggcccccaaatgcacgaaaaaatgagaaatccgtccctgggactcagtcgtccgcgctaaatttttttctatagttttcccggattctcctcaaaaagttgtaagacccttccactactttcagggcgctcccggccttcggccgggagaaaatggttttagcaacgaaactccttgtcaatataacatatatagtaactagcgggtgcgtgaaccgtcggctatttagctgggaaaaagcgcttcgcgctttgggagcttcgctacctagatcagttatgggttgtggagtaattgttggtccagaagatatttga

SEQ ID NO: 59643 - DNA, 802 bp, Heterodera glycines
  Genomic contig location: Contig_ID=SeqID_29085; Location=6..807; Strand=+
  SCN-specific regions: Sequence locations=1-545,569-613,642-802
atgacaatgaatgtcctggattactgtaggctcctttgtgtcccattattccccatttcaatacagtatgcaacagtaacgcctttattacgggaaaggaaatgatacattattaggctctttacccgcttagggctcgggaacagagactgcccagggagagaggctcgttatgaataaagtggtcaagagcaagaccccgggatcgtaataaatcactgctgattttattgctttgattgaattattatttattcgaatattataatatgttttcgtcaaggttttttgtattttatattttacatatattttttgccaggtcaactgatcgccagccatttaaacgcctgtcagagttcagaattttcagttttgtacaaaacccattgcatggttttggcaatcccaaacgtttgttgcttgggtggttaatttccaaaaatcagattacgtgattggtctctttttattacttgaatatttattgcctattagatagtaaaatttcaaaaagttaatgaatttgaggattatagggtgcatttaaatttagggttatagaaatataaacaattgaaaaaaatatttaatccgtgataaaactgttttgttaatatatataatattaataataattagagatcgacattttgaaaatgcctggacctggacctggattccatgttggacctggaccttgatttcctggacaaaaatccagaaaaatccatgtccaggaaaaatccaggctcctcgagacctggatccagacctagatccaggaaaaatccaggcctag

SEQ ID NO: 59644 - DNA, 251 bp, Heterodera glycines
  Genomic contig location: Contig_ID=SeqID_29086; Location=143..393; Strand=-
  SCN-specific regions: Sequence locations=1-219,243-251
atgcacaagacattttttcgagaaaatcgcgatgaaaaaagcaattctcggctgaaaaataagaaattgaataaatttgtggtgaaacgatttttgctcttaaagggtgggaaaagtgataaaaaggtgtttttggcaatttcgacatggttggacaaaatgtcgacagaaaacaagacaaagtgtgtcgatccaatggacaaagtaattactgctctcgaatgttaccaataatttataatttttagtga

SEQ ID NO: 59645 - DNA, 471 bp, Heterodera glycines
  Genomic contig location: Contig_ID=SeqID_29086; Location=509..979; Strand=-
  SCN-specific regions: Sequence locations=1-23,46-109,147-275,297 -364,458-471
atgtatgtcgaagcttgtgtaacttttcccatttcacaattgcccaatatttttgaggctgttcaattgactcgacttctcgacttggaagtgagacaggatttttcactattaaatgtaaaaattaaatttttataatattttaagaatttgccaatcgttgtttggattatattgatacaaaggtggaaactctgctcagaacaaatgattttttgcaaattgatcaacaattcttgtgcgaaatctttgggcaggaaaaactgcaaattaatggcgaaatttcactttggaatgccgtaaatttttctgggatttttctttttttatttcactaaaattaccatttttggtgccaaaactgttaaaaatgaaaaaaaaatcacataaatttttaaatttaggtatgaaatagtaatttattttaaatatttctttttgtttttaatttttatatgtttttctaataaa

SEQ ID NO: 59646 - DNA, 1132 bp, Heterodera glycines
  Genomic contig location: Contig_ID=SeqID_29090; Location=218..1349; Strand=-
  SCN-specific regions: Sequence locations=1-25,50-191,213-819,841 -972,999-1081,1124-1132
aaaacgatataaccaaaatataaggaaaaattttttaatcatctttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 59647 - DNA, 1442 bp, Heterodera glycines
  Genomic contig location: Contig_ID=SeqID_5911; Location=52..1493; Strand=-
  SCN-specific regions: Sequence locations=1-155,178-460,482-656,678 -725,747-963,985-1081,1103-1442
atgaaagaagacgtaaaacttttgattgatgcatgtgatgggtgtcagagaaggaaagtccaaccaggtcaatcaaatttctcaccaagtgttccgataaaagcagcggaatacccatttcaaagggttcactgtgacttaatgggtccaccacttaagaaaactgaccgaggaaatttctacatttttctgacaatcgatagtttttctaaatggataacagcaaaagcaatttctgaccaaaaagcggagactgtttccgaagcttttgtagagacagtaattcataaatgttccaccccagaaatagtcgttacggaccaaggcagacaatttacttcagaaatatttagtaatttatcaaaaatttacggtgttgagcatacaatgtcaacggcttatcatcaacagtcaaatggccaagcagaaggctcaatgagaattgtagctaatattatgtcacaaataataaatgaaaagggaaacaattgggataaattactgactcatgcattatttgcttataatacagctatacatacagttattaaacacacaccattttatatagtatatttacgacattctaaattaccagtagaccgattgctaaagttgcctaactccgaaaatttagagtcagatatatccatttatacaaaaatacactcagaaaaggcatcgaaagcttggaaaatagtgcgtgaagaaatagaaaaaggacaagaaaaatttaaaaaggtaaatgattcagtcgaaaagcgacagaaaagaatttaaaattggtgttggatagtgaataatttgaatttatggcgatctgacttattgactttatttgttatttctatgtccatccgcctcctccctcgtccataaaagtggacacctcctcccactttttgttctttcctttcatcattcatttatattttatttcccaatttgccctccgaccgaatcaataaaattatttatttatttctttttctttgtgtgttctaagtggaagaacacaacaattggtgatttagttttgttaaaaaaagaggtattaaaacataaatttgaccaacgttggtcaggaccatttcaatgtgtaggagtggaaaaagaaaaaaataatataattttacaatcgctaaataaaaaaggaaaattgcgaaaagtccaccaagaaaagaaaaatgtataatggaccggtcgatcttccattgagggaagcggatgaacccttaaattgggaaaaatttgtcaatgacccgaatttagaattggaggaaaaaactgacgaagaaagttttgatgaggaagaaaaaaatactgaaattgaaaatttaaataaagaaaaaagggacaaaaagggagtagaatttaaaaaatcattgaccgaatttggatttgaaagcagtgaggaagagcaggaatcacaaatcgctttt

SEQ ID NO: 59648 - DNA, 145 bp, Heterodera glycines
  Genomic contig location: Contig_ID=SeqID_5912; Location=2741..2885; Strand=+
  SCN-specific regions: Sequence locations=1-58,123-145
gggtcccaggttcggttcccagtgcatgctattgatgtatttcgatgattttaatgaataaataaaaggaaaagtgaccaaaataattttaaaattgtttcaaatttttaaaaactttatttgtcacttgtaatgaaaaaaaaaa

SEQ ID NO: 59649 - DNA, 953 bp, Heterodera glycines
  Genomic contig location: Contig_ID=SeqID_5912; Location=1645..2597; Strand=+
  SCN-specific regions: Sequence locations=1-375,397-578,600-880,920-953
atggaacacgacgagcaacaaatgtcgatgctgccgtacgaccatggaatggtgagagggaggggggggggcggagcgggggacccacgcgtttcggcgctcccgtttcggcgccagctcgtttttccacttaagcttttttctttggcatccaaatccaacaatcttggtatcattcgaaagctcttaacatgctctattagccttatcaaaaacgaaaagtttttcaagcctgtaaaaattttattaagaaaaaatttcgacttttcacaattttcatgcataactgttttgataattgtctaatcgcaaagcaatagcttagaaaaagcttctaaatagattaagctttcgaacgacaccaacaatactggatttagtttacaaagaaaaaagttatagccaaaaacatgctggcgccgaaacgcagtggaccccggagcggtgccgttcaattgcatgttaaaatattcatttcttccatgtttagctgttgtctgaggacgcggaggaatttctgctgtttgatggtgattttttggttcgcaaaactgaagaaatttccgacgatggacgaatttttgtgttgtctgtgaatgtcgctggccgagtgagtcacattgttttttgccgacacgaggccatggcggggatgtacaccattgagggcaatcctgagggtttcctaaccatcgaacaatttgtcaacaattatcttgggtccagaacttcgatcatcagcgtaagacaaagcttgaatttttttttgttgcgtgattttctattttttcaggggcaatctttattaagtaaaagcctatccggcggtgggaaaatttcacaaattttgaatgaaatttgcgatgaaaaatgagttaactttaattaaatttattatttaatttatttaaaattttttggcattctgtcttagaaaaattttcaaaaaatca

SEQ ID NO: 59650 - DNA, 925 bp, Heterodera glycines
  Genomic contig location: Contig_ID=SeqID_5912; Location=2856..3780; Strand=-
  SCN-specific regions: Sequence locations=1-139,173-757,779-925
atgcctaaaagaaaattattgagcaaaattaacgcaagaaattcaacgcaaatcgtgaacaaaaaagggaggagcggacgaaccaaaatggcaaaggcgacgaaagcccgtttggccaagaagagtgagttttttcaccaatttttaattcaaaaataatttttttaaatttcagccgctccaccgccgaatcccaatcccgaaacgccacagcaagacgcagggccgtcaacatctgctgcacctgccgaagaagcgatggagccgccgccaccaactccaggaccagtgctgacgcccgagatggacgaggaaatcttggaatttggcttttcgctgccgtcgacatctgtcacaccaatcggcgatttggtgccgttttcgacaacacaaactgcgccaatggacaccggagagacgaccccgccaccgctggctattgacgagcgatcagagcgcatcgaacagctggagaagaaagcgagacatgacggggaacagcatccggaaaatcctcgtccacgccgatcaaatggaggcccttttcgagatggaatggggcaaaataatttgccaaacaatggcacatctgggaaaagttcaaattttcataatttttcaggagatgaggcactgcattccctttggaagacgatgccggacgatgaaaaaatgcgccaacagctggagcatcatttcgtctcgaattggctgctggacaccggtagatttgacgaattgaagctggtgggctgacagaagggaattttaaaaattttaaccaactaattaagcgggaggaggaacaacgggagcaagcggaaggtgacaaaacgaatgaagaaagtgatcaagatgccgaagtcgatatcgttgactgatcgcggattgatggttttttttttcattacaagtgacaaataaa

SEQ ID NO: 59651 - DNA, 450 bp, Heterodera glycines
  Genomic contig location: Contig_ID=SeqID_29092; Location=44..493; Strand=-
  SCN-specific regions: Sequence locations=1-133,155-450
atgacagcgcttatccgtgcttttctaaaaatattcgtcaaaaacataatatccaaacgaaacagacccaacggggctacgaactcagtaggttcggagtatggggataagtgttcattttcaaaagtcatgatcatcttatcatgtatttcctagatatattgaaacatcctaatataatttttgaaatttcaagctaataagcaactcatgggctatcgtatgataccaaggaatacaaatactcatgagagggttggaagaagacgagaaaaagccttccggcaatactgcgcgacaaattctttttggtaaaacttacttcgacacgcttttattatattagtacagcgagtgttgaatgagaaaatgaagaaggtgaaaaacagatttttactttttaaagacgcttttcaaaagtaaaaaagaaaaatttaattgtttattaaa

SEQ ID NO: 59652 - DNA, 89 bp, Heterodera glycines
  Genomic contig location: Contig_ID=SeqID_29095; Location=117..205; Strand=-
  SCN-specific regions: Sequence locations=1-89
atgaatccgcaacagtactcgccgtctgctcaaccgcaaatattccatcaacagtacccacagtattcgccgtacggtgggatggaagg

SEQ ID NO: 59653 - DNA, 691 bp, Heterodera glycines
  Genomic contig location: Contig_ID=SeqID_29096; Location=292..982; Strand=+
  SCN-specific regions: Sequence locations=1-514,537-691
atgccaaacaaatcaaacagtcgccaaagcaatttgtttgcattttttcaaaagaagccaaaagatgagcctatcgaaaaggaggagaagcagcaaaaggtgagtatttttgacaagaaaaaacaatgccttattaatggtgagtttttagtgtgttgagaatgagtgcgagaattttcacacgccccagcgaaagcggacggaagcgacccgaaattctgtcaacaaaagtcagccgatgacaccgctgaatcagcaacgaaatcagtcattggtggcggaaccacggaaggacaccacagacaataacacgacaaacgcagcatttaccgactcggaggaggagggggaagacagttcgtgcggcgttgggtttatgagttgcgcttctttggccaccccttcttcggctgaatgtgcttcggcaccgaaacggcgacgagtgattttgtcatctgacgacgaagaagagaaaatgatgggaaatggacagagaaaagaccaaaagggggacgaaacggagaatgaaccccaaagacaggcgacgaagcgaaagcgaagggacgcggcgaaagaagcgaaggaaaggacgcctccttccgttgtccgtgtcccgcgggacgaaatacagacgacgccttcggcaaaatgtgcacattcattcatcaattcatttgtatgccatctataa

SEQ ID NO: 59654 - DNA, 1034 bp, Heterodera glycines
  misc_feature (57)..(57): n is a, c, g, or t
  Genomic contig location: Contig_ID=SeqID_5913; Location=1427..2460; Strand=+
  SCN-specific regions: Sequence locations=1-191,213-629,663-1034
atggtcacctggtcggcaaaagacggcttggaaccgatgagcgaatttgttaattgngtgaagggcttcagcagatttgaaacggtcgcttttgcacattacgggggacggttcgactcgcatttcgtcttggccgaactatcaaggaaggaaaacgaaactgagctaatgatggcggaccttaagatctatcaaatcaaagcaggaagggtgtgctttcgggatttctggatgcttagtcagaacaagttggcggatctccctaagaccttgggactgagcatcgcggccaagttgtactttcctcacaagtacaacaaaaatgagaactttggcaagagattgcccaatctgccgccacttggagactattgccccgacagtatgaaggaggaggaagcggtaaaattggaatcctggtataagggtaatttcgcaacagatttcgaattaggtaggcagaaaaaatattggcttcttaattaaattggttttaaggggaacagctcagggttttgcagtgaggtattttgaatggttggcgcaacgcaaaggggtgaaagttcgacatgcctgcaacggcggggaggttgaatttggaggtgaaagtggactgtgtgattggtaccgaaaagaaaatcattgaatttcaggttttaaaacatatatatgtatgttcaaatttctattactccagggatgtgcatttcacgggtgcccgaggtgttatctgccgtggacgattggaccaaatgggcgttgcatggaagagaattacagaaggacagagatgcggatggaaaattgagagaaaagtgtatgttaagggcagcgcccttcgggtttcgagtgtggtcaacataacgccacacgcaatgccttttgacccaatcgatattcccttcccctctgttcgtttgttatttaaattcaccctttccctcattcatgttcactcttccctattcagttcactttttgtgcaattgacattattgttcttccccaatttctcttcatttattttcttctaa

SEQ ID NO: 59655 - DNA, 3133 bp, Heterodera glycines
  Genomic contig location: Contig_ID=SeqID_5913; Location=2874..6006; Strand=+
  SCN-specific regions: Sequence locations=1-1897,1919-2934,2964-3133
atggcacaaccgacggcacaagagcttttaaagctgattgccgaccagcagacggcgatgacacaacagcagcaacaaattgcacagcttttagctttgcaacaaacgcaaaaggctgatacagtgctcacactgccggatgtggccatcttcgagccgagtgatgacaaatcgcgaataagcgaatggctaaagcgcgcacaattcgcaatcgattgcgtgtctccaaacgcatcggacgctgtcaaggttaaggcgattatgaacaaactctccgaggcggcattcagcgagtacaccaaattctgtctgccagagcccgtgacaagtttcagcttagacacaacagtcaaaaagcttgagaagctgttcgccaagcctcaatcgatcttcatcgaccgatttgagtgcttgatcgcccgcaaaggggagggagaggacttccgatcttttgtcaaccgtctcaagcgtttgatcacggatttcaaattcagcgacttaaaagaacaacagttctatgtcctgatgttgctgacagcgctcaaatcgcacggcgatgcaatgctaaggcaaagaattctgtccaatttgaccgcggatggagacaacatcacgtatgatgcggtggtggaggactgcatgaattttatgactacaattgcggaggccaaagtcatcgagtcttcgtctagtggaagtcaacgaagtcatgccgtaaatgcagtccatccaaaacgagaaaagccgaagtatgagagaccaaaaagccaacaaagcacaaagacggagcaacaaaaatgctggaggtgcggtcaaacgaaccatcaccacgcagcttgcccgcagaaaggctacaaatgccgaaagtgctcacaaaacggacacatcgagtcgcgttgtgaagcagtgcaggaatggcgcaaaaagaacgccaaaagttggctcaagaaaaatgttggcaatgtccacatagtgacagtcaacattggcaccacagcaaaaccgacaacaaagtcaacattgctaagggtcaaggtctcctttcaaggcaaagtcatcgaatttgtcctcgacagcggtgcagaagttaatgtcataaacgaaatgacatacaaattgatcggcagccctaaaataagacctgcaaaagaaaaggcagtgctttacaatggaagcacaagaagcttcatcggaaaagggaccggcacattcgaattcaacggaatgaatgttgaacacgagttttatgtggccggcaaagattccctaaatttgctgtctattcaaacaatggacgcatttgggctgctcgacgaattgaaggaaaagatttcctcaaaaatggtgaacatgtgcaaaggcggtaataaggagaacgctccaagccgaccaaaaggcaccgaggtcaacgaatacctcaccaagctgaaagaaatttttcccaacgtgttcaaagaagaactcggattttgcacaaaggcaaaagcaaatttggtcctaaaaccggacgcacagccaattttcagaaaggctaggccggtaccttacaactcacgagaagttgtcgagaaagagctggaaaggttggagagcctaggaatcatcacgaaagttgagcacacggattgggcggcaccgattataatcgtgaaaaaggccgacggatcagcccgtatgtgcatcgactactcgacgggcctcaacaacgctctattggaccatcagcacccacttccgttgccaaatgacatttttgcgacgctgaatggtggactagtcttctctcaggtggacttaaaagatgcctacctgcaaattgagttgactgctgaagcaaaaaagctatgcacgatcgcaacccaccgtggctattaccaattcaaccgattgccattcggtgtgaagacggcaccaggaatttttcaatccatcatggataaactcctggccggactcgagtttgcgacggcgtaccttgatgacatcataattgtcagcaaaacaaaggacgagcattttcaaaatctggaaaaagtgttcgatcgaatccaaagctggggatttcgggtcaaaatggacaaatgtgcatttttcaaaaaacaaatcaagtatcttggccaaatcatcgacaaggatggaagacgacccgacccaagcaaaatcgcggcaataacaaatatgccagcaccaaaagacgtcccgtcacttcgcacgtttcttggaatggtaaaccattaccaacaatttgtaaaaaacatgcgattcgtccgacaaccattggatgatcttctgaagaaagacaaagactgggactggagcaaagaatgccaagaagcattcataaaaatcaaggaaattttatcctctgatttgctcctaatgcattacgacccaaaactggaaattatcgtggcagctgacgcctcagatcatggaattggcgcagtcatttaccaccgatttccaaacggagcaattaaggccatcgaacatgcctcatcatctttgacacccgctgaaagaaactattcccaaatcgaaaaagagggattggctttgattttcgcagtgcgaaaatttcacaaaatgatctacggaagacaattcattctccaaactgatcacaagccactcaatcgccatttttggcaacaaaaagggaatccgccagatgagcgcgaaccgtcttctacgatggtcactcatgcttttggcgtatgacttcgagattgagtatgtgaacaccaccgaatttggacaagcagatgcactctcgagacttattgcaaaaagcaccggtcccgatgaagatcgagtcatcgcgtccatggaatttgagaaggaagccgaaaatttcttcatcaacactttggaaacagtgtcactctcatcgaaagatataatttcagcaggaaacgaagacgaaaccatcaaaaaggttaagaagtttgtcaaagatggatggcccaatgacaaagcaattgcttcggaaacggaagaaattaaattgttctttcgtcggaaagatgacctctccatcacaaaagaatgtctgatgtacggagaaagagtcgtcatcccgccaaaatttcgagcgaaagtcctccgaatgctccacaaaggccatccagga

SEQ ID NO: 59656 - DNA, 65 bp, Heterodera glycines
  Genomic contig location: Contig_ID=SeqID_29105; Location=328..392; Strand=+
  SCN-specific regions: Sequence locations=1-20,56-65
taactttttatgagatgtacaaaaataatttcataattttaaatataattttatagaattaggtt

SEQ ID NO: 59657 - DNA, 724 bp, Heterodera glycines
  Genomic contig location: Contig_ID=SeqID_29106; Location=1..724; Strand=+
  SCN-specific regions: Sequence locations=1-533,563-724
  Gene Ontology: Mol. function=protein phosphatase type 2A activity; Biological process=nitrogen metabolism
ccgaagtgttcgattgtttgagcctcgccgcggttctacacccctgcattttctgtgttcacggcggtctttctccgtacattcgaaaccattgaccaaatcagaacaatcgacagaaagcaggaggtccctcacgaaggtgggcaaagggtcccttttcaaaacaccacaaaaatttctcaatccaaaggtgcaatgtgcgatatgctttggtctgatcccgaagtacggcatttttgtaccaagattttatgttattcttatttaattttttgaattattgtttttttctgtaaggagtgcgtcggcttcgctatcagtcctcgtggtgccggctatctgttcggttctgatgttgtgaaattgttttgtgaaaagaatggcgtagaaatgattgcccgtgcccaccaattggtcatggaaggatacaaatggcactttgacaacaccgtaagtaaaacgcaatgtttaacagagaaacagcgaaagatatttcccatctttcataggttctcaccatttggtcggcacccaattattgttaccgttgtggcaatgtggcggccattctcgagatggacgatgtactgaaaaaggaatttttgattttcgaggcggcaccgcaagtggtcggaacaatatttaaaaaagaatattttgaatgttttggtttttcaagggacgaaacacaccaatgaaggggcctatgcctgaatatttcctt

SEQ ID NO: 59658 - DNA, 1055 bp, Heterodera glycines; identical to SEQ ID NO: 29107
  Genomic contig location: Contig_ID=SeqID_29107; Location=1..1055; Strand=+
  SCN-specific regions: Sequence locations=1-243,265-316,346-356,379 -506,544-568,590-1055

SEQ ID NO: 59659 - DNA, 283 bp, Heterodera glycines
  Genomic contig location: Contig_ID=SeqID_29111; Location=318..600; Strand=-
  SCN-specific regions: Sequence locations=1-283
tttcatttgtgtatctgcttcgatgtgttccttctgctggcacatgccaaagtcggcttggctttggcgttcgtctccgactgattcgactgtttggtggacacgcacttcaacagccgaaaatggtcacttggccggctgagaattgcccgtccgtggcgaggcgacgatcgcaacaccgcaaattgaaaaatggaacaacgacgtttgtgctccaatttccaatcccacaaacgccgctgccgaatggtgtcgttggatttgaatgcatcatgatcgtttg

SEQ ID NO: 59660 - DNA, 5486 bp, Heterodera glycines
  Genomic contig location: Contig_ID=SeqID_5914; Location=900..6385; Strand=-
  SCN-specific regions: Sequence locations=1-526,548-646,668-899,921 -927,957-1016,1064-1318,1341-1551,1573-2019,2044-2071,2093-2196,2222 -2381,2423-2474,2559-2696,2718-3241,3263-3420,3442-3726,3764 -4047,4224-4257,4438-4586,...
  SCN-specific regions: Sequence locations=...4608-4660,4696-4814,4918 -4955,4977-5159,5190-5265,5423-5486
  Gene Ontology: Mol. function=transcription factor activity; Cellular component=nucleus; Biological process=circadian rhythm
attgccgcttctaccgttttttctcttccattcaaatcgccttccatcacagcggtgccgccgcgccccatttcgtctccgtcggattcgccgtgtgcctcccctcgggacattggccaagggactgacggagcatcgccggtggagccgttagagacaattacgacgctaacagcagaacaacaacaaccacagcctgaacctggtcagctgcggtgcgcttccgcgcaccgaaccgccgaagacaaaagcgcacacgcgggaacaggcggcggaagcggaaacccaacgcggaggacacccaatgttcctgagctgaagatcgactcgtacaacagcgcgtgcgtattgcacgcgaactccgctggaatacgcggcaatcggcagcagagaatgacgccgaacgttgccgccggcgcattgctttcaaacggacttttggcacacgctttggaaacgccgacgccgaagattccggaccttttacgcacgccgaccgcactgctcacatcgccaacaaacacttgcgcaggcggcggcagcggcccaaaatcgtcggtacgcgtcttgacgcgacggcacgcatcgtttcgcaatgcgacacgaatttaaaatggcaaaaacggcttaagagcccaaaaggacctttctctccccacccctcgtcaccccataaataaacgctgtcattgatcagtcaatccattaaaaataatatgaaaaagcgcatcgcaatcagttggttgattcattcgtgtcgcatgtgatcagagatcagctgaggggcgtgtctttctaagcaccgcccccccccccgtagcaattggttcacatcgacgaactgaacacgccgttgtgcctgaactcggcgacaccaaaaagtcaacattcacaggcatttttcggggaccacgagccattgctaacaggtggagaaatggaaaagaatgaataattaggaaaagggaagcccattattattcattcacatactctgaggaggacaaaactttttgatttttaaattaaaaatttaattaaatttaaatttatttattattttctttctctttttacgatttcaaacaatttacaaaagtgtcattttgatgggttttttaacttttctgtaaatgatcaatgccaatcgatggcatttgccattgccaatgcttttgctttgctggccatgccctccccctttttttgtctaattccccccccccatttagccaacatcgaaatcacctccaccgttgtgtcagcatcttctcaccaccactcaccgcctcagtccgaccatcaccagccaagtaaaattccaattttgattttattttgctaaataaatgaattaatttcctccataattgcccccccccctcaaaaggcgcttcttcttcttcttcttccgctgagtgtgcgcatcgttccgccgcttcgcttctccacgcgtccaccggaagttttggcacaacgccaacagcaaaaaataacgccggaggaactgatcagaagctcagtttccaaatcaaagggtccatctccacaaatttgccactgaatgcacaaaatttgaactcaccaggtgagaggaagtcggaagcgaagaaagaagggaattcccactgattattaatatttgaaatccgcttaattaattacccaaaatgccgatggcatttgccaatttcgacacttttcactattttcctctctctgcacctcccccccccccccctctgaagaacgaataggcattccattccgagattcaccaaaacagttgcgaattaacttttaccaatacaataatttgttcgccgaattgtccgataggaaaaaagggaaagggggggggggagaagaagacacccccgggggagaaacatgtgacaaattaattaacagagggggggggggggaaggcagagaagcgcaaattgtgaaagtgacgaacgaacggagatgattttgcagaaagaattcggacaaaaagcaaaaaacaaaaacaaacggaattttaaaatgtaatttaaatgattttccaaatccttaggactgagtacgcccttcttcaccttctcgcccctcgtggagcacttcctccagtcgtgctggcgtaatcagggccttcccgtcctttcggtggacaccaacagcaaaacgtccatctccgatgaggtaaaaactttgcccaaaaattgaatgcccaaaaatgccgcgcccttttgcccaccgcaggcaatgagagaaagcgatgacggcggtgcctttcccctcgcgtgcggcaaacagacgcccgaggcggtcccatcggccgcgagcagtgcgacgacgcccgggggcgaacaaaagcatttgctgcattcgttggagggcaacggcaacaacaacaataataacagcaacaacaacaacagttttgcaacagcgcaaagagtcatcggcggaacagagccaatggaaattgtgcaacagcagagccatcaacagcaccagcagccgcagcacaaccacagcatacaacagcaacacttccaacagtacggcagcagagggggcggaggaggagcaacgcatggacaagcggtgagagagtgatcagaccgaacccagggaaagattgatcgggtccaaataagtaataagtctgaactgcgatatgttgaccaagggaatgcctgactgatcttttcgattccttcagcagcagcaccaattcagcgcctatgggcttcagcagggacaagcgggtggtggatcagcggcacttcaccaacaccaccaaatgtgctcgccggccggacgatttcaggtggagtggtgggggtaatcagattgatctgatagaaaagcatttgatcagttggggttgaaatcggatatttctctgaagttgcagattcatcaaagcatcagctgcagcattatgccagccccttcgtgcagttgtgagctgagtcacaacacccacagcagcagccgcacagtctccgccgcgtcttcagccaacgacggaaacgccccgggcactgtcggcacgaccctttccggcggaacggtcgcattgacaccgcagcagcagcagtcgcggcctaactcctccacctcgacgacgagttcggccggtgctcattcactggaagcaatgcaccactctccgctccaacagcactttggcacttcgcaaatggcatttttcgggcttttccattgcctaaggcattgacctgtttaagaatttcaagctggagccgccgttgttcgatgaatggccaacttatcaaccggcgccgatgtttccgtccaatgccgcccatccgcaacattccgctaatggcatcgcgtccgtttcggccgttgagttcgttccgcaacggtcgcgcgaacggcgctccactttttcgggcgctgccacagccagcactgtgcctgacattgtggccaatgcaacgacgccagaggcctcaacttcgccattccaacgaaacgcgaggacgccggtgcatgaaagaccacaccaatgtccggtggacaattgcgacaagcgtttctcgcgctcggacgaactgacgcggcacattcgaattcacacggggcacaagccattccaagtgagcaaatcagcgaagcagaagcatttgaaagtgccaaatgcttttcctttttcaatttcagtgcaaattttgcatgcgcgccttctcccgctccgaccatttgacgacgcacatgcgcacgcacacgggcgaaaagcccttctgttgcgatgtgtgcggacgaaaattcgcacggtcggacgaacggaaacggcacacgaaagtgcacgcgaagcaaaagggcgggggacgacggatgtccgtctcttcgggcggaagccaagagggcattattggcagcggacgcactatgcatgccgaactttaagcggacaaacggccgacgcgcgtcgccccgggggatggccggcaaagggcgcttaggcactttttgttttattattgttgttttctccactattttatgttaaactctgctgctattgtttctctctctctctttccttcactctctgtctctcccgttctctctctctttctctctctctctctttccttcactctctgtctctcccgttctctctctctttctctctctctctctctttccttcactctctgtctctcccgttctctctctctttctctctctctctctctttccttcactctctgtctctcccgttctctctctctttctctctctctctctctttccttcactctctgtctctcccgttctctctctctttctctctctctctctctctctttccttcactctctgtctctcccgttctctctctctttctctctctctctctctttccttcactctctgtctctcccgttctctctctctttctctctctctctccccctctcccaatctctttcttcggtcccattctgtatgccattcctttccttttctaccgtatcttttacagtataccgtccttcagtaagtgctattggctatgttcttccttcaggtggtattaatttccatttatgcattttagactattttagtctatttttattgattgatctctgtcttttggcaatttgcattaattgctatccgctaattaaggttaattaattaataagcatttaattaataatatttcgagtattagcaaacattggccagtgactactgatcagagataaattagtgaaattaattgccaaagcaaaatattaatgagaggcgaattttcgtcacttattcattaattaccttcttctctttctttctctttccctctctctctctttctctctctctctcctctctctatcctcatctcttccccatttcctttctctctctcgccctccccctttcccatattctctttcaataccaaatgacagactaccgtatgtttgtctgtttgtttgttcctaccgtacatccatataataataatttctctgtcagagtgttcgtccattcaaaattccaataaattacggtgattctttctttttctttatttttttattcaaattttgcatttatttattgtgtctttgtttgacataaaatatttataaaattggacttcatcatttgctaacaacaacaaaaatacaaatttttaaataaatatttttccgggtaacttttcaatgccacggcattttttatatattttctgcgaaattcgaaaaaatacccaaaatcaaatttaagaagaaaagtcagtggaaggcaaaaacaacgaattaaagctaaaaatggtcagagagagaaagaaaagaaaaatgggaccaaaggcaaagggaaaagaaaagaaaaggccaaaaaagggaacaatcggagggaaagggagaaaaaaaagtgaaaattggaactaatgaggggggggggggtaattaaaggcaatcaatttccaaatgattgattgtttt

SEQ ID NO: 59661 - DNA, 361 bp, Heterodera glycines
  Genomic contig location: Contig_ID=SeqID_29114; Location=71..431; Strand=-
  SCN-specific regions: Sequence locations=1-340
atgatggacaaattggacaatgatgaagcattgaaaagcgggaatgatgtagaagaagcaaggaaaaagcagctttctgccattgaagagacaaaccgaacggttcgccaaattatggaaaatttaagccaattcaaaaagacgggcattccgtcgggcaaagggttgaaatgcatctcgcaacaattattcaatcggatggcacatcatttgggcattgaatggcaccaagtccagccttacagagacatgtccaattggcgactcgcaatgcgcggcttttcggcactgaatgcctttttgaaaatgggcattcatttcgattcgtttgctggcaaaaagaatcacaaaagggaagaaa

SEQ ID NO: 59662 - DNA, 117 bp, Heterodera glycines
  Genomic contig location: Contig_ID=SeqID_29115; Location=374..490; Strand=+
  SCN-specific regions: Sequence locations=1-117
cattcatactctcggcggtgacgacgataacaaatctcgacaaaggtccaactcaagtgacgatgaaaacagcgatgaggggaggcagggcttttttgttggcggaagtgatcacag

SEQ ID NO: 59663 - DNA, 513 bp, Heterodera glycines
  Genomic contig location: Contig_ID=SeqID_29116; Location=98..610; Strand=-
  SCN-specific regions: Sequence locations=1-22,62-157,179-281,320-513
gtgacccacacaagtaccgttttctctctctctctcgttccctctctctcttctctcactcgtcttctcaattggcaattgacacagcgaatgaatatccgaaaaaggaaactttagacggaataattcgagataaatttgaaaacattttgaaggatttgtttaaaaaggcagaagaaaaggcaaaaaaagataatccacggagagccaatgagataaatgatgacataaataaaatacttttgggttcaaaattcaatgactcatatacatgggtaagcaaaaattatattattatttttaattaaaattaaatttagttagatgaagccttactttcggtctttgtgaaaggaaatgtgaagtttaacaaattccttaagcgactaaaagagtaccaagcggcagcattttaccaagatgaaagtgatctttgtatgagaattggcaatgtgacaaaaaggggagaaatttgaaggatatgaacagacagaatgccaaaaatataataaa

SEQ ID NO: 59664 - DNA, 625 bp, Heterodera glycines
  Genomic contig location: Contig_ID=SeqID_29117; Location=1..625; Strand=+
  SCN-specific regions: Sequence locations=1-35,57-223,246-378,402-625
  Gene Ontology: Mol. function=transferase activity, transferring hexosyl groups; Cellular component=endoplasmic reticulum; Biological process=protein modification
gttgggtcagatttactaaaaaattaccgaatcggatggcctttgtttttgaaggtcctccgtttggtcggtgctcctctgctgttccccggccttttgttcgtggactgtgcccactttcagtacaatcactgctccctcggcctctttctgtgggcgatctcttttctcgagaagggccgtctccgcgccggtgcttttttctttgtgttggcccttaaccacaagcaaatggaactttaccacgctttgcccattgccgtttttctgttcgcccgttcattcgttcacacaaatcgaattcgttcattgttttcggcaattggacaaaggcaggacattcgatgaaattcccctcattttctattcatatttgacttttttcagtgtctttaatttgtttcaattggctctggtggtgctgctcacttttgtcattctttggtctccattcctttggcctgagccttcattggccctccaattgcttcgacggattttccctttccatcgtggccttttcgaggttttaattgtcttagtttctaataattattaaattgtccaaggataaggtggccaatttctggtgttgtgcttctgtgctggtcaaattcaaacaaat

SEQ ID NO: 59665 - DNA, 507 bp, Heterodera glycines
  Genomic contig location: Contig_ID=SeqID_29119; Location=288..794; Strand=-
  SCN-specific regions: Sequence locations=1-107,134-236,259-277,299-507
atggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacagaattactggattttttcatcatagcagtgcttttccttgtactgttttgagagctctctcaaaatctggttcgcttctgatcagtttataaaaaaaaagttaagcctaaaatttttcgcatatttaaaaagcaattaaaaatttttagatttttattcatctccctttttgatagtgaaagcatctgagtgcctaaaataacttgtaaataaa

SEQ ID NO: 59666 - DNA, 986 bp, Heterodera glycines; identical to SEQ ID NO: 29120
  Genomic contig location: Contig_ID=SeqID_29120; Location=1..986; Strand=+
  SCN-specific regions: Sequence locations=1-18,41-354,376-584,606 -719,742-777,800-986

SEQ ID NO: 59667 - DNA, 247 bp, Heterodera glycines
  Genomic contig location: Contig_ID=SeqID_29121; Location=1071..1317; Strand=-
  SCN-specific regions: Sequence locations=1-125,150-247
attttataagaaaaaataggagttttgggggcgcggcggtgccgataggcgccgcctgggaaaaaattggaaattttgatcatttataaacaggttttcactgaaaattagccaatttataggtaaaattttgaaaaattttatgggaatttaatccaattcttaagggtgtaaaagtcgcgtttcgcgccaaaaagcgaaatgcgaaacgccaaaaaatgcgaaaggcgaaatgcgaaaagcgaaa

SEQ ID NO: 59668 - DNA, 603 bp, Heterodera glycines
  Genomic contig location: Contig_ID=SeqID_715; Location=241..843; Strand=-
  SCN-specific regions: Sequence locations=1-197,435-471,493-603
  Gene Ontology: Biological process=N-linked glycosylation
atgcaccacggcatgatagcggaaatggaacgacacctgacccgaaaaaggtcaatacagtacccggatgagggggagattgttgacatggaagtcgttgaggaggaagagcctgaagaagcaccattaaatccgttgaaaaatcgcacaaaacttgatcaacttcgcttgaagcatgagcgagacaaaaaagagagggaggaggaggataaacggcgacagcagcgagaagagcagcagcagagaaagcagcaggaagagcagagaaagcagagagaagagcagcagagaaagcagagagaagagcagagaaagcagagagaagagcagcagagaaagcagagagaagagcagcagagaaagcagagagaagagcagcagagaaagcaacgagaagaacagcagcaaaagcagcgagaaaaagagcaagagaaggcaaagaaatctgaggctgaacgattagccaaagagaagaagacagaaaaggagcggttggcaacggaggaagaagaacgactcgccaaggagaaggcggaggaggaacgatttgaatttggccaagttgtgctgactcttcagtttaaaaaagtcgtaactttctga

SEQ ID NO: 59669 - DNA, 803 bp, Heterodera glycines
  Genomic contig location: Contig_ID=SeqID_715; Location=1100..1902; Strand=-
  SCN-specific regions: Sequence locations=1-47,88-716,738-803
atggctcctcgtaagcagaatgagcagtttttggacgaaatccagagtaaattttaaaataaaacacaaaatataagcattttatagaagcgaaccacgtggaagaagcacaaaacaatcaaagaaaacataaaatgggtaaaatttttcacaaattttacaaaaattttggattttttctcatttttcagatattgatgatgacgtcatattggttgactcgcagtcatctcacgcagaggaacgtcctgcgctcaagaagaggggccgaaagtctcgctgggaaaaactgctggaggacgtgaacaacgcaaagaagtccaaccccgcagaggttgaagtcacagatgtcgacgaacgcaaagcagccaacgtcttcgactacccaacaattttctggaagctcgcacgcccaaaggtaatgtttgctctggtggcagccctacaatgttcttcttcttccgttgcagtatggggtgttcacctttatgtgcaacgaatgccgtaacgaaaacttcaagcgaggcgacaagcgcttcatcctcaacactggcagtggccaagagaaactggagttacccaaacgttttgccaagactgtgccaagttgaactttgactgcaccgacctgatcatgaaacaccaaaaaaaggatgatggaccacagaagaacggaggacggagcacctttttcaagacggaaaagtgatctttgaccattcattcattgatttttcgttaaaatgagtaactctttctttgtaattttgcccagcaatacgccgggatttgtcggcaataaa

SEQ ID NO: 59670 - DNA, 545 bp, Heterodera glycines
  Genomic contig location: Contig_ID=SeqID_715; Location=2123..2667; Strand=+
  SCN-specific regions: Sequence locations=1-247,270-545
atgcccccactgacaacagccttatccaagctgctgaactgtaaagctgagaatttggcagagtacctgaataacccggaagctgtgaacaaggcgagtgcatacctgcgaggaaagaagctcaagacaacctactcgaacaagggcggcactacaaaggaggtcgagtttggcaacttctcgctaaagtctgcttcggagacgtacgccttcgagggattccttggcaagtgtcctttctgcaagcattccctcactttggaaagttcagaggtcaaagttcaccagtacttctacataaagcaccggatccgcctgttgtaccctcagctgaagtgcatcgttgagtaccacagcaaaggtcattgcaagtactatccgttgggtaagctttaggctgcgatgaaagcccataatctcgcacggtttcagagttgttggccatagaggaaagtgcagagataacaggcgaaaagccaacagacaccaactacttggactacctcggcttccgaagtgtttggcagccaacccccgtctattga

SEQ ID NO: 59671 - DNA, 1898 bp, Heterodera glycines
  Genomic contig location: Contig_ID=SeqID_715; Location=3480..5377; Strand=+
  SCN-specific regions: Sequence locations=1-354,376-675,701-957,980 -1023,1046-1898
atgatgaaaaagttgccaaaaccctttcttattgtctacgatgacctcatgggcgacattgacgcgaagaagttggccgatctgtacaccaagaaatcacaccacaacaacttttcggtgatattcctcacccaaaacctgttcgacaaggcgatgagagtgccaaggtccaatgcgcagtacatctttctgatgcgtgcgcccagcgatatgttgagtattcgtaatttggccagccaaatgtttcctcgcgagcaagggtttctgatggacgcgtacaagcaggcgtgtgccgatccgtacgggtatctgttggtgacactacacgcaaacacagacaacctcttacgactgaggacaaacattttcccagacgacgaagaaaagattgtctttgtacccaaaaatggttaagaagcaaatggttggacagcgggtgttggacaactacgagtatctgaagtcccttgggaggacgacatctcacaagaagaggcgtcatttgttgagcagtgcaggttgtgaagagctgttgaccctggtggagatttgcttaaacctacttaacggatccttctgtttgacgcggaaacagaaacaaaaattgttgccttttgctgacaccattcgacggttggcacgcgtgagaagtgagcagagtgcgagaaagctgatcttacaacaacaacaaccacagcaggagggaggttcactgtttgcccctttgttggcacccatactgttagaggaagcacgttatctgctgcgcaaagatggccaataagctcattcttctgccttttgagcattaccgaggattagttgcagcgagagagggtgtcggcgttgcgaaaggagacgacgatgtggcagggcagacaaatttgggattcgtcaaacgacagctggagaccgcgaagaggaaacggacagcgaatgtcagcgaacgaaatgtattgtacaaccagcagctgaggagatatttgaagctgagaaaggaggtcaaggacaggcccctcaaggtccagctcagcaacggtgcgcaactgctgaataagacggtggaaacgggcgtacaggtacggcctggccccgacgagccgaaggacaactccgtattgattactggcgaagatgaagagattgaagtgcctacgccaataagtaagacgccgggaaacagccgatcgcccaggaccaacaagaaagcgatcaagcagaaagaaatgaacgaaaagaaggaccacctcttggccatcattatgtctgacccgcagagattcggcgctacggaccgtgggaaaatattaaatccaaagacggggcgggagttcatcaactcggacctggcctggtcaattgaacgcctagtggaccctcgcccggagaatgccccttcaccaagcggaaccaaagagttgatgaggaagctcgcacagaatccgctcgccagtagcctacttaatcgactattcgttgggtctggacaagtcaaacaaacgggaggatttgttccctctaaatggacgaaaaaataaacaaaatatacaccgacccggccaatcccggtgggtttgcgggtgcgagtgcactctatgcagcggtcaagaagaagcacccaaaactgaagaggaccgactttgatgactttttgcagcggaacaccacctacacgctgtttaagccaaagagggagaagttccgacgccttcgcacagtccccggagggttcatgaccggtgagtttgtccacgttattttcacgtgatcggctcagacgttcaggcggacttggcagacttccaagccctttcgcgaaagaacagcggctatcggtacctgctgttggcggtggatgtgttgtcgcggcgtatgttcggctcacccgtaaagagtaa

SEQ ID NO: 59672 - DNA, 738 bp, Heterodera glycines
  Genomic contig location: Contig_ID=SeqID_715; Location=6174..6911; Strand=-
  SCN-specific regions: Sequence locations=1-101,123-175,197-600,622-738
atgcaccacggcatgatagcggaaatggaacgacacctgacccgaaaaaggtcaatacaatacccggatgagggggagattgttgacatggaagtcgttgaggaggaagagcctgaagaagagcgctacgacacgcgcattttatacatggtaagagtgtgacaataaaatattcataataaaatattcttttttcaggacaccgacagtatcttctatgacttcaagactgcactgggggacccgctgaagggaggcaaccaacttggggagctcgcggacgagtaccccagccataccatcgacgagttcatctgtggtaaggactttggccaaaataatttgaataaatttcatcgattttcagctggacccaaggcctacgctctttggcttcggaacaacgcaaccggcgaggacgagtacaagctgaagctgcgaggcatcaccttggactcgaacgcctgcacgcacatcaactttgagaagatgaaagaaatggtgctggagaagtggggcacgcccggcaaccatgtgcggttcgactaccctacgaagaacttccgcatcacgaagcagggcgacattctgacggtgcccatcaccaagcagttcaaccccaccgtgaataacggggtgctccgggaccgtggactgaaaattgtgccctttggttacagctcatatgagtattgcaaagcccataacccctatgattgtctctgtaagaaggaataa

SEQ ID NO: 59673 - DNA, 666 bp, Heterodera glycines
  Genomic contig location: Contig_ID=SeqID_715; Location=7168..7833; Strand=-
  SCN-specific regions: Sequence locations=1-424,446-579,601-666
atgggtaaaatttttcacaaattttacaaaaattttggattttttctcatttttcagatattgattatgacgtcatattggttgactcgcagtcatctcacgcagaggaacgtcctgcgctcaagaagaggggccgaaagtctcgctgggaaaaactgctggaggacgtgaacaacgcaaagaagtccaaccccgcagaggttgaagtcacagatgtcgacgaacgcaaagcagccaacgtcttcgactacccaacaattttctggaagctcgcacgcccaaaggtaatgtttgctctggtggcagccctacaatgttcttcttccgttgcagtatggggtgttcacctttatgtgcaacgaatgccgtaacgaaaacttcaagcgaggcgacaagcgcttcatcctcaacactggcagtggccaagagaagctggagtttacccaaacattctgccaagactgtgccaagttgaactttgactgcaccgacctgatcatgaaacaccaaaaaaggatgatggaccacagaagaacggaggacggaacacctttttcaagacggaaaagtgatctttgaccattcattcattgatttttcgttaaaatgagtaactctttctttgtaattttgcccagcaatacgccgggatttgtcggcaataaa

SEQ ID NO: 59674 - DNA, 2279 bp, Heterodera glycines
  Genomic contig location: Contig_ID=SeqID_5915; Location=311..2589; Strand=+
  SCN-specific regions: Sequence locations=1-906,936-1087,1109 -1315,1337-1564,1610-2063,2086-2279
atgctttgcaggcacaacttcctcaacaacttatgggcgtcttcaattggtgaatacgggcatttgattgtacacatccaactgtcttccgcttcatcaacacaattcgatgtgagcaaaagtctattgatgcagaaatctcacgatgcatcgctggtgaactccctcctcaaaaggcgcccaaatatcgtgccgccgatgcgagaattcttcgactcttgcagagctacaatgccatcaacaataaccaggctcaccaaaatgatcacaattaccatgcccttatcaatgttaacccctataacatcatcaattttctccttggtatttctcggaattatgagatgcgcccgtaatattttcaatgttttgttatttttttgttgttaacacattgataaatctattatggtgttaattttaaagaattttcgagaaacaaatcagaattggatcaatgtaggacaaaaacagcttgccagactaaaacggccagactaaaccgacccccaccgtgcaaaattgggaaattcggaaaatgcgatttgagtttttataaataatgggctggaattaaaattcggaaattcggatcccaacgttttattcaaaatttatacgaatccaggtgatcagggttcgagaaatttttgggacaatttcttgccttaattctcgagagcagacgatccaagaaaaaaaaatgatggacataacacacaatttgctaccaagaaatatttgtttgtggtggataattgcgaatcaattaggggaaggaaggaataattaatcaattaatgatcatgatgatgattaattaggatggttaattaggataatgattaatgaacaaaatgattttcattgttttttttgcagccatttgcgaaaactttgacaaacttttaaaaaatttaattatttgattttttgagaaaaaaaaatctacgttttattgaaaactcttaaaaaaaccttttttgtaaaaaactgcgttgtacgaactgccattgacccaaaaataggcactaaatctttgaaaactggtgccatcgagaaaaaaaaaattgtaaaatttggtgccaaaaaaataaaatttaaatttgattgaattgaagcccattcattttaaatatcattggctctcctttttagccatcaatttatgttgccatgctaattaccaacaaatgttgcggaaacattggcactgcacttttgtccaattttggcatcttttgtcatgttttgggttgatcacgaaaacattttgtgccaaaaagggtgaagtttgttaattgctcaatttactctctttttggcattcattgtaaatacataatcgtttgtttgttttgtttgttttgcgttgtgtcgtccgtcgtttgtcgtcccttttccgcttatttttggccttttgtccaaaagggcgcgcaaattgcaaatgcgtcaaaaaacaaatcgcagaaaattttgcactttaaaaggacaaaattttgtttttgaaagaaaattatggtgaaaatcaaccaatttttgatcatttaatattgaatgaacgattaattaaaaaagaaaatttaaaatatatatttaaaaaataattcatgttttaaaccaattcatcaaagttttaattatattgaaaaatggatgaattcattaaagtcaattcgaaaagcaattaaaaacaattaacgcatgtgacttatccgtgccggtactcaattagactacagcgaagaataaaaaaattttcggcatttttgttaatttcatcatcgtcatagcacagtatggcattccaattttcttgataacaaatgatgacataacacattcgtcgtcatctgtccttccgccgttcttcctttaattaaaccatcaatcaccgccgccggcgctaaaatccgatgttttcggcacggcacagacgcattgtcattttggcgagaaaaatcccgaatttgctctgatgcgtgcactttcagcggatataattcccatggattttgcaacactaatccggcgcaaatttgcgcgcctttttgcgccaaacattctaatttcattggctacaaacatatccaaaaatggcacactttctgtgtgcaaaatgcctgcgggcacagccattagccaaaattaacttttctttttttgtagctgttcaatgtgccgcctgtgatggcggcacaccaaaacaacaacaacaaaaacaacaaacggagcataatccgacaatggcattggcatcggaaatggtgctcatctga

SEQ ID NO: 59675 - DNA, 1595 bp, Heterodera glycines
  Genomic contig location: Contig_ID=SeqID_5916; Location=612..2206; Strand=-
  SCN-specific regions: Sequence locations=1-758,788-1047,1069 -1206,1228-1250,1274-1595
atggcccgacgttgcgcactcgtgttggtgatcctctgcacccagctgagcaacaacgcgctggttgccggcctgacctgctacgagacagtgaatgtaagttgttgtgttgacgggtgcgttccgtggggttgcatgccgtgccaacattggcatagtgaccttgttgccgatggcattaaggcacagttaacatattttaatcctcgagagtttcaagaattttcggggactggtgctgactaattaaacattcttttggtatatgccatcactcccttcagcgacccccgggggaatttgcgaataatatgttcacattccccgccaaaatgtggtgacacagaaaattggatgatgagggaggggaacaaaaagccaagacacgacactctctgcctttttttaatttctcttttccaattttgttcccgttttggcatgacgtgagtcggcggtcgatcggccacggcacaaacgccgcggggggggggtcattatcggcggggtatttaattgcggaagtgtggccatttggccttcctgaaaatggggggaaatgccgaggaatttttggcacgtaaaagatttggttgcccattgtgttgtctccccccccccccccaccgggggattaatgtggcttatatgcatgtctaatataggtataatggcactttagcggcgggtaattaaatgcctcacatgacggggggaaatggcgatgccattttacgttaaatgctattattggtgccaaaaaaaatatattttttaaaattttttagggcaaaactacaattgtgcaaaacgaatcgtggacatactgtgccctggtgccggccaccattgtgggcaacgagctggtcaacggcagccagttcgggcttggccccgacaatgacatgatggcggcgtacaacaccgcgttcgccatgtcggtggacgagtaccggatcttgaccgtatgcatttacgaagtgagtgtgggttaaagatgtgatgggagggggaatcatgctgatcagagttttcgcgaagttcaattaagtctctcataaatagaaattgcctgaaatccctcaaattggcaaaaattcagcataatcgcgttccaaaagcggcacattctttatcaaattacgtgctgtgacctcacacaaaaaaaaacgtcatcccaccataacacagtcaataattggagtcgagaatttgtgccaaaaatgggcatcaattatatgtcaagattgtttttaatggtttttctgggtctcaatttgaggggttattttgaaacaatttgcattgactttgatttcttttcacgggttgctgccgttacccaccgtaccctgtaggggccaggggataccgtattacttatctcgcccatttgtactgtaaaattgaatattatataatcttttgctttttttttgtagcgctacgacttcagccgcttcatgacgataaagccggacctggcggtggagttcgcgttccggtgcgtgtgcaactacgacctgtgcaacagtgagccgacattctccgcctatttgtccgccatcaaatccgagagctttgcgagaagatga

SEQ ID NO: 59676 - DNA, 826 bp, Heterodera glycines
  Genomic contig location: Contig_ID=SeqID_29125; Location=530..1355; Strand=-
  SCN-specific regions: Sequence locations=1-131,154-232,254-711,756-826
atgcaggtccagagtgctgaatccaggcctcgacgagcctgggtttttcctggactggacttttgtccaggtccaacatggaaacaaggttaatttccaggcttttttcgaaatttcggattgtaatgcttataaatgaataatttaaaaaattcacgataatttggggatgattatcagcaattggcaaacttttgttgaaattcataccgtacttgtaaattgtggactttgaaagttggagtgaaattttatgggctttgagtgggactcgggaatagcgttcatttggacagaaattggccaaattaggggcgaacatgacgagggtaaaaaatggagtcaaaaagagaatgaagagaaatttaggggagggggggggggaatggcaaatcggcggttagggaaagaaatggccacgaaaaaagggaaaagtgagacaaattacacataaacaaaatgggatgaagtgataggaaaatggatgaaattgagaagcaaaaattgtcaatcgctaattaatcactcgccagaggggcaaaaatggacaaataatttggctggaaaaccaatgaacttttggctaaaaagtacatatccgctttctcacccgtactcaacaaatacttcatccgctccttcaaattgctcgatttggacgaaggagaagacatttgacagataattacaccactacaaaaatttaaacggaatttaaaaaattaaaaagaaaatttttttttagaaaataaaaagctatctgctgatcgatttacccaattcgcgtcagattctaatgaaatatctaattttaattaaaaataaa

SEQ ID NO: 59677 - DNA, 121 bp, Heterodera glycines
  Genomic contig location: Contig_ID=SeqID_29127; Location=53..173; Strand=+
  SCN-specific regions: Sequence locations=1-121
atgaccatgccaatcgacattttggaggtgaaccaagtgatttccatccgactgttgactgataaaatgctggataacacaatcacgctgaaactttggcactcaattcaaggaaaggaag

SEQ ID NO: 59678 - DNA, 431 bp, Heterodera glycines
  Genomic contig location: Contig_ID=SeqID_29128; Location=730..1160; Strand=-
  SCN-specific regions: Sequence locations=1-228,250-358,407-431
atgcgtgtcttcagtcagcttctcgtccagacttgcgtcgtcgatttgtttgtgctgatcctcgccgccctcgtccttccggtgggttgtccgcctaatgttgcgccttcctggcccaatcatttgtcctaatgatttggcccttgcctttggcaggtgttcttcgtggagaatggcatcggattcgacgtcatggcagggcctctccaatcattaccaaatcccgccaatcactttgtgtttatgctttggtttggccttttttacttttccatcgaaggaatcgccgtccaattcatctaccgctatttgaccatttgcaggtgaaaagcacataaacacacaaacataagtagcgaaattttaaaaaaatttaaaaaaaagtaattaatactaaatatttttagaaaatctttttggcttcggcctaa

SEQ ID NO: 59679 - DNA, 243 bp, Heterodera glycines
  Genomic contig location: Contig_ID=SeqID_5918; Location=982..1224; Strand=+
  SCN-specific regions: Sequence locations=1-69
atgatctttgggctgtcttcttgtaccttttgtcaacttccgcatctgattcttgccatctcactgtacaataatttaattttaacaaataataaaatatatttcagatttttatttgtttttattaatattgcataaattaacaatatttactgaatcgctttatcatttatatatttaaatattgtttatgttttttatttttgttatttcaaaaaattaatttattaaaaattaattaaa

SEQ ID NO: 59680 - DNA, 629 bp, Heterodera glycines
  Genomic contig location: Contig_ID=SeqID_5918; Location=2206..2834; Strand=-
  SCN-specific regions: Sequence locations=1-175,213-231,281-342,364 -540,562-629
atggcaccaaaatgcgttgccaaatgtaatgtttctgctgttcaatggtgaattggaaggagccgaccaatgacacaatggccggtgccaaacattggcaggcgaattcgcgcgcgtacatttcatgcacttcggtgatgggccactcgcgatggatctgtgtgaattttggagccaaaacatttgttattttcaaatagttttccatttttgtcaaaattttgccatggctaagtaattaattaattgattggctaagtaattaattaattaattagttgcaattgacatttcatttttgaacttgttgaccatgattttaagaatatgttcagcaaatgcgaattggcacatggcactgaacagacaaattgtgcagtccgtccagaaaagggcgcgttgcgagttgacattggcatggcccgtgccaatccaacggcgcgtcctcgcgcacatcagctgcaatttgttggtgccaaataggaattttaattgaaaggaatgattaaaaaatagtttaaattgtggatttattaatttcataatttatttacttttttcgaaaaaattttgaaaaaaagacctgataactttgaaaaattataatgaatttgagtttcaaaaataaa

SEQ ID NO: 59681 - DNA, 322 bp, Heterodera glycines
  Genomic contig location: Contig_ID=SeqID_5918; Location=2873..3194; Strand=-
  SCN-specific regions: Sequence locations=1-230,252-322
atgtgggaaaaggccgctaaattgagacccatcggcggaactgagaccgatacacaaagatgcggcaaatttcgcaaaactcaagaaccaattaacggacctcgagagtcgagactgggaacaagagcccggaattttgaaaaacctggaccaggatcggtgatcggaacacggattacgagatggaaccggacagcattcagaactatgaagtccttgttttaacaggtctccaggttctgtttctgttttttctaagcccgagactggcaatcgcggcacttgagaacaaaaaagtgccgaaaattccgagagcattaaa

SEQ ID NO: 59682 - DNA, 2102 bp, Heterodera glycines
  Genomic contig location: Contig_ID=SeqID_5919; Location=337..2438; Strand=-
  SCN-specific regions: Sequence locations=1-1,24-153,181-222,244 -518,560-660,684-1085,1107-1450,1476-1904,1937-2102
atgtttggttccttggcagttttcttgaccctttttcttgttttgctattgttttcaagctttgtgaccggaggcgagtacgatttgactgccgaggttcctccaggtctgtttttcgtttggttaacgatttctacattttcaagataactagacaaatttttataaaaaggaaatacagtgtaaacagaaacctaacgaaagcctgccaggattttccgattttttaaattttcaattccaaaagctgatccaatttccacaaaaatttagtaatttttgcaaattttcaggaaaaatccaatgtttttttcaacccgtgttggagaagcacaaatccatggaagtttattaccaggtaactgaagggtttagcagttaattgtttcttttgtggacttttttaggttatcgacggcggcgacttgaacataaattttatgctcattttggacgcaaatgtgctgaagcaggaccagatgaggacggacggtgaccataagtgagtagttttgtaaaaatgattttataatttaaaattcccatttttaaaaatgaaaacccggtccgggatcgtttcccgaatccagctggatgtagaatttttcaaaatgtgaggtcggctcaaaataaggaaataggattcccgaaaaaaagttgtaaattatataatttttaataaactcctgaactttaaaaaattctggataaggccaggattccgagaaaatctcggcgggatcccgtcctgtttttgaaatggaatttggctgacaaatgaacaatgcgtatttgtgcattggcaaaaaaatttgttttttcttaaatttgacactggtaaattaaactttccattgggttcggtggtcaagtggttaatgaccttgttggtgatgttgaacaaactgagcaacttgagttggtatttccgtttgcgcacattttgtgtggttggaagtgccaaatttgttgctcaaaagcgaccgttcatttgtcgatcaggtcactcgaatgtttgcacacaaaatgttcgagtgtaaggttgacaatacatttttccattatttctaagacctaatgcctgccaattttaaaccaaaaattttgaaagattcgccaagtaaatctaattattattttgaattttagaattgacattcccgcccctgccgactaccagctctgttttgacaactcattctcataccaaacccgtaaagtggtgttcttcggttcgttttccattttttcgctatttttctttgatttcccaacggcgccgctcctcaaaaattgaaaaatttcttacgcttttcttagtgtttggcactgtcataccaaaaaatgcttggaattattctatcacctcatccccctataaaaaatgcattcaaaatattggcaatttatttatgcaaaaatgttgaaattgcaacgaaaacaaaaggtcctcttctcacatttcttttttgcaacacagaaatttatttgtacgacgccaacggcactttggaggaggaggacgtgaccaaatttgccatcaaaggctccgacgcggcaatgcaagagatgttgaagcaggtcggcatgaccgtgcaacagttccaggtcagtcgatatttttcaaaaaatttgccaccccccccccccctcctctatccaaaacaggagtctttcacgacgatcaaatcgcgtttggaccgtgtcgagtattaccaaggccaattccgggccagcgaagcacgtgaccgtgccgttgtcggtgccaacaatgaccgtgtccagttctggtcgttggtacgtttttctgtgcatttaattacctaactaatttgtgccattttaattgggcataaaattgggaggaaacaaaaaaaaatggtgaaaaaccgtttagggatgacaaaattaaaaaaaaaaaatttgtattaaatttcaacatttagaaaaaacaggtcccggattccatgtccacctgaaatcctgtgttttctggacaaagacccatgaaaaattttcagacatttgaaaaagacctgtccttggcccgggaatccagaaaaaatccaggcctttctggcccaggccaaccaaaaattaaa

SEQ ID NO: 59683 - DNA, 743 bp, Heterodera glycines
  Genomic contig location: Contig_ID=SeqID_5919; Location=2981..3723; Strand=+
  SCN-specific regions: Sequence locations=1-183,209-549,571-743
atggacttcaaagagttggtcaaccaagcggaacgaaatgcgaagcggcaagagcgcaaagtgcacgaggcggaacgcgagatgaaggcgcgtcagcagagccaaatggaacgcctcgcttatgaaaaggcacgcgaaaagttggtgttgaaacgacgcgctgtcgccacaatgcaacagcaaaaggaacagcaacaacagcagcaggtatttgggaaaaaaggacggaatttttcaaaacgaaaatgggtctctaaaacttggacttccagggtaaaaaacataattctgtccggtcaatccgggagaactatacattcattcgtcttatttttgtccgagttccttggttaccgcgtctgaaattgccgttttatcggccggcccaacctcggcgaagttgctgggccacagtcaacggcacggcataattattgactacaaagcaattttttgggaggcctctaaagcatgaattttcgaatccaaggttcagaattgacaaggaatttggttacagactttctgtccttgaggaaatatcgttttcagaatacacacaattttctatttagctacaacagtcacaaaagcagtcgacgacgcatgaacgaacggatgggacgacgaaagcgatgacaaagcgagaacggttgggcagcgacgcggtggccactgacaataaacatcgaaagggagccgggccgggagacgcagcacagctgtgcaacggcagcaacgag

SEQ ID NO: 59684 - DNA, 210 bp, Heterodera glycines
  Genomic contig location: Contig_ID=SeqID_29132; Location=395..604; Strand=+
  SCN-specific regions: Sequence locations=1-148,170-210
ggaccagttgaggggggggggggctgaaaaaatccattttttttgttttcggggcagtccccccgaaccgatgcgcccagatttatggggagaccgaatccttcgggaataggttccctatagcctgtactttaattctgcgttgcatttttgctccccataaatgtttgagtacccccatacggacacttgaaaaaatcgatttttttt

SEQ ID NO: 59685 - DNA, 204 bp, Heterodera glycines
  Genomic contig location: Contig_ID=SeqID_29133; Location=466..669; Strand=+
  SCN-specific regions: Sequence locations=1-70,102-204
atggaaatggaattgaaattggccaaattggaactcgaaattgtgaggagttttgccataaaaattcgactaaaattaagaaatttttaaaattatttttagaaggtacttgaacaaaagttaaagcatcaggaaatgatggtcgaacagaaggcattgaaggaaaaagtgatcaaaattgaacagaaaaatgaaaaaaaatga

SEQ ID NO: 59686 - DNA, 128 bp, Heterodera glycines
  Genomic contig location: Contig_ID=SeqID_29138; Location=588..715; Strand=-
  SCN-specific regions: Sequence locations=1-13
tgaaaaaagtaaaaaagcttacaacaccttcgattcccaggacgtctccgttccaagtactaagaaggcccaacgttgcttaacttgccagatcggacgggatggcgtgctttcaacgtggtatggtc

SEQ ID NO: 59687 - DNA, 577 bp, Heterodera glycines
  Genomic contig location: Contig_ID=SeqID_29140; Location=330..906; Strand=+
  SCN-specific regions: Sequence locations=1-131,153-229,271-318,340 -456,502-577
  Gene Ontology: Mol. function=kainate selective glutamate receptor activity; Cellular component=integral to plasma membrane; Biological process=synaptic transmission
atggagtctagctcgctggagtacgaagtgcagcagaattgtaatctgacacaaattggcggtgtgctcggctcaaagggttacggtattgcactgcaaaaaagtacggtgcaaaaattttcaaattttaatctttccttgctgtcttctctctactcacagattccgaatggactgatcgaatctctcgccaaattttgctttaccaaaaacgcggaattatcgcaatgaaaaaagtggagaataaatacgattttttaattaaaatttcagacaaaatggtggcgctcaaagtaatgcggcggcgaggagaatctcgcccaaaaattccaaaattttaggggtgcctcatgccatggcgttggttcgtcggttaagcagcagcgcatttcactgaatttgcacaacgtttccggcctgttcgtcattctctcaatgggcctacttttttcggtgaatttttaaaattaaattaatattttttaaatcttttattattaaggttttcattgtttgcgttgaattctatgcacgaaagcgtgagaatcagaacaacaaaaggaatggacaaaaatga

SEQ ID NO: 59688 - DNA, 633 bp, Heterodera glycines
  Genomic contig location: Contig_ID=SeqID_29140; Location=302..934; Strand=-
  SCN-specific regions: Sequence locations=1-104,150-266,288-335,377 -453,475-633
  Gene Ontology: Mol. function=kainate selective glutamate receptor activity; Cellular component=integral to plasma membrane; Biological process=synaptic transmission
aaatgtcttgaatttcatgtcccaaaaatcatttttgtccattccttttgttgttctgattctcacgctttcgtgcatagaattcaacgcaaacaatgaaaaccttaataataaaagatttaaaaaatattaatttaattttaaaaattcaccgaaaaaagtaggcccattgagagaatgacgaacaggccggaaacgttgtgcaaattcagtgaaatgcgctgctgcttaaccgacgaaccaacgccatggcatgaggcacccctaaaattttggaatttttgggcgagattctcctcgccgccgcattactttgagcgccaccattttgtctgaaattttaattaaaaaatcgtatttattctccacttttttcattgcgataattccgcgtttttggtaaagcaaaatttggcgagagattcgatcagtccattcggaatctgtgagtagagagaagacagcaaggaaagattaaaatttgaaaatttttgcaccgtacttttttgcagtgcaataccgtaaccctttgagccgagcacaccgccaatttgtgtcagattacaattctgctgcacttcgtactccagcgagctagactccatctgcaataccaaaaaaattaattgtgat

SEQ ID NO: 59689 - DNA, 2884 bp, Heterodera glycines
  Genomic contig location: Contig_ID=SeqID_5920; Location=182..3065; Strand=+
  SCN-specific regions: Sequence locations=1-822,848-2242,2266 -2368,2396-2570,2592-2619,2641-2884
atggtgcgttgtatgcgcgcaagcagaggttcttcaaagggtaaaggcataaagcacatgagcagcaggacgcagcatgcgcagtctgcttcaaaaagacaaaagttgcacaacaacgaggacgactgtcaatgggagggatgttcaaacggcacggacagcagacggaagatggtcggaatcaacgaccttcctcatccggtgttggtcagtcgcaacgcaaaacaatcatgaattgtctttttgactaaaaattataggggcttatcctggcaaatcttaacccggccgaacgtctgcgagccgaatctgtgtgccatcgatggaaatttgttggaacacactttagttggaccaatcagcgagagttaactgtcaaggaaattgtgcacccttcaaccgcagtgcactcgctgttcagcatgtcaaagccgttgaccaacaaacatgtacatgctagttcataaaacaattccgttcttccaaaagttttcagcgaatattcatacaaaaagaattttcctaaatccgtcaatatccaattcaattccaaatcttaataacattaaatacagattgaaatacttttgaaacggtgtgggtcaagtcttcgtctgctgaacatcggctcactgagctccgtcaacagagacagcatcacttacgcggtctgttccttgttcgtacatgtgccaatgctgcacactttggatttgtccggcatccaactgacaaactccgctctttcatcgcttggctttcggttgccgaatttgaagagagtggcgtttagaaattcattcaaggttttgaacattcctcattattttttttaatatataaatttcaccatctggtttcattaattttgttttactgaaaaaatatacgatcattgttaaagaaagcccataatttgttaaaatcaaatttggcagaacacccgtatggagcgtggcctttcttcgtttctcgcgagttgcaggcggttgacgcatttggatttgagcgggaacgaaaacctcatcggctctgctttttccgaccttcctccgtcggtgagtggaaattttttttagcttatttcgttttttctcgggaccatttttctttctaaaaacaattacttttccattcatttacagctggaagagctcaacatttcctactgttatcacattggcatccacggcattagacaaattcgtgcaacttgcgccaatttgcgacgcctttacatggaccaaattggcgattcggtgtctattagggaattggacgaaatgctgcgagaactcaaaaggtattttccgttgctttattacattttttacagtagagttttgtttatccttctgacaaataattggtcttttcattcagcttggtctacctcaaattttgtgaatgctatggctcttccgacttcaacgacttgcaactgaatcatgaccaacatttgacgggcattggcgagctgacaaatctgacggaattgcacgccaacgaaaatagactgttctttttttaatttaattttttcttccatttttttttactgtttattgccatttcgcagtgttgatgacgaggtgctgagggcgatctcttttggttgcacttctcttcagtttttggacatttcgcaatcgcaacggggcatcactgacgcgggtattaattttgcttaattcattcaaacaatttgctgaataaattttgaacgtttctttgattaagggcttcgtcatctctcccaattgcctaatttgacgacactgaaaatgaacggacagcggatggtagggtttttacactgtttaacaaatccatatatccaggatacaaaaataatacaacaacataatttttaaaccatttagtgcgtttattgtgataagtggtcaactcggaattaattccaattttaggtctcggatgagtctttgattttaattgctcgtcgaggcattttaaaagtttgcatttagttttttctttaccctttatgctcaaagcaatgctttttttgccacttaaggagctaactattagtcgctgcacacaaattaccagcgaatcggtgctacaaacaatcaaacactgcaaggttgttttgttttgttttttgcttgcatacatcgttttgaaatgatgaacattttttctgaactcaatttttaatactctaaaacaatccttctcttattgttggttcaaatcaattcaattgaaatgacttaaaagtttagaattaaaaaccaacttttttggcgcacaaaactattatttgagaactattttgatggctcatacttgggttgatttaagggttttattagcaaatgcttgtccaaatcatcaataaacattttttaaatttacattttcttgtcagaatctcagttctttggatgtctcttattgtgtgggcgtcacacaaatcatttttgctgaactcaacaaggcaatggagcgtcgacatggcaaaaatgcgccgtcgcgtcagacacggcaagaagacaaatttcgccttactatttgccgttccggcatccaaggcatggcacaaataaataaataaatttattcgagtattctctcatcatctgatatcgcaataatttaaattttattggtctcttatccgttttttcttattaattcatttttaggaaatgtcccgtcccattcgccatggattcacttggtcgactacccgcccaactcggaaaactcgctgacatcgaacgctgttttcatcactgctcagtgagttcatcttccgtttggagtgctttactaatgaaaaatgagttcaaaagattttagtcttctgaacattccgatgatcgccatttaaatgatagggaaggaagagaag

SEQ ID NO: 59690 - DNA, 974 bp, Heterodera glycines
  Genomic contig location: Contig_ID=SeqID_5922; Location=422..1395; Strand=+
  SCN-specific regions: Sequence locations=1-97,119-447,469-622,707-974
atgctcgactcaaaagttttggacaattacgtggaaattgagaagggccgcttcagcgaaggggggcaaatggtgcagacgcggtacaaggcgaagcacgacagacacacaactgcagtgcgccaacagcagatcattttccagagggaaaaggaacgaaagtgagtaaattcgcatttcttttcgttttgctcaaaacctccccaaattgggaatttaacaaaattagcaagcgaatattcttggagaattgttgggattcattttgttttgttaagagaggagcgaagacaacggcaaatggagcgtaattttgatgcacaaatgtggagaccgtcggaaaaatttggtcaaccatccgccagtggaaagaggttagtcccggaaaaataaacataaacgaagaattgcatttagaacattgaatgctttctgattacgaaatagtttactactttttagaaaaatgaaacgcataaaactaaactcatttaacttttttttagtttttccaattactacgagtcgcaacagcagcagaaccatcgattctatgctcagcaaagggagcattcgccagcgatggaaatgaacggcgcattggacagcaattggtacacaaatgaagacgacgacaacaacagaaacaacaacagcgacggcatcgacaacgtcgacgaccgcgaggaggtcagtgacagcgacggtgcaagtgccaaattggcggcggattacagcaacttcttcggggccagtaaatggccaagtaatttgtacaacaacacccattgtcaggcaaaacctacagcaaaggagcagcaaaaacagcacaaatcaccgccaaaaaaggttggcggggtgtcggagtggagttcgggttcgggagacgaacagcaacagccgagcgaggaggaagagaagccaaagccagcacaggagcagaaattgacaaagcaccaattcgtcgggatcag

SEQ ID NO: 59691 - DNA, 396 bp, Heterodera glycines
  misc_feature (9)..(9): n is a, c, g, or t
  Genomic contig location: Contig_ID=SeqID_29142; Location=9..404; Strand=+
  SCN-specific regions: Sequence locations=1-68,104-363,385-396
atggtttgntcggcaatttcgacttccaaaagcggctcaaattcgcaatcagagtcattccgtacgggtttggaagaagaggaggaggaaagggcaaacggaatggaagaagttgttaacgaaacgcctcacttggacatgatggagacgagtgggacagggacggaagttgagaacgcgtcgaattccaaagggaagatcgaacagaggaagtcggccatcgcaccaatctgctcaatcactttgcgtcaacgatcgtccgcaatgaaatttgcaccctccgaaatgaagcggactcacagtgggcactatcacataaaagctgggaaaaaacaagagatcgacctgggaaacctgggtttcatggataatattttgacttgttatttcgagtga

SEQ ID NO: 59692 - DNA, 467 bp, Heterodera glycines
  Genomic contig location: Contig_ID=SeqID_29143; Location=72..538; Strand=+
  SCN-specific regions: Sequence locations=1-296,318-467
atgccaattgaaccatttgaattggagaacaaagtgacaaatgaaaagctgacactgaaactgagcgaagaatccatcgaattagaatataattggctgttaaaacgatgcccaattggggagacggcgccagttaggtgggaaaattgcgaaaattcggatgccaatttgaactaaattacagatttgatccgcggtatggcaataatgcgtgtgccaatttgaacattgtccgatttgatttgggtggaaatcattggattgggtgagccaacaaaagcaattttcaattgtcgaaaaatgaaaataattttaggccattgtcgccgccagcagtggtagaagaagaattggattaaagcaatgaaaatcttatttgagaaataatcgacgctctcaccaattggaaactgatttgatggtctacaatttttctccgaaattcttttgttgattctttcgttcga

SEQ ID NO: 59693 - DNA, 208 bp, Heterodera glycines
  Genomic contig location: Contig_ID=SeqID_29144; Location=1244..1451; Strand=-
  SCN-specific regions: Sequence locations=1-181,203-208
aggttggcttgggaacacgaaatttacaacatcggacgtattcacgccgttaccatttcccacttcagcacacattccaaccctttcaggtaaagttggtttagtctgtcttctgttaaaacttcccattcccatctttcagaaattcgttgatggacattccgacttcgttagatttctccatggtagagaacaatgccaaattaat

SEQ ID NO: 59694 - DNA, 582 bp, Heterodera glycines
  Genomic contig location: Contig_ID=SeqID_29149; Location=101..682; Strand=-
  SCN-specific regions: Sequence locations=1-361,385-386,408-513,538-582
atgcctttctatctctggattaaatgccttttatcccctgttaacgattgcgttgattggcataatgccaagtgagtgtgattgaataagcttctgagcagatatcagcacccggcaccggcaaggcactagagaagctgcccaattaaatttgcttgctttccccaatgcttaagcattccttttcactagcatttacaaatttcgaaatcaaagtaaggcatttgtatttatcaagatgagaatggcattcatcccactggatcatgcatgggaagtgccaacgatgccaacatcaaaagtggagggcatcgtaaaaaaatatggggagggcatatgtatgtgtgccagcaggtcgtcaaatgattcattattaattagttttaatgaagaaggtgaaggaatttttaatactaaaataatcgcttctaaaaagcacaaaaactgaacatttgttttttacttttactttcaatcttaattgttttttatgcttttcagccaattagtgtcaattttttatttttttattaaaaagaagtcgataatttgaaatgtgtttttctgatctaaactaataaa

SEQ ID NO: 59695 - DNA, 388 bp, Heterodera glycines
  Genomic contig location: Contig_ID=SeqID_29149; Location=1064..1451; Strand=-
  SCN-specific regions: Sequence locations=1-149,183-258,281-388
atgccttcaacacttccgacattggttaagcctcctaacactgaggacatcgcaagacagcgcacacatgcttttacgcatttgtggccaagaccttcttctccagctgttgaaggtaagtcaagcatcagtaaattttattttgtcgcatattaattattttttaaaaaaattgaaaatttctaggcaatttagataaatatttcgaattggattagttttttatcacgtggctttcgatagcggaatttcgaagcttcaaaaaattttggaaactgagatcagctaacactccaaaatttctgaaattataattcctatgcccaaaaatgagggaatctggaacctaattttgaggcataaaatttataaatcaggatttattaaa

SEQ ID NO: 59696 - DNA, 714 bp, Heterodera glycines
  Genomic contig location: Contig_ID=SeqID_29151; Location=363..1076; Strand=-
  SCN-specific regions: Sequence locations=1-84,106-204,226-282,330 -658,680-685,708-714
atgagcgactcgtggggagggcgcagttattcagacgaaggtgagggaggagcagcagcaactgcacctctctgctgttggcattctgatttggctttcccctgtttaggcacaacaaactccacttcgtacactgagccctccgcggatgaggtggaagttggcttcacgttggtccaacagtgtgcgatgcgcgggtcggacgaggagttcaccagcagcagcagcacttcgtccggttcctacacttcgggcacttatacttcatcctcgtcaatcgacgaggacgaagaagaggaggaggaagatgaggaggtggaggaggaagaagtctcaggcgatgaacacggcagcagaccctcttctcgcgcagtttcgccctctcatcggagtcggtccgtttcatcgacttcttcgtccggagaaagtgccgaaagtatgtgtagcgaagaagagcagcagaagccggcggaagagacggagctgaaagccatcgtggaggatgaggaaaagcccgttgcgacggaagagacttctcccattgcaaagaaaagtccttctccaatgtttgtccaaatggcggaagagtcagaacaaatgttggaaggacacgcgacggtcgaagaattggacggagaagagatgaacatggaagaattggaacagatcgaagaggagcaaagcattgatgggagcaaagaggtggctaattag

SEQ ID NO: 59697 - DNA, 500 bp, Heterodera glycines
  Genomic contig location: Contig_ID=SeqID_29151; Location=212..711; Strand=+
  SCN-specific regions: Sequence locations=1-158,181-186,208-500
caaaatctgtgcgcggtttgctctgtcctgtcagcggacgtgtcgcttcttccgttcggccatccctgagttcttgcacccgaacataagtctcctctcggcaaatctgtaaacattcgtaaatgcattgttaattaccctctaatagtagctaattagccacctctttgctcccatcaatgctttgctcctcttcgatctgttccaattcttccatgttcatctcttctccgtccaattcttcgaccgtcgcgtgtccttccaacatttgttctgactcttccgccatttggacaaacattggagaaggacttttctttgcaatgggagaagtctcttccgtcgcaacgggcttttcctcatcctccacgatggctttcagctccgtctcttccgccggcttctgctgctcttcttcgctacacatactttcggcactttctccggacgaagaagtcgatgaaacggaccgactccgatgagagggcgaaactgcgcga

SEQ ID NO: 59698 - DNA, 2824 bp, Heterodera glycines
  Genomic contig location: Contig_ID=SeqID_5924; Location=1294..4117; Strand=+
  SCN-specific regions: Sequence locations=1-63,85-168,191-482,506 -669,691-842,877-1040,1062-1215,1247-1483,1505-1647,1669-1698,1742 -2172,2195-2219,2242-2291,2313-2428,2451-2824
  Gene Ontology: Cellular component=extracellular space
atgttgaaagaagcaaaggccaaagtaccaaatccaaacttgatcatttggacaggcgactcactgccacacgacaaatacgacgaaaagggtgctaattaattaatagcccagttattaaataattcgataaatacgacgaaaaaagtgctaattaattaatagcccaattattaaataattatttaatcatgttttcttaattcgtccattgtttagtgttatttgacatattgcaaaaggtgaccaatgcgataagtgcccaattccccgacgccgttcttctgcccgtgctgggcaaccacgactcggcacctggcaattcgttcactgaccatccggcaaaacagcaaatttacgagaaaatgttcataatatggaagcaatggattggccaagagggaaaggtgggaaaaatttgtagaacataaaaggtaactcgcccggtgggcctcgaacccacgaccccagcgatccgtgccgtgctctaaccaactgagctacgggcattccttttagaggttcttttaggtcttttatcccactttctctcacactccttttccttctgacatcatgaattttttctggagtaattcgaaaaccaaaccatttaggagagttttacgcgtggcggatattaccgcgtcgaaacatccgccggactgtttttggtgctgaacacaaacatttactacgaatcgaatccgctgaggaaggagcttgtggagccggaagacccaactggccaattcgactttctgcaatttgagctggaaaaggcccgccaaaagggggtgccggtgcacatccttggccacgtgccgccgggcggtgccgccaattaaaaacaaatttaaaaagcaaattttattttcattttagcatttgaagaatattcggtgaacaaactcgaaatggagcaaatcccgcaaaaatacaatcaaaaattggtcgatttgcttgttgaatacgcgccacaaattggatggatatttttcggccattaccataccgacacttttcgagtgattaaggtgaaaatggcaaaacaacaacaaataaaaaaaatccattgtaattaaggatggcatttttagattttagcctatttttcctgagctcccagtgacatgaaacacacgaaaaacaagtttttgggaggttgttaagctacttttcgagttatttgagcctattttctttcttgataagaatttttgattttaaaaattatttatataatgatttggattaattttttaaacttttttgaatagtttttgttattttacacaccataaatttgagggtttttagtgcctatttttggtgttttttagagcctaaagcctacttattttggctgtttttagagcctaagatatcattcatatttataagaaataattggtggaaaagctttatagcgaaaggtttttttctgtcggaaaagtaaaattttaaattcagagcaatagcgcttaaaagagaaaagaattaaactatttaaaaagattattaattaagaattccgacggaaaagcggtgcagcgatttttcacagcgccggcacttacgccggcatttcagaagaataacccggcatttcgtgtggccgactacaacactgacacatgggaattggaagacatgaagtgggaaatgaaagagggggggggggggtaattagtgaaattaatgagttgtaaatttaaaccatttaaatgcacttttaattgttcattatttatttgaagaacgtattacgtcgagttggacgaactgaacaaaaatggggcggacggaacgcgcgcgaaattggaatattcgatgcgcgacgcattcggcggattggacgcgcaaacattggacgcgcacattcaaaaggcgaaacggaacggcacagtgttcgacgcattgatacggcacaaccacgtgatgtacgaggcgaacaacaattggcgactgaacgccacgcaacggtaaaataatggaaaatatatatattaaagaaaagctggaaactatttactcatcgacaaccccacaggcacaataagcgaaaaagaaaccaataattgggagaaaagggagcaaattaggggggggggggggggagggggagcgctaataggggtaagtaatgttttatttgagggtatttataccattaataatattattaatttttgggggctttctgagccatttttttaattttcagatcagatatattctaatcgcttctttcaaaaattaccgtttcttgcaatgttttttcaaagaataagattttaaaaattatgggattacgcatattttgggcacccgaataccgtatttccataattgaaacaatctccgtaattatggatacttaaacgaattttcatgtaactgcttaaagccttcaaatctcaataattaaattttgagaaaatatttttcgattgaatgattattcagtgctgttcacctttgtgccttggaatttgttgactacaaaatgtttgagcagtgtttggccaacgacgccaacaccaatgaccaagtataatttcgactatttaatgcccatttgagggcttgtgaactttttattgctgtgaatttctttaaatttatgccaaaaatttcagattcccgcggcaattccgttggccatcggcggtttcgctgtcccatttttggtcacattgtcttcaattctaaccttacttttgccattttgacttggtttctgatcggctattcctttttaaatattattgtttaatgagattaatttcactaattgctcaaataagaaattaggacaaaa

SEQ ID NO: 59699 - DNA, 645 bp, Heterodera glycines
  misc_feature (634)..(634): n is a, c, g, or t
  Genomic contig location: Contig_ID=SeqID_29156; Location=695..1339; Strand=+
  SCN-specific regions: Sequence locations=1-146,168-168,201-525,548-645
atgaacagacggtaaggaattttaattaccgcatttactcgattagaacccccctctcgaatagaacccccccctctcgaataaggctccctttatgaggggggttgaacaatagaggccccgggggctctaatcgagtaaatacgtaaatatatatatatatttttcattttcccaattttttcccccacaatttcagttggatttgcaacgacgtgtggatggacattctgccatcttttgaccgtgttcaacttggcctcaaaattgcattgctttcgccacgttttgatgcgctggtggacaaacattttgatggcaaaatgacggaattgacaatttggagagcaatcgaatttgcaaggacaatggacaaaaaccaatgttattagtcgactgggagtctgtggcatttcaactgccggaccgtccgctgcccaacaaaattcgcttttgtttccttcacattgcgtaattttaacacatttgggtacttccgtgttttgctacgccctcccctctcgaaacattttaaaatacatattttggtgggttttcaaagtcactgatcatgcatatggtgtgcctgtttcgacatttgatcacaacatcatattcgtgatcagtgactttngaaacataaaa

SEQ ID NO: 59700 - DNA, 1063 bp, Heterodera glycines
  Genomic contig location: Contig_ID=SeqID_29157; Location=180..1242; Strand=-
  SCN-specific regions: Sequence locations=1-427,449-1063
catttcaatcactgggactcaattctcttgcattccaatcactgggacctaacctcacctggtccttcggcattccaatcactgggactcaattctcctgcatttcaatcactgggactcaaccctccagcatttcaatcactgggactcaattctcttgcatttcaatcactgggactcaacacaccagcatttcaatcaccgggactcaattctccaggacttcaatcactgggactcagtttttatgcatttcaatcacagggactcaagacaccagcatttcaatcaccgggactcaattctccaggacttcaatcactgggactctattctcctgcgtttcaatcacccggactcagtttttatgcatttcaatcacagggactcaagacaccagcattccaatcaccgggactcattctcctgcatttcaatcactggtcaattctcttgcattccaatcactgggacctaacctcacctggtccttcggcatcgcaatcatcgagactcaattctgcgaaattccaatcaccggaactcaattctgcgacattccaatcactgggactcaattctccatcattccaattcccgggactcaatcccaccagcattccagtcactgggactctgttctcctgcattccaatcaccgggactcagctctccaacattccagtcactgggactcaattctccagcattccaatcaccgggactcaactcaccatcattccaatcgctgggaccgaacctcacctgattcttcggtatcgcaaccaccgagactcaattcccctgcattccaatcactgggactcaattctcttgcatttcaatcacagggactcaaatctccaggacttcaatcactgggactctattctcctgcgtttcaatcacccggactcagtttttatgcattccaatcaccgtgactcattctcctgcatttcaatcacagggactcaaatctccaggacttcaatcactgggactctattctcctgcgtttcaatcacccggactcagtttttatgcattccaatcaccgtga

SEQ ID NO: 59701 - DNA, 1368 bp, Heterodera glycines
  Genomic contig location: Contig_ID=SeqID_29158; Location=177..1544; Strand=-
  SCN-specific regions: Sequence locations=1-564,591-726,761-828,850 -1002,1027-1326,1348-1368
atgctgagacacaaacttgcggccaaactgaggtgtaccgctggatctttgactatccagtcctgtgtatcggtaaagtctcaacaaaagtcattttttgaattgaaatatcttttatttgtttttgcatgtcagcagactgtacagacagacagcgataggaaagcgatacagtgaagacagacaccaacacaacgcctccgggaaagaaaatgactggccactgccaacaaattccataatggctgaaccgctactcccattatcaatttttggcacaacttgggcggattaatttgaattcataaaaatgccggacacaaaagttaccactgaggggaagacagaaacattctgactctccatatcatttaaataatccattacttttgtgttgggaacgcttttttttgcgtttccgatgtttgattagtctcatcagagtcctcttaaggggattaagaaggatgtgtgaattcgaacccaaccaattattccaatttattacccgaatgacctctttctcaaaacggactttaatggacacgccttgcgattatcatttttcaattattattttctatatttttggtctctgctctgactctatataaagagaaaggagcaatggaaatggacgacagtctctctacagtgaaagtggaaccaattaaattggaggaagcattatctctcggtcagaatatatatggcttttcggttctcttttttaattaaaattaacaataataaaaaatatgttttaagaagcccaaaacagtacttggggtgttttcgaggtgttgaccttgaatatgatatttctgcttctgtaattattaatgttaaaaagcttaaaaaatattgtgcaaaaaaaaaaacaaaatcaattatttgcagggtgggggaattgaacttgaagaaaaaatgaacggaaaggaaagaccactaggcccagagacgctcacatcggctttgcattctttgtaaatgatattctatagcaaaaaggaaacaaaaaagaattgaaaacttttttaatctagaggagttgcagttaaatacagatcttccgagattagaagatacaagtagagctatctctgagataacgatgaaagatataacttttaaatatacagatcagaaagattatcttttcgccaaaagaacagatgttttttcgtggaagtcccacggtcacttgggtacctcttctttgttagggaaaaatatagttaaatcaatttgatcagctcggtgccataatctacgcgtaatttcaaaataattaattgcgggcaactctaattgttggccaacttttattaaattagagaataagtgaaaagccattgacaaaataaa

SEQ ID NO: 59702 - DNA, 1223 bp, Heterodera glycines
  Genomic contig location: Contig_ID=SeqID_29159; Location=49..1271; Strand=-
  SCN-specific regions: Sequence locations=1-551,573-656,678-831,869 -977,999-1091,1115-1124,1147-1223
atgctcatcgttatccatcatatttacgcattcgttatgccaaagcgatcaaacgccggaattgtcgcatggatcaaccggagttggaggtaaaggaagtgttatccaatttcaagaaaaaataaatgaaatttttgaaaaaattttcagcaatttttcgaattttatcggtaggggtcaactccgtctggccaactccgtctcagcaatgttcaaaaagctataacttttttctttgttggccaaacttcacaatcatggtatcattcgaaagacctagatgtttagaagatatttataagctatttctcagtgattaatcagctctcaaaaaagttgtcagttgaaaaccgcaaaaaaggcagaattttcaaagcttttatttctatctttttttatagttcgaaattttctgtaatttttagtaggccaatagagcctgtgaagagctttcgaatgatatcaagattgtttgattcggtcaataacttcaagagttatattgactcaaagttggctcagacggagttggccagacggagttggcccgttccgaattttatggagaatttgtatgtttttcaaaaattttccaaaaaaatcgctgcaaaacttaaagattccgataattttagtctttttcatatagagacaagaaattttttgggcttcgaaatatacttccgatatttaaggataccccgacatttgaatataacaccgtatttgagtacaattctgacatttgagtataactccacctttctttttttcggtgtaattttttttattattgattatttttgggttcaattcggctgcccatttatgtaattaattagttattacatataaataaataaaaattcgtaacaaaccactatttagattcattcaagtcgggagaggatttagtggacgcagcatcggacttggtcaatgaggcaaatgaaggggtaattagcgacgatttggccattgatgggatgaaaaaagcatcggttggcgttatgtgcaatgatgccatatttgaattaaaaatggaccattttggaaaattgcgcaatgatttgtgtaaacaattgaaaagtgatggccaaaattttgaagttttcttggcaaatattctgaatattttcacaaatgttctaccagctgttttgagcaatgctataaatgaaattgagaaaaaggcattgctcaatgaacaaaatgtgcaaaat

SEQ ID NO: 59703 - DNA, 938 bp, Heterodera glycines
  Genomic contig location: Contig_ID=SeqID_29161; Location=307..1244; Strand=+
  SCN-specific regions: Sequence locations=1-137,160-245,268-375,405 -723,745-849,871-938
ctgtaaaaggtggaatcagagtctcaggataccatcaggttttttatcaaggtcatttaattgaaaacattgtaacaagctttaagtttgtgagtcaagttgacctaatgaattccgaaaatttgcagaacaaattctttttatgaacccgaaatattttgtggtttaaattacaaaagaggaaaaggtttatcagcattagttttaggaccgggaaagtggtaattaccggtgccaaaaacggcggaaataaatgaaatgtttcatcatattctcctctatttgaaaatgtctaaaaagaagtacaatccgttccaaaattttgtgttcaatttttttttatcattaagaagttcacaaaaaaattggaaagtgtaaaataaaaaatttttttatgaatttttccccaaaattaccctaaatttgctgttccaaaattatgagttcaataattgaaggcatgtaactttttttatagagcaccaaaaatctgaaaaaattcatttcagtacaactttttatgctgatcataaaggtccattgcaccacagtgatcagatcactctcatgtctctatgagttctctacattgcgaaacataggtcgaaaagtaatccaagggaaagtggcgtaaaatttgtcattttttggatagtcgaattttaggcttacctccctcggtgaagacgaatcgtcgagccaggtattttcaaatcaaaatggttgtagaatgtctgttcatgatattcatgttaattggatgctgttttactattcaagaaaattgttagagaaggtcaaagtcccctgagggatagaaattctgatcactgtggtgcaatggacttttttatgagcataaaaagttatactgaaattaattttttcagattttttttgtgctcgataaaaaagttaaatgtcttcagtacaattaa

SEQ ID NO: 59704 - DNA, 3422 bp, Heterodera glycines
  Genomic contig location: Contig_ID=SeqID_5927; Location=346..3767; Strand=-
  SCN-specific regions: Sequence locations=1-1,23-431,454-465,487 -493,539-556,579-871,894-901,976-1009,1031-1063,1132-1222,1263 -1652,1675-1694,1765-1909,1951-2373,2628-2861,2895-3130,3211 -3228,3250-3422
atgctgcccgacgagtgcctgcgacacgcgtggattcgcaagaatcgcgagcgagcactggcggcgagtcgcaccgcgagtccggcagtttgccacccgctggcggtggacaaattccgcaaatacgtgaagaacaaacggttccgtcgccttgtgttcggcgtactgttcatcaaccaggtgggtgttgtggtttggcatatactacggtaatgatggaaaaggaggggatacggtagtgggaaagtgtgtgcgtgtgatacagtaatgggaaatgtaagacagtagcgggggaaacttggcgatacggtagtgggaaaatgatacggtaaaggaaaaggatactataatgttaactgttgattaaaagaaatttttggagtttttttattttcaatttatttggtttatatcaattaaaaaaattttaggttttgtttttgtaaattatttcataattaaaacgtgaaaagaacataaaatgccacataaatatctaattaggcatagaaaaggttttttatctttttaaaaattgatattaggagcacatttcaataaaaattttttttttttttgaattttgataggaactttcatatttttcatatatcaaaaagtgcgaactataccgtaatatgtagaaaaatccattaaatatgtaaaaattgtgtaaataaaagtctcaactttgtgcacaattcaaaaatttttcttactatttaaaacatggagaatccaagaaaaaaatatgcatgaaatttttatccctactaataaaaaataaggatggaatgtatcgcgcaatccgtggctcagtgggataaatgttggtcaatgatgaataaaaactctgatttggttgatacacttatgagaaaaataaaagaatctgaggcccttttttaaatttaaatttttcatttaattaaattttctaaatttatttttgaacatttttcaaaaaaaaaattacaaagtatagataaattcaaattttagctgggctcaaaaactgattttatatcgacaaatttaatttttttttgttagaaattcctccaattaaaaaaaaaataaatttaaaaatcggtaataaaattataatttaaacaaaaaaattaaaataaattaagacgggaaaaatctaaccgagaaaattccgagtgttttctcgttttcgctgtattggaattttttaaatgcaaaaacaaaaaaatgccttaaatttttcaaaaattttaaatacattttggcattttgttttacaggtgatgcgcatgatgcggacaatgcagcggaacaaaagtgtgcacggcgcggagtatgtgcgggtacgcaaaatgtataggaacggtggtcaccaaagggcacgggcaccactcaccgcaatcaatcgctaggatacggtaacacctaagatacggtaacacacaccggtagtgatcagcagagagaccatgcctgggggccaatgaatgggtttgatcgatttctttctgattaaaaccccgaaaaatcaattttgatttcaccaaaaaacctgggaaaattgaaaatcagtgaggggaaaacgaaaatttcatttgatcgggtgggttgttcgattggaaattcggaaaagatagtgccgaacactgaccgttttgccggggttttaccaaaaaacccctgttaatcgactgaaaaaatggataaaaaattatacatttaaaaaaaatttaaaccaaaatttaaaagaaaaaaaagaaaaaacaaataaaactctgaacaaattatcacaaatgacaccgatgaagctgagagactgtgggggctaattaagtcttacaatttcactaattaatgtgattttggcattttgcttacagaatttgctggtggcggcggaacagcaccaaacgaatgccaacaacaacaacaacggcacaacaacaacaacaacaacaatcgaaaatggacatggaaatagcattgatgatagtgatagtgataggattggcacgacaattagcggcggcggtagtgccaacgaaactgctaaagggaaagtgccaaaacaacaacggcgacaagagggccaaaaaatggaggaaatggcgatggacaccagcaacaacgacaatgatcaccaccaccgccagcagaaaaaggtagtgatcgctgtcacgccgcctggcgacagcggtgacggcggcgatgccaaaaaagcgggggagactaccgcagcgagtgccaagaagaaagtggtggtggtgaagcgagtgccacggggcgagaagcggtccaagtcggaggcgcggcgagcagcggatcagcaacggacgcgctcctccacggagcaaactgcaaacaaaaagcaacgccaggagagcggtggcgctggtggtggcgagcagtgccagcagaatcagcgagcggcggtggacagcgattgcagcgtgaagtcgccgttgatggcacggcgactgggccagcgagagactgcagcagcgactggcggtggcaccagtgataacagcagcagcagcagcaagtcaccgctgatggcacggcgatcggtcaagtttgaggaggtgccgacgatggcgacaacgaccgcggcggcgccgaaagcggcgacgacgagcgcaacggggtcgccgattatgaagcgagtgagcggcggagacagcaaggtgctgaggatagctgcgcgactggccgaacaaaatgctggcggcggcgagtgctcgccaagtacttcggcgagcaccaatggcggcggtgccgacaagcgactgtcagcggaagcggcgacaatgacaaagaagaaatcgctgtcgtcgtcaagcaaagtgagcgcattgttgaagaagttggagcagaaaggtgccggtgcagcggcggcggcgagttcggcgacgacgacaccgacgagttcaaggtggtcagcggtttcggcgtcagcgtcgccgttgtcactggcagtgacagcgatcgcaccaaagacggcgacgcttaaaaaggcggaggagagggcgagtgatcatggggagaagcaacaacagcagcagaaagtgatcaaagtggtgaagaagaagaagcgagtgttgagggttcgaactgttgatgatcaacctcagcagcagacgacggagcagcgactgggcgaggcggtggcgacagtgacggcggcgagggcaccatcggcgagtgtggtgacggcgggcgaggaaaagccggggatgaagacgaagcagcagctgcgacggcaggataaagtggcacaaaaagcaataataaatgaggagaagccggtgaagaagcttaatgtgccagggcgatggagcactatggcattggcagcacaaaatgggcacagattagcagcggaggtgaatccaaaggagaagcaacagctgaatgggggagaattaacg

SEQ ID NO: 59705 - DNA, 105 bp, Heterodera glycines
  Genomic contig location: Contig_ID=SeqID_5928; Location=410..514; Strand=-
  SCN-specific regions: Sequence locations=1-105
atgtgcgtgtcgcaaacgtccaaccagatcaagctgatcgacttcgggttggcccagtggtacgacgggtccaaggatttgatgttcatggccggcactcctgag

SEQ ID NO: 59706 - DNA, 660 bp, Heterodera glycines
  Genomic contig location: Contig_ID=SeqID_29164; Location=83..742; Strand=+
  SCN-specific regions: Sequence locations=1-660
aaacaaaaaaatcgattttttcaagtgtccgtttggggtactcaaacaattatggggagcaaaaatccaacgcagaattaaagtacaggctatagggaagctattcccgaaggattcgttctccccataaatctgggcgcatcgtttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggtttggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaac

SEQ ID NO: 59707 - DNA, 641 bp, Heterodera glycines
  Genomic contig location: Contig_ID=SeqID_29165; Location=708..1348; Strand=-
  SCN-specific regions: Sequence locations=1-313,335-641
atgggctttggcgccacaggactgggccgattgcttgcgatggacgcttgtcggctgatctgtgtgctacggcgaggagccaacgacggtggaggcataagatgcgaatccgtcagcgcttgggattcattggcgggaacatccgaagccgcggccgtcgtcgtgtcaacagtcgatggaatggactctgttggcgacgcagccttggcattcttcagcgggcgtccaccaatgatgcctcttggcttcggaactgcacacaacggagcagcattttcgacaccacaaatttgactaaaatacaaatgcaaatactagtgaaagaaatgtatgagtcgtcgcttactcgtaatgcatgtcctgaaggccttgccacggctttgtgcactttgctgggcagctctgcttcggtgcgggcgaatacctaatttgccaaaaggaaaaggggtaaaaatccaaaatgattaaacactaccagcattcgaagtgagtgtaagagtcacagcaaggcaggaacaccttgctctgacgaagcccatttgcctgcagcttgaacagccgctgacacaacatgcaaaagccggggtgttgcgtgccgcaatctgggcatttgccaccgctttctttgagcctataataaa

SEQ ID NO: 59708 - DNA, 651 bp, Heterodera glycines
  Genomic contig location: Contig_ID=SeqID_29166; Location=369..1019; Strand=-
  SCN-specific regions: Sequence locations=90-116,138-241,281-317,343 -353,482-651
aaattaaaaattatttttctttttttaaataataattaattaattagaacattttttaaaatttaataaataaatattatttaattatacggccccccatttctttttcgctttaagtcaaaaattgggaaaattccgttaattgatttgtttattaggccttattgcagcactcttccccttcttcattgatttgtttattttgttcatcttaaggggtcctgtaattaatttggtttagttaaaataattatgcaaaaaaataaataaataaaatattgggctcataaattaaatttagataaaaaaacattcaaagccaaagagttagaaaaaataaatttgcatcaaagtataaaatttcattgaaattttaattgtttgaaatttaaaaaaatatttgttattattttaaataataattaactaattaattaattagaacattttttaaaatttataaataaatattatttaattatacggtcccccatttctttttcgctttaagtcaaaaattgggaaattccgttaattgatttgtttatttgaccccccttcccttcccgccacccgaactcgccatttcccgtatccctcgctgcaacccttcctcgccactctcgctgccgagcaatttctcgccatttt

SEQ ID NO: 59709 - DNA, 114 bp, Heterodera glycines
  Genomic contig location: Contig_ID=SeqID_29167; Location=345..458; Strand=+
  SCN-specific regions: Sequence locations=1-114
atggtcagagcaacaacggccaggacaagggcatcagcagcgcgagcacggaccatcaaaatcaatcgtcgaaatgccaagaaggcgcgtgccgcaattggacgagccggacat

SEQ ID NO: 59710 - DNA, 699 bp, Heterodera glycines
  Genomic contig location: Contig_ID=SeqID_29169; Location=157..855; Strand=-
  SCN-specific regions: Sequence locations=1-7,277-317,589-699
  Gene Ontology: Mol. function=DNA binding; Cellular component=nucleus; Biological process=regulation of transcription, DNA-dependent
gaggatcaagaaagtagaagagaaagtggaagaggaaccgaaagtgtgagaggaacagaaagtggaagagaaagtggaagaggaacagaacgtggaagagaaacagaacgtggaagagaaactgtaagaggaaccgaaagtgtgagaggaacagaaagtggaagagaaagtggaagagaaacagaacgtggaagaggaacagaaagcggaagagaaagtggaagaggaacagaaagtggaagagaaagtggaagaggaacagaacgtggaagagaaacagaacgtggaagagaaagtgtaagaggaaccgaaagtgtgagaggaacagaaagtggaagagaaagtggaagaggaacagaaagtggaagagaaagtggaagaggaacagaacgtggaagaggaacagaaagcggaagagaaagtggaagaggaacagaacgtggaagaggaacagaaagcggaagagaaagtggaagaggaacagaaagcggaagagaaagtggaagaggaacagaaagtggaagagaaagtgtaagaggaacagaaagcggaagagaaagtggaagaggaacagaaagtggaagagaaagtggaagaggaacagaacgtggaagaggaacagaaagcggaagagaaagtggaagaggaacagaacgtggaagaggaacagaaagcggaagagaaagtggaagaggaaca

SEQ ID NO: 59711 - DNA, 547 bp, Heterodera glycines
  Genomic contig location: Contig_ID=SeqID_29170; Location=599..1145; Strand=+
  SCN-specific regions: Sequence locations=1-278,322-547
atgataatattcaaattaatgcaatttggaatagacgcaagctcttacattttttttggagatgagcaaaaagttataaattggagccttgaaaacggcttgttaacaaatgtgcgttactgctatggaaaacggccgacacggcactacaaaaaggaaatgcgttttgacaaaaacagaggcagggccggctcattcatatgcagtacttgtagagcagaaaaagctctttttgttgattccggtttggtcaaaaattttaaggtctttttttgttgtttttaactatattttttatattttatgaataattattatttagtattatgtactcatttgcgcatcaagagaaatacaaaaaatgtatttcccttttgcgaagttcaaatttttttaagggatgattgagaatgacagtgaagactttcgtgtcgttgtgtgtccggacaatgtcagaagtcccgatgctctacttccgatcatccaaaacacgttgcagttggtactgaaatacacattgacatgtggagggcttattctcgattaa

SEQ ID NO: 59712 - DNA, 117 bp, Heterodera glycines
  Genomic contig location: Contig_ID=SeqID_29171; Location=380..496; Strand=-
  SCN-specific regions: Sequence locations=1-55,77-117
aaattagtcaaaatacatgtcagattcgtgattagcgacctttaaaaccccggataaaaaattatcatcgttttttatcttaaaaaaattttgcaaaacaaaagggtcccccctttt

SEQ ID NO: 59713 - DNA, 2736 bp, Heterodera glycines
  Genomic contig location: Contig_ID=SeqID_5930; Location=616..3351; Strand=+
  SCN-specific regions: Sequence locations=1-102,124-202,224-516,538 -1062,1093-1216,1239-1276,1299-1323,1345-1401,1423-1517,1539 -1661,1695-2642,2664-2736
atgaagatcctagtaggtggaaaagctaatgtggctctaggacaggggtgtgaccaaacaatttttaaaataaagaacatcaatgacaaaaaataaggtttagggtcaaaaaagacaatcttgcaaaattggttcgaatcagttaatatataattttttcgataaaaaatgtattaaaatgttatgtttttcacatcctattatggattttaacaatttttggggaagaaattagcaactgctgaaaaaaaaagattttcaaacgttttttttgcagtgtatttttttttacaagttgatgaatgggaagtgggtccggcggcgccgataggcgacgccgggaaaatttttgaaaatttgagtgctattttatagcagattttcaattaaaatcggtaaaaacatgattaaaaaatcggtaaaataaagtgcggtcatgcgggatcgaacattaatgcacagcacaaagcaaacctgctgttttcaccactaaactaaaatacttaaataataaaacttattatttctttccaaaaaagtcattcttaagggtgtaaatattttcgtctttttcgtaaaatattgctctgacgaaaacgaaacgaaaatcctaaattttaaaaaccgaaaacgaaacacgaaacgaaaaataaaattttgaaaaccgaaaacgaaacgaaaaaactttagcggacgaaaacgaaacacgaaaacgaaactcaaaaagtgccgaaactgtaggacgaaacgaaaacgacacgaaatttcgtccagccctgatccccgcccccgcgaaaaggccacccccgcccacggggtccgaaccctacttcaaacaaagtgtggaacactttttaaatcattttaaggtcatttaaagtcagcaacaaaaaaaaaattcatttggcttaaattcccatccctagatatgactgagtttttcctgaaaagtctgtaaaagttggcactttacgaaacgaccaagcaatgcttttatttgtccttgttttattttttttgcaccattttgttttaatttcagaaacaaccggtcctcaatagcaaagctgttgctgctgctgctgttccttttgtgccgccttcgaaccaaaaatcattgccaaatacaccaattgcatcatcaactcagaaatccacaccaatccccacacaagtgtacaaacaaacgaccgctatgcgcttacgaaactcggtgtttattatatattttttattttgtaacgttttaggtttattgttaacatttattccagggctttcgggatcgttgttgttcaattttttttctattcattccgatacgtttttaatagtttaaactagtgcagcgggaccgggacctaaacacggacaactgagtgcctaagtcccggttttgaccgggaccagtcccgtttttccagccaaaaattcccgggtttcaacccgaaaaggtcccccggctttgcccaaaaatttatgaatttgggaaataaaaattttctaacttttttgcatttgaaagcatgtttctgggtggtttttaaggcactgatcatgaatatgacaccagactggttacaaagaaaaaaaattgttttaaaaccggaaaatttttttccgaaagttctacatttcgaaaaatgtgctaaccaacttgaaaaatatattcttaatttaaaataagtcaaaaaatatttgaaaattcataagttccgcctcgattttcgagtttgaagttataaaaaggtgtcgcccaaactgttgagaacatttgtgatttggctcataaagctattgagaagacttgacttctagagatttcttgtacgaaatccaggttcgagtttaaaatttacacgaaaatgaatgtcttttcgtgaaattaaagaaaaatcgtcaaaaaatttttttttgttttttaagcttccaaaaaaatagtttaaaaatttttttcaaaatcttttctcgggacggagagctgatccaggaggaagggaactgatatgggggagaaaacgagatgttcccatggggaatttagcatagttattttttatcgctttatttcttgctcttccagcaggcacctctcaacatcaaagcaattccgttcgtgccgtcaaagaaatatttggtaaatacagcaatcgcgtcgtctacgcaaaagccatcacaacaaaactcgcagccaacaccaacaaacaaacagcagccatcaacaacgacccctcacaagaagaaatcggtgtgcttaattggtttttcaaaaagttgagaccggacgagaacgcgggattccaacgtgaaaagccgcgttttttttgttgccgggacgagatttttacgagaacaggaaaaaagcgggactttcttgtcccacttttttccgatttcccgtaaattttcctaaaacttttagactaagaaaatgaccataaaaaatttgtttaccggactctaccaaaaagcaaatctttggaataatcttcactaatttaactcgaatatcgaattttttttttttagagagagcaaccagcaacaaacaagaaagatgttaaaaaagataccacgaaaaatttggagcaagcgcagaaaacgaccaatgaaatgacaattaccccgaattacaaaaacgggaaggcggaggagaaggcggcggtttgcacaaatttggaggaagtgcaggaaaagacgaatgaattaagcctcaaggataaaagggaaaagaca

SEQ ID NO: 59714 - DNA, 1464 bp, Heterodera glycines
  Genomic contig location: Contig_ID=SeqID_5931; Location=97..1560; Strand=+
  SCN-specific regions: Sequence locations=1-463,498-719,823-846,869 -1028,1051-1464
atgtccgttccttttattgacatgtccggcaaaatgatgaaggatattagagttgtcaggtgggcttttttagattctaatgcactttatgagcacaaacaaattttatgagtccaatcaattaaccataattagtttttatacaacaactttgttcatgttcgaacaacctaaaatatttttggtatattcgaaagcagaaaagactgaattaagtgtaataataataccgcgaaaacaagagaatagttaacatttaagaaagttacaaacgaaaataatcaacaattacttaattaagcatgcctaaacgcgctgacaaagggaggtggccaagtgtccgtgggatttccaaatgaaacttggttggatggatagagcacccatgggttcttaagaaaaatggttttattttctgccaaatgagcacgagtgccgagttatgacgtgccaaagtttttagttttttataattaaagaaaataattaattatttacatatcttcaatgtgttgtttggtgtagaggtaatgtgttagtcaaaatttttattggtcacaagttcgaatcccctttgtgtaaatccattttttaattttaatttttcctttttatgagcacttcaattagcaaattttatttctttatcaaaatctttattttaattttattccattaaaaattgcattaaacataaagatgtaataaaaaacctgtcgaattaaaaaatatatttttgtctaatatttttattgagtattttatgcactaaataatttcaaaaaaattaaaaataaagttttttttaataaaaaatattttgataattgacttggcataatagacaaaaatttaaaaaattaatttacatgtaggtgatccgaaccctaggttaactgatgctgactattgcactaccgctacaccactggacactgtgcggagacacaaataagtatttcttttatttcatcattaaaaagtttggcattttttatctcggcacaggggtccatttggcagaaattgaaaacatttttcttaagaacccaggtgtgctctatctacccaaaaaatctcattccgaaatcccacggacacttggccacctccctttgtaagtgatatcgcaacaataatattcctgattatctattaagatctgtgctaacgtggcctttcatcctcataactttgtgggcgattacttctaccaacaatcccgtaaagagtcggttgacgtgggtcagttggcggaacgcaccacatggattctgcgcatgttggagaccaaccgcgtggtgcacgcacgaccaaaatatatcattgtgttgcgcgacggactgtcagaggcgcaattttccatggtgagtgatgaaatattggtatattatatagttaattttgtcgttttaggccattgatgaggagatgagtgctcttaaaatgggctgcatggaatag

SEQ ID NO: 59715 - DNA, 348 bp, Heterodera glycines
  Genomic contig location: Contig_ID=SeqID_29172; Location=1164..1511; Strand=-
  SCN-specific regions: Sequence locations=1-97,135-348
atggctccggatgtacgtgccctttggcaattactaataaatcaccgcactaattaatacttttgtttttaggcgacaacgaaacggtgcggaacttcacattggacaattttaatttaaatatttccaaaaatcttttgatttcaggtcattatcattgatttcaaaaaggcgacgcggtcggccacgggcaccgattccgcgcagtcggcagaaccgtcgtgttaggatggctgatattttgctgatctaaaaattttcaaaaatgtttgtggagcacaagtctctggaatgcagattttttgcacttttcccttaaattggaatacacacaaaacactcattaaa

SEQ ID NO: 59716 - DNA, 98 bp, Heterodera glycines
  Genomic contig location: Contig_ID=SeqID_29175; Location=61..158; Strand=-
  SCN-specific regions: Sequence locations=1-33,60-98
ttaagcctaaactttttggcctgtttaaaaaggaattaaaaatttttaaaaattttattcatctccctttttgatagaaaaggcatcagagtgcctaa

SEQ ID NO: 59717 - DNA, 795 bp, Heterodera glycines
  misc_feature (31)..(31): n is a, c, g, or t
  Genomic contig location: Contig_ID=SeqID_29176; Location=156..950; Strand=+
  SCN-specific regions: Sequence locations=1-119,141-414,450-795
atgtcattgaaaattataaataaggtgcacncaagtaaaaaaaaaaaagaagtaaaatgcagcaatacaaagcgctatttgctagtccccgaagagatttatcagagtttggcatcaccgccaccgtctgacggaacaccaattgggctggtacgtaacagaattaaacaaatcaaaaacgatgatggcataaatgaggcggaacgggcaatcaaatatgagcaggaacttaagcgtctcaacaagctcacaagggacgaggatgagtgtcccgtcggtgttaaattagaaaatttgagtgacgtggttgacgccatgcccaaatcagtcaacgtcagaagaccaattgttgtcgctacgcgtcgccatctcaaggttgggcgtgcgcgaaaagaaaatgttgaacaactagaagatgatgatgatgctgatgatcatgctgatcatgaccatgaaactccaaagccatcgagttcaaataaacgacaacccacacaaacggaaatcttaaaattaatttataaaaacgcccaatctcttggagtgtctgaggaaggacaggtcttgagagcgggtgggcggccgtttataaccagcagtgtttatgacattgttagtcacctgctgaacaaggacaaacgtgctcaaaacaaagagccaactgcattcaaagaatttgttgaaagggcaagacagatcccgctcttgagtaggcatttatttcccgaaggccaatcgggcaaaggcatttataaaaacaccacactgaaatttaagccatcattatggatttga

SEQ ID NO: 59718 - DNA, 176 bp, Heterodera glycines
  Genomic contig location: Contig_ID=SeqID_29179; Location=318..493; Strand=+
  SCN-specific regions: Sequence locations=1-176
cattggcattggcattgaaagcggagagtggagaatggcattgtgttgtacttccgtgacattagtgtatttccgcactccatttgcggcacgaaaatgctcatattacggcgagggaattacacgaattgcatttttatgaattcattgggcaggaattgacacaaatcggaata

SEQ ID NO: 59719 - DNA, 276 bp, Heterodera glycines
  Genomic contig location: Contig_ID=SeqID_29181; Location=228..503; Strand=-
  SCN-specific regions: Sequence locations=1-276
atgcaagcggaggatgcgccggaagtcgacttggaagtgctcaacggcacttggatgcccgacctgacgcttcgctatccaccgaccttttcaaaacgcgacctcatttttggcattgacggaggccttttgtacaacggaaaacagccattggagtcaatggaacggccaaagtttgaggacatcgaagtcagggaccaggtcagaatcggagggaacagaaggggtgaaggagacgatgctgcacttgcagatgctcggcctgattctgagcga

SEQ ID NO: 59720 - DNA, 423 bp, Heterodera glycines
  Genomic contig location: Contig_ID=SeqID_5932; Location=1280..1702; Strand=-
  SCN-specific regions: Sequence locations=1-348
atgagaagaggtacaaaagtgattaaaagaggtacaatagtgattaaaagaggaagaacagtgattagaagaggtacaactgtaattaaaagaggtacaaaagtgatgagaagaggtacaacagtgatgagaagaggtacaacagtgtgagaagaggtataaaaaggattagaagaggtacaaatgtgatttaaagaggtacaaaagtgataaaagatacaagtgattagaagaggtacaaaagtgatttaaagaggtacaaaagtgataaaagatacaaaagtgattagaagaggtacaaaagtgattagaagaggtacaaaagtgattagaagaggtacaaaatggtttaaaattaaataaataatgaaaagtttttataaaaatcgattgcattttaatttaaaatttttttataataaa

SEQ ID NO: 59721 - DNA, 472 bp, Heterodera glycines
  Genomic contig location: Contig_ID=SeqID_29182; Location=136..607; Strand=-
  SCN-specific regions: Sequence locations=1-472
  Gene Ontology: Cellular component=peroxisome
atggaccactcactggtggcacaacacttggccaagcatttcccggacgtggactgcacggcaccattgataaaggacacgtgcatttacacggtaatagttttttacacttaaatttcatgagcttttcgtttttattttggcgaaatgtccctgtctcttaagactttcactctcttaatgccaatatgatcaacaaactcggtttcagatgactgacgaccttcaattcatcgtcgatcgccacccccgacaccaaaatgtgttcatcgccggcggcttctcgggcaccggtttcaaatttgcgctgactattggcaatgttctggcgcaatgggtcaatggagaggacactccgccacacattgacgtaagctcatttcggttggatcgacgaattgccgacacggacagaccgaagctttgatcgacggaagaaaaacaaaaacggacattttaacaatcaattaaa

SEQ ID NO: 59722 - DNA, 388 bp, Heterodera glycines
  Genomic contig location: Contig_ID=SeqID_29184; Location=502..889; Strand=-
  SCN-specific regions: Sequence locations=1-275,297-388
atgccaaaacaaaacgaaatcgttataaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 59723 - DNA, 578 bp, Heterodera glycines
  Genomic contig location: Contig_ID=SeqID_29188; Location=295..872; Strand=+
  SCN-specific regions: Sequence locations=1-507,530-578
atgtccaatcgggccggacaaaaggaatttgaaaatgagaatgaatgtgaaaatgaaaatggagcgacgaaagatggagaaaatgcagatgtgaaatggtggacaaattggataatgagaaatgaaattgaaaatgatgatttaaataaaaaggagaaaaatgggaagaaaaggagaaaaggccagattggcggggatttcgtcatctctccgatcttctgctccgtccgaccgaccaacgggaatgttcccgatcatcaatggtaccacggcttcttcttcttcgggcccgagactcgtggaggtgcagtaaaccatgcgcctggggtggcccatcggttctcctcctcctcatcgattttacgggcattgtagtgcccgcccgagccccgggtaaaggacaattggcccgatccttcaccccaactctcgtcgcggtttcgcgacaattattgttatggcttttgcgaatggaaatgaaaaaagttctggaatattgcgattctgccttttttcccaatgtcaaaaaactcatattggttttagcaagcattctaataacttctggtaaaagtaaa

SEQ ID NO: 59724 - DNA, 1193 bp, Heterodera glycines
  Genomic contig location: Contig_ID=SeqID_5933; Location=1136..2328; Strand=+
  SCN-specific regions: Sequence locations=1-398,420-541,563-797,819 -870,903-915,937-1085,1107-1193
atggaagagaagcggagacaatttgtggcaattgaagaggaaaaaatgcggcaagaaatgccattgcgagcggaaattatgggtcaagcggagcaggtcggtgccgcactgctgtacacgctgatccacatgaaaatgcgacggatgttcatggataacaaccaaaccccaagcggaagcaacaggtggacttgtgaattttctggctctatttcctttggctttaacttttttctttacctaaattatttatatcaacaaaaaacttaaagcctatagaatatttcgtcgacctaaattctgaactaaatgtaacagacaaaaaaaaaaaattattcttgaatatactcgaaaaaaacgccttttgtgttttctcgttgtaattattttttttattgtcagtatttgctcttttcttacattcgtgagttccagggaatttaagctttcgtttaataccaagaaagtagttattgaccaagtaagaaaaaagttatggccaaagaaactaaactttggacgcctaaaatgcactagagcattttttccccggtccccaaattgatggtcatttttaagactaattaacatttttgtaaaagacgtcaaaatttttaaaataaacttaggaattctatttattaaagggaaatctgtgtatgaactcaaatggtaatagtttagttttcaatttcctatttattgcccaatttccgggaatttttggggccggtgatcaatgatcacgaataaaacactcattcagggctaattctgaaaccgaaattatacaaaacaaaaagcttaaatttctgatttaatctttagtcgttctaaataaaaattctcaattaagccaagctcgtgatgacgacaacaacaacaacaacgaaaagaacaaccagcagcagggcttagctgaccctgcatattttccattttggttgaaaagggtggaagaagcattccgatcacatttcgagaaaggaaaggaacaatttggcatattttgactgaattccctaccgagaatttggagacgtcaaagaatgtgttgccaaatgggaaaacatgatcaaagttgcagcagcagcagaaggaagtgacaatgaaagtgatcagcactcattttctatttgttgaaatgggtgctatgtcgaagcacgaaaagtgcaaagtgatcactgatcaaa

SEQ ID NO: 59725 - DNA, 3357 bp, Heterodera glycines
  Genomic contig location: Contig_ID=SeqID_5935; Location=821..4177; Strand=+
  SCN-specific regions: Sequence locations=1-264,286-431,469-544,566 -679,703-788,810-1239,1261-1282,1359-1536,1575-2185,2209-2227,2249 -2880,2902-2992,3022-3165,3188-3357
cagtttgaggtcggtttctctgcgctaaacagtgtttttttaaagggataaattctgatcaacagttgtccgcttttagggctgatcatcatggaggacctaagcgaccgcgcgtgctgcgtgccgatgctgccggggctaagcgacgcgcaggtgcgcgcggtgatcacggcacttgcgcgcatgcactccaccgcatggacacaccggacggaactgatgagcgaactgtggaaggacggcacagcaagcgaatgttgggcattggagccgctttttgtggactcaatggttgaggcgggcaacgatttggccaaagtaatcaaaatgccctgcggggctgcaaaggaatttttttatgaaatcgaagaaaaaaaaacgaatttcaaaaaaatgacgggaaaaattttacaatgcagggaaaattttcctaattttatcattttaaaaaaaataatacataattttgtggctttttggcacggaattgtgaaaaatccataagaattgcaattttcgataccaatcaaattttttatttctgaaaaattcaataatttctcttcaaaatcgaaagaaaatggtgaaattatcgaaattgaaagattccgactcacgcctgatccaacggccaaatttgatgctgaacagactaatgattgtacggcacaaacgcactaaaattacttttttataaataaatgccattgagaatgggtgccaattatgagatggaccaatcaatataataggtttgatcagcaaatgagcttaaattctgaagaaataagcagataatatattaaaactattctttaacaaaattaaacgaatttatgaatcttgttttcacattaacaaacaaattcaaaaaaatgaatgacaaagttattaattattctttttgtttactcatcgttttccttaattgttgacaaaaattaaatttattgtacaacttcaaattagtcaatgtttcattattcataattttcgatgtcccaatttacagattgaaccaaatgccatcggtcctttgctgtgtcgaattttgccaaagtttcgagtggaaaacctcgcagagagtttttatgatgaagacaaatatggtggctaaaaatcgtaaaatatttaatgaattttccttgttttgagtggcattccctaaatgttaattatttttttgttaatttattttggaaattcattttttcgtcggggggcgtccgtcataagacatcttttttattcaagtatttgaagatgaattcaccaacagaagaaataaaatataataaaaataaataaatttattgaaatttttctttttaaataaatttaatttagaaattataattcaagggtttcctgcttgcattgttcatgccgatttgtgggccccaaacatattgtggaccaaaaatgcggaaggacaagcaaggtggaaaatagtagaaacatttttgcaattcctaaatgttgaaaatattaaagcaaaagaatgattatttcagcgttttttcctatcgaaaaatgattattattaatttttatcaaattcattattaaatttagcgatcaattatgcgcaattatcgattggcaaacggtccattcgggcaacccttgcgaagacattggccgtctgctcgcgctgaacacgacaagtgcataccgtcgtgccaacatcaaccaattgttggcattttatgctaaaaaagtggccgaatttatgggcggaaatgccccatttacattggcacagctgaaaaaggcattcgtcggcgcaatgccatacgtaatgatgtgagattttctctaattgggcgatgtaatatgcaattttcgagactcaaacccgagacagaagagactctcgaacatatcattatttaatttagcatttttggttcttgtcaaattttgtactaattgccgcataattacttatttacctttgttatttctaaacaatttaaatttaaaataggtttttctgttttggaacgacaaattattgcaccatggaatcggtggtgggcaaagaaggcacggcaaagcgagaagaaaaccgtgccgaactgttcgatcgcgtccgttcattcatcgaagacacagaaaatgaattttacgatcaaattcaatgaaaactattaaaaattaattgaataaatagtcctgtgccataatttttatatttttatttttgcaattttatcaacaaatttgtgaaaaatctattattaaatcttaaataaaccaagttataatctatgttcccctatttgggctaatttttgtccggcaatgtctgtcgagcacctcaggatctttaaaattagatccctcagatcaaagtgtcatacatattaatcactcatttgtattgatcatccaaactcatttctgcagtcattacgattcctttttcctttttatcgattccgattaacatttccttcccatttcccttatctcgtgacctcattagtcctttagaaaataattaatgaatttttcaagaaaaaattctcttaatgacaacatcagcactcagtgggattcgaattttggatttctcacgagttgtggccgcaccgtttgcctcaatgattttgagcgacttgggcgccgaagtttggaaaatcgaacgacctggtgaaaaaatgactgacattaataagtctggcgtaattttttccaaatcttcctgtgagatttttccctcctaaatcgaagaaatgcaaaacaacataaattaatattgaaatcaatttatgtttgaaaaacaaaaaaatttgcttataaatctttattaaccaggccagattgatgtttatcctatggcactgaaaattctattattttagacaaaactaaatattcaatttataatttgaaatggattcaaattattcatccggattttcaacaattgctttggtcacattattcccaattctcaataaatactgacaatcaaaaaccttacaaaaaaaattaaaaaataaataatattttcttttatgttcaattattcgcaggtgttggcgatgattctcgcctctttacaccgcccgaaatcaatggccaaagttgttatacgcttggccttaaccggaacaaaaaaagcattgcgatgaatttggctcatccggaggcacaaaatttggtacaaaaatttttcataagacttcaactattaattttttattttaggcgcaaaaattggcaaccaaagcagatattgtgattgaaaatttcaagacgggttacatgaaaaatttttgccttgattaccctcaattagcgcagctgaaccccggcttaatatattgctcaattactggtattttt

SEQ ID NO: 59726 - DNA, 565 bp, Heterodera glycines
  Genomic contig location: Contig_ID=SeqID_5936; Location=455..1019; Strand=+
  SCN-specific regions: Sequence locations=1-281,303-365,387-477,528-565
atggatttgccagaattgtgcaattcatctgactacaaaacaaatgccgaccgtgttcggaatcgtgaaaaacttattggaatattttcaaaaaagtaatgttttataaatttatttcgcattattttatttttcatttctttcaattttaatgctaaattttaatttaattcccccccaccccacagatttcttgaacatgaccttgagcactggaacgtgttgctaaaacattcaaaatttcctgccggcccagtgaacacaattcgtgaggcttttcgtcatgagcaaacgcaacacattggcattgtgaagccgatcactcaccaacagtacggcactgtgaaggtggtcggtaagcgaattgaattgttttatttttagtaaattaatttaaatgctcttgtaaatggttttacagaaaaaccattcccaagagtttattttaagattttggttcggtgatttgtcacggagaaaaattaaaaaatatattggtttaatatagaaaaattgtttaatattttcagaagagggacaattgaaatcatcagaaatttattaa

SEQ ID NO: 59727 - DNA, 104 bp, Heterodera glycines
  Genomic contig location: Contig_ID=SeqID_5936; Location=64..167; Strand=+
  SCN-specific regions: Sequence locations=1-104
gtcccggtcccgaaaaaaaaatcgaggtcccggtcccggcttctcaggtcccggcaagtcccggtcccggttttggcaaaaattcccggtcccgtggcactcta

SEQ ID NO: 59728 - DNA, 49 bp, Heterodera glycines; identical to SEQ ID NO: 51181
  Genomic contig location: Contig_ID=SeqID_29193; Location=780..828; Strand=-
  SCN-specific regions: Sequence locations=1-49

SEQ ID NO: 59729 - DNA, 621 bp, Heterodera glycines
  Genomic contig location: Contig_ID=SeqID_29195; Location=56..676; Strand=+
  SCN-specific regions: Sequence locations=1-132,190-246,272-296,322 -351,374-530,554-582,607-621
atggtaaacaaaaagcagtgagcaaaaaagggaaaaagcagtaaataaacaccctcggggagaagaatggaagggaaaagaaatcgcgtcgaaaaattctttgttttgaacggtgggcggggttaactgccgattaatataatagattatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttgaaaatttgattgtaatttgttaacagattttcaacaaaaaaggttggtttttgggattattaagctcaattggtaggattttcatttaaaaaaatgataaaaatgtatcaattttaaaaaaaactatgaggaatcatattttctttataggaaacccacgagtatacaaaacaaaaaattgaaaataatctaatttctgtagagggattgaaccaggggaaagaagaagggaaagtcaaggagactagccattag

SEQ ID NO: 59730 - DNA, 1239 bp, Heterodera glycines
  Genomic contig location: Contig_ID=SeqID_29196; Location=108..1346; Strand=+
  SCN-specific regions: Sequence locations=1-68,154-241,264-280,302 -647,710-832,854-899,928-936,958-960,1005-1198,1238-1239
atgcgcgacaataaaagtttgaaaaagatgattgattcgattcattggattaaaagtgataatagcactatttttatattatatattccatttaattattttttttataagtttgatgaaaaaactaaaataaaaagaattaaaaaattatatgtaaattgtggaaaaaaaatttcatgagcaaaattcgtttaaataattttttgctaaaattactaattctgcattttctaaatccatgttttgcaataaatagtaaataaggggtctcaactataaaatttttatattcatgtattacaatgatttttttctactaatttttatttgtttacaataaatttccgaaattttttgtccatattttggcattttttgctctcacattttagtgtttttgtccatattttgttcatattgtgattttttcgtccatataattccagtctctaatgataacatataaactgcgatttgcatagttattgtattaactttaacgttaatccattttaacaaagacattaatcccctcacattcacacacttttcgaaaaaaaaaagtttttttttagtgtttttaaagcgaagaacaaatattgtcattttcgcaaatcagtgagcacaaaatgaatcaatgaaaatactttttaattaatcttctttttttcaattttcaatttgttattttatttatttttatattattgtgtgtctttaaacaataaaaccatttaaatgtttaattgcattttgaaaaagcagtttttagtttcgttcgattttttctcatctttttttttgctaaaatgtcaacagacatcagaaattatcactattttaagtaattttttccgttataagcttaaaataaacaaaccttaaatttgtaatattcaaaaatttgtttgtttattcttttttgaaccaatcaaaaaatgctcaaactttaaaaatgacaaaaatttatttttaaatgatattttttagaatttcaaatttttctacgaaatggaaaatcgtcagcagcagagacgaaagagtgaaatgatcaggagaacattgtctgaagattatcccggccttgactatcttggctttcataatgtgctgaatgccaaatatttttggtaccgtgttctttggttttccgtggttaccgtatgcctgctgattggcctttttactatattcaggcattaaaacaaaaataataataataataatatttttaattca

SEQ ID NO: 59731 - DNA, 1162 bp, Heterodera glycines
  Genomic contig location: Contig_ID=SeqID_29197; Location=1..1162; Strand=-
  SCN-specific regions: Sequence locations=1-176,199-1112,1134-1162
ggcataagcgaggaccttaaggcgaagagacacgattggctctataaagaaaggcgtacggtaaaggggatacttgaaaatagaccacagaaggtcgtgattgagaatcatgtacccggtccaaatgttgcaccatatctgggcctcaataaccaatccaaaccacaggagactgaagaaccacggaaaataattattcctaggaaaagacttaaagagcgaactcctgagtgcgatttgtgcatatttgaccagttgaaaaagcataacgacggttacaaatatctgttgctatgcatatccacatgctgagtcgaatgatcttcagtgcaccggccaagtcaaagaagaatgaggacatgattgaggcttttgatcgggtattcgaaaagtcgaaaattatcccgatgaaaatatagcgacagcggactcgagttccaggctggaaaaatgaaaaaatattttgaggaaaaatttatcatcaaaaatgtgatgtatagtcctgaccttcacgccggagtcgttgaaagggcaaatcggacaataaaggagcgcttgtatagatattttacaaagatggacactctacgatgggtcgatgtaatagacagaataataataaacattaacaacagtgtgaataggaaattgggggccaagccagtatccgttacttttgaaaatgcacgggcgctctgggaaaaattatataaggcgaaggaatttaaaatttcgaaaaagaacaaatttaaaattggcgatatcgttcgaattaccaaggaaaaaggaaaatttgcaaaggggtatctcccaaactttaccgaagaattatttaaaatcgttattgttaattcaacgacacccgattcatacaggatcgaagatttggaaggaaatttaataaaaggcatattttataaccaggaattagtcagtagctctctcatcaattatttacccctactcattcaccgctctcggtataaatggtcaagagtttataaaagtatgggaaaatgacagcagtgtccccattcaagtttatttaccggacatgaattttaaaaccgccgggggattgggaaataaaattaacgaagcatttacacatcattacaaaatcaaaaaacaaagtgggaagtgagaagccaaggctgaagat

SEQ ID NO: 59732 - DNA, 660 bp, Heterodera glycines
  Genomic contig location: Contig_ID=SeqID_29199; Location=233..892; Strand=+
  SCN-specific regions: Sequence locations=1-660
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 59733 - DNA, 174 bp, Heterodera glycines
  Genomic contig location: Contig_ID=SeqID_29199; Location=955..1128; Strand=-
  SCN-specific regions: Sequence locations=1-174
tctgcgttggatttttgctccccataattgtttgagtaccccaaacggacacttgaaaaaatttttttttttgttttcggggcagtccccccgaaccgatgcgcccagatttatggggagaccgaatccttcgggaatagcttccctatagcctgtactttaattctgcgttgg

SEQ ID NO: 59734 - DNA, 665 bp, Heterodera glycines
  Genomic contig location: Contig_ID=SeqID_29200; Location=529..1193; Strand=+
  SCN-specific regions: Sequence locations=1-26,53-198,220-551,574-665
atgtcgacgcgtcaagacttggtccgtttatttgtttaaaataaaaataagaattcttataaatttcacaaatttttatgtattttgcctgaggcatatcttttttattcccttttatttttgccgctaatactctcctcccatgagattagataagagccgcatggaattttcttaaatagtacctaaatatttttccaacaattttcccttccaaaaatgtttttggcccccaaaaaactgcccactgaattggtctttgagctgagccgtttcatcaaatttgatttaaaatgggcgaggaaaaaccgagtgtcattttcatttgaccattttttgttggcaaaaaacagctattggctgaaactgatcaaaaaattggttttcctttctttttgcctgatcagcaaccatttatattatcaattttcagataagcgagtgcattttgtcattcgaaaagctgcgcgactatgtcgtgaacgaactgcaccatttgccggcactgcaaaagtcagctgctcgagccacttacggatgtaaatttgaagaatttatttaaatatcacaatttaaataacattcaaaaattcattctaacggtcacggtcacaattcacggggctattcacgggttttcttcgtaattgtcgcatttttataaa

SEQ ID NO: 59735 - DNA, 82 bp, Heterodera glycines
  Genomic contig location: Contig_ID=SeqID_29200; Location=1409..1490; Strand=+
  SCN-specific regions: Sequence locations=1-82
atgatcaaggctaatgaattggtgcgcacttgtgcttttcgtgaggaggcttccatggatatgcttggacactttgatactg

SEQ ID NO: 59736 - DNA, 704 bp, Heterodera glycines
  Genomic contig location: Contig_ID=SeqID_29201; Location=653..1356; Strand=-
  SCN-specific regions: Sequence locations=1-434,456-643,666-704
gctaaagccggtcaaaatgtctgggcaaggctcgggctttaacaatttaacaagaccctgtccgcttggctcaaagaagcccgtttaaccggacgacctgaacccggtagtttcaaaatttagctggcgcgggctcgggtggcccatgaaagtctgtcgagcgccagacccggcccaattatattgtataatcgtaatataatttaatttttcatgaccttttccagcaactattgcctcccctcttttggatgttggccaagttttgcggaccaaaagcaccgaatctttgccctttttgctttgcttggcaaatttggcggttgtcgatttcccctccgtttttaagtgccttagtactccagttcttttccaggtctgtgtccaatggttgttgtacggagttttggtcgacgatttctacatgaaagttcgttgaattttaaaaagtaaaatgtttatcccttcttcctttttacggttcccaacggaatcgggacgttcatctcgaccatgcagttgtctctgttcatcgtttaccccagaacttacaaacaactcacagttggcaatgtttaagtgtgtccgaacgttgccaaagccatggaatgtttcgccgtgtttgaattggctaacaaacaataagcaaaacccagcagagctgtgtgtccgttgtcagtgcattcattacctccgtccatagt

SEQ ID NO: 59737 - DNA, 424 bp, Heterodera glycines
  Genomic contig location: Contig_ID=SeqID_5937; Location=148..571; Strand=+
  SCN-specific regions: Sequence locations=1-424
atgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgccacgacgacgactcgtatgaacaaaaaatgcaacgacgactcgtatga

SEQ ID NO: 59738 - DNA, 77 bp, Heterodera glycines
  Genomic contig location: Contig_ID=SeqID_5937; Location=1363..1439; Strand=-
  SCN-specific regions: Sequence locations=1-77
ttttttcctgagatccccgtggcctgaaacgcacgaaaaacatgtttttttgggctgttgttaagctacttttcgag

SEQ ID NO: 59739 - DNA, 1139 bp, Heterodera glycines
  Genomic contig location: Contig_ID=SeqID_5938; Location=625..1763; Strand=+
  SCN-specific regions: Sequence locations=166-215,237-243,266-476,529 -529,588-702,726-1080,1102-1139
  Gene Ontology: Cellular component=mitochondrion
atggccgacgcgggccaactcgtggcactgacgggcgacggcggagtggacaaaacagcgcttttgaacacgttgctggaccacaacctgaagactttgagcgtggagggtcaagtgctgatcaacgcgcactccttgggccggttcatcacttacgtcatcggggtgagtcggaaaactgctaatcttctgttaaatgtcaaattttgaattctaaaacaaataaatggtaaacagaattacaaaaatgtacaatttttcctttgaaaacttgggtttcaagcgtactttaccaattaagttttgcaattctgcgcgccgttagttttaaattcaaaacttgaccgcataatgtaaagtgccggaatggcaaatccaaacatcgacgatatgtcggttgagaccgttaattgaaacgggattagtggttattaaactatagtgtgttttcccgttctcaatttcagtacgtgcagcaggacgacttgttcatgggcacgccaacggtgaaggagcatctgatggcgcaggcacagctttggatggtcggacacacccaacggacgatgcgtagacgcgtcaatgaggtgggattttggatgagtacaaaatggaaatcactaattttctaatggattaatttggctgctaaagtgtcgtcgtgcggtcattggaattagcaaacgagttttttaagaatgaatttctcattttcagttggaagaagccatttcggatggtgaggcgcgtcgtttgccgttcgccttcgaaccgcggcacaacccgcaaatcatttttgccctcaaaccgactaaggttccaatttttttttgaattatccaaaattcctgattaggacctcgactcgtcagtggtggacagtgtggtctcgcacattctgcgtaccctgaatttgttcggccggcgaatcgtcgtcacaattcaccgtccgtcagaaggaatgtgccagaaatttgagcgggtaaaatttgaccgattttccataaattcagttgggatgagtgccacccccaccctaaatcaccaaaatttacgcatttgtttttatttgtctgttgataaattatatttactattaaacgttactttttgaagttgccatctgaatgtacctttta

SEQ ID NO: 59740 - DNA, 1181 bp, Heterodera glycines
  misc_feature (765)..(765): n is a, c, g, or t
  misc_feature (791)..(791): n is a, c, g, or t
  Genomic contig location: Contig_ID=SeqID_5939; Location=970..2150; Strand=-
  SCN-specific regions: Sequence locations=1-670,696-1181
  Gene Ontology: Mol. function=chaperone activity; Cellular component =actin filament; Biological process=protein folding
atggaacggctgcagttggcctgcggcggcgaggcggtcaattcggtggacgacctgacgcccgatgtgctcggatgggcgggcagtgtttatgagcatgtgctggtcagttaagggggagcagtgccgttatttcttgggcggggacagttttccattggtgtactgtatgtaacacatggttaccgtccgcttcagggcgaggacaaatacacttttgtggaggagtgcaaaagtcccaagtcggtcactttgctgctcaaagggcccaacaggcacagcatcacgcagctgaaggacgccatttacgacggacagcgggcggttgccaatgcgttgaaagacggtgggttttgcgacgaggggatgggacaatttggatgaaaatgactaattacctaggcaattaatgccttggcactttgggttatttgattttgcacctcttttcccagttttgggctttacttatgactgtcatttggtcgtcacatatttaattttcatggtttctttaggtgccgttttgcccggcgccggtgcatttgaaattgcgggatattgtgcactgaaaaaggtagcaagcagagtccttccagacttcacgaatatatctattttagcttgccgacaatgtgaaagggcgtgccaaactcggtgttttggtgccgtaattctttctttctttcttaatccctttcaattattgtcatcattctcattcccaggcttttgctgaggctttgctagtcattccgaaaactntggcggtcaatgccggattcgacgcncaggaggtgagtgaaaagcagtcaaaaatgtatgtataactcttttcaattgccaggccattgtcaagctggtggagacgttcagtgctgctggtgagctggtcggattggacttggagagcggagagccgtgtgtttctcaggtgtgtccccagaaatggacggggacaaatgggtcgggccataaaaagtgaacactttcattgattcccttcccccgtttagagcgtttgggacaatgtgtgcgtgaagcaggcgagtctgaacgcctgtcagaacatcgcctccaatctgctggaggtggacgaggtgatgcgtgccggcatgcgcgacttgaaggggggacagtgaaaatgaacggaacggaaatgaaggagcaacaccaataaa

SEQ ID NO: 59741 - DNA, 877 bp, Heterodera glycines
  Genomic contig location: Contig_ID=SeqID_29206; Location=262..1138; Strand=+
  SCN-specific regions: Sequence locations=1-83,105-266,288-402,424 -444,466-579,601-621,643-877
  Gene Ontology: Mol. function=single-stranded RNA binding; Cellular component=transcription factor TFIID complex; Biological process =post-embryonic development
ccaaggggaatggcacgggaacagaggagggttaaatgggggacaaccaatggggaatggcacgggaacagaggagggttaaatgggggacaaggggaatggcacgggagcagaggagggttaaatgggggacaaccaatggggaatggcacgggagcagaggagggttaaatgggggacaaccaatggggaatggcacgggaacagaggagggttaaatgggggacaaccaatggggaatggcacgggagcagaggagggttaaatgggggacaaggggaatggcacgggagcagaggagggttaaatgggggacaaccaatggggaatggcacgggaacagaggagggttaaatgggggacaaccaatggggaatggcacgggaacagaggagggttaaatgggggacaaggggaatggcacgggagcagaggagggttaaatgggggacaaggggaatggcacgggagcagaggagggttaaatgggggacaaccatggggaatggcacgggaacagaggagggttaaatgggggacaaccaatggggaatggcacgggaacagaggagggttaaatgggggacaaggggaatggcacgggagcagaggagggttaaatgggggacaaggggaatggcacgggaacagaggagggttaaatgggggacaaccaatggggaatggcacgggaacagaggagggttaaatgggggacaaccaatgaggaatggcacgggagcagaggagggttaaatgggggacaaccaatggggaatggcacgggaacagaggagggttaaatgggggacaaccaatgcggaatggcacgggaacagaggagggttaaatgggggacaccaatggggaatggcac

SEQ ID NO: 59742 - DNA, 98 bp, Heterodera glycines
  Genomic contig location: Contig_ID=SeqID_29208; Location=602..699; Strand=-
  SCN-specific regions: Sequence locations=1-98
cctacgggtaatttacccctcactttcctttccgtcactccacagatattttgttatttaattattataattgtccatttttaaacactgagtttccc

SEQ ID NO: 59743 - DNA, 1308 bp, Heterodera glycines
  Genomic contig location: Contig_ID=SeqID_5940; Location=359..1666; Strand=-
  SCN-specific regions: Sequence locations=1-1257,1291-1308
atggccaattacgattttgagatacggtacatcaacaccgcatcgtttggccaggctgatgttctctcacgcctcatcgcaaattatccccgaccagaggaggatattttgattgccaacatctgcaccgaaaccgagtgctacaacagcaccattctgcaaaccaaaacggaacaacttcccgtcactgcagacgaaatcgcagaggcgacaccaaaagatgagattttggcaaaaattttggcattcacccaatcgaattggccaaagaaatgcagcgacccggacatcgcaccgtattttccaaaaagggacattttggaaatcgagggctgtttgctctaccaaaatcgcgttgtcgtcccgcaatcgcttcgcaaccgaatgctgaagtccctgcacatggcacaccccggaattgtgcgcatgaaagcactcgcccgccaacacgtatattggcccggcatggattcggaaattgaacggattgtccgtcagtgtgaaaaatgccaaaaggcgcaaaaagcaccgatcaaggctcacggagtaaattcacggtcaaggtcacgaaaaccgtgaatttcacgggtttttagatagtggttacggtcacgattcacggagtcaattcagatcacgattcatggtcacgaaaaccgtgaatttcacaaattttagatagtcacgattcacggagttaattcacggtcacggtcacgaaaaccgtgaatttcacaaattttagatagtcacgattcacggagttaattcacggtcacggtcacgaaaaccgtgaatttcacgggtttttagatagtggttacggtcacgattcacggagtcaattcaagatcacggtcacgttcacgaaaaccgtgaatttcacaaattttagatagtcacgattcacggagttaattcacggtcacggtcacgaaaaccgtgaatttcacgggtttttagatagtggttacggtcacgattcacggaatcaattcaaggtcacgaaaaccgtgaatttttcaacttaaaattcaatttgaaattcaattctaaggaatttaatacaaaattcaatcgaaattcaattgtttcgttccgcgcaattgttcctcgctaaagcatttctcttccgcagctccaacctggccaaatattgggccaacgcttctccgtccttcgcattagctttgatcattgtcggatccatgccggccaaaaggcatttgtcgaggcgacagccgcggcatcggatgccatctgagaaaagaacaaaaaccatatttaaattcatcaatgtttaataaa

SEQ ID NO: 59744 - DNA, 2340 bp, Heterodera glycines
  Genomic contig location: Contig_ID=SeqID_5941; Location=1..2340; Strand=-
  SCN-specific regions: Sequence locations=1-1061,1083-1184,1207-2340
ctaatgggccaagcaccgcaaaacgccgcgtcagcgagtctgaaccatgcaaatttggcaagttccatcgacggccgaatttcaaaattcaattacgacgccgaaaccggaaacactttcgaacagtggttcaaacggtttggagttttgattgaggaagatggtaaggacctccccgagtcgacaaaagtcagactactcctcggcaaactcggcgacgaggagtacggcaaataccgcgacagcatcagtccgacccagcccgacaaagtcacttgggtggactcgatcaccaagctgaaaggattatatgccgaaacgcgttcactatttgtccggcgctacgaatgtttcaaaattcgtcagcaaccgagccaggacatatcatcgctggtcgctcatatcaatgcgtcctgcgaaaacgccaatttgagtccgaccaaagaacaagtgcataatcctggtcattgcactcaacgacgagcatcacgacctgaggcaaaagtgtctcaaaatgctggaggacgcaaaaaagaccggcacagacatcactctccaaaaggtgtaagaggaattgaaggcgattcaaatcgtcaaggaaagtgccctttctctgcttactcaaccagtctcaaccagcgccatccaattgcgacctcagcaatggcgagagaccagcaaaggcaaacacaaggcaaaaccggcacccaaatggccacaacatgaaccggcacccaaatcgccgcatcatgtgccttcgcctaagcaaaaatcagacaataaagcaaaccgaggccatccaccgcacccatgtgcatcctgtggaagcaccgatcactggcgatcggactgcaaatttgccaacgcattttgcaacaaatgcaaccggcaaggccacattgcgattgtctgccgtcagtgctcgtccaacacggcacacaaatctcagaaccgatcatttcacacggtcgtggtcaagtcacattgtatggtgattggcacaacccaaggccgatggtggaagatcccggtcataatcaatggtataaatttgaagatgaatggagacagtggagcccaagcaacagtcatcagcttcaaaacgtggatcaaattgggtcaacccaaactctctccaacggacatcgaaacccgcaactgcaatgacaccgcattttcacccgaaggaaaattccattgcaccgtcagttgcttcgatcggccatccaaaacactgatcgcttacgtaagcagtgacttaaagcatgatttgtttggccttccgtggattgaggaattcgagctcatcccaagagaaattttgttcccaaagagcaccaaaggaaagcccaacgcgtcaatcaacgccaatgtcgtcaaggcaccaaacccggcgattggcatcacggatgaatcctcgctcaccgctgtgttgcaaaaagattttgaggaagtttttaagaacggacttggccattgcgcaatcaaagcgcacctgattctaaaaccggaggcccgacccatcttctgtaaagcacgaccagtcccccatggtgcaatcgaagctgtcgacaccgaactggaccgcctcttgcagattggcgcaatcaaaccggtagaattcagccattgggccgccccgattttggccgtcaaaaagaaaaatggaaagacccgggtgtgcatcgacttttcgaccggattgaacgattcgatcgaactgaatcgccatcctcttccgagacccgacgtcatttatgcagctttaaatggagccgcatttttctcaaatctcgacctgagagacgcctacctccaaatggaattggacgaaaaatcgaaaccactatgcacaatcaacacttaccgcggcctatttcagtgccaacgtctcccatttggcgttaaatctgcaccgtccatttttcagcacctgatggaccaaatctgcgcaggaattccaggggtcttttcttatttggatgattgcctaatcgcctcaaagaccctggaagaccacgtcaatgcgcttcaaacgcttttcaaacgcattaatgactttggcctacgcattcagctcgaaaaatgcaaattcctccagaaagaattgctttttctcggccaagtcgtctcctccaacggcatacgccccgacccagcgcgctcagaggcaattcagaaatgtcagcgccgcacgacaaaacgaccctccgttcattcttgggagcgctcattacggacgttttgttaaaccaatgcgagaaatcagggcgccattggaccaacttcttcgaaaggatgaatcctgagttggggaggcgaacagcagtccgcgttcga

SEQ ID NO: 59745 - DNA, 782 bp, Heterodera glycines
  Genomic contig location: Contig_ID=SeqID_5941; Location=3059..3840; Strand=+
  SCN-specific regions: Sequence locations=1-191,214-256,279-355,377 -398,456-569,593-748,778-782
atggggcatatttcactcacatttgcaatttatgtgaaaccaatggaaaatgagtaccaaccgtcggcggatgaaaataatgaaaatccaccggatgatgaagacattcgaacaatggtccgaagaatccttttcaggttgttcgagccaaacttggcaaaggtgtacaccgtcaatttaggcaaaattgacccacccgaattgtattttaatcgcacaattttggtggacaagaaaaatgatttggccaattaccatgccttattgtatgccaaaatgcatataaatcgacaaaatatctctggttataatcttttgggctatgctcaattaattaaaatcaacgacgaagaagcatcctccagcagctcagaaaataaggtaaaagcaaaaaacggtaataatatataaaaaattatttatattaatttttgattatttttatgtaatttttagtccaataaataccaattgaaaattccaattaatttatgtgcgcttttcaaacacttcattcatagctttggattgcaaatttattcttttgaaaaggtagatttattaatattacaaataaacaatacaaaaaacacttaaaaaataatgggcagtaattagattaattatagaataaaaatcacaaagaaaaaatggagaacagagaagaaaatccgcaaagaatgtgcaatttgtcttgaatcatttgaagatgacaaattaacaatgaaattgcatgaggattataaggttaattaattaattaatgatattaatttagttaa

SEQ ID NO: 59746 - DNA, 978 bp, Heterodera glycines
  Genomic contig location: Contig_ID=SeqID_5941; Location=3928..4905; Strand=+
  SCN-specific regions: Sequence locations=1-214,294-733,756-978
atgtgtttcacaaggaatgcatcactaaatggtaataaaaaaagattgaaatattcaaataaacaattgttttttagggttttatcccaagaacaaatacgatgcccaatttgcaatagaaacgcatttcaagtcacaacggtacaattttaatcgctgtaaaatatcttattagcttatcattaggctcgctggtcggggttaagggatttcgtaataaaatattttttaaataagcaaaaatttaacttatcattttattcattcgaaaattaaaattttctaaatattttgagtttttgacttatttagccagatcttcaaccatatttgatagacctgaccagccttcaacttcatttttttatttgaaccctttggcatttttattccaattagcgaatggaaaaacggaaaatgatgaatttaaaaagaaaacaaacaaaattagcaattaaaaagactgaagaatttgtaaaatcacgtgaagccgaactaaagcaaattgctttggaagcagaatttttgaatttgaatctttcagctgagcaaaaattgttcgaaattgggccggacggagtgaaaagtcatccaattgtcgaggaattgaagaatcaaatttcagacattctttcaaacggtcgtcaaaattcggaggaaatcatagcaaaagccgaacaaatgaattttttgatcaatcgaattacaatttgaattatggtgttcgtttggctttattcattgaaaatatgcaattgatcagtgaaaattgatttccaccctcccttcgtcccatccttttgtgtttatctgacaaatgagcttgtctttgactgattattgcctttctttgcaatctgttatccaattcagcatttgttgacatttttctttaaattttcctctcgaaatgaattataattcgttaacctgttctctattagcctgcaaaatttcattgaatttcgttagggttca

SEQ ID NO: 59747 - DNA, 667 bp, Heterodera glycines
  Genomic contig location: Contig_ID=SeqID_29212; Location=469..1135; Strand=-
  SCN-specific regions: Sequence locations=1-112,179-246,278-546,609-667
  Gene Ontology: Mol. function=ATP-binding cassette (ABC) transporter activity; Cellular component=mitochondrion; Biological process =transport
ttgaaacacagcgccagtgacgcattgaccatggactacggcttgggacgcatacgccgaagacggtccaattatggagcgatgtcaccgaccaagagtgtccaggaagtgcaacccgtggcattgtcttggcacggtctcaccgctgtccatgccaaatcgggacggaaaattcttggtaaaacctgtcggggttgcactcattgtgtatataaatttcgaccttttacagacaatgtgtccggtatggccgacgcgggccaactcgtggcactgatgggcgccagcggggcgggtaaaacaacgctgctgaacacgttactcaaccgaaatctgaagagtctgagcgtggagggccaagtgctggtcaacggacattccctgggccggtccatcacttacgtcagcggggtaagttgttatgatatgaagttcgggggtttcggttcggttcctggactcggaaatttcccggattttttgggttctggtatttcgaacccttttttatcatccttatactatataaatttccacacaatttcagtacgtgcaacaggacgacttgttcatgggcacgctgacggtgaaggagcatctgatggcgcaggcacagcttcgcatggtcggacactccaaacggacgatgcgcagacgcgtcaatgag

SEQ ID NO: 59748 - DNA, 949 bp, Heterodera glycines
  Genomic contig location: Contig_ID=SeqID_29215; Location=100..1048; Strand=+
  SCN-specific regions: Sequence locations=1-23,45-316,354-396,418 -528,574-853,935-949
atgcgttcaaataatttggacgaaaataaaagaattgagcagagaaaaattgttggaataaaaattggtgatcatcgggaggaacaattgcagaagagatcagcagaaatatggacaaattatatggaagagactttggaaaagattaaagcgcacatggaaatggttaaattaaaatattatttgtcaaatggaatcactttttgggactaaaataatgatttcgcatggattttattatttttattcttgattttggttttttaagagaaatttcttaacaaaaaggtttgttttattaaaaaacaacaaagtgtttttaaaataattttttagtgaaataaaatttttttgatcatttaaaagtttgttaagctaaatttagtttgggcacattaaatcaaattttgaagatttttctcgggtttctctgatcagttttcgaaccgggccaaagatccgaaatttaaattggaaattcttcccacgaaaaaacggcataagccgacttgaacatttacaatttgggctttgtcttttgagggaggcttaaaaaagaaatgttttaatttattttaaacccaaaatgaatgaattcacatcataaattgaaagagaatttataaatttaatttttcaggatccaatttaccaacaattggcagagcaaaaatatgcaattgacaatttcccgggattggatgacattttcaggaagacgcgcttttttcttgtaaattcacaacccgaagtggactttgacaattacagaagtgtcaaaggcatggaaaaggtcaaattcatcggaggatttaatttaatgccgaaagcgcgggaattggacgaagttagcaaaaaaatagttaaataaataacagttaaatttattaaaagcaaaattaaattatcattaaaaaaaaatttgttaatatttgaccctaggcttata

SEQ ID NO: 59749 - DNA, 521 bp, Heterodera glycines
  Genomic contig location: Contig_ID=SeqID_29216; Location=894..1414; Strand=+
  SCN-specific regions: Sequence locations=1-376,398-521
atgtacaatacaaaattagatatcgcttttttccgatcacaattggagatgagtgccgatcacttatccactgttgctttgttcaccatcaggtatgagcacaacgtgtccatcgttgtacgcgccctcaaacacggcgtttcccgaatgatacaattccgtaaattgacgaaagtgaaatttaacagagaatggggccaaaaacaaatatcgggatatgctttaaaatagggacaacagagaagcggaagattcgaaaaatggctaaaacatcattcggaatttcagtccgtgagacgggtgctaaattctgaataccaactccgtgtaaaggatttaaaggcaaaaacaggggtacacttatacagtttacagggtactttttacatacattttcagatgcctataaatgtgtttcagaaattaatgaaaataagtgttaaggggttctcgaggtcgctgattacgaatatagcatccatttttctaattccgaacccctgacccgaaatcgaacaata

SEQ ID NO: 59750 - DNA, 50 bp, Heterodera glycines
  Genomic contig location: Contig_ID=SeqID_29216; Location=957..1006; Strand=-
  SCN-specific regions: Sequence locations=1-50
atggacacgttgtgctcatacctgatggtgaacaaagcaacagtggataa

SEQ ID NO: 59751 - DNA, 85 bp, Heterodera glycines
  misc_feature (26)..(26): n is a, c, g, or t
  Genomic contig location: Contig_ID=SeqID_29217; Location=1058..1142; Strand=-
  SCN-specific regions: Sequence locations=1-85
atagtgctctgaaacgcatcaaattnatgtacgagttaaataaggctctctgatgcttttactatcaaaaagggagatgaataaa

SEQ ID NO: 59752 - DNA, 163 bp, Heterodera glycines
  Genomic contig location: Contig_ID=SeqID_29219; Location=1..163; Strand=-
  SCN-specific regions: Sequence locations=39-163
tttttaattttttaaatttttttgaatttttaaaaattcccggttggtcccggttcccggtcccgaagaaaaatcgaggtcctggtcccggcttctcaggtcccggcaagtcccggtcccggttttgcccaaaattcccggtcccgctctactctacattaaa

SEQ ID NO: 59753 - DNA, 237 bp, Heterodera glycines
  misc_feature (44)..(44): n is a, c, g, or t
  misc_feature (96)..(96): n is a, c, g, or t
  Genomic contig location: Contig_ID=SeqID_29221; Location=862..1098; Strand=-
  SCN-specific regions: Sequence locations=1-237
gcgcatcggtcggggggactgccccgaaaacaaaaaatcgattntttcaagtgtcgttgggggtactcaaacaattatggggagcaaaaatccacngcagaattaaagtacaggctatagggaagctattccggaaggattcggtctccccataaatctgggcgcatcggttcggggggactgccccgaaaacaaaaaaatcgattttttcaagtgtccgtttggggtactcataaa

SEQ ID NO: 59754 - DNA, 2871 bp, Heterodera glycines
  Genomic contig location: Contig_ID=SeqID_719; Location=1380..4250; Strand=+
  SCN-specific regions: Sequence locations=1-382,404-1835,1858 -1872,1894-1909,1931-2016,2038-2334,2357-2398,2421-2483,2505-2871
atggtgcaccaagacttcccggatgatcagtttggcaattttacggcgactcaaggcccaggtcaacaaagacaggtcattgaccccgttgtcatctggtacaatgggacaaatcactttcaaaccgttgtattggtaagttactgaccgtttaattcaaaacacataaaaattctatgtccacgtttacagccgtccaggccgtctgcctctcgctttgcagtcgaaatagtcacttcgccgcagtttcctccttcgattcacctttttggtgaagaagttgaagctatggaaattgcagcgcctgccgctgccccttctgcgccaattccatcgacgtccagtgggattgaggagaagcgttcgaccaccgtcacagctccatcaatagtgactgaagaagaagatgtgttcctggaagaatcgttgccgaagatggagtcctgcaaatgctgtaatagcgctgttgtgccaccggcattagaagacgccaatgtccatctaaaacaacagtttgcctattacggctacattagcactccctgttgtggcgacttccatctgagatgcttcgaaaaatggtcgcatttgtttttcgaagtctgtgcaaattacttctatctttaggaaccaaagtccgccctcttatgcgctgaagcgccttcacaactacgatggtgttgatgacaactgtccaaattgtcacaggcgtattgtttcgacattgtctgatgacgtggccactgaacatgccaaagaggagcgcgcagattcatctgagcattctgatgtgaataattaaaacaaaaaaatagctaagggattactaattttaggaaccgactgagccagaaagccagcagctaactgaagcagttgatcttgctctgaacatcaacgaggagctttatacgccgatcaaagttgagtatgacaacaccagcattgcttacttcgcagtttacaatgcaatgatccgtgcgaagaacaactgctacagaaacaggccgacaccaccgcctgagatgctggctgaattgagggcgtgctccgaaaaggagaaaagcctttactgggacttcagtgcgtcaactaaacgccatcaatatgcaacggagcagatgcttaagatgcaggactacttgaaggctacagcgcagcccaaacatcggcaatgtgtgaaggagcaactttgcgactctttgaaggaggcaacaaacaacaaggccccaataatacgggagcagcattgtttgctcatccaagcgctcgaagaacagctttacgacatcatcaagcagtttctcatgctctggcactccatgcaacagatcagtcccagcactgcgtcgttggaatcaatgcaggaatggctcctttcttcggaggacaacggtatggaactggcgcgtttggccgacagttgggtcgaacatctggccctcatcaacgaaaacatcaaaagttgtgtgaagaagtgcaataaggcgaagaggaggacgagcttcatgtcggttggccaacttacaggcctcctccaagcaaagctaaagtagatattaatgtgtagcaaaaaaataacttaacaattaaggattgtgcgtaagaggtcaaaaaagaaggctgtaagggttgaacgccatccgctgctcgaccatgtttttgaagacctgcgtcaaaaacatttccagctggaagcagccatacgaaagcaggaagaagctcaaaacacaacagacggaggacaaagaccgcgggccaattccatcggcaaaaaacggcgaattgatgacaaatcggtgactcgtgaatcgcccgtaaagcgacgggaaaaggccgcagatgcagcagaacatcgtatgcagcgaccggttctgatgacagctgaacaagcaaagacattggaggcggagcgaatcgaggcccagaagcgcatggctgcagaccgccgagcgcaagagagattgcgccaggctgaccaattcctcaagcaacatcttgctcagcagaagcggcttaagcagcggaatctggtctggggcaggcaagccgcatacgagcgatacatcaatgagcggttggagaagctcaaggccgaggtcaacgctctacggaaatctgcacgcgagtcgatgaacttcacagaaattgacatatgtcagctgaaaataattattttatcaaatagcgtcaaatatttagttctgccaactcgccaagctgttgaagcatattgcgctgacatcattcgctatgccaatcatcatgctgaggaggatgttcaaaaggcaattaaggaacatcagcagattctcgagcgacgacagcgtgccttggatgaggagcggcagcgacaaaaattgcttagcacatggcggggttaacaaattaaatggaattgcttttaaaaaacaactttagacgaagatagacaatgggcatatcgagaagacccagtgcttgctgccgagctcgaaaagataagacagcagaaggagcaaattgatgttgagtatgcggaagagcaggccaggcttcgtaacatcagaagagccgaggaagatgcacggtcgcgagcccgcaatgagttgcttggcctctacgattcaccagaatctggtaaaagcaaaatttgtagtttcgttcgagaccaaaatttcagagggttggtcggacgaagacctgttctacaacgtccgtcaagccgacagaatgcccatcatgcaagaagtgggagtggcgcagatgccgcgggaggcaattcgcgcaagagaggtcatagatcggcgcttgaacttccaagaggccgactatgttggtgagatgacgccagctaacaaaggcgacgacaacagaggtagccgaaagtaa

SEQ ID NO: 59755 - DNA, 610 bp, Heterodera glycines
  Genomic contig location: Contig_ID=SeqID_29224; Location=896..1505; Strand=+
  SCN-specific regions: Sequence locations=1-148,170-277,299-537,567 -574,597-610
atgtcaatctcaaccaattcaacaaatggcgattttacaccaacagaaggaggtaatgagaaaaagagaaaccgtaggaagttaaattgagtactggaaatgttaagataaatattaatttatgtttgcgaattaaattttataagattttcagaagttaattgtgaatcaattagtttggacaacgatggacaatctgatggaaaagcgactgatccgcagcagcagaaagtgagcaattaatagcatttgtacgagaaagatttgaaatattttgacataatatttttaaaggaatttgttgaaaagtgtgccaagatggaaatggacttcaaaattagcacattagaacttgagaaagttggttttcatagataattaatttatattcttgtcctgacctatgcacaaaatcataaattagagaaatttcattttaaatgttagaaaatggaaaaactaatttactattttgtgtttgcaaaaaaaaattgggcgtttctttacatatttttacatttttcaagaatattctgcatataaatatgtataaaatatttattatacacttttggaactttttgtaaatattttgagggtttttgagaaa

SEQ ID NO: 59756 - DNA, 657 bp, Heterodera glycines
  Genomic contig location: Contig_ID=SeqID_29226; Location=801..1457; Strand=+
  SCN-specific regions: Sequence locations=1-82,107-495,524-549,571-657
atgaatcgtggaagaaacaatcaaaactatttaattcatggtaaattctcgataagaaattgcacagcctactaatctattcaagattttgtctttttaaaattttcttaaggaattagcaaatactggcaagtcgtcggcgctctgggtctatgcgttgtcatggtatgcatcacttatcaattgtttctgcacgtggacgaaaagcacaaatcgttcaaactgatgatcgatggacacttcaaagatttcaagcaaatccacaacgatttcacggcgtggtcaaaaaatttcacatcgcatctcaatgagcgtttcgaacagcaacaggctcgatcaagagcgcgtttcaaacaacagttggcgaagtcaaaagagcgttttgatgaacaacacgctaattttgtcaaaatccgtttggactttgatcgacagtttcaaaaaactatgcaccgttttgccgaagttgagttggaaaccgtgctgaacaaaaggttggattgtttgttttttggaaaacagagaatattcgcttcacctccacatccctttgtttaaggttttcgtataatttttgtttcaatcaaaagcatcaactcctagaaattttcaacagacaaaacaaaattcaattttcgtacttttttcgagtaggga

SEQ ID NO: 59757 - DNA, 213 bp, Heterodera glycines
  Genomic contig location: Contig_ID=SeqID_29230; Location=1..213; Strand=+
  SCN-specific regions: Sequence locations=1-99,121-213
taatcatccgattttgctgtatcaaaaagtgttggaactgttcggcgacttgcaacacaaaggaaccaaaaaggcgaaggtcgaccatttcgcgtgtttccgttgcatttggtcactccagaatgttttagaaggaatttgtcaacttttccggcgtcatttgccacttccccactcgctacgaactttgccaatgtcgaattgaggactcag

SEQ ID NO: 59758 - DNA, 359 bp, Heterodera glycines
  Genomic contig location: Contig_ID=SeqID_5946; Location=152..510; Strand=+
  SCN-specific regions: Sequence locations=1-319,342-359
aaaagccgaagcgtgtccactttgtgtgcatggaccgcgcggagtcggaggcgcgccgtctgatgcgccaactgcggcgcggacaacgctcggtcaaagtcagcagcgcccagggcgagtccttctcggaaatgatggacgagccgcagcagtgctggcggcgccggaactgaacgcggacgaatgggacgcggagagtgcgcggagaagagtagaaattgatcattagtcagtcaacatacctaacactctccgataacttcccccccccccgtctaatcagtgatcagtgtgatcaatgaccgtaataaaagtgccaattttattttgtttaaatgcaccgataaaataattgtagt

SEQ ID NO: 59759 - DNA, 730 bp, Heterodera glycines
  Genomic contig location: Contig_ID=SeqID_29234; Location=394..1123; Strand=-
  SCN-specific regions: Sequence locations=1-83,128-129,151-370,408 -615,654-730
atggcttcatctttctgctcctcaatcatttccatcgtcgcaattgtctgtttgctgtgcaaatgctgcttttcggcaccccgtattaattaaaatttttttatttaaaatcatttttatttaaaaagatccatgctgtcctggcagccaacatgtcgtttcgatgatgaaagatcacaccggcacattctccgcttcgatgccaaagtcttcgctttgtctgagtgccgaaagagtcgccgctgcggtggaaaaccaactgaaaacaatttggtgccctggcaatggtggtcaaacactcatcaacgagatcaacgcagctcaatcatcatctggtaccaatggacaattaaatccctttaaaatcatctattattttttaatttaaattcaatttctattaatttggttcctaattagatgagtgtgctcgctctctcggcttcatccgtgccatgttcgaaattgccgcttccgccgcttcccatgccggtgccaacgccgaattggccaatttggctgtccagttccgagaacaagttggcacaattgacaccaactgtgctgcgctggacattcttctgttgggcaaatcagcttgggcactcccaaaggtaataaataattaattatttttaataaatttattttttcaggagaccatccgcaagtgcatgactctgagactgtgcttagtaaccctggcaacagcgggtttcacaagcgctta

SEQ ID NO: 59760 - DNA, 1637 bp, Heterodera glycines
  Genomic contig location: Contig_ID=SeqID_29237; Location=323..1959; Strand=+
  SCN-specific regions: Sequence locations=1-613,641-895,917-1413,1436 -1637
atgcgttgtttccttccgattttgcgttgcgagagcattacgttaaaatccacaacaaaacatgttttactgtgagttcttcttttggggttgtgtttatgggtcaatgcagttcgtacaaatttattcaattaaaaccaaatttttcaaatagtggttttatacagagacgggtgcaggacccgggtcccgtgccaaattttacgagttcccattcatcccgcattttgggaattgagggttaattcttagaatcgatcaaagcttctgttttcatattcttttgctcttctcagataaaatatcgcgtctctcctgagttggaagagcgacgcgcattgctccgtcgtttggtcgatcagtcaatgcataaaacgggaagcggcacaattcagcagaacaaagcaccgaatttggagccgcccaattcatacacttctcagctgctgatggattgcacgtcactgctgcaaacgcaactgatggccagcaatcactttctgaacagtggcatcaaaaaggagaatgtttgggaggagagaaacgacggcgaaagggtcgaccatttggagggcgaaattgaaggaccaccaattgagggggttggtgaacgatagaagacaacaaaacaaatggaaaccgatagggttaaggtcaccttttgcgctcacaaacgaaacgctttgatgggtcagaaacgcaccttttctgatgaagacaattcaactttgtaaagccaattgcaatgggaaagtgtcactcatccaaatttaagcaatttaaacgatcgcctttcgccgatgccaatgaattcgctaaatgctgtaatggatacggaggagatgctaaacgaagccaatttggagattaaaggcaccatttcagcaaaagtttgattttattttttatttttttagtttctccaaccaaaaaacaaacaaaaaaccgacgaaagacacaccgagacacgggaaatgaccaaatgcacgcgaattcctcgcaagggtccaacgaagaaacgaagcagcaaaagggaggaggggtaattttatttgtactttttcattttttctccaagaatggacagatttgaatttgttccgaattaagccaatggttgagtgttcgggctgcaaacggatggttggccaatatcgcaattcgatgctcatccatgtcaggtcagcagcccatccaaatgattgaatggtccaatccggctttgactgttctgtcctctgtcagtacgcatcactgcgaccagccgattttcgaatgtattgcggacggatgcgggaagaaatggtactccatttcagcacggactaaagagcacattgaggctaagcacggaggcgacttcaactttcttcaggtgcccatcatcatttcagcattcatttgttgctattataatttttaatttcccattttatttgactctgaaattcaaacatttatttcccccccccccaggacaatcgcagttcgctgttgcctcttctccggtcgaccgccgtccgcctcttttctggtgcttattaagcgcacatttgtgattttttgtgtaaatttgtattttctgatcactttcactgtatcgggtaccatttaatgcaaattcaatcacatggaaa

SEQ ID NO: 59761 - DNA, 1116 bp, Heterodera glycines
  misc_feature (50)..(50): n is a, c, g, or t
  Genomic contig location: Contig_ID=SeqID_29238; Location=89..1204; Strand=-
  SCN-specific regions: Sequence locations=1-736,758-1116
atggactcgcacattcgatggcccgaattcaagacgcctggcccacattngcgaagtcaagaaatgaaattgcctagcaacattggacagaagaaattgtccaacattggactggttgtgacaactcgaaaaattggtaagcgagaccaaatttaatggcctaatttaaattaaagaaaaaatcaaaaaggacgagtagaaaaaacagaaatctttgaaatttaatttctttaattttctgcgttttcagtctcaattggtcttgaatatccgcacgcttacgaagaaattgtgaagcagtacaacgactttcgttcccacattgttctcctgcaagatctgaagacggcactgcacaacactgagcttgaacttgaccaacttgccgcccaaatgccagccgataaattgagtgttggcaaaaaaaaaaaattgttttccccatttcttttttaatttttgaatcccaatttaggaatgtccaatcattgagccacgctttcgtgtgagcagcacattctacgaggaattggaacggagtccggtgagggtgctgaacacgccaatgactgagggaggcaaaggaaaagggaagggcaaacagcaactgaagccggcaccggtgaccggccgagcgatcaccaaaatgattgaagtgaacacagcgccaacaacagttgtatgttttttgctcatttttaggggatggggaatgaaaaaaagggtgcagctcgtttttctccaaaaatgtgcacaaatttataaagtgcataaagcattaaatctcggggatataatgagaacaacaattgttgataaaatctcttcgaatagattagctttggaatattgcgaaacttgtgaatttgcgcgccctttgttaatttttggaatgcgaccccaaaacaggaaaataccgaaaaaaatttaaattttctagcgattttttcgaaattttaatttctgaaaattcggacttgatgtgcccccccccccctattttctacgcaatttttttagactcgtaagagacggatgcactaccccgagggaacgccgccaacccggtctcaaacggccattcacctgcaacaacaacagctacaacaaaattag

SEQ ID NO: 59762 - DNA, 356 bp, Heterodera glycines
  Genomic contig location: Contig_ID=SeqID_29240; Location=133..488; Strand=+
  SCN-specific regions: Sequence locations=1-41,71-126,212-218,241 -245,276-356
ggaatcgaaggtgttgtaagcttttttccttttttcacttgtaaatttatttaaattttcaatttttttagctttttttcgaaaaattttttgtctttttttcggcaggcactgcctctgacaatgttttttatttatttagaaaaataaattgattttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctgtcctttcgcttacgaccatacca

SEQ ID NO: 59763 - DNA, 157 bp, Heterodera glycines
  Genomic contig location: Contig_ID=SeqID_29241; Location=1..157; Strand=-
  SCN-specific regions: Sequence locations=1-44,79-157
tttttgggccccggggtcgtttgggccccaacccaaaaatagaaaaatgtacttttttaaaaattaagattctaaaaactaagcctgagggatccctcgccacttggcataagttaggtttaattaacattcgctcattttttacaattttacttat

SEQ ID NO: 59764 - DNA, 405 bp, Heterodera glycines
  Genomic contig location: Contig_ID=SeqID_5947; Location=119..523; Strand=-
  SCN-specific regions: Sequence locations=1-62,84-205,228-405
atggaagcaattctaacaaaaaggaaccgtaccaagcttcagcacaatggctattcatacacttttcacaagccgagtgctgacggtgaagctcgcttttgggcgtgtgaacatcatcacgcaaaagacatcagttgtaaaggacgccttcacactgacctcgacaaccgcattttacgtgaagttgggaaccaccagtgtgaaccaagtgcagctcgaatggaagcactttcgagtgatcactggaatcaaacgcagggcggaacaaaccatggaaccaccagcgacaattcgctctttggcactgcagaatgtggccacgccagtccttgcgcaactcccaaccaaacaggcgacaaaacaagtgatagttttttatgtttcctcaaatatttgtatatttag

SEQ ID NO: 59765 - DNA, 146 bp, Heterodera glycines
  Genomic contig location: Contig_ID=SeqID_5949; Location=79..224; Strand=+
  SCN-specific regions: Sequence locations=1-146
tgctcctaactttactatttgttattttgttagctgttggtggtaaaacggagataattaatgttgatttattagggtcgtacgacccaaatgcaactattggaggagctacggactgtaatagttaattttttttgttcgcaaca

SEQ ID NO: 59766 - DNA, 221 bp, Heterodera glycines
  Genomic contig location: Contig_ID=SeqID_5949; Location=1340..1560; Strand=+
  SCN-specific regions: Sequence locations=1-221
atgtttaaaacgtatttgcggccgaaattgagtggtaattaataaaattgtggctttttaaacaattattttagtgctcctaactttactatttgttattttgttagctgttggtggtaaaacggagataattaatgttgatttattagggtcgtacgacccaaatgcaactattggaggagctacggactggtaatagttaattttttttgttcgcaaca

SEQ ID NO: 59767 - DNA, 396 bp, Heterodera glycines
  Genomic contig location: Contig_ID=SeqID_5949; Location=1715..2110; Strand=+
  SCN-specific regions: Sequence locations=1-93,115-331,353-396
atgagaagaatgaattattgcccgaggaaggtatgatttttgggtgggatttctcgggagttccttaattgctaattagtgtaagggtgggcgccttttttgtttggttaatggaaaggcggtaagcggaaactgcccataactttcgtctaagtaaccaaattaaacattcttgatatcattcgatagccctaagggttctctctattacttcacctaattttcaaaaatttgatcatgtttggacaaagtttggccaacagtactcaggaaaccaggttatcagaatatattgatcataattttttgaaacttagccaaatttttgaaattttgcaggccagaagaaaacacttagagctatcaaatgatatcaagaaaataaaaatttaaaca

SEQ ID NO: 59768 - DNA, 520 bp, Heterodera glycines
  Genomic contig location: Contig_ID=SeqID_29243; Location=646..1165; Strand=+
  SCN-specific regions: Sequence locations=1-418,440-520
atgaaccaacgtaatgtatactacagctggacggtgagttgtgttttgattttgcgcctattctttaattatacaaattaatttatgaattgaaaatggtaaatgatcgataccctttttttagattagcaacttttccttttgtcgcgaggaaatcggcgaagttttgaagagttcgactttcaggtttttcccttttaaacgttttttaaacatttggactgcatgttatttgaaaatttgattggcaaaaatgatttaaaattttcgattttttgggttcagtcgattcactcattgcccgtgggacttgaatttgggtttttgtcactccgctttagtgtcggccccaacgacatgttcaagtggcgcctgcgcatcaacccaaagggccgcgacgaggagtccaaggactatttgtccttgtatttgctgctggtgcaaagcaacaacacgcaggtgcacgccaaattcaaattcggcatactgaatgccaatggagatgaaggccgagtgctgg

SEQ ID NO: 59769 - DNA, 69 bp, Heterodera glycines
  Genomic contig location: Contig_ID=SeqID_29244; Location=41..109; Strand=+
  SCN-specific regions: Sequence locations=1-69
atgccaattgcgaagatatgcggcgacgttttcatgacattggcccaaagtcgcctatttgaggaatcg

SEQ ID NO: 59770 - DNA, 563 bp, Heterodera glycines
  Genomic contig location: Contig_ID=SeqID_29245; Location=83..645; Strand=+
  SCN-specific regions: Sequence locations=1-415,437-496,518-527
atggcggcggcggcggccagcgcattcccatcgcggcggcacagttgcacatcggcgggcgcggactgttccgaatggtgagagagcaattagcgggaattacagtaatggtttttttgacaattagtattagctacaagaataattacagtaatcgtgttgcatagttcgtcgagagttacggtcaagggtaattacagtaatcgttgcatagttcgtcgagagttacggtcaagggtaattacagtaatcgttgcatagttcgtcgagagttacggtcaagggtaattacagtaatcattggcatcgaggagttatggcaatggaagcaataaaaaacatttgtatttaggtggacgttttttgacaggaaaaattgcgttcaactaatcctttgaatttttggatcatcaggaaaactaaaataatttctcttaatttcagcattttcatcataatttagttaattattttgggaattttcacttagattttcttcaaaattttggaatttatgaaggtatttctaaattttaatttttttttaaatttatttttttaaa

SEQ ID NO: 59771 - DNA, 618 bp, Heterodera glycines
  Genomic contig location: Contig_ID=SeqID_29247; Location=795..1412; Strand=+
  SCN-specific regions: Sequence locations=1-618
atgctcggagttggacagctcgggaatcattgccaagtgcgaaatttggacagcggcccagccaaattggaaaagcataatgggcggaatgaaccaaagaaggcgcagaaaaggcagccaatgacagagcaaacaaccggagaaaatcagcgggaaggaaagagtgacacagacggtgccgaaaacgcaaaggttgaaataggaaatggaaaaatgccaagccaacctatgatatgccacgactttcgtcgcccaaaacggcgtaaaatgccgggcagaagggacaaatcgctgagcattccaaccaacggagtggacacggcgtcagtcacctggcggaaaatggcgaaatgtttttgtccgtctacatttgcagtttttccatggaatattcattgattgtcagtccgtgtttgcctgtccaatgaacatgagcagaccagcttgccaacttagcagcaagacgaccttctccaagaaaatcagcagataggtgaaccacatcgatgcgcacaaatcgttgtaaaaatgacccgtggaataggccaaaatgcgccgttttggaaggtcatccgatgaaacttgggccgaaacaacctgaacagatatttagaataa

SEQ ID NO: 59772 - DNA, 1204 bp, Heterodera glycines
  misc_feature (31)..(31): n is a, c, g, or t
  misc_feature (121)..(121): n is a, c, g, or t
  Genomic contig location: Contig_ID=SeqID_29247; Location=377..1580; Strand=-
  SCN-specific regions: Sequence locations=1-912,934-1204
ttctccgataagcggaagtcagcagcattgnctccttcacgcggatgcgagcgttcagagcgaaagcgttgacggcgtcgaaatcgaagggaatgaggacgaacaaaatgtgaggaaattntctggttgcagttaccatttttttaccaagcccgaaataagttttaattattctaaatatctgttcaggttgtttcggcccaagtttcatcggatgaccttccaaaacggcgcattttggcctattccacgggtcatttttacaacgatttgtgcgcatcgatgtggttcacctatctgctgattttcttggagaaggtcgtcttgctgctaagttggcaagctggtctgctcatgttcattggacaggcaaacacggactgacaatcaatgaatattccatggaaaaactgcaaatgtagacggacaaaaacatttcgccattttccgccaggtgactgacgccgtgtccactccgttggttggaatgctcagcgatttgtcccttctgcccggcattttacgccgttttgggcgacgaaagtcgtggcatatcataggttggcttggcatttttccatttcctatttcaacctttgcgttttcggcaccgtctgtgtcactctttccttcccgctgattttctccggttgtttgctctgtcattggctgccttttctgcgccttctttggttcattccgcccattatgcttttccaatttggctgggccgctgtccaaatttcgcacttggcaatgattcccgagctgtccaactccgagcatacgcgaatggtcagcgaaaaagcaattaatgagagcaatgtcattttggccatcccttttcagtcaatgacttcctatcggtacggtttcaccgtggcagccaatctgttcgtgtttgcctgtctctttctgtttttggcccaagacaaggacaccagcaaaatcaaaccatccgatttggccaattttcgggttcgacccacaagcaaaattgatttcttgtcggacttttcaacatccaaaatctccactcgttcagaatctcggtctggttgctgttgcgcttggtaccgccgtcacggcacttttttacgggggagttagtgagccgaacagcggacagcggcggatgagccgactgaactcggagagcggcgacgcgcaccgattgggacgcatgtcttggcaagaaaatatt

SEQ ID NO: 59773 - DNA, 312 bp, Heterodera glycines
  Genomic contig location: Contig_ID=SeqID_29248; Location=667..978; Strand=+
  SCN-specific regions: Sequence locations=1-90,130-312
atggatgaaaatgacggcaaacttttcaactccaactacatcgatttcgaagcccttacggtattatacttagaaaatattagagaaatattaacaaaaaataaattaaaaggaattgtttgagaggaatttttatcgataaaatgagaacttacaggttgcgccaccagatttacctgatttaatgggtgatagtgaattgagcaattataatgcgaaaaaagatgttaaattcatccaaaaagaaaaagtttgtttaatattgcgttaatagaaccatgcataaaaatcaaaataagatcccttatgaaa

SEQ ID NO: 59774 - DNA, 49 bp, Heterodera glycines; identical to SEQ ID NO: 51181
  Genomic contig location: Contig_ID=SeqID_29249; Location=579..627; Strand=-
  SCN-specific regions: Sequence locations=1-49

SEQ ID NO: 59775 - DNA, 56 bp, Heterodera glycines; identical to SEQ ID NO: 52733
  Genomic contig location: Contig_ID=SeqID_29250; Location=787..842; Strand=+
  SCN-specific regions: Sequence locations=1-56

SEQ ID NO: 59776 - DNA, 56 bp, Heterodera glycines
  Genomic contig location: Contig_ID=SeqID_29251; Location=1258..1313; Strand=+
  SCN-specific regions: Sequence locations=1-56
gctatagggaagctattcctgaaggattcggtctccccataaatctgggcgcatcg

SEQ ID NO: 59777 - DNA, 243 bp, Heterodera glycines
  Genomic contig location: Contig_ID=SeqID_5950; Location=101..343; Strand=+
  SCN-specific regions: Sequence locations=1-243
atggaacgttggatggaatggggagagataatcaatcgagttgggcgtccagtaaaataccgaagaaatatcacgggtaggttccggaaaaaggaggagttcatcagggagcataaagtttcaaatatggttttgtcatggtggcccactagcgcagcaaaggataaaactgtacgagtacaaggagcaggtctacagggaggaagggtctaagctgctgtattgcgatacaggtgggcagga

SEQ ID NO: 59778 - DNA, 345 bp, Heterodera glycines
  Genomic contig location: Contig_ID=SeqID_5950; Location=482..826; Strand=+
  SCN-specific regions: Sequence locations=1-345
atgactcgagagtatgctgacagcgaaattttggagtttgtgtccgcgggcccgaaacagtacgccttgaaacatagaagaaagaaggatggtgtgatttggcataaaaccaaaatcagagggatgacattggatagacgaaacgaatttaaatatgaattgttcaaagagatggtgctggactacaaagaaggggtaaagaaagtttttcactacccggagaagatcgggccaacaaacgacttccgggttctctcaaaaaatgtgcaaaaagaatatacgccggtgcagaaaaaaggaattattgacgatcattttaatgttttaccctttggatattattga

SEQ ID NO: 59779 - DNA, 1507 bp, Heterodera glycines
  Genomic contig location: Contig_ID=SeqID_5950; Location=1145..2651; Strand=+
  SCN-specific regions: Sequence locations=1-30,52-143,168-298,320 -356,379-930,957-973,996-1029,1062-1507
atgagccgagaagctgagccgggctggaaaattgagaaaatttcagtggacctttattgcagtgccctgtcagacccagtgatcatccctgcccgccccttccaacaatcgaacccagacattgttttcaacgagttcatgcacaggcagcaatcatttggggaagtgaatttgttagaccagagaatttcaataattatgccacttattctttccctgttaaataaaattttttcatttttccctttcattattttttgttcattccattattatttattcgagttttttttctttattaatttttcagttaaaatgtactcgtttcaaaaatattttgaggaggctctcgaaaaagaagattttttctggcagaaaaacagagcagaagtggaggcattgttaattgaggcttcaaattataaaattataatacacagggactacgaaagccgctattctgattatattgccacctatcgccgcaccccactcttctgtttctgcatgattgagagaaatttaagatttttttacgacacaggaaccgggacgcccataggaagggttacaaccgtgctacatgttaccgttgaggcgagctatacaggagagggcttcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgtatagataggttggaacatagaaaaaacaatttaaaaaaatattttagagatttggtcggatcgtggtcattgttctatagactcccaccctcactttttgacacttcacgccgggtggttgcggagaataaactggaagaatttttaaaattaccatcattttttcgcatgcttttttataataaatattaaatgttcatgttgtttttaaagtgaaggttttgacccaaatatttaatcaattttaatttattatttttggtagaattccagaaaatgcaaacaatcgctgaaattaaaaatttcgagattattgaaggcggaagagtttttattgtgagagcgagaattgagaacgtagtacatgcggagtacagggtttgtattaaaaatgaaaaaaatatatcagttttttaaggcttgcgttttatgccgtaagggggcgtgttcatgtggcgttgagaaggcactgacaccttatttgaaggtgtctgtggcagatgatactgggattttggaaaatgtggcaattttttggtgtatgtgggaagaaaaacggaatggtaatgttttaaagaaaaaataccattctaatttaaattcaggaggagttgagaggattgtctggggccgtgtgcactatgaaaatcggcgcgagggtgaaagaattcggagggaagaaggggatctattactctttgattga

SEQ ID NO: 59780 - DNA, 1752 bp, Heterodera glycines
  Genomic contig location: Contig_ID=SeqID_5950; Location=4062..5813; Strand=+
  SCN-specific regions: Sequence locations=1-193,215-337,374-435,497 -648,679-725,755-843,865-1008,1030-1524,1546-1685,1715-1752
atgtccgattcaatttgggaaatcttcacaatcctggacaaaatcaatttggagtcagaaaaagccgaatctacgtggcgtgatttcgagagatgcaaaacatttgaccaggcaacaaagctcgaggaacaatcgcaaaattcattaatggaagcccggagattacatttcgagtcccgaagggtgcagagccaaatgttaaattatgaaaataggctccaaacaattgtttgggaacatatgggtatataagaataaaaaaacgaaaagggaaacactcaaaatggaagaatgtacaattatcgagtctttatgtcatgttaatccaaaatttggctttaaaaaatataaaaataaattttattttaaaaatcctttcctaattaatacggaggaaaattttaaaaatatactcgcatcaataatcgaagaaatttataaaaaggaacaaggaaaattcagaagtattttgaagctttcttttggttttgagtcgttttattgccctcttagatgccctagcgaaaacacagctgaggctttgttccaacatatcttattaaaagaagaaaaatattcgcttttctatactttggatgatgtcataacgctagaagtaaccataatcccagatgtcaacaatagaccaaaaaattaattttataaaaaacaaaattacaggaaattggaaaattgccggaaagattgttaaacgttcacatttgttagcaatttttgcaaataaactttttaaacgggtgaaaattttctacatagcggcatttagcgcgccagacattgaaaatttatatttttcattcttagaaatgctcgataaaattcaaaaattaccaaattttattatgtatgaatatagaaaacagtctttagctatgcaaaaattagaaattggcatcaaagaacgaaatatatttaaatgtcaagaagcagagaatttattggacctttcttattcaaagataaatgaattccgagaacaagtgcaaaattattaatttgacatgaaaatgttatacaataaaatacgattgacagctattaaacatttatttaaacccgaaaagaaattttttagtccgtttcaaatagaaaaaaatagagaaattttttattcattatttcggcatatctaataaaatcgcaactttctttgcaaaaaaaatgaaatattttcgtaacataatataatcgaatgatttttagtgtaatatttgagccttacttgtgcaaaagaccaaaaagtttttgcaagtttgaaggccattcactaatttcgtttgttgaatctgaactaaattagggttacgtcatgtattacaaaccaaaaatttgagtatttaagaagaaaaatacacataactcatctgccgtttttcaacttttcaacgggtatgggttccccatggggggggacttggattaatatcccccgctaacttatatttaatattattttagatgtacgcccaacaaaacgacatgcaaatttcggcgcaaggagatgatgtgttgccactgacagcagcagattttgcggctatggatgaagcgcataggcaatgggagactgaacggcggcaacgagaagaacaacggcaaagagagcaaaaaagcgcccgaaatggaagtggtctgatgaatggatggtgcgccaaagagagtgggaaaaagaaaaagaagaagaagaaaaagaccccaaaaatggaaaatggaaaaggaccagcaatttga

SEQ ID NO: 59781 - DNA, 859 bp, Heterodera glycines
  Genomic contig location: Contig_ID=SeqID_29252; Location=326..1184; Strand=+
  SCN-specific regions: Sequence locations=1-254,319-353,375-460,482 -600,787-859
  Gene Ontology: Mol. function=transcription co-activator activity; Cellular component=nucleus; Biological process=ubiquitin-dependent protein catabolism
atggtggaacgaatgagtgactggccgaagttaataagtgggttaattagttaatcatgtgacactttcgaacaaattgttttttctttcaataatttacataattgatatcataaattcgtattttttagaagaagtcagtgctgtccctgaacttttgagaatgtacatcaatcatgcaaacaaattggaaaattattcattggacaaggatctggtcgcacaattagcaaagtttgaggaatcacagaagaaaacaaaagcgcaccaccaccatcatcatccaaattctcaacaacaacagaaaaacagcaaggaacttcttactgctaaaagtgacaaaaaagaagacgaaaacacaaacaatgaaatgagaacggacgaaggcttggaaagaaagcaggcagtttcatcaccatcgcatgacacatcacaacaacccgaaccaattcaacgggatgaaaattcaccacccaaaactcagccggaacaaatactacaacatcaaaatccagcaagccaaaaccaacagcaaactccaccccaagtccaacagaatccatcgactgatgatcaaaaagaaacggattcaattcaacaaaccccaagccaaagccaaccaaatcaacagcaaactccgccccaagtccaaccgaatcaacagcaaactccaccccaagtccaaccgaatcaacagcaaactccaccccaagtccaaccgaatcaacagcaaactccaccccaagtccaaccgaatcaacagcaaactccaccccaagtccaaccgaatccatcgactgataatcaaaaacaatcggattcaattcatcttcaaactgaaggtcttccaaagtcagaa

SEQ ID NO: 59782 - DNA, 958 bp, Heterodera glycines
  Genomic contig location: Contig_ID=SeqID_29253; Location=282..1239; Strand=+
  SCN-specific regions: Sequence locations=1-55,77-858,881-958
atgttttccgagggcttcgagcgcatgttcaacagtgagggctttcgcgagcagcgcacccaggaagtggagctgaagaccgtgtcgccggacgtgttccgcgagtttttgtacatcatttacccgagtcacaagcgtccgcatggtatttttcttagaaaaatcatttatacagtttatccaagataattggaagagggtgcaccacccaacgaactttttttaagtcttcattcatttcaatttattttcggggttttagaggagggagacccaatcctgatttaaatatttttcaatttctaaagtagcttcagtatattgcaatttatttatttcccttttcttctagtgccaaatacgcgcggactgctcgaactcgcccgcatgtatttcattccgacagtgactgcgatgtgcgagcagtgtttgctgcaagcgaccgagactgacatggtggtgggcgagcggctcaaactggcggacgaatacggactgttgcgtttgaaggtacaacacgttcctacggaccttttattcaatacaaaactgccataatgtcaatagattttcaagtaagaaaaattattttggaatagaaagtccacctaatcttgttgttagttatcttcgcgtttttaaatttaaattttttgtctttatttcctcattgcccctttctcgtgacaggccaacatcatgcagaagacggatccgaacgcgttgcgcgacatccaaggactgcgggaggacacgctgagtatgttggtgcgcaagctgcagaaccgggacaaactgcagcgagagaaggagaagcgtatgcaacagacgcgaaaggacgacggcggagaggcgatggaagtggacggcaaacaggtgggggagagggagagcaaagtggaccccaatcttcagtggctaatgatgggatttttttcaaaaaatgagacatgaacca

SEQ ID NO: 59783 - DNA, 119 bp, Heterodera glycines
  Genomic contig location: Contig_ID=SeqID_29254; Location=23..141; Strand=+
  SCN-specific regions: Sequence locations=1-119
caattttccgtcatcttctaccaactgttaggcgtacagcaacggcggcacttgccttcgatgcagctgttcacgggctctctaaccctatttttattttttttctatctcttctctga

SEQ ID NO: 59784 - DNA, 1449 bp, Heterodera glycines
  misc_feature (217)..(217): n is a, c, g, or t
  misc_feature (311)..(311): n is a, c, g, or t
  Genomic contig location: Contig_ID=SeqID_29255; Location=456..1904; Strand=+
  SCN-specific regions: Sequence locations=1-221,244-350,373-443,466 -626,668-955,977-1449
atggtgcgctttatgtccacttgtgttcgttgtctccggacaccgaatatgcgttttacgtctctgctcatggggcaagtggccaagaattgcgccactctcgccgagtgtgtgtgcctacggatatcgcttaaatggctcgctcattggccgaaataacagcgggatttatttattgacataatacatacgcatttttgttctcacgatttcaaangcgggaatttttattcatttttaaccgatctcgccttaaagttgtttgttgacaccgtttcgaacactgaataaaagtggaaattacgtacganatgtttttgatttgtttatgaaaagaggaaatttcagtctaatttaaaatatatttttattggattgacaaaatagttcgggcttggggggtttgtcgttacgaaaattttattttgttatgcactttggatccccaaatttttcagcttttttcactttccaagcaaaaaacatacgaacatgtatgtttcgggctcgctgatcactaattcagcatccgttatgcccaatttcgaacccttgacccgaattcgaacaacaggtcgaaaattcacttcgccaaaaaagggtggtgggaagggaaccaaaaagggtggagtgggaagggaaccaaaaagggtggagggcggcgaggcgttgtgtgatgggccttcactctttttgaagtgctgttaaaatccctaatcaaacctgaaaaccgaaaatgaaagagcttcaaagataaatttgcatcaaaaattggcattggaaacgatgaatgatattttcgactttttgttccaattctggtcttaagttccagtctctccgatcaaacgcaaaaaaatcaaaatttctctgatcaattttcaattatctaattcgctctttcccgctatttgctatttccaaatatgcataattattacctaattatttcgatatttaaaatttgggttcaatggtggtttgacagtgccacggttcgcaccggaagaatggagtgtgcatcaacggacgttggatggaggagacagaaccaacaattacgcagaagcattccatagaaaacttcaacaggcatttgattgtacccatcctagtgtcttccacttcatcaacacaattcgatgtgagcaaaagtcaattgatgctgacatctcacgatgcgtcgctggtgaactccctcctctaaagaagcccaaatatcgtgccgccgatgcgagaattcttcgacttttgcagggatacaataccatcaacaataacccggctaaccaaaatgaccacaattaccatgccaatgtcaatgttaatcccgataacatcaaccatttgctcgttggtgtttctcgaaattatgaaatgcgcccgtaatttttcaatgctttgttattttttttttgttgttaacacattgataaatattttttgata

SEQ ID NO: 59785 - DNA, 483 bp, Heterodera glycines
  Genomic contig location: Contig_ID=SeqID_29256; Location=235..717; Strand=+
  SCN-specific regions: Sequence locations=1-284,306-435
atggacaagggcaatctgtgggtggtgcccggcttcacattgctcgtctttgccattctgtggacaacaaaactgtgagtgaattatccccactttttactcattaatcccccccccctttcccattttccccttatttttttgtaatttttccatttcgtccaactctcttttccatccgttgtcgtccaaacttataatttgttattgtacaaattcaattgttcatttttcagttccaaaattgccctggaggagtccacttgccgcggggcatccatttatgactttgctggcacacagctggacgaagatgcgaagaggcattgccagaccgcgaaaaggtattacgttgggccggacgaggcgttttcgttggaccacaattggcgcaaacagcgggaggtcaaaaacccggaggtgggcacaaaatgcaataatattaatattattatttatttatttttatgtaaatattaatta

SEQ ID NO: 59786 - DNA, 896 bp, Heterodera glycines
  Genomic contig location: Contig_ID=SeqID_29258; Location=659..1554; Strand=+
  SCN-specific regions: Sequence locations=1-152,197-269,291-445,467 -584,608-672,713-764,786-839,861-896
tgatatcaaattgacaattgtaattgctgatgcggttagaaatgtcaatggaaaatcagtttggacattggttggtagcgatggttacgattttatcaacatcacaatgtggggcagcaattacgaaaaaatggcacgagaattcggacaagaatttaaagttaaatttataatttaattaaaaattatatttattgttaagcaaaaaacatatgtatttaatacttggggagtacaaaaagttattccgaatttcaattatggtaatgttgattatgaattaattgcaaaggaaggatcgacaattacactgatcactgcggaacaatatcaaattttatcgataaaaacaaccaattatttcacatttttgcgtgagaaatttgcactcgataatgatggtttttttccaacgccaatcaaaaaaattcgcgcaggcgaacagtttgtgtaagttaataaatagggattttagctaaaacaaaaaaataaaatttaagtgaaattgaatgcgaattattcgaattaaagcccgtgagaactgtaatggcaaaaggaaacgaagcacgtgtcattgatgcaatgattaatgaaggaaataacaaaactcaattaactgcttggaatattcttgcggattttcttgaatatattttacaagacaaaaaggtgtattaaaatatatatttttttaaatattttttaaaattaagggatatgttttaaaacttcaaggcttacttacgaagaaaggctttccggttcagaatatttcttttgtttttatcaacacttctcgaattggatttgctgaaaaacagcgaccacagaaaattccattgaaattggcagaattaactgaaggactttgtgaatgtaattttaaaaagttttga

SEQ ID NO: 59787 - DNA, 49 bp, Heterodera glycines; identical to SEQ ID NO: 51181
  Genomic contig location: Contig_ID=SeqID_29259; Location=537..585; Strand=-
  SCN-specific regions: Sequence locations=1-49

SEQ ID NO: 59788 - DNA, 583 bp, Heterodera glycines
  misc_feature (152)..(152): n is a, c, g, or t
  Genomic contig location: Contig_ID=SeqID_29261; Location=499..1081; Strand=+
  SCN-specific regions: Sequence locations=1-282,319-583
atgcagcaacccagagtataacgcacacctgattgtttatataccatcatggatttaaattaaatgcattcatttcttgcgatattggatatcttggatctccattctgttctctttcacaattttatgcatttttacatttttcgaatcanattttcaggttctctaccatccccagggtatgattgtcaacgggctgttcccttcatcaatttcgacaatcgaaagacgtttccaattttcaacttccactcttggccgtataatgcaagtgcgaaattgaatttttatgaatttttttgaaaaaaaaaattttttcttcagttttacgactttggttacgtgctgttctgcatcccggtctcatattttggtggtcgacattcaaagtcaacgggtctcggggcgggtttgcttctgatgtcggtcagtgctaaaaactcatgacaacaatttttgcattttctatagaatagaaaaatccaacaattttatttatacatgggacgggggcgtgaagactgaagggggggggggggggtagaaaaatttgcaatttttttttcttcaaatttttttaaca

SEQ ID NO: 59789 - DNA, 951 bp, Heterodera glycines
  Genomic contig location: Contig_ID=SeqID_5952; Location=613..1563; Strand=-
  SCN-specific regions: Sequence locations=1-9,55-108,139-261,283 -568,593-720,742-951
attcccttcacagcgacaacaacaacaacaacaaacaatcagcaacgacgacaattgcgcaacgcttcaacacagcacatccatcgcccgtgcacacgtcgaatccgatcacttctgctgctgctgctctccaacaacacaatgggcttcctcttgtacatgttcgtggctgcggttgcgttcggcggtggagcggtgggtttgagggtgggggaatttgttttgttgctgcattttttgagtcccaatcaaatttgtatccatttcaaaatttgttgttttaatcagctcgggattgagctttcaaaaaggatgaatacgagactcataaaagcacggaaaatgaatttggcttaccttcagcgtgttttttaattcatgtcagacggaatcaaattttagaaaccgaaaattgagtttagaagcctttcagagatgaatttggtttagttggcccgcttttgcctccgttcgtgttcgttttgtgtctaatttgtttcccatttccttttcagtactgtggcatgatttacaacgccaaaggggccaaggcatcggcgggcggcggctccaagaaggacaagaagcagaaagcgtgagccccagcggtgaacaatgatcgactcgaggatggcccccgtggatgaacgaacgaacgatggacttcgagcaacaaacgcttctccccttctaactgctgctgatccccacaatatgacgctgttcccctccccccaaattatatcatttgtaggtgctttatcaccctctgatctgttgtccgtgataagctatatgcgctgtccatatcagtgatcaaaccattgtaattgttgtaatgatatatgtatgtatgtcctatatattgtattgtatttgtatgtgctccaatgcaacaaccaatcattatgtgtacataaatatgttgtatgaatgtattcggacaataaa

SEQ ID NO: 59790 - DNA, 2072 bp, Heterodera glycines
  Genomic contig location: Contig_ID=SeqID_5952; Location=2563..4634; Strand=-
  SCN-specific regions: Sequence locations=1-170,214-274,302-378,400 -416,438-458,480-517,539-722,747-1068,1095-2072
atttattaaagttttccaattatgtcagaaattcataactaaaatattcttaactatgaatcttcatttagacattttataatcgattttcgttcaaatacgaaatcataagcaaagattgacttattttgacagcagcggcagaaatgcagcgataaaggcgaaaaaatgaaagagagagagacagaagagagggagggggatgagagagaggcgaaccatttgtccaattcacaagcagaaggaatgaaaaggaagaaaatagtatttcgtcggcaaagaaagaggagaagtgagagggaaagtgcactgtttgctccctcttctcttcctccattttcatcccatcattaatttctctctatttctttgttcgactaaaatgaaaattgttaaaaattgttaggctcagtgtttttggaaattttgtatttttaatcaacaaattttttttcttccttttctctttgtcccaaaaatatcattgtgagtaattctccgaaggtgtcaatttttggaaattgttaataaggaaaaacatttccaaaatctgctcgcattcaaactctaacaaatttgaaattttttggataattaattaaattaaagttgttcggttatgtgccacaaattatttaaatcccttagaaaatgcaaaatggccacaaattttatttctgatccgtaaaaacaacaatccatgccaattcagaaaatcgaaatcagcagcgcctgctggaggagcctcggcactgagcattcgcatcgctgaagtccgttggccaccggaggagaatgcgtcgtactacaacggaatcactatggcgccaggtaaaaaaaatggcgaaacacaagggatcgaagagctccagcagtgagaagagccaatgatgccgccgcagatgaggacggacgaacgatggaatggccgacaacagttcccctcccaaaccgatgctatccccaaaatatatgttgttacccccatcatttgtgttttatcactctgtaagcaaattttgcgctttccataccagcgatcatattgttctaattgtattgatgtgttatatatgtgtacacatgtatttatgtatggtccaatgtaactccgtttcatattgtatgtaaaatgtgaacaataaattgtagttttgatggtaattgtgacacttgtatgggtaatactatagatggtacccccccccccccccctttttgaagaaacatttttttttgttctgaaaagtcttggaaacatgtttatggggggttttcgaggtcgctgattacgaatatgcgatagtgagatccgaatcgaaaattttcaacgcagaaatgtatttttgagcttctttcttcgaaacaattgagcaaaaaaaattagttaaatcactaaaagtagcgaccctaataatttccattaaatttaattgttaaaacgaacatttgaaaggacgtggacgttgccgctgcaaatccaattactggctactcaaatttaatgtgaatttatatgatgtcatatattttgggatatcattttagctaatctgtttgacacaaacttccccaaaggtacactttccacttttacgccggcactcacacagtttctggcctcggggcaaaactcaagacggcctacacaaaaagtggttcttggggtcataatattttaaaaaacaatatttgcactaattgccaggtctgcccatttttctgagacggcacaattgcgaccagctccatgaacgaatggtggtcttttttggacggctacaaaatctcctactgtaactggtccgtctgtaacaagggcgagtcgtgttcggcattgaccaccagcgcatcggcgagcaatgtgaggaaaaatgaaatgtgaagccaaaaaacggaaaggaaatgatggccaccaatggccgagactgtattcgaccaattgcatttctcgaaatggaaacattccaaatttttgtaattttatttaggtcggttcctcttcctactggacaacctcaggaaaactgatccaagcttactacaaggagcaaagcaacggcaagtttttt

SEQ ID NO: 59791 - DNA, 343 bp, Heterodera glycines
  Genomic contig location: Contig_ID=SeqID_29262; Location=45..387; Strand=+
  SCN-specific regions: Sequence locations=1-343
tgtgggcgttccacaaaaaaagctcagtgtgggcgttccacaaaaagctcagtgtgggcgttccacaaaaagctcagtgtgggcgttccacaaaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaaagctcagtgtgggcgttccacaaaaaaagctcagtgtgggcgttccacaaaaagctcagtgattgataaa

SEQ ID NO: 59792 - DNA, 721 bp, Heterodera glycines
  Genomic contig location: Contig_ID=SeqID_29262; Location=564..1284; Strand=-
  SCN-specific regions: Sequence locations=1-424,463-513,536-627,649-721
atgcaactaaaaggtattgacttaagtttttgtaccttaagacgctacgtgtcaagactaactattgtttctgcgcatacaaataaaaatgatgcttcaaactcgaatgcttcaagccatgaaatgccaaaacatgaacttagatttgaaaagtgcttttcaaaaactttaagaaaaaatgtttttataattggaaatgaatctgcttggagaaaatatgttcaaacaaatgagaataatgaagacatatatatttcttgttcaaaatgtcgttattttcgcgaacaagaaaaaaatgttaatgtcaaatcgatcgtcgcatcagctgttctgcgacagggaatacaacttgttatgttgcagtcaaaccataatgctaactgtaagcccgaaaaattagagaaactggaaacagaacaggttgatagagaacaaagaagagaaaattataaatgtgagtcagaaggcaagattatttggcacaaaggtttgggaaaagcacgagaatccgacttaaataataaaattataaattctttacatgaaatgcaaagaaaattagcaccttatcaattgtcttcaattaatttgtgaatttttcctttttttagttttgtaataaaattataaattctttacatgaaatgcaaagaaaattagcaccttatcaattgtcttcaattaatttgtgaatttttcctttttttagttttgtaataaa

SEQ ID NO: 59793 - DNA, 1220 bp, Heterodera glycines
  Genomic contig location: Contig_ID=SeqID_29265; Location=57..1276; Strand=+
  SCN-specific regions: Sequence locations=1-332,354-443,467-656,693 -799,821-926,955-1078,1147-1160,1219-1220
atggcggggtgggacccaagactcatttggggggggggcgggggccgagaattggccggaaatggcacaaaaaatgttagggattcattgatggcccagtaatagtcacaggattttggctgggtgccaaaaaattttcgcccgctctatttttgaaaaaaaattctgtaccaaattttaaatgaaaattcaaaaaaaatttttttgttttttcccattaaaaatgttgagtattttgtggttttgggagattgattaccttttgaagacgcggaaattatcatttttcacaatttcccttttattgcttaattgatatttactataattgttaaaatggattcaattaatgttttgttttttttttgactgaatttttctcctatttttccattgaatttttttccaaatttcaattgttttttctatttcaccaagttaacatttttaattattataattttaacaagggttgaattactgtcctttttttacattggattttctctcattttcccggttctgaattttttccaattttaaaattttccaatttttcaggcactctctcctcacttcggcggacggggggcggccaaccacgtccacggcatggcaatgggccgaagaaacattacgccaaagagatggacaagtaaaatataattttttatttaaaaaaattattttttccaagatatttcataaatttatgcaataaaaattcaaattttctcccctttggccgacttttttttggcccaaatgccaaaaatgcaaaattttggcccatcttaactctcttaaaaagcaccaaaaatgccctcgggagatcatttactccctcccccaatttcctgctgcacccggggccaccaaatatttatttgctggccgcttcaatttcaccgcaaattttgtgccgtcagtggcggcggcggcggtggcggcaattttttcattgccccaggggaaatgacaaatttgaaattgttttttctgttttatcagattttgtggggggaattttttaaatttcgtcattttatgaataattttagggttgaaaaaaaatacttttaattaaattattaaattatttattatattaaattttaatttaaataatttatttttaattaaattttaaagcaaaaaggaaaataatttatttttaaaatattattttctattatttttgaaaaatcattattttaaga

SEQ ID NO: 59794 - DNA, 102 bp, Heterodera glycines
  Genomic contig location: Contig_ID=SeqID_29266; Location=606..707; Strand=+
  SCN-specific regions: Sequence locations=1-102
ggcgctcccggccttcggccgggagattttgtttttgcagacgaaactccttgtcaatataacatatatagtaatattgacaggatattcggctaaaaacgg

SEQ ID NO: 59795 - DNA, 606 bp, Heterodera glycines
  Genomic contig location: Contig_ID=SeqID_29267; Location=377..982; Strand=-
  SCN-specific regions: Sequence locations=1-606
atgacggacagtgccggcgacagtcggtcaacggaacgggacaaaacgatggtcaatggctgtaaagttagggataatgagccgtggctaagacaagccgtgaggtgactgcgaaattcaccgtttttgattaccaaaagcatttatacggtcccaggatttcgggttggggagggtaccctccacccgggcgacgacttttttttttgttgctgtttttacgaaaaaattttttggtgaacagggggttgaattttgtccaaaaaatgacaaattttgcgatttttagtcatttttagcagattttcttcaaaaaattgtagattttttgaaaaatttagcgaaattttttggaaaatttgggtgaggctaggtcagggggatacaagcaaggaaaacctaaaattttcagcaaaaatatgtaattccttaaaaatttcgagtgcggaagggccttgggggtgggggggtcttgccacaaaaagtgtgtttccattgctcgccccagacgatggactaattcgccatgtcaacgacgtccaacgcgatggggaacacaaagcgtgttttacgggggtggaccagatatacacctgccgatgctga

SEQ ID NO: 59796 - DNA, 388 bp, Heterodera glycines
  Genomic contig location: Contig_ID=SeqID_29268; Location=247..634; Strand=-
  SCN-specific regions: Sequence locations=1-20,42-275,297-388
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaa

SEQ ID NO: 59797 - DNA, 388 bp, Heterodera glycines; identical to SEQ ID NO: 59796
  Genomic contig location: Contig_ID=SeqID_29268; Location=779..1166; Strand=-
  SCN-specific regions: Sequence locations=1-20,42-275,297-388

SEQ ID NO: 59798 - DNA, 620 bp, Heterodera glycines
  Genomic contig location: Contig_ID=SeqID_29273; Location=314..933; Strand=-
  SCN-specific regions: Sequence locations=1-251,275-620
atgcctggcggtagcaaaaccaactacaaaattcatgtgcaaaccatcccatggaaggtcggtaaaattcacaaaaaaaaaaattgaaatttgatccctaatcgtgaaaacatgtttatggggcggttttctgggtcactaaactgatcacgaatctgacattttcgggttcgtattcgaaattgatcaaaatgaatttcagatttgtgacagcgacaacccgaaaccacccataacatattttcatgactttttgaacaaaaattcttcaaaaaaggtggctcaccatctagaatttgatttggaacggttttacacccaaaaacgtcaatgttgttgccaatgggcgctggcaaaaatgaaaaagttgtaaattcaaaaaaaaagtgccgtgacaatgcttcaaatgatattgtaaaacaattaaggaatatgaagcggatgcactgaaatcggacggtgaattggagcgcgaagaagtgagttcaaacggcaaaagtttgacaaaaaatattaaatcaaattttgcccaaaaaatctatctaccaaattctgaacccctgacccggtttcttacaaaaagtcgaaaattcaaaattttcgcattttggtctaataaa

SEQ ID NO: 59799 - DNA, 794 bp, Heterodera glycines
  Genomic contig location: Contig_ID=SeqID_29277; Location=703..1496; Strand=+
  SCN-specific regions: Sequence locations=1-168,190-472,494-520,542-794
tttccgcttttaagtacggtgacttgtgagacgcattcgccgttcactcccgacaattccgagcttgacggtctcgacacgaaattgccgaggcaataattccaagtgtggttttttgaccaattttcttttcaggggatggtaccgtattgggacagtaagcattcaattgattttcaatttaattttatgtgtttcctactgtagctgtcaatcagacacgacagggcgtggttcaacctgtacaggcaatttgaaattcattagaattaattgtgagttttgtcatcgctttaggcgacgggccactggactcggctattgggacttttacacacagtaacccacctccacatttacagtatgtaacaaaatactcaatttaggattccggagcggaattgcatcgggtgggtcggcttaactggtcctctgtacttttccgcatagtcaattcggtttgcacgcgggtgaaaacattgccggatctgtggcagtgaaagacaaacgatgttttggtaagggattcaaatgtattgcatctggcgatacgttttttgcctttggcactgcctaaacactgatcgctatttcagatcgcctcgtcgtgcaaattgagcgcaaatcgaccaccgaaaaggcaaccgaccgcagcagcaaaagggaccaaacaagaatgtttaccatttcagttcgatgttctccaatgccgaaagtgtgtgttcaactcgtgttggcttggctcgcgcactttgcacgaccaacgcacttatctgaccaacctccgatcgtat

SEQ ID NO: 59800 - DNA, 662 bp, Heterodera glycines
  Genomic contig location: Contig_ID=SeqID_29278; Location=170..831; Strand=+
  SCN-specific regions: Sequence locations=1-128,151-662
gactcaacccaccagcatttcaatcactggcactcaattctcctgcatttcaatcactgggactcaattctcctgcatttcaatcactgggactcaattctcctgcatttcaatcactgggactcaacccaccagcattccaatcactgggactcaacccaccagcatttcaatcactgggactaaacccgccagcatttcaatcactgggactcaattctcctgcatttcaatcactgggactcaacccaacagcatttcaatcactgggactcaacccaccagcatttcaatcactgggactcaacccaacagcatttcaatcactgggactcaattctcctgcatttcaatcactgggactcaacccaccagcatttcaatcactgggactcaattctcctgcatttcaatcactgggactcaacccaacagcatttcaatcactgggactcaacccaccagcatttcaatcactggcactcaattctcctgcatttcaatcactgggactcaattctcctgcatttcaatcactgggactcaattctcctgcatttcaatcactgggactcaacccaccagcatttcaatcactgggactcaacccaccagcatttcaatcactgggactcaattctcctgcatttcaatcactgtga

SEQ ID NO: 59801 - DNA, 295 bp, Heterodera glycines
  Genomic contig location: Contig_ID=SeqID_29280; Location=242..536; Strand=-
  SCN-specific regions: Sequence locations=1-295
atgtcctcaattaacaccagctcagacaatgcggtaaaacaacaaaaaataataatgaaaatattaaccaaatatttaagtgaataaaaaaatcccataaatttattataattaggtatttgaaaataaaaatttactttttcagctttatttggcctaccgttctgtgggtccatccgtcgatttgattgtgccggccgttgcgctgtatttggttgcgttggttggcattgtgttgaacggcacagttttggtggtcactgccaaatccaggcaaatgccatggcatttctga

SEQ ID NO: 59802 - DNA, 775 bp, Heterodera glycines
  Genomic contig location: Contig_ID=SeqID_5954; Location=1667..2441; Strand=+
  SCN-specific regions: Sequence locations=1-51,75-128,151-207,258 -300,322-460,508-509,552-775
atgcttgagcaacaatatccagatcaatcttggaatccgggtggtccaggaatgaaaactgaatttattcttttcagtttctatggcgaaaaattgacctttttgattgaaaatctgtaaagagtgagtttaatttattttaatttttttgtctgcggcgcagattgaaagaattcaattatattgaaattgttcaagaataattggttaattattaaattatttactataattaaactaaaatgataattttttttcattccgttggccgcaattgtcctgaccgcaaatgtcttaacaattttttatgttattttcaaaattcgacaaattaaaaaaacgcccagaatcgttttccggttcgacaaaaatttaaattctcggatgtatttaaactccaaaattggttaaaaaaattcgtataaagtgttaaatttggcttttgttcactttagagcagaaattttttataaaaaatttcaaaaattaaatttttgaaaaatttttcagctttttgtaaattctttgctttttaaaaccaatttaaaaaatccaggtcaagcctggattcaggccttgaggagcctgggtttttctggacctggattttcggtccaggtctaacatggaacccagtccaggtccatgcttttttcaaaataccaatctctactaataattctttatctgctctttggtttattatacaactttttgttataatttctttcattccataacgcgtccaattggcgaaaataatattaatttaaaa

SEQ ID NO: 59803 - DNA, 2426 bp, Heterodera glycines
  Genomic contig location: Contig_ID=SeqID_5955; Location=341..2766; Strand=+
  SCN-specific regions: Sequence locations=1-333,376-378,425-500,552 -657,682-780,843-873,898-909,931-1172,1194-1320,1344-1568,1705 -1719,1775-1966,1990-2102,2125-2426
atgccaattcgtttcctctccatgctctgccctcttctcgtgctgctcaccaatgttccttcaacgctgccatggatgttggaacgggatggtgtccttttagcttacgacccaaacaattacaatgcggaaacatgggctgactggggcaagaaagttggcgcgagtgcggtcgcaggaggagtcgctggatccgctgttcctggcattggaacggtggccggcgccatccttggctttttcggaggagccgccgttgctgctggcgaattcgcaattaataaagtgtattgtcaggtaaaagaacgtacctttcgacctttcgcatgttaatttgttttatgctgaagtaatgaaatgaattcagtttttaaagttcaaaaatgtgaccaaactttaggaatttggcatttttaattttgtggcaattttttttttaatttcgactttttgttttttcgttgctttgaaaaatgtcaaaatggctttaacctcttttgtaaaatttaaaaagtatatacaaaaactttaaattatttaaaacaaattatgaatgttgtcaacttataatttaaaatgatttttcatagaaaaattctcgttggtcttcggtaacacttaattttagtgaacgtttaagggccatttccgtccttaacgaaaatttttaaaaattttcaatgcattttttagagatttaaatttttaacaaataacaaaaaatttccaaacttacaaaaacaagaaaatgcttgaaaatattccgctgagaatacaaacttattaataaattaactttttttattttgatgattaattttggattaaatttaaattttattctgtatgtaaggtagatccaagctcaatatcttttattatttataaattaaatttcttatttgtaactgatttgttttattggtttgtaaagactgcgtgtggctcgcagtacgttgtttgcacccaatcgaaaggggcaagcatggcatgctgcgacagcaactttgcacgcaaatgtgttaatgattttaatgaggttaatgaataagatttgtatacatttacaagaaaagctaaaaagctatttaaaatttggttaatttgcatgcgaatatttgaatcacttttatttttgacattttttaatattgataatggtaatttatatcctttattaataaaatttaaacataggtcgaggcaatgtttcccaccacaacgacgacaacaacgactccaacgccggctccaattcacccaacggtcgtagactaaagaaataacatatcattttaatagggtttagatttaggttatattttataacaataccttgctatgttttgtgcatgttttaacatgaaattttgaaaatcttgcgttaatcatgggacggttcagtttcaaattaagcctctgctgatgattagcatttttgccaaaaaaaacacgccgggaaggggggggggactcactcgataagaacgcatatgttatgacaaatcaacagataaatcacaaaatatattctaaattgaaaatgccgtgatgcaagggcaaatccgaatttatttattatttaaaaaatgaatctaatcattattatataaattgaagcaagtataaaaaatattaattaatttataatttattaaataaattataacttttaagcaaaaattaaaatatatttaaaatattctcttcacctgaaaattttaaaatctaatttttggcaaaatttaaaatatcctaaaaatttccaagaaaattttgcagcgacattcaaaaaaccatacacaaaaaatttatttaattttcagcaatttaaaaatctaactgattgtcatacatatatgagttagatttcctctaagaaacctttaaacatatttatttttagcatatggcaaattggcaagagacagcggtcaaggaagcagcaaatttcaccgtaaccctcaaaattaaaaataattttatttaccttaattccttcattttttaaagttaatatttttagaagttttcctcattaaagtgtaaacgaggacgcaaaacgacaaaagattataatattgggggaaatggttgcccctatgagtcattatactgctatttcatgttctgttatgacggtaatgaaaattattaatttaggaaagtgaatgatttaatattactcctcttcgaaatttagtgcgatttgagaagggacattttgctgaatggggctgccacccagcagatgaacgtgtagatcattccaaaaattatcctcaaggcgattgggcatgcgaacagtcctatcgactacacccggattatgataagcagaccctcggctacgacatgtccaacgaacaagatacttttgaggaagcatatgaagatttgcgcaagaagtacagcaagaaaactgg

SEQ ID NO: 59804 - DNA, 517 bp, Heterodera glycines
  Genomic contig location: Contig_ID=SeqID_29284; Location=27..543; Strand=+
  SCN-specific regions: Sequence locations=1-244,293-517
atgaaagtaaacacttatattagcaccaggtttttagtttaattgcataaaatacttcttaattggtgctaaaaaataaattaattggtcatattagttttattttgtaatattttggttaacaaaggaaatgaaaaatagttacaaaagaagttgcttctacttttttttagcgtaatgttgcgctcgttaacagcatacaacacactgccattgttcttcattctaattttactcaaacggcaatttttttaaatttaatttttattttaaacatttaaaaaaattttttcaggattataacaatatcaccagtgataaatataaacaaatttgggaattggttgatgatccaattgtgatttggcatgatggggatgagcatttcaacagcatttgtttggtaaaaagatcaaaatgccaaatgcaaccaaaaaacacttatttttgaatttatttaatctttttctttcttacttgaatatgataaatttttaattatgaaatatagccttaa

SEQ ID NO: 59805 - DNA, 507 bp, Heterodera glycines
  Genomic contig location: Contig_ID=SeqID_29285; Location=265..771; Strand=-
  SCN-specific regions: Sequence locations=1-279,322-462,492-507
atgaaatcgtggttccttgtcctggtgttgctgctcgccttttgcctggttgttcgcctcgtgatttgtttggtcaaatgcaataactgctgctgctgtaagtgacggacggcgacggaaaaagaaaggaacggacggacggaggagaaaaatgagcaaaacgaagttaaaatgccatacgattttgtgtgaattttgttgtgatttgtacataccatatatgttattaatgtatatttgtaaatactgaataacaaatattctctgtccaactatggcattattattttttttagaaatttatgcttttttaaaaaataaggattcgaatggagagccgttgaaaacttttttttctgataacggttacttttaatgatcgcttaaaactagagaccggacaagaaggtcggtttcggttaaaaaaccgaaaaaaccgaagaaaaatttacggtttttcggtttttttttttgattttatttatttttttccaaaaaagcaataaa

SEQ ID NO: 59806 - DNA, 333 bp, Heterodera glycines
  Genomic contig location: Contig_ID=SeqID_29285; Location=1039..1371; Strand=-
  SCN-specific regions: Sequence locations=1-333
atgccgtcctctccgatgcctttttcgctgttcgtcgtccttttcctattcgtcccatttttgcccggatgttcgtctttttatttggcgcctccttcttctccttgtgtctcctccgatgtcgccaaaatctgtgagattcccacacaaattcatctaccaaattctgcattttcttttgctttttcaggcggtgaaccatccgttgcgcattatttcgagtgctgtggcgacaatggcgcaggtcggcacacgaaattggcacatgacaaatgttttgtggcacttttcggcttctttgtgccgttgaacatgaatatggcatttatttag

SEQ ID NO: 59807 - DNA, 262 bp, Heterodera glycines
  Genomic contig location: Contig_ID=SeqID_29286; Location=899..1160; Strand=-
  SCN-specific regions: Sequence locations=1-262
cctgaccaactctgtgcttgtgctcaaatgggcccctcaacttgaaatcctcgcccatcccaatgttcgtgcctttgtcacccacgggggcaacaaaaggtgccgaatttcttcgacagtaatttactcaaattattgtattaattgtcgtttaattagcgttcgcgagggaatctgtgccggcgttccgctcattgtgatgccggtctatgcggaacaagtcaaaaaagggtgccatttgcacaagcgaacacaaatttag

SEQ ID NO: 59808 - DNA, 558 bp, Heterodera glycines
  misc_feature (18)..(18): n is a, c, g, or t
  Genomic contig location: Contig_ID=SeqID_29286; Location=1362..1919; Strand=-
  SCN-specific regions: Sequence locations=1-396,419-558
tttcagcccttcactttnttgatgccaaacattgccaaattcggagtgccgaatttcagcttcaccgaattttattcgcgtagccaattgttcttgcacgacagcatcgacaggctcgggttgccggtgacaagtgaggaggaggaaaattgaaatgaatgataattattagaggataatcaattagcaaaattaatttaaatcataaaagaacaataatttgattaattttcaaagcattaattacgcttatgctttttgtacaaatacaaaattaaattgtattcgttggttcagctgctgctgacattttcggagtcggcgcccattgcaaaacgccaaaagattcttccgccctttccgccaaaatcaaacagtttttggaggacccgagctcaaaagatattaaaaataatatccaattaattcatttatgctttatttttaagcacaatttatatcgccttcggttctcacatcgattggaaatttgcgccacggaaatttttggacgattttgtcaccgtttttcgaaaactgccccaatatcgtttcatt

SEQ ID NO: 59809 - DNA, 739 bp, Heterodera glycines
  Genomic contig location: Contig_ID=SeqID_29287; Location=153..891; Strand=+
  SCN-specific regions: Sequence locations=1-413,435-635,658-739
atgtccatttcaattttagtgtctgcaagagcattgggtgagcaacaaaaccatagaaaatgaacctgacgggggggggggggggaggttattggggaaaatcataaaatgcagtgatcaagatgcgaattttttttttacgaaattgagaaaaaaaattttaccaacagattcgtcaattaagaaatttcattgcctttttaggcctctttctccaccggcggaagcagcaaaagaagcgagtcaaagcagcgaaaagggcgtctaattatgtggaaatgaatttttggcatttggaaaatgtgagaattgaccgatcatttttgagttaggtattatgctaaattgtgttgattatatatataattctgtattgcgttttttgcgtccgaatgttttttttgttaaaaaaattatttgcttatcaatttatagaaattgcttatgaaaaggggacggattcgtacttaaatggcaagcacgtatttggaaaagcggtcctaatgtgggaaaatgtgaaatccgtaccctcacacctgcttaccctaaaagcatgaaaaagtgagccgtaaaaaatgcacatgcagcgaaatgaggaaaatgatcagcggaaacaaaaaattagaaaaaaaatctattccagtgaaaaatacgggaacaggacaaaatttcgtcgttgaacatcttggcgtcactgttaatgaatttggtacttgtacagtttggaacacatttaata

SEQ ID NO: 59810 - DNA, 759 bp, Heterodera glycines
  Genomic contig location: Contig_ID=SeqID_29288; Location=301..1059; Strand=-
  SCN-specific regions: Sequence locations=1-215,237-759
atgtctatctcttcttatgagaaattttatgtgttacaaaagcgctcgagcgtgagacggaggttagttggcattcgagcatttaagttctcagagaattttttaatgctatcttatatccgagaaaaatgaatatctcttatcatgagaaattttatacgttgccaaatcactggagagtgagagcaagggcggtgtgcaatccccatctaatttcacagagtatttttaaatttatgtaatatccaagatcaactactatctaccagtttgagtcatttcatgagttacttgaattctaaatcattatataaaatcatagatacttgtcaaatctatgattaaaagtcatcagatgttaaaataaatatcatattcgtgatcagcgaagttggaaaccccaaattacgaattttggaatttttttgagggggggcgacataacccgaagtaccaaatattcttctgttgcaatgattaaattaaattttgtttttagtgtaaatttcgcaatttcctgaaatcggattagctgtaagaattttggaaattattttttttattaaactctcaattgtcaagaatgtgtgcgtgacaaagtaatacaaatcaggttggtccgtaaaaaatctttaaaaaatgcttatgtgtgttttcagagtcgctggtcacaatcagacatttacagggacgtatccaggatttgggcttggggggggtaccgatccgaaaagtcaattattaggggtgtatttttga

SEQ ID NO: 59811 - DNA, 96 bp, Heterodera glycines
  Genomic contig location: Contig_ID=SeqID_5956; Location=3259..3354; Strand=-
  SCN-specific regions: Sequence locations=1-96
cactatgggtcaagcccagtgttagacaaaattactcataacgccaaatagcgtatttggcgtaaatttttgcgcgttaattcaaaatttacactg

SEQ ID NO: 59812 - DNA, 898 bp, Heterodera glycines
  Genomic contig location: Contig_ID=SeqID_29298; Location=123..1020; Strand=+
  SCN-specific regions: Sequence locations=1-518,540-645,669-768,811 -864,886-898
gaatacatttgttcggatgaaaccgaatacaactttgtcaaaaatgcttggattgaaattaatcaaaacgatccggcactgagccaattgttagaggcattatttgctacggtcatttcggcaaataaagctttggaatacggtaaaaaataattcgcaggccgaaatttcggaaattttcagacgatgctaacaaaatatctgcgcagcttaatgaactcaaacagagtttggcatatgccgtgtttttcatggcaaagcgtggccaaattccactggaaagcccacgagaggagaaggaaagggagccaaaagaaattttaattggcctaattgacatttataatgagtgtcaattggacgctgataaggtgctaaaaagttgtggagaatgtgggaaaaaaggaaaagaagaaaaatggcaaaaaggaaaagaaaaatatggcaaaaaagaacgacgctttcttgaatttgttgcgcattcattggaaatgaaatgggacgcaaatgcattttcagcaggtggtcagcagcagcaggacgacgatgatggtaattattagggagtccaattatatgcacatgcatatttttttcctggactgtgggaggcctgaaacgcacgaaaaacatgtttttagcttgatttgaagcttctaagatgactttccatatgcatattttgcatatttgtgcatatttcgcgatttatgtgcatatttccatatttgtccatattttggcatttaactccatattttatgtccatattttggcatttttccaaaaaacctctaatagaacggcccccaaaagacaaattggactttttgacctcaaaaaccggaaaattttccaaaaaaataattttttgcaaaattttcacgaaaaatattga

SEQ ID NO: 59813 - DNA, 877 bp, Heterodera glycines
  Genomic contig location: Contig_ID=SeqID_29299; Location=360..1236; Strand=+
  SCN-specific regions: Sequence locations=1-478,509-511,674-718,865-877
  Gene Ontology: Mol. function=protein binding; Cellular component =axoneme; Biological process=N-linked glycosylation
atggcaaacttttcgccaacacttcgccaaaatgaattccatgccaatgccacccgcaaattcgcattacatttgtctgctccactcaatgcatgtttatctgtgccctcgagaagcagagcgagaaaagttaatggccaactttttgattcggacgagcaaaaatgggcggatggacggagaaaagcgaaggacagcggaacattggcactgacaaaggcaattcggcacaatttggagagggcaaatcccccgccggttggagcaacgcctcctttatctgcactatccgttttggcacattctccggtatcggcatcgcctcccaaggaatattcaccacagaaggaattttgcgcgaggcggccattgtttcccaagtcaaaatttttgagaaaagctcagaagctgaggaaagaatggaattgggtggcaaacggaagcggaagagaaacgacgccaacgcggacaaaggcaaaggaagaggaggaggaggagaaggaagaggggaaacggaagaacaggaaaaacaaagcaatgatggaagaggaagaggaggaggaagagaggaaacggaagaacaggaaaaacaaagcaatgatggaagaggaagaggagaaagaaagaaaaaatgataatacaaaggggggcagcagggaagagcagaagaggatcattcatctgctgatagtgaatggagcagcagcagaaaaagtaaaggaggaagagagggacgacgagagcgagcgggacgaagaagaggaagaagaagaggatgaggaggaagatgaggaagaagaagaggatgaggaggaagacgatgaggaagaggaagaagaggagcagggggaggggacggaagagagtgacggcacaa

SEQ ID NO: 59814 - DNA, 105 bp, Heterodera glycines
  Genomic contig location: Contig_ID=SeqID_29301; Location=196..300; Strand=+
  SCN-specific regions: Sequence locations=1-105
gatgccgccgaattgctgtacgatgtgctgtttgagtcgggcaatgccgtcccggttctgatcgcatgcaacaaacaggacattggacacgccaagtcgcactct

SEQ ID NO: 59815 - DNA, 760 bp, Heterodera glycines
  Genomic contig location: Contig_ID=SeqID_29302; Location=352..1111; Strand=+
  SCN-specific regions: Sequence locations=1-337,359-603,625-670,692-760
atgcgaaaagcgaaatgcgaaacgccaaaaaatgcgaataatgcgaaaggcgaaatgcgaaaagcgaaacctcggcccatccctggtgtgggcggaggccggaggctatttgctgataaggaaatagtcagcaatgaagtgggaaaccgggaaaccatttgctccccatttcccgcaatatggctcttaactatgactccccgaaacaaggagcaaagcggcacgcatcggcagatgctggacagttacttctgcgaatttttatggcgtcattccgtcaaacgaagagatgtcgatgcattcgaataccatttgcaaaacatcgttgcttatatgccaccaaattaatatgatttcttgcgatgataataatttgtaggagaaaaaaagaaaaaaaaattgaattttgataattgttcgaatccgggttcggagttcgaaatgggtcgaaacggacatcatattcgggttctacgaccccgaaaacccatagaaacgacttttattaatttaaaatcaatttaacaaagaaaaaaattttgttgacacaaaacgcacaagtaccaaaattagcaatggacaaaaaattttgaaaattttattaaactatgaaattttgaagcttctttaaattcacgaaaaccaaaaatataatttttgacaattttcgagttttttctttccaaaatttgtgtttagaagtgtatttcttggaaatttaagaaacaaatccatttaactaagctctattatgaaaaaa

SEQ ID NO: 59816 - DNA, 799 bp, Heterodera glycines
  Genomic contig location: Contig_ID=SeqID_29304; Location=258..1056; Strand=-
  SCN-specific regions: Sequence locations=1-59,121-619,641-799
  Gene Ontology: Mol. function=RNA binding; Cellular component=nucleus; Biological process=regulation of protein activity, epigenetic
tacaattcggtgcagggacagtacggtggccagggaacgaacggtggatcatcgacggcacaacactactcacaacaacaaccgcaacagtactacagctacaacagcaacacaaacaacggatacggtggcggaacggggtaaaaaagggggagggaaggcatttgtggcaaataaatgagatgagactgttttcagtggctatcagcagcagcaatcgccccaatacgcccaagggaattattattattccaacggaaactatccgcagtcacagtattccgggagctacccccaatcgtcacagtactcctcctcttctgcacagtcgtcgccttacgcgtacggtcagcaaacggtcgttgtgccttcgtcttcacagggagcgggcggtcagtacggcacgccccaacagcagccgattccgattgtgcaaagcggaggacaaacgcagcagcagcagcagctaactcagtttagtggaaatggcggacaacagcaacaattacaaggaacacaatatggtggaacagcaggaacatcccacgggacgcagcagtacaacggaggacaaggacagaacggacagggacaaggacagcaggggtactactcacagtcaacggcacaacgccaacaaggccaacacattgcatcggcagcgggacaaaatggccaagggcaaggaggacagcaacagtacacgacgagacaagtctcgggggacagtgtactttctgctactaatgtgaattctccttcctttgcaaggcgtacttcacaacgccgactccgctga

SEQ ID NO: 59817 - DNA, 1738 bp, Heterodera glycines
  misc_feature (1729)..(1729): n is a, c, g, or t
  Genomic contig location: Contig_ID=SeqID_29306; Location=2..1739; Strand=-
  SCN-specific regions: Sequence locations=1-167,193-405,427-561,583 -608,631-754,778-833,855-1343,1366-1437,1464-1552,1578-1738
atgggtgaagaagagtatgaaaaattaaaaaaatggtattatatgaattacaataatggatttattttaggtaagagaaaaaatatttaagttaactatttaatattttagaagaaaaattggatgaatattgttcaaatgatacggacattttaatgaaagcgcttataaaattgagaaagatttttattgatataacaatagataatgaaacaccgaatgggatcgatgtaatgagactatcgacaactattgcgtcatcatgcatgaagtagggaccaaaataaaaggaaaataactcaatttttagcatttttcgtgccaaatttttaaaaaatagtgaaacaatacccatcattcccgagagcggatttgagcctaaagatagtcagagcaacatagcgataaaatattttgaatggataatgcatagggatggagttaaagcgagacatgccgcaaacgggggagaaattatgctttttggagataaaaaattaaaaatcgattgcataattggggcgcaaagagaataattgaatttcaggtaataatggaaatgaaataaaatattaaaaagatttttagggatgcgcttttcatggatgtaaaaaatgttataagggatttatgattcaagcgaatggactaacagcggaacaaaattatgatagaactcaacaaaaaatggagagattaagaattgcggggaaaaagatgggatatactgtagaggaagtttgggtaaatgccaaaagtttattcaaaacataattgtgttttaggaatgtgatgtgagaaaaaagttaaatcgaaagagtgaaatttatgatgaaaacatggcaaaattttttaataatttaccggaaattggacctattatcccaagaaatggttttgcgggtggccgtactggtagatttattcgttttttctgaattaatgattaatttttaggcccattatgtctatttgctgaggcttctgaaaatatggaaatttcgatttatgatattgttagtctttacccttgggtgaactattccaccccctatcccgttggcaacccaaaaatagtcattcctaaacaatatatagtaaaatggtaatttcggtaaaaaatacaaaattcaatgcatttttaggacttcacctgatgacattccttatgagggtcttttgaaagtacgagtgatccctccaaaaaatcaattccttcctgttttaccttttcatactgtaggaaaagacagtttttttaattttatagattttttaggatgatttattattatttactaattgttcttcgtgtgccaagaagaccaaaacagattttgtttattcaaaaaataccaaaaagtgtagacatagtgctgaacagcgggcacttactggtgaattttgtactttagaattgaaaaaaggtgatagatgtattttaaaaaaataaaaaattatttcagctttggaattgggggctgttattgatagattttaccgcagttatcattacgaaaattttgatggaaatttatttaagaattatgtcagaaaatttttaaaattgaaagttgaagcttccgggtggcctcaggatgtccaaaatgaagaagaaaaattggaatttgtgaaaacttaccgagaaatatatcaaattgaattggaagcaacaaaaatgaattttaatcctggattaagacatattgccaaattagcatttaactcngtatggtaa

SEQ ID NO: 59818 - DNA, 1017 bp, Heterodera glycines
  Genomic contig location: Contig_ID=SeqID_29308; Location=347..1363; Strand=+
  SCN-specific regions: Sequence locations=1-1017
atgggacgacgcctcgagggcaaaacggcactaatcactggcggcgcgcggggcattggccgtgcctttgccgaaggtttcgtaaaggagggggcgaaggtggcattggccgacattatcgttgacgtggcaacaaaagcggccggagaaatcggcgccggcacaatcgccgtcgaattggacgttaccaatcagaaatccatcgacggatgcgtccacaaagtgttggcgcagttcgggcacatcgacattttggtgaactgtgccgcggttttcgacatggcgccagtcggcgagatcagcagagaaagttacgacagagtgttcgctgcaaatgtttcgggcactttgtttatgacccaggcaaaccaccaattagcatggctaattagcctaattaaacaggcagttgcacgtcatatgatcgagcggggaaagggcggcaaagtgattaatatggccagtcaggcgggacgtcagggcgacgcattggtcaccgtttattgcgcatccaaagcggcggtgatcagtctgacccaatcgaccgggctggcactaatcaaacacagtataaacgtaaacggaatagccccgggctatgtggacacggaaatgtggcgacaagtggacaaattgtttgccaaatacgaaaagatcgaagtgggcgaaaagacacgccaaacggcgaatttgctgcccatcggaagaatgggcgtggccgaagatttggtgggtgccgcggtgtttttggcatcggaagagtccgattatgttgtgggacagactttaatgtgacgggggcagccgactgaactgagaaggaaagtgccaaacggagagaaaaagccaatcaaacggaaaaaatgccaacaaacgaatgaatgaaatgatcgaccagcataatgtatcaatgattatgccataacaaatgaaaagccgacgaatgattaattatgaagatcaaattaattgtccgattattacgcactttgtccaaaaatcagcccaaaatatgaa

SEQ ID NO: 59819 - DNA, 303 bp, Heterodera glycines
  Genomic contig location: Contig_ID=SeqID_29308; Location=1562..1864; Strand=+
  SCN-specific regions: Sequence locations=1-75,208-241,278-303
atgaattcgaattacgaaaaggacggacaaaaaaaggaggaaaatcaaatgggaaaagtgccaaacgaacgaccgaaagaaaacggaggaaaagacgaagagaaggtgagaaaaggaaagtaattagaagaagtgaaaaggtaattaaagaaaaaggaagaagcggaagaggaggacgaaaagcaaaagggaggagagaatggaaaaaggcaactgaaagaaagcggcgaagaattccgacttttggtggacgaagaagaaaaggagaaggaggaagaaagcacaaattgcgcacacaagtaa

SEQ ID NO: 59820 - DNA, 611 bp, Heterodera glycines
  Genomic contig location: Contig_ID=SeqID_29310; Location=1..611; Strand=+
  SCN-specific regions: Sequence locations=1-328,350-397,471-589
  Gene Ontology: Mol. function=protein serine/threonine kinase activity; Cellular component=nucleus; Biological process=signal transduction
ctgctccgcgcgctgttcaaacgcaacccagcaaatccgttgggcggcggtgcgcagggggccgccgcgctccgtgaccaccgcttcttcgcctccgtcaactggcagcggttggcccagcgccaggtgggtggtggcggcgttggatttttttaaaatttcaaataaaaaaagggatttttttgctatttacaaattgcaattaattggtaattccccattttttcaaggttacgcctccgtttcggcccgcttttggcacttctattggcgtcggttgtgatgccattggagcggacgcttcgtcttctgcggcattagcattggatgttgcccattattttgacaccgaattcactaagcgaacgccaaaggcgagcattggcttcttttttattctttctctatttctcttgctctctctatgtcaccctccatctttatctctcatctctctctccctctccctcctttatccccacattttatacctccattttaattcccttcctccaggactcgcccgccgtgccgccgtccgcagccgcccacgagctgttccgcggcttcagcttcgtgtcgcccagcattctggaggaggacgaggagga

SEQ ID NO: 59821 - DNA, 84 bp, Heterodera glycines
  Genomic contig location: Contig_ID=SeqID_29312; Location=471..554; Strand=-
  SCN-specific regions: Sequence locations=1-84
atgacatggacgattgagtacctgggaaatgacgcagcagagggcgcccccacaaagtgtccaagccacgaaatgtccaaaaga

SEQ ID NO: 59822 - DNA, 861 bp, Heterodera glycines
  Genomic contig location: Contig_ID=SeqID_29316; Location=467..1327; Strand=-
  SCN-specific regions: Sequence locations=1-270,293-454,476-861
atggcaccaccgatggagacaccgaccaccagcaaaagtgagtgaaactaaaatcccctttttatattttcaaataattttctcttttttaattttagcaaccccaacaggacgaccaaagatgaatgtcgatcatttgcagcgcacctcacgtcgcaaattggccgatgaaatcgcggctgtaataaaacgggacagatcacgctcagccagccgggcgtccctcgaacggatcagtcgggaagttcggcacaaatttgctcattacacgccacagaagaagaaacaacaactgtcaagacaaaaaaagtcagttgatccagaggatgctcttctgatcctcgggcttgtcggtacacagaaggcttacagacgactaaaaagcactattcgcctgatcaatgccaaatttgatgtgttcccgccactcgaaaaagtaaaaacaaattttagcatttatatttatttaaaaattcaattgaatattgttaggtgcttgacatcaaacgccgcatctgtgggtcattgcaatacgcaccaattgagactagtgcaggtgttggatttgtgtgcactgatgttgaggcagctctggaggcgcgtctttcatctgccaaggacaatctgatcagatttggcgacgaaatctacataaagctgagcggcgaccatggccagagttgtacgaagattaccgtctcattcagccaggctgctcggtcaaattctccatcaaacaatttcgtctgtgccgttttccctaccaaggatagccgcgaaaacttggagcgctatggaagcacactttgggaacaaattgacggaataggcacattggcgggcaaccgagtcaagtggtaa

SEQ ID NO: 59823 - DNA, 1982 bp, Heterodera glycines
  Genomic contig location: Contig_ID=SeqID_29317; Location=1..1982; Strand=-
  SCN-specific regions: Sequence locations=1-238,260-277,320-658,680 -760,792-970,998-1058,1089-1112,1134-1278,1307-1419,1441-1446,1468 -1748,1770-1982
ttttttgcttaagagtggccagtctgatcggacagccccaaattgagaacgttttggcatttacgtcgagggtaattttgtttaaaaacaattttttttccaatatttgtgtttttcctcgacgtttttaggcacggagcggcgcctgtacgcaaccgacgccaaacccgctcagtgtgctcgagttcatccacaacggagtgcacgcctgggttggaggggacatggtgaatggactttttcaagaaaattatgggctattttgtgaaattcttacttttattttaacaaattcaaataaattttcaaaaataaaattccggcaccgtcgaaaatccccgtttagtaatctttttaaaaaaatccaaaatgacaaaaaaattcgtctttttcagtgaaaaacggccggctaaatgatttttttactttttccgccggtgccgaaattttcgaacaaaacactggagaaaaagaaaagttttagcagcaaaaaaaaatgtcttcggattccccgtttcgaaattttttggcggggcatgcgacataagggaacaggacaaaacgtcgccggacaaaacgaaaaaaccaagaaaaaattgtcaaaaaatttagttctagcctacctaatacgaagaaaattctagaaaaactcaaaaagaaatttttattaagaaaattcattttttccggaaaatcagctaaatttagttttattaacaattagattttcaaaaaatctaaaatacttttcaatttcttgaaattttgaaaatttattattattattttttgcggcgacgtttcggccgacgacgttttggcgtgtacccgcgacataaacccataaaaacgcaatttactttttcgaattccatcgggaatttttttatcaaattttctgggttgcgaaaacaataagctcaccccctgggttattggcattccatcacaaataatgtgcaaattgtaaaagtgtatttttgttttgtttcagttgccgttgaccacctcgccacaggaccccgttttcttccttcaccattccttcattgattacgtaaggaaacaaacaaacaaaatacagaaaaaaccttgttcattccatcttttagggggtggcattttctttgaaaataataaatagagcgtaattaatcccatggatttttaaaatgtccaaaaaaaaaactttttagggataccctgagaaaatggccaaaaaatgtccgtgaggtgtggggtttcaactcttggctttttcattcgtttttatgggcctttaatttattatattttattattttttgcgacagatttgggaacagtggcgactgctccaccaaaatcggcagcagcgcgagacgcaatttccgcccgactcgcaaattgtgccggtcagtcattgccaacaaaatgattaattaattgcattaattttgatcattttgtgtttgcagtgcgctggctcccagaattacctgctcagtgcgacaatgttcccttttcaagaccccgtcgtgctcaaccgaggcatgtccaataattgtattcaatttatcacaattttgtgtttaattctttttatgccttttatcggaagcagctcgcccccccccccccccaccgtcgtttcaaattttttcatagaaaattcgaagaaaaaaaaatttcaaaatttttccagcgattttttcaaaggggtgcaccgttttctaaatgttgttacaaacaagattattatttttttgcaaatatttctcattttgcccatttcgtcagtctgtcagtcacttaatttgcttttttgtcccctgttccagctgggttgagcaactcctacacggacagtctgtacacttacgcgccgaggcccacctgccgtgccgcaggcgactgtcgttcgcggtaggaaacattcattccggttgaactttacatttgcagcacccctcccctccaatattcaaaaatgtaatttttta

SEQ ID NO: 59824 - DNA, 324 bp, Heterodera glycines
  Genomic contig location: Contig_ID=SeqID_29320; Location=1170..1493; Strand=-
  SCN-specific regions: Sequence locations=1-324
atgccgcaggcgctgcattcgctcgacgaggtaagtgcagcctgagggaaggcaaaacgggggaaagcggtaaaatgcaaaagaaaaaacaattttgaattggaataataatgtgaaataagtaatcaatccattggaaggaagggatatacaaaaaaagggattaaaaccgggcatttattaaagcaatttttaagttgcttacagcagcgctttatctggtcaatggctgcctgtcgaatgcgaacctgaaagacggagttcgtgtttatggcatttgattttaggaaaaaacttatttttaaccacccattgttaaataaa

SEQ ID NO: 59825 - DNA, 160 bp, Heterodera glycines
  Genomic contig location: Contig_ID=SeqID_722; Location=847..1006; Strand=+
  SCN-specific regions: Sequence locations=1-160
atggccaattacaacgcaaaaggcgtcgacctttcgatggtggccagcggaagtgggacaaagcgacaaaaggagggggaggacgaactgttgatagacttgggaggagcagcggatggcatcgggacgaagggaattgcggacaaaatggcacaaatcg

SEQ ID NO: 59826 - DNA, 1012 bp, Heterodera glycines
  Genomic contig location: Contig_ID=SeqID_723; Location=1134..2145; Strand=-
  SCN-specific regions: Sequence locations=1-18,40-379,401-761,784 -860,882-1012
  Gene Ontology: Mol. function=cytoskeletal protein binding; Cellular component=cell-cell adherens junction; Biological process=signal transduction
atggcctttttgggcggcaaaatgttggtgcaaaagtgcgctagcgggtcacttcgggaggcgaaaatcaaagtgagacggacacaaaggcattggccaaagcgttgttcactattttcaggtggacttcgaccgaagtgcccatttgagcatccgcaaaatcactcagcgccgcctgcgacgcatttgcatcgaatacgaacgcgacaaaacggagcagcgagcgcaggcggaggagcggcgactggaggaaatgatcagcgaggagagggcgcgcagagagcacgaggaacgcgaaagagtgatgcgacgccttttgcgagcggagcgacggcagcgattggtgcggagagaaacgccaaacccacgactacaaaactaaattttaaattaaaaaaatgagtagtaaccccaaaggaacgaatgggccggaaaattgtttaaatcttgacgaattttgttaatttttgaaatttgtcaattcttttggtcctttcctttgaattttaattaacaaattgcagcgagaacagcgcaacttcgagcagattctgcgcagaaaactcaagcggaaattggaccatcggttggagtcgtcgtggagagagcgccgacggcaggcgaaggcactgctgcgatacattgccgaactgtacagggtgagcggactgaacagtggccgacagaccaacattttggttgacccttatgattggagaattcacagaagcctcctttgccttaattgttttgttggcatttttcttttatttaaaagttttaaggcgcagcaacaacacgcggtcgagtccaaacagtcaatccatgaattggcatcggaatacgcgcgcgaccgtggactgcccgaggaggaggagctgagacaacgcattttgcaaaagcgggagcagaaaatgcggacacgggttggatcgaacgaatatgattaattagcaataattgccttagtgaatgctttaaacgagagaggattttaaatggaagtattaaa

SEQ ID NO: 59827 - DNA, 851 bp, Heterodera glycines
  Genomic contig location: Contig_ID=SeqID_724; Location=1178..2028; Strand=-
  SCN-specific regions: Sequence locations=1-110,132-197,220-344,367 -448,470-500,522-851
  Gene Ontology: Biological process=signal transduction
atgaaaaaagtgagtgggacgaacagaaaacgggcacgaaggaaaagccgaaaaaacacaatttaatgaacaacaacgcgtagccagggggctgacattaggggcctctaatttaccatatttttgaaaatggcaaaacgtagctttttgggcggtgaaaacggtacaaatccctgcaaaatccatttaattcgggatatctgaaaaaataaaatacacccgacacccctaaaaatcgaatttttgaattcaccccccccccccgaagccaagagttttctgactacgcccttgtaaacatttggaaagtcagaattcgtctttaagttgtactctttcaatttcatgcataaaattggagcagtacaaaaatgggaagaccaatgccaaatagcaaaacaatttgctaaaaatagtttaagattgggacttaattggtcacaagtattaaaatagtgctgttaattatgcaccatggcttttttcgcctttgctcgttcattttgacccaatttccttccctttgcaggtcatttcgctgctgaatggcccttctttccgtgccattggtttcgccgaccctttgacagtcaaagcggacgaggccaaattggactttcccacccgcgtggattgggaccaattcttcacttcagccgccggcaaatgcccaatggacgaaagggagccgggagaaaggccggacaccgtctacgtggggggactgccgttcgactggttccaagtcggtgcgaatggcaaataaaagtttcaattcaaaaaacttttgtactttatttgggttcaaaaaacccaaaagaaacttataaattttatgggaatacaataaa

SEQ ID NO: 59828 - DNA, 93 bp, Heterodera glycines
  Genomic contig location: Contig_ID=SeqID_725; Location=6319..6411; Strand=-
  SCN-specific regions: Sequence locations=1-93
gaggggagaaatgtcgcacaaccgaagaaaagttgacattataagtaatcggaggatcgagaaaacgcgtgctttcatattcctttttcttaa
